United States Patent 8,952,217 (PROCESS FOR DECREASING VERBASCOSE IN A PLANT BY EXPRESSION OF A CHLOROPLAST-TARGETED FIMD PROTEIN) - sequence listing, part 7

SEQ ID NO: 22501 - DNA, 4734 bp, Ashbya gossypii
  CDS (1)..(4734): n means a or g or c or t/u, s means g or c
atggcttcggtagggctcgaaaaagtgaacattctcggaagggacagcatccatgtcgggtacgacctgcgggcacacattgcgcggacggtattcgagtcgtgtgtgtcgtcgacatacgtcgtggtgagcgacgcgaacgtggcgcgcgtgccataccacgaggcgctctgcgctgcgctggaggaggggctgcccgcgaggtcgcgcatgctgcggtacgtggtgcagcccggcgagacgtacaagacgcgggagacgaagggtgagatcgaggacttcatgctggcggagggctgcacgcgggacaccgtggtgctggcggtgggcggcggcgtgatcggcgacatggtggggttcgtggcggcgacgttcatgcgcggcgtgcggttcgtgcaggtgcccacgtcgctgctggcaatggtgcgctcgtccatggtcggcaagaccacggtgtacacgcgtacggtcaagatcttcattggctccttctggcagcccgagtttgtattcgtggacgtcaagtggctcaagaccttgccgcgccgcgagttcattaacggcatgtcggaggtgatcaagacagcgtgcatttggaatgccgcggagttcatgcgcctggagatgcacgctagcatgtttttgcaggtcgtgaacagcagcaagcaggtgaaggtggataccaagggcgggccgacctcgctctcctacacgaatataacacaaatcctggaccacgtcttccagctagtattggagtcgatcaaggtaaaggcgcacgttgtctcgtccgatgagcgcgaatcggggttacggaatcttctgaactttggtcatagcattggccatgcatacgaagcactcttgacgccgcaggcgctgcatggcgaatgcgtctctatcggcatggtaaaagaggcggagctgtctcgctacttgaacatcctctctcccacgcaagtggcgcggcttacaaaggttctgtccgcatacggcctgccaacatccgtgaacgaaggatggttccgcgagttgactttagggaaaaggacaccgctagaagttctgcttcgcaaaatgagtatcgacaagaagaatgacggaagcaacaaaaaagtggtactcttggagacaatagggaaatgctacggcacctcggctcatgtggtgagcgacacggatttacgttttgtgctgaccgatgaggcgctagtttacccattcaccgaggtacgttcgagcactggtcatactattgtgccgccggcatacaagnctatcgccaatcggcccttgatccttgcggcgttaggcaagggtaaatgcagaatcagaaatttactgcactctgatgataccaagcacatgctcgaggctgtgcagcagttaaacgcagccacaatatcgtgggaggataacggtgatactgttgtcatagatggccacggcggaagaaccctaactgcgtccgatttgcctttatatctgggtaatgcaggcactgcttctaggtttttggcatcagtggcatcgctggtctgccctgagggcaatagggactccgttatcttgacaggcaatgcgagaatgcaagagagaccaattgggcccttggtggaatccctacgtctcaatggcgtccgtgtggactatctaaaccgcgaaggctccttaccaataaaagtgcacgcggaatcgaagttccgtggcggtaggatcaacttggaggctagtatttcctcacagtatgtctcttctatcctgatgtgtgcaccatatgcagaagaaccggttacgttgtcgttggatggaaaacctatctccgagctatacattgagatgacaattagaatgatggaaaagtttggtatcaaggtggaaaaatctaatgatgagttatacacttatcatattccaagaggacagtatgttaacccagctgaatatgtcattgaatccgacgcttcatcagctacataccccttggcgtttgctgctctcactggaactacagtaactatacctaatatcggccatgattccttacagggtgactcccgatttgcatgtgacgtcttgaaaccgatgggatgtactgtacagcagactgccacatccacgacggttacgggtccggagcctggaactttaaaaccacttgagcatgttgacatggaacctatgactgatgcatttttaaccgcatgtgttgtggctgctgcagcacatagtcctgaatctaagtgtaaaaatatcatcaccatcaccggcattgcgaatcagcgagtaaaggaatgtaacagaatactggcaatggtcactcagttaagtaagtttggtgtgactgccgaagagctaccagatggtatacaggttcatggcgtagagcagttaagccaactgaaagtaccggatgctgttgagacttacgatgatcatcgtgtcgctatgagcttttcgctattggcgggaatggtaaattacggccaggcaccttcttcttgtagacctattaaaatactggagagaagatgtaccggtaagacatggccgggatggtgggatgttttacacagtagactgggcgcaactctagatgggaatgaaccattgcctgagaaagagaacgatataaggaaaagcgtcgtgctcataggaatgcgcgccgcagggaagtctactgtcggcaggtggtgcgctgaagcattaggctataaattactggacctagatgacgagtttcagacatactttggaatggggacagtaaaagaatttgttgcgcagaatgggtgggagagcttcagaagtaaagaaaccgacctctttggtcatgttctaaacaagtatagcaggagcgggtatgttatatctaccggaggaggaatagtcgaaactgcatcttctagaaagctactacaggatttcgcagccacaggtggggttgtgctacatctataccgtgatattgacgagacgataaaattcctgcgcactgatcctactaggccggcttatattgaggaggtgagaggggtatgggatagaagagagaagtggtaccatttatgctcaagttatagttttttctcacctcattgttcaacaacggcggagtttgagggtttaagaagggtgttctcgaaatttattaggaggataaccggtatgctagaagtggaagtacctgtaaagcgttccacgtttgtttgtttaacattccaaaacttgctgcccgaaatggaaagaatcaaagaggctgtttatggctgcgaggctgtcgaagttagagttgaccacctcgagaactactcccaagactttgtcttaaaacaattaacagccttgcgacttgccaccgattctctacccatcgttttcactattcggacaaagaaacaggggggcaagttcctggataacgactattcgacgttggaagacctgctaaccgtcggcctaaaggctggcgtagaattccttgacttagagttgacgctgccttctccaatccaccaaagaatactgaataaacgctataagacacgtattatcggttctcatcatgacttctctggtgaattttcgtgggagcatccagaatgggaacatagatatgcgcaagcgttagccatgcaagttgacgccattaagtttgtggcaacagcaaagggatttggtgataacctgtctctagaggaattcaggtcaaaacatacagacaaaccactgattgcgatcaacatgagagagtgtggaaagctctccagagtattgaatacaattttgactcctattacatcggatgtcttgcctcaagcggcggctccggggcaactgacgcttcgtcaaattaatgaactttacgcttccattggcggactccggccaaagaaaatgtttgttgttggatcgccaatcggccattcaaggtcacctatccttcacaacactggctacaactcattaggattgccctacacttttgacaagtttgaaaccgactcggctgagatcgtcaagaagtccttgctatccagagaggacttaggagggatagctgttacaattcctctgaagcaagatattatgcaatacctggacgagcttactgactcagcgaaatgcataggtgctgtgaatacaatcataccgaagaaggatgggaggtttatcggccacaacacagattggctaggtataaaaaattccctgatagcgaatggggtcccggaacatgttaacactgctggcttgatagtcggctctgggggcaccgccagggcagctgcgtatgccttccatgaaatgcaatgctcgacaatctatatgattaaccgcaccacgtcgaacttgactgagctgcagaagagtttcccacaggagttcaacattcatgttattgagtccctcgagcaaatagagcaactttctgaacctgttggcatcgccgtcagctgtgttccctcagataagccgctagatgacgcactgtcccagaaactttctgcgttcctgtccaggccatccgccacaaacttcatccctacaatcttggacgcagcgtataaacctttggttacgcccgttttaaagttggctagtgaggtacatggctggcgacccgtgtccggggcacagatgctggtgcatcagggggttgctcagtttgagatatggacaggtttcaaggcgccgtttgcaccggtgtacgacgccgtgacacaggagtaa

SEQ ID NO: 22502 - protein, 1577 aa, Ashbya gossypii
  Xaa in position 426 is unknown
MASVGLEKVNILGRDSIHVGYDLRAHIARTVFESCVSSTYVVVSDANVARVPYHEALCAALEEGLPARSRMLRYVVQPGETYKTRETKGEIEDFMLAEGCTRDTVVLAVGGGVIGDMVGFVAATFMRGVRFVQVPTSLLAMVRSSMVGKTTVYTRTVKIFIGSFWQPEFVFVDVKWLKTLPRREFINGMSEVIKTACIWNAAEFMRLEMHASMFLQVVNSSKQVKVDTKGGPTSLSYTNITQILDHVFQLVLESIKVKAHVVSSDERESGLRNLLNFGHSIGHAYEALLTPQALHGECVSIGMVKEAELSRYLNILSPTQVARLTKVLSAYGLPTSVNEGWFRELTLGKRTPLEVLLRKMSIDKKNDGSNKKVVLLETIGKCYGTSAHVVSDTDLRFVLTDEALVYPFTEVRSSTGHTIVPPAYKXIANRPLILAALGKGKCRIRNLLHSDDTKHMLEAVQQLNAATISWEDNGDTVVIDGHGGRTLTASDLPLYLGNAGTASRFLASVASLVCPEGNRDSVILTGNARMQERPIGPLVESLRLNGVRVDYLNREGSLPIKVHAESKFRGGRINLEASISSQYVSSILMCAPYAEEPVTLSLDGKPISELYIEMTIRMMEKFGIKVEKSNDELYTYHIPRGQYVNPAEYVIESDASSATYPLAFAALTGTTVTIPNIGHDSLQGDSRFACDVLKPMGCTVQQTATSTTVTGPEPGTLKPLEHVDMEPMTDAFLTACVVAAAAHSPESKCKNIITITGIANQRVKECNRILAMVTQLSKFGVTAEELPDGIQVHGVEQLSQLKVPDAVETYDDHRVAMSFSLLAGMVNYGQAPSSCRPIKILERRCTGKTWPGWWDVLHSRLGATLDGNEPLPEKENDIRKSVVLIGMRAAGKSTVGRWCAEALGYKLLDLDDEFQTYFGMGTVKEFVAQNGWESFRSKETDLFGHVLNKYSRSGYVISTGGGIVETASSRKLLQDFAATGGVVLHLYRDIDETIKFLRTDPTRPAYIEEVRGVWDRREKWYHLCSSYSFFSPHCSTTAEFEGLRRVFSKFIRRITGMLEVEVPVKRSTFVCLTFQNLLPEMERIKEAVYGCEAVEVRVDHLENYSQDFVLKQLTALRLATDSLPIVFTIRTKKQGGKFLDNDYSTLEDLLTVGLKAGVEFLDLELTLPSPIHQRILNKRYKTRIIGSHHDFSGEFSWEHPEWEHRYAQALAMQVDAIKFVATAKGFGDNLSLEEFRSKHTDKPLIAINMRECGKLSRVLNTILTPITSDVLPQAAAPGQLTLRQINELYASIGGLRPKKMFVVGSPIGHSRSPILHNTGYNSLGLPYTFDKFETDSAEIVKKSLLSREDLGGIAVTIPLKQDIMQYLDELTDSAKCIGAVNTIIPKKDGRFIGHNTDWLGIKNSLIANGVPEHVNTAGLIVGSGGTARAAAYAFHEMQCSTIYMINRTTSNLTELQKSFPQEFNIHVIESLEQIEQLSEPVGIAVSCVPSDKPLDDALSQKLSAFLSRPSATNFIPTILDAAYKPLVTPVLKLASEVHGWRPVSGAQMLVHQGVAQFEIWTGFKAPFAPVYDAVTQE

SEQ ID NO: 22503 - DNA, 792 bp, Wolinella succinogenes
  CDS (1)..(792)
atgcgccaatacgctgtctttggcgatcctatcgcccactccaaatccccccttctgcacaatcgggtctttttggagcttggagttcccgccttttatgggcgctaccacctcaaagaaccaagctctctcctagagcgttttcatgctttgggcttggagggggccaatattaccgttccttttaaagaggtggcttttgagcagtgcgatgaggtgaggggaatcgcccaaaaaattggctcggtcaatactatggtgaaagagggagagcgggtcattggctacaacaccgatgctgaaggatttttccaaaccctagagggcaagctccgcccccagaatgttctcatccttggggcgggtggcacagccaaggcgctggctatgatttttgatctccatcaaatccctgtgacgattctcaatcgcacccctgggcgcctcaaacctttggccgagcagggctttaaaactctcacccacgaggagttcgctcccgattcttatgatctcatcatcaactccaccagcgctggattgagcgatgattctctcccccttcccgccccttggctagaatcactcctccattcaggcgtgctcgcctatgatgtgatttatggcaaaaccaccccctttttacgccttgccaaagcccaaggagctcgatttcaagatggtagagagatgctcatttcccaagccgctctcagctccctgcacttcactcagcaccacttttccctctccactctccactctctcatgcgtctcgctctccctcaataa

SEQ ID NO: 22504 - protein, 263 aa, Wolinella succinogenes
MRQYAVFGDPIAHSKSPLLHNRVFLELGVPAFYGRYHLKEPSSLLERFHALGLEGANITVPFKEVAFEQCDEVRGIAQKIGSVNTMVKEGERVIGYNTDAEGFFQTLEGKLRPQNVLILGAGGTAKALAMIFDLHQIPVTILNRTPGRLKPLAEQGFKTLTHEEFAPDSYDLIINSTSAGLSDDSLPLPAPWLESLLHSGVLAYDVIYGKTTPFLRLAKAQGARFQDGREMLISQAALSSLHFTQHHFSLSTLHSLMRLALPQ

SEQ ID NO: 22505 - DNA, 834 bp, Vibrio vulnificus
  CDS (1)..(834)
atgactcaacaaatcgatcgttatgccgtgtttggtaaccctatcgaacacagtaaatcgccatttattcacaccttgtttgctcgccaaaccaaccagcctttaatctacaccgcagaaaccgcgccaaaagaggggtttgttgaggcagtgaaagcgttttttgctgaagggggaaaagggtgcaatgtgactttaccttttaaggaagaggcgtatcagtttgcgagtcgtttaacggagcgagcccaattggctggcgcagtgaatacactaaaaaaactggatgatggcgatatcattggtgacaacactgatggcgctggccttgtgcaagacttgttgcagcaccaagttgtgttagcaggtgcacgtattctagtgataggcgctggtggtgccgctcgtggcgtgcttaaaccactactcgaccagaaaccaacctctctcaccattacgaatcgtactttctctaaagctgaagaactggctgtgttgtttgctgcctatggatctgttaccgcaaaagagatgaatacagtgacggaagagtacgatgttattatcaactctacgtctgcctcattgagtggtgagttacctgccctctcttcatctatatttgccgccaacagtactagctatgacatgatgtatggcaagggcgataccaccttcaatcaatgggctaagcaacacggcgctgctcatgcctatgacgggttgggtatgttggttgggcaagctgccgaaagtttcatgctatggagagggttgcgtcccgggtctaaacaaatcttgcgcgagttaagaaaaaatcttgaagggctataa

SEQ ID NO: 22506 - protein, 277 aa, Vibrio vulnificus
MTQQIDRYAVFGNPIEHSKSPFIHTLFARQTNQPLIYTAETAPKEGFVEAVKAFFAEGGKGCNVTLPFKEEAYQFASRLTERAQLAGAVNTLKKLDDGDIIGDNTDGAGLVQDLLQHQVVLAGARILVIGAGGAARGVLKPLLDQKPTSLTITNRTFSKAEELAVLFAAYGSVTAKEMNTVTEEYDVIINSTSASLSGELPALSSSIFAANSTSYDMMYGKGDTTFNQWAKQHGAAHAYDGLGMLVGQAAESFMLWRGLRPGSKQILRELRKNLEGL

SEQ ID NO: 22507 - DNA, 750 bp, Porphyromonas gingivalis
  CDS (1)..(750)
atgaaaaagtacggtctgatcggctatccactggctcattcgctgtctgccgaattcttcaacgccaaattcaagacggagggaatcaatgccgtctacgaacttttccctctggagtcgctctcccaactgaagagtctgctttcgctccatccctctcttcaggggttcaacgtgacatcgccgtacaaagtggaggtgatgcgctatctggatcggatagacgaggaagcggaattgaccggagccgtcaatacgattcgggtagaacgtgcgcgctttcgtcgtccccatctcgtcggttataataccgatgtgaaaggctttgccgatagcctggagctgatccgaaagccgtggcatacgcaagctctcgtcttgggatcgggtggggcagctctggctgtgatgcgcgctctgaagaagatgggaatagtacatcggcaggtcagtcgcacgccttcggctcccggtgtgtatgcatattcggatctgacgccggagattatcgaacggcacaagctgatcgtcaatgccactccggtgggtatgtatccacatatagaccaatgtccgtctattccgttcgagggtataggtgcagagcatctctgttatgatctgatctataatccgcaggaaacgatcttcatgcatcgcgctcaagcacagggtgcttctgtgcagaacggattggagatgctgctcatacaggcgttgtgcagttggcgtatctggaacgaacgatag

SEQ ID NO: 22508 - protein, 249 aa, Porphyromonas gingivalis
MKKYGLIGYPLAHSLSAEFFNAKFKTEGINAVYELFPLESLSQLKSLLSLHPSLQGFNVTSPYKVEVMRYLDRIDEEAELTGAVNTIRVERARFRRPHLVGYNTDVKGFADSLELIRKPWHTQALVLGSGGAALAVMRALKKMGIVHRQVSRTPSAPGVYAYSDLTPEIIERHKLIVNATPVGMYPHIDQCPSIPFEGIGAEHLCYDLIYNPQETIFMHRAQAQGASVQNGLEMLLIQALCSWRIWNER

SEQ ID NO: 22509 - DNA, 819 bp, Photorhabdus luminescens
  CDS (1)..(819)
atggatcaatttgctgtctttggtaatcctgttgcgcatagtaaatctccgcgtatccatcagttatttgctagacagacaggtattgagcatcgttatgggaaaattctggtgccgataagtaaatttcaagaggcattggatacatttcttaaacagggaggtataggagtcaatattactgtgccatttaaagagcaggcatttattcgagcaaatgagttgactgaacgggcaagactcagcggtgcagttaatactttgaaattacttaataataatcaattgcttggtgataacacggatggtatagggttattaacagacttgatgcgacttgagtttattactcaagggcagcatattttaatcattggagctggtggagctgccagaggtgttttatttccattattagaatttggttgtaaaattacaattacaaaccgcacgtttagtcgcgctatacaggttgctaataatttttcggcaataggcagtattcggcctgctgagatgaaagtacttaatagtcctgagtttgatctcattatcaatgcgactgcatctggtattaatggtgagattcctactatatctccattcatatttaatgagaattgtgtctgttatgatatgttttaccaggctaatttgacgccctttatttcctttgctaggaagcatggtgtttctcgttatgcggatgggctggggatgttagtggggcaagctgctcattcatttaaattatggcatggtgtattgcctgaaatttcacctgtgttactaacattggaacaggagttacgttcgtga

SEQ ID NO: 22510 - protein, 272 aa, Photorhabdus luminescens
MDQFAVFGNPVAHSKSPRIHQLFARQTGIEHRYGKILVPISKFQEALDTFLKQGGIGVNITVPFKEQAFIRANELTERARLSGAVNTLKLLNNNQLLGDNTDGIGLLTDLMRLEFITQGQHILIIGAGGAARGVLFPLLEFGCKITITNRTFSRAIQVANNFSAIGSIRPAEMKVLNSPEFDLIINATASGINGEIPTISPFIFNENCVCYDMFYQANLTPFISFARKHGVSRYADGLGMLVGQAAHSFKLWHGVLPEISPVLLTLEQELRS

SEQ ID NO: 22511 - DNA, 858 bp, Gloeobacter violaceus
  CDS (1)..(858)
atgtccgactctccagctattcgcggcactacccggctgttgggcctgttggggtatccggtcggccattcgctgtccccggtgatgcacaacgccgccctcgcccgcctcggccttgatctggtctacgtgcccctgccggtggcccccgccgatttgccccaggcggtggcgggtttgcggcgcgcaggcttcgtgggcttcaacgtcaccattccccacaagcaggcgatcgtacctttgctcgacacactcacccccgaggccaagggcgccggtgcggtcaacaccgtgcgcgtcgagaccgacggaagcctcaccggcaccaacaccgatatcgaaggcttcatgggtccgatcgaaacggtgccgtttcaaggagcggccactatcctcggctgcggcggctccgccctcgcagtcgccctaggctgtgcccaactgggattcacgcgcatccacgttgtcggccgcgaccctgccaaactggctgctttcaaatcgcacctgcaccccgccgccaccgtcgaaattgatctttgggagcagctggaatcgctgctgcctgggacggggttactcatcaacaccacgcccgtcggcatgatcccggccacagaagcgagtccgctcgaagatttgggggctctgccgctaaaagcctgcgtctatgacctgatttaccggccgcgcccaacccggctgttgcagctggcggtggcgcgttcgctccaaaccttcgacggtctgggcatgctcgtagggcaggctgaagcggccttctatttctggacaggctgtaagccacccacgcagttgatgctgcagaccgcctgcaaagcgctggcgcacgattag

SEQ ID NO: 22512 - protein, 285 aa, Gloeobacter violaceus
MSDSPAIRGTTRLLGLLGYPVGHSLSPVMHNAALARLGLDLVYVPLPVAPADLPQAVAGLRRAGFVGFNVTIPHKQAIVPLLDTLTPEAKGAGAVNTVRVETDGSLTGTNTDIEGFMGPIETVPFQGAATILGCGGSALAVALGCAQLGFTRIHVVGRDPAKLAAFKSHLHPAATVEIDLWEQLESLLPGTGLLINTTPVGMIPATEASPLEDLGALPLKACVYDLIYRPRPTRLLQLAVARSLQTFDGLGMLVGQAEAAFYFWTGCKPPTQLMLQTACKALAHD

SEQ ID NO: 22513 - DNA, 822 bp, Chromobacterium violaceum
  CDS (1)..(822)
atgaccgaccgttacgccgtaatcggcaacccgatctcccacagccagtctccgttcatacacgaggagttcgcccgcgccaccgggcaggacatcagctacgagcgcctgttcgccgacatcggccgcttcaacgacgtggtgggcgagttcgtcgccagcggcggcaagggcttgaacatcacgctgccgttcaagggcgacgctttccgctacgcgtccgagctgaccgagcgcgcgcgcgcggccgaggcggtcaacacgctgactttccgcgacggcaaggtatacggcgacaacaccgacggcgtcggcctggtgcgcgacatcgtggaaaacctcgactacccgatcgttggacgacgcgtgctgatcctgggtgccggcggcgcggtgcgcggcgtgctggagcccatcctggagcagaagccggccagcctgaccatcgccaaccgcaccgtgatcaaggccgaggcgctggcccatcatttcgcccgctacggcaaagtggaggccgtcggctacgccgcgctggaaggccgcagcttcgacatcgtcatcaacgccacctccaccagcctgaacaacgagatgccgccgctgccgcacggcgtgttcacgccgcgcacgctggcctacgacatggtgtacagcaccggcctgacgccgttcctgcagcgcgcccaaggcgaaaacgccggcatgctggccgacgggctgggcatgctggtggagcaggcggcggaatcgttctccatctggcgcggcgcgcagccggaaacgcgcaaggtgaccaatatgctgagggaagtgctggcctga

SEQ ID NO: 22514 - protein, 273 aa, Chromobacterium violaceum
MTDRYAVIGNPISHSQSPFIHEEFARATGQDISYERLFADIGRFNDVVGEFVASGGKGLNITLPFKGDAFRYASELTERARAAEAVNTLTFRDGKVYGDNTDGVGLVRDIVENLDYPIVGRRVLILGAGGAVRGVLEPILEQKPASLTIANRTVIKAEALAHHFARYGKVEAVGYAALEGRSFDIVINATSTSLNNEMPPLPHGVFTPRTLAYDMVYSTGLTPFLQRAQGENAGMLADGLGMLVEQAAESFSIWRGAQPETRKVTNMLREVLA

SEQ ID NO: 22515 - DNA, 870 bp, Synechococcus sp
  CDS (1)..(870)
atgatcaacggcagcactggtttggtggggctgctcggcaacccggtgcagcactcgctctctcctgcgatgcagaacgcggcactgcaggcgctgggactgaactggcgttacctggcactgccctgtgaggagaacgctctccctcaagtgatggaggggctcagggcggtgggctgccatggcctgaatgtgaccatcccccacaaacaggcggtgaccagcctctgcagccaactcagcacagctgcccgtcggcttcaggcggtcaacacgctgatccccgatggtgagaatggctggtgcggcaccaacacagatgtggaggggtttttggcacccctcggcggcagcgaacgctggagagatcaacgggccgtggtgctcggctgcggcggttccgcccgagctgtggtggctggtttacagacccttggcttggcatcgattcaggtgatcggacgacgtccgaaggcgctgttgaacttcattgctgacctgcagctggaggacgcccctctgagcagctgcctcgaaacagatcccgccgcggctgatcttctggccacagctgatctggtggtgaacacaacgccggtgggcatggccctgcacggcgacgcctccgccatgcccctgggctctgatctctgggacaggcttgcgaagcaggccaccctttatgacctgatttacaccccacgtcccaccgcctggctgcgttggggtcaggggcgggggcaccgttgcatcgatgggctggaaatgctggtccagcagggcgccgcatctctgagactttggagcggcttcaatgacgttcccgtggacaccatgcgccacgcggctgaaaccgctttaagccattag

SEQ ID NO: 22516 - protein, 289 aa, Synechococcus sp
MINGSTGLVGLLGNPVQHSLSPAMQNAALQALGLNWRYLALPCEENALPQVMEGLRAVGCHGLNVTIPHKQAVTSLCSQLSTAARRLQAVNTLIPDGENGWCGTNTDVEGFLAPLGGSERWRDQRAVVLGCGGSARAVVAGLQTLGLASIQVIGRRPKALLNFIADLQLEDAPLSSCLETDPAAADLLATADLVVNTTPVGMALHGDASAMPLGSDLWDRLAKQATLYDLIYTPRPTAWLRWGQGRGHRCIDGLEMLVQQGAASLRLWSGFNDVPVDTMRHAAETALSH

SEQ ID NO: 22517 - DNA, 1491 bp, Rhodopirellula baltica
  CDS (1)..(1491)
atgatttgtgtcagtctcggccgcgcccgccacaaacgcatgatcgccgagcaccagtttttggtcgaacaaggtgctcagctcgtagaactgcgtctcgattacatttctcgcgccgtcgacctgaaacgattactcaatgaccgtccgggtcccgtggtcgccacggttcgcaggaaagaagacggcggtcggtgggaaagatccgaacaagatcgcttgatgctcctgcggagtgttatcgctgcgggtgccgagtacgtcgacatcgaagccgacgtcgcggcacagattccgcgttacggcaacaccaaacgaatcatcagctaccacgacttcagtggcactccggagaatttggacgaactgcacgaggccatggcggcggaagacgcagacatcgtcaaaatcgcttgcatggcgaattcattctcggacaacatccgaatgatcaacctctgcaagaacgcgaaaattccgacgatcgggatctgcatgggcgagatcggcatgctaacgcgaatcctggccaaccgtgtcggatcgccgttcacctacgcaacgttcagctctgacaaaaagcttgcacctggccagctcaactggaaagagatgaacagcgtttatcattacgagaccatcaaggaagacaccgctttattcggcgtgatcgcggatccggtcgctcatagccacagcccgttgatccacaacgctgctttcgtcgacgcgggactgaacgcacgataccttccgctgcgtgtgccgaaagatgacctgccatccttcatgcggacttgcaaggaactggggattcaaggaatcagtatcacgattccccacaaggagtcggcacttcaatactgcacacaggcggaatccagttgcaccggtatcggcgcgatcaacacgatgatcttcaacggcgatgatcgcctcggctacaacaccgactatcgcgccgcaatggattgcatcgaagaatctttcaagatcgaacggggaaccgagaattcgctgcaaggaaaaacagctctggtcctcggtgccggcggcgtctcacgtgccatcgcgtggggactacgtcaacgcaaatgcgacgtcaccatcagttcgcgaacacgtgaacgagccgagatgttggctgctgacatcggttgtcgtgtgatcgactgggaagaacggcacgaggcaaaggtccagcttttgatcaatggaacgcccattgggatgcaccccgacgtcgacaacactcccttcaatcagtcggccctcaaccagttcatggttgtattcgacacagtctacaaccctgaaaacactcttctgatcaaacaagcgacgcagaaacaatctcgtgtgatcacgggagtcgacatgtttgttcgacaagccgcgtaccagttcaagctattcaccgggcaagaggcgtcgatcgagttgatgcgaaagaaaatcaaagaggcaaccaacccagttcgtttgaactaa

SEQ ID NO: 22518 - protein, 496 aa, Rhodopirellula baltica
MICVSLGRARHKRMIAEHQFLVEQGAQLVELRLDYISRAVDLKRLLNDRPGPVVATVRRKEDGGRWERSEQDRLMLLRSVIAAGAEYVDIEADVAAQIPRYGNTKRIISYHDFSGTPENLDELHEAMAAEDADIVKIACMANSFSDNIRMINLCKNAKIPTIGICMGEIGMLTRILANRVGSPFTYATFSSDKKLAPGQLNWKEMNSVYHYETIKEDTALFGVIADPVAHSHSPLIHNAAFVDAGLNARYLPLRVPKDDLPSFMRTCKELGIQGISITIPHKESALQYCTQAESSCTGIGAINTMIFNGDDRLGYNTDYRAAMDCIEESFKIERGTENSLQGKTALVLGAGGVSRAIAWGLRQRKCDVTISSRTRERAEMLAADIGCRVIDWEERHEAKVQLLINGTPIGMHPDVDNTPFNQSALNQFMVVFDTVYNPENTLLIKQATQKQSRVITGVDMFVRQAAYQFKLFTGQEASIELMRKKIKEATNPVRLN

SEQ ID NO: 22519 - DNA, 858 bp, Prochlorococcus marinus subsp
  CDS (1)..(858)
atgattacaagtaaaacatcatttcttgctttgattggaaacccagtaagtcattctttgtctccaattatgcaaaatgcagctattcaatatttaggccttgatttaatttatatggctataccttgtaaaaatgaagacttagaaatagttgttaattctataaaaaaaatgaattgtaaaggtttgaacattacaattccttttaagcaaaaagtatttgatatgtgtagtgaaatatctccagttgcaaagaaagtgaaagctattaataccctgaaattaaacgataataaaaattggattggaacaaatactgatattgatggatttatctatcctttaaaaaatcttaatttaataaaaaagagttcattaattttaggttctggaggagcagctagatcagtaatccaaggtctaatagaattaaaattatcaaaaattacaatcatttcacgaaaaagaaattctttaaatgaattaattaccaattttaaaaatgatatcgaaataaaaggtttgcttagtactaataacgaaattaaaaatttaattcaagaaactgatttaataatcaatacaactccagtaggaatgagcaataccactaatactgatgaattaccatttggtcaaggtttttgggattccataaattccaagacgattgtttatgacctgatttacaatccttctcccactccgttcttaaaattttgcgataaaaaaggatgcatgactatagatggtactcaaatgctaattgctcaaggagcaaaatcattatcattctggacaaacggattagaagtaccttatgaggttatgcatgatgcattaaaagaatatctttaa

SEQ ID NO: 22520 - protein, 285 aa, Prochlorococcus marinus subsp
MITSKTSFLALIGNPVSHSLSPIMQNAAIQYLGLDLIYMAIPCKNEDLEIVVNSIKKMNCKGLNITIPFKQKVFDMCSEISPVAKKVKAINTLKLNDNKNWIGTNTDIDGFIYPLKNLNLIKKSSLILGSGGAARSVIQGLIELKLSKITIISRKRNSLNELITNFKNDIEIKGLLSTNNEIKNLIQETDLIINTTPVGMSNTTNTDELPFGQGFWDSINSKTIVYDLIYNPSPTPFLKFCDKKGCMTIDGTQMLIAQGAKSLSFWTNGLEVPYEVMHDALKEYL

SEQ ID NO: 22521 - DNA, 912 bp, Prochlorococcus marinus
  CDS (1)..(912)
atgattagcggcacaacctccctaataggcctgctcggccaaccagtgcaccattccctctcaccggtgatgcaaaacgcagccctcgctgcaatgaatctcgactggtgctacatggccatgccatgcgaaaccaacgatctggccaatgtgctctgcgctctgcgttcgatcaactgccttggactgaacatcaccatcccccacaaacaagacgtggccaaaacctgtcgagagctcagcccattagcaaaacgactgaaagccgtcaacactctgatccctcatgccgacggcggctggacaggcaccaacacagacgtggccggttttattgcaccccttcaagaaagcaagtgcgagtggcatgggcgtcgtgcagtcgtgctcggttgcggtggtagcgcccgagcagtcgttgcaggtctgcaagatttaaaattggctcaaatcatggtggttggccgccgatctgatgcgctgaagagatttctcgatgatctccagcccaacccagccagctccgaatctgattgccaagtgctcttgcaagggattctccaacatgaccctgctctgattgaacagctaaccaaagccgatctggtggtcaacaccacaccaataggcatgtcccaaaaccgtgcggaaacatcaactcctagagcgccaatgcccctggggaagaagatttggcaaaacttaagcccaaagacaactctctatgacctgatttacacaccaaaaccaaccgcctggctaaccttaggaactgaacatggctgccattgcatagatggcctcgaaatgcttgttcaacaaggcgctgcctctctaaggctctggagcggcaacaacaaggtgcctgtcgaagagatgagaaaagctgctctgagctggctcacggtttag

SEQ ID NO: 22522 - protein, 303 aa, Prochlorococcus marinus
MISGTTSLIGLLGQPVHHSLSPVMQNAALAAMNLDWCYMAMPCETNDLANVLCALRSINCLGLNITIPHKQDVAKTCRELSPLAKRLKAVNTLIPHADGGWTGTNTDVAGFIAPLQESKCEWHGRRAVVLGCGGSARAVVAGLQDLKLAQIMVVGRRSDALKRFLDDLQPNPASSESDCQVLLQGILQHDPALIEQLTKADLVVNTTPIGMSQNRAETSTPRAPMPLGKKIWQNLSPKTTLYDLIYTPKPTAWLTLGTEHGCHCIDGLEMLVQQGAASLRLWSGNNKVPVEEMRKAALSWLTV

SEQ ID NO: 22523 - DNA, 903 bp, Prochlorococcus marinus
  CDS (1)..(903)
atggaacaacttataaaaggaccaattaatggagagacaagcctggtaggggttcttggatgccccgtaaagcactcattatcaccaataattcaaaatgctgctctaaaagaacttggtttgaactggtgctatttagcaattccatgtaaaccccaaaattttgaattagtcatcaaagctttacgaacaattaattgcaaaggattaaatataacgattcctcataaaaatatagctcttgatgtatgtgatgaactaagtagtattgccaaacaaattggagcagtaaatacattaattccaagcaaaagaaaaaactggtttggaaccaatactgatattgaaggttttcgttcttctttattagaaagaaaaataaattatgaagggaaaaacgcaataataataggtactggaggcagtgcaaaagctgtattacatggtctggatactttaaaatttggaaaaataactattgttagccgcacaaaaaattcattaaagaaatttttaataaataataataatctttgcacagagattgatggattaattcaagaagatttaaccttagaagaatatattaaagctgctaatttaattgtaaatgcaacacccataggtatggaaaataaagcaaatagtaaaagctcttcggaaattccactaggtaaaagtatctgggaaaatcttcagccagggtcaactttatacgacttaatctatacacctaaacctacaaaatggttgcaattaagtagaaaatattcctgtcatcaaattgatgggcttgaaatgcttgttcaacaaggtgcatcctctcttagattatggagtggtatagaagagattcctattgatataatgagaaaagctgggcaaaaagcattattaaattaa

SEQ ID NO: 22524 - protein, 300 aa, Prochlorococcus marinus
MEQLIKGPINGETSLVGVLGCPVKHSLSPIIQNAALKELGLNWCYLAIPCKPQNFELVIKALRTINCKGLNITIPHKNIALDVCDELSSIAKQIGAVNTLIPSKRKNWFGTNTDIEGFRSSLLERKINYEGKNAIIIGTGGSAKAVLHGLDTLKFGKITIVSRTKNSLKKFLINNNNLCTEIDGLIQEDLTLEEYIKAANLIVNATPIGMENKANSKSSSEIPLGKSIWENLQPGSTLYDLIYTPKPTKWLQLSRKYSCHQIDGLEMLVQQGASSLRLWSGIEEIPIDIMRKAGQKALLN

SEQ ID NO: 22525 - DNA, 807 bp, Helicobacter hepaticus
  CDS (1)..(807)
atgcttggtttttttgctgtttatggcaatcctatcacgcattctaaatccccttttttgcataattacgcctttacaaaacttggcttaagtggctattatagtcgtattttgcttgataaaggtgcaaaccttcgccaaaattttctttcaaatggcttaagtggagcaaatattactttaccctttaaagaagaagcttttaatcaatgtgatgaggtgcgcggagtagcccaaaatattggcgcttgtaatacttgggtgcttgaggacaaaaatcatcttgttggttataatacagatgcgcaaggattctatgagtgcattaaagaatataagattaaaaatgcccttatcattggcgcaggtggttcagccaaggcagtagcgatgatacttcaatctcataatattccaacaacgcttattaatcgctccgtgcaaaatcttagcttttttgttcataaaggttttgaatgctatgtaaacagtgaatttaaacccacttgtagttatgatattcttattaatactacaagtgcagggcttaatgataatctattgccttgtgatgaatcacaacttaaagaactctgctcttgtggtaaatatgcatttgaccttatttatgggaaatgcacaccttttcttgctttagctcaatcattccatcttagttgtagtgatggaaaagaaatgcttataaatcaagcggctctttcatttgagcttttttgcaaacaaaaatataacaaaggcaatttagagatacaacgtattgcatcgtttatgaatgagattttatag

SEQ ID NO: 22526 - protein, 268 aa, Helicobacter hepaticus
MLGFFAVYGNPITHSKSPFLHNYAFTKLGLSGYYSRILLDKGANLRQNFLSNGLSGANITLPFKEEAFNQCDEVRGVAQNIGACNTWVLEDKNHLVGYNTDAQGFYECIKEYKIKNALIIGAGGSAKAVAMILQSHNIPTTLINRSVQNLSFFVHKGFECYVNSEFKPTCSYDILINTTSAGLNDNLLPCDESQLKELCSCGKYAFDLIYGKCTPFLALAQSFHLSCSDGKEMLINQAALSFELFCKQKYNKGNLEIQRIASFMNEIL

SEQ ID NO: 22527 - DNA, 831 bp, Haemophilus ducreyi
  CDS (1)..(831)
atggcacgtcaatatgcagtgtggggtaatcctattgcgcatagtaaatctccatatattcatcagttattcgctcaacagtcaaatcggcgtattgaatatgccgcgaaattaggggataaaattgcgtttgaaaagcaacttgtacaattttttactgatggtgcaaatggtgtaaatattacttcaccatttaaagcgcgcgcgttcagattagcggatgtatgcagtgaaagttgcttattagcaggcgcggctaatacactgaagcgtttagatgatgggcgtttgtttgcagataatacagatggcaaagggttttgtgccgatttagcgcgattagagtggctgattcctgaacagcgggtgctaattttaggcgcggggggcgtcactaaaggtgtgttacttcccttattgttagctaagcagaaggttactttatctaaccgcacacacattaaagcagttgaattagctcagcaatttgctaaatatggcgatattcaagcggtctctctatctgaaattgttcagcatccaccatttgacttaattattaatgcaacatctttaggcctacaaggcggatatatagctttgcctaatcatttatttgagaagagtgctgtctatgatatggaatatgctagcaatatgtgtactccatttttaaattatgttcgtacacaaggcgttacacgttatcaagatggtttaggtatgttagtaaatcaagctgctttttcttttcaattatgggaaggggaattgccaaaggtggaaaatgtacttaaacaactgagagcagaaatgggttatgttaaataa

SEQ ID NO: 22528 - protein, 276 aa, Haemophilus ducreyi
MARQYAVWGNPIAHSKSPYIHQLFAQQSNRRIEYAAKLGDKIAFEKQLVQFFTDGANGVNITSPFKARAFRLADVCSESCLLAGAANTLKRLDDGRLFADNTDGKGFCADLARLEWLIPEQRVLILGAGGVTKGVLLPLLLAKQKVTLSNRTHIKAVELAQQFAKYGDIQAVSLSEIVQHPPFDLIINATSLGLQGGYIALPNHLFEKSAVYDMEYASNMCTPFLNYVRTQGVTRYQDGLGMLVNQAAFSFQLWEGELPKVENVLKQLRAEMGYVK

SEQ ID NO: 22529 - DNA, 885 bp, Candidatus Blochmannia floridanus
  CDS (1)..(885)
atgagttcttttgctatttttgggaatccagtaagtcatagtaaatctccaaagatttatagtatgtttgctaatgaatttggtatgtgtggtgaatatgatttgaaagtagcttcagatgataatttttataatttgttatatcaattttttgatatgggtggttttggggcaaatattactgtcccttttaaaaaacgggcttttttattatgtgataatttaactgatagatctatattgtcaagtacagtaaatacaatcaaaaaacaacttgatggtactttattaggagataatactgatggtatagggttaattaatgatttgaagcgtttaaattggattagcatagataatgcttttatagatatgacttgtaataatattcaggaaacagctaatattttattaatcgggtctggtggagcagctcaaagtattattcctgttttattagatataaaaaaatgttgtgtgaatataattaatagaactttttttaatgctcagagattagtgcaatattatcatagtataggtcgtcagaatatatcttgtattgatttaaataatttattgtgtgaaaaaaatgcatgtaaaaagtatgatttgattattaatgcgtcatctagtagtatgaataatgatcttccttgtatttcatcgtttttaattacaccatttaccaaatgttatgatttattttatggaaatcaagatacgatatttgtgaaatggtgtaaaaaaaatggatcaaattattgtgttgatggtttgggaatgttgatagaacaagcagcatatgcgttttatttatggcatggtaaaaaaccatctgtacccatagttttaaatgcatttcgatctgaattatgtaagtaa

SEQ ID NO: 22530 - protein, 294 aa, Candidatus Blochmannia floridanus
MSSFAIFGNPVSHSKSPKIYSMFANEFGMCGEYDLKVASDDNFYNLLYQFFDMGGFGANITVPFKKRAFLLCDNLTDRSILSSTVNTIKKQLDGTLLGDNTDGIGLINDLKRLNWISIDNAFIDMTCNNIQETANILLIGSGGAAQSIIPVLLDIKKCCVNIINRTFFNAQRLVQYYHSIGRQNISCIDLNNLLCEKNACKKYDLIINASSSSMNNDLPCISSFLITPFTKCYDLFYGNQDTIFVKWCKKNGSNYCVDGLGMLIEQAAYAFYLWHGKKPSVPIVLNAFRSELCK

SEQ ID NO: 22531 - DNA, 864 bp, Bordetella parapertussis
  CDS (1)..(864)
atgaccctgccggcctctccgccccgctatgccgtcatcggcaatccgatcgcgcacagccgctcgccgcagatccacgccatgttctcggcccagaccggccgcccgctgcgctacgagcggctgctggcgcccgtggacggcttcctgcccaccgtgcaggccttccgcgagagcggcgggctgggcctgaacgtgaccgtgcccttcaagctggaagcctacgcgctggccgaggcgcgcctgtccgagcgggcgcggctggccggcgccgtcaataccttgtcgtggcgcgacggcgcctggcacggctgcaataccgacggcgtcgggctggtcaacgacctgctgcgcctgggcgtggcgctggccggcgcgcgggtgctgctggtgggcgccggcggcgccgcgcgcggcgtactgcagccgctggccgcggccggctgcgcccgcatccatatcgtcaaccgtaccgccgcgcgcgccgccgagctggcggccgcctggcgcgccgcggcgccgcgcaccggcacgcaggtcagcgccggcgccctggcccaggccgccgaacccggcggctgggacgtggccatcaacgccacggccagcagcctgcaggacgcggcgccggacctgcccggcggcctgtacgcgcccgacgccctggcctacgacatgatgtacggcgcgcggcccaccgccttcatgcgccaggccgaggccgacggcgcggcgcgctgcgccgacggcctgggcatgctggtcggccaggccgccgagagcttccatatctggcacggcgtgcggcccgaccccgggccggtgctgctggccctgcgcaccgaactgctggccgcgggctag

SEQ ID NO: 22532 - protein, 287 aa, Bordetella parapertussis
MTLPASPPRYAVIGNPIAHSRSPQIHAMFSAQTGRPLRYERLLAPVDGFLPTVQAFRESGGLGLNVTVPFKLEAYALAEARLSERARLAGAVNTLSWRDGAWHGCNTDGVGLVNDLLRLGVALAGARVLLVGAGGAARGVLQPLAAAGCARIHIVNRTAARAAELAAAWRAAAPRTGTQVSAGALAQAAEPGGWDVAINATASSLQDAAPDLPGGLYAPDALAYDMMYGARPTAFMRQAEADGAARCADGLGMLVGQAAESFHIWHGVRPDPGPVLLALRTELLAAG

SEQ ID NO: 22533 - DNA, 834 bp, Bacillus cereus
  CDS (1)..(834)
atgaaacaattatatggtgtaatcggaaatccaattggacattcattatcacccgttatgcataacgacgcatttgaacacttgaatatggatgcccattatcatgcgttccttgttgaagaggaattgctaggggaagcagtaagaggtttaaaagcattaggtatttcaggatttaatgtaacaactccgcacaaggttgctattatggagtatttggatgagattgacccattggcaaggaaaatcggtgcagtaaatacagtggttcataaggatggaagattaattggctataatacagacgggattggttttgttcgagcgttgcagtcaattagtaatgaaccacttcaagggaaacgtattttgttacttggttcaggtggtgctagccgagctatttatttttctcttgctgatgtaggtgtaaaagagattgatgtagccaatcgtacagtagataaggcaaaggaacttattgctgcacgtacggccgatgttaattctgttgctttgtcgttagaaaaagcgacagaagaacaaggaaattatgatattatcattcagacgacaacgataggtatgcatccacacgtagaacatacgccattacaaatttgttcgttaaaaaaaggaacgattgtatcagatataatttataatccatttgaaacgaaaattttatgtgaggcaaaagagcaaggtgcaatcattcaaaatggtattgatatgtttgtttatcaaggagcacttgcatttgaaatgtggacaggacgcacgccaaatatcgaaagaatgaaacaattagttatagaaaagcttggaggctaa

SEQ ID NO: 22534 - protein, 277 aa, Bacillus cereus
MKQLYGVIGNPIGHSLSPVMHNDAFEHLNMDAHYHAFLVEEELLGEAVRGLKALGISGFNVTTPHKVAIMEYLDEIDPLARKIGAVNTVVHKDGRLIGYNTDGIGFVRALQSISNEPLQGKRILLLGSGGASRAIYFSLADVGVKEIDVANRTVDKAKELIAARTADVNSVALSLEKATEEQGNYDIIIQTTTIGMHPHVEHTPLQICSLKKGTIVSDIIYNPFETKILCEAKEQGAIIQNGIDMFVYQGALAFEMWTGRTPNIERMKQLVIEKLGG

SEQ ID NO: 22535 - DNA, 1434 bp, Chlamydophila caviae
  CDS (1)..(1434)
atgttgtgtgcaacaattagtggtccctctttttttgaagcaaaacaacagcttctgcactcattgcctttcgtagatagtatagaattacgtatcgactgtcttttatctttatcatcagaccagctgaaacatttggtttgcttagctaagaaacctatcctcacgttgagaagacacgcgagtctatctgaaatcgcctgggtagaacgtactatggaattagcaaaattgcagcctgattatctggatattgataaggattttcctaaagaagctttaagaaagatccgaaaccaatatcctaatatcaagatcattttgtcatatcatagccaaacttcagaacacgtccccaccctctataatgaaatgctaaaacaacaagcgcatcattataaaattgctattacttctacaaaatctgtagatgcgctacgtcttatacagataaaaaaacatcttcctgaaaatactacagtactgtgcatgggaaatgaaggcatcgcttcgcgtatcctttcaccactaatgaagaatgctatcaattatgcttcaggaatccacgctcctaaagtcgctccggggcagctttctatagaagatctattagcttataactatgcgaatctctcttcagaagcacgtatctatggcctcatcggcaatcccatagatcgtagtatcagtcatctttcccacaataagctgttttcagaacttcatatgaagacgagctacataaaaatccttttatcctctgcagatcttaaagaatttttctctctaacacgtgatcttccttttggaggacttagcgtaactatgcctttcaaaactgacgttcttgattatatcgatgtttttgatccctctgtaaaacattgtcaatcttgcaacactcttgttttcaataagaataagatcacaggacacaatacggatggtttaggattactgaatcttttaaaacgcaaaaacattgccgttcacaatacccatgtgggtattgtaggctccggaggagccgcaaaggctatagcaacaacatttgcttattcgggagcttgtattagcatttttaaccgcacggaagaaaatggtaaaaaacttgctgagctatgtaatggcaatgcgttccccctaagctctttatcagaaaagcatgctatagatattctaattttatgccttcctccgcatgtaaaaatccctgaaatcttccctcctgtagttatcgatatcaatacattgcctaaagaatctccctatactaggaaagctaaagcccaaggatgtcatgttctttacggatatgaaatgtttgctgagcaagctctcctacaattttccctttggttccctagaagtctctcccaagacgatagcgagagattccgtattaacgtagaaaatattgttaacaccatgtaa

SEQ ID NO: 22536 - protein, 477 aa, Chlamydophila caviae
MLCATISGPSFFEAKQQLLHSLPFVDSIELRIDCLLSLSSDQLKHLVCLAKKPILTLRRHASLSEIAWVERTMELAKLQPDYLDIDKDFPKEALRKIRNQYPNIKIILSYHSQTSEHVPTLYNEMLKQQAHHYKIAITSTKSVDALRLIQIKKHLPENTTVLCMGNEGIASRILSPLMKNAINYASGIHAPKVAPGQLSIEDLLAYNYANLSSEARIYGLIGNPIDRSISHLSHNKLFSELHMKTSYIKILLSSADLKEFFSLTRDLPFGGLSVTMPFKTDVLDYIDVFDPSVKHCQSCNTLVFNKNKITGHNTDGLGLLNLLKRKNIAVHNTHVGIVGSGGAAKAIATTFAYSGACISIFNRTEENGKKLAELCNGNAFPLSSLSEKHAIDILILCLPPHVKIPEIFPPVVIDINTLPKESPYTRKAKAQGCHVLYGYEMFAEQALLQFSLWFPRSLSQDDSERFRINVENIVNTM

SEQ ID NO: 22537 - DNA, 837 bp, Streptomyces avermitilis
  CDS (1)..(837)
atgacgggcaccgacagcaagcgccgagccgccgtactcgggtcccccatcgcccactccctctccccggtgctgcaccgcgccgcgtacgccgagttgaggctgagcgactggtcgtacgaccggttcgacgtggacgaggaggcgctgcccgccttcttcgggaagctcgggcccgagtgggcggggctgtcgctgaccatgccgctgaagcgggccgtcatcccgctgctcgacgagatcaccgagaccgccgcgtcggtggaggccgtgaacaccgtggtgtgcacgcgggacgggcggcgcgtcggcgacaacaccgacatcccggggatggttgcggccctgcgtgagcggggcatcgagcaggtcgactccgccgcgatcctcggcgcgggcgccaccgcctcgtccgcgctggccgcgctcgcccggatctgcaccggtgaggtcgtcgcgtacgtccgcagcgaggcgcgcgccgccgagatgcggcagtggggcgaacggctcgacgtcgaggtgcgtaccgaggactgggcgcaggcggccgaggcactgcgggccccgctggtcgtcgccaccaccccggccggtgcgacggacgcgctggccgccgccgttccggagcggcccgccacgctgttcgacgtgctgtacgacccctggcccaccgacctggccgcgcgctggtccgcgtacggcggcgccgtcgtcagcgggctggacctcctggtccaccaggcggtgctccaggtcgagcagatgacggggcgctcgccggctccgctggacgccatgcggcgggcgggggagcacgcgctggcggcccggtag

SEQ ID NO: 22538 - protein, 278 aa, Streptomyces avermitilis
MTGTDSKRRAAVLGSPIAHSLSPVLHRAAYAELRLSDWSYDRFDVDEEALPAFFGKLGPEWAGLSLTMPLKRAVIPLLDEITETAASVEAVNTVVCTRDGRRVGDNTDIPGMVAALRERGIEQVDSAAILGAGATASSALAALARICTGEVVAYVRSEARAAEMRQWGERLDVEVRTEDWAQAAEALRAPLVVATTPAGATDALAAAVPERPATLFDVLYDPWPTDLAARWSAYGGAVVSGLDLLVHQAVLQVEQMTGRSPAPLDAMRRAGEHALAAR

SEQ ID NO: 22539 - DNA, 876 bp, Streptomyces avermitilis
  CDS (1)..(876)
atgacccaggactcgtatctcgtcggcctgatcggttccggcatcggcccctcgctcagccccgccctgcacgaacgcgaggccggccggcagggactgcgctatcactaccggctgatcgacatcgacaggctcggggtcggacccgaagccgtgggcggcctggtacgcgcggcccgggacctcggtttcgacgggctcaacatcacgcacccctgcaagcagctcgtcatcagccacctggacacgctcgccccgcaggccgaggcgctcggcgcggtcaacaccgtcgtcttcgaggacggccgcgccgtcggtcacaacacggacgtcaccgggttcgccgcctccttcgcgcgcggactgcccgacgcccggctcgaacgggtcgtacagctgggcgcgggcggcgcgggcgcggccgtggcgcacgccctgctgacactcggcgccgggcacgtcaccgtcgtcgacgcgctgccggagcgggccgccgccctcgccgtggcactgaaccggcacttcggcgacggccgcgccgccgcggcgagcccggacacgctgcccaagctgctgacggacgccgacggcatcgtgcacgccacccccaccggtatggccgcccaccccggaatcccgctcccggccgagctgctgcaccccggtctgtgggtcgccgaggtggtctaccgccccctggagaccgaactgctgcgcaccgcccgcgcgctcggctgcgccacgctcgacggcggcggcatggccgtcttccaggcggtggacgcgttccggctcttcaccgggcgggaacccgacagcatgcgcatgctcgccgacatcgccgaactggccggcaccgcggccgtccggcactga

SEQ ID NO: 22540 - protein, 291 aa, Streptomyces avermitilis
MTQDSYLVGLIGSGIGPSLSPALHEREAGRQGLRYHYRLIDIDRLGVGPEAVGGLVRAARDLGFDGLNITHPCKQLVISHLDTLAPQAEALGAVNTVVFEDGRAVGHNTDVTGFAASFARGLPDARLERVVQLGAGGAGAAVAHALLTLGAGHVTVVDALPERAAALAVALNRHFGDGRAAAASPDTLPKLLTDADGIVHATPTGMAAHPGIPLPAELLHPGLWVAEVVYRPLETELLRTARALGCATLDGGGMAVFQAVDAFRLFTGREPDSMRMLADIAELAGTAAVRH

SEQ ID NO: 22541 - DNA, 831 bp, Nitrosomonas europaea
  CDS (1)..(831)
atggatacctacgcagtcatcggcaacccggttgcgcacagcaaatcgcccttcattcatgcccggtttgcacaacagaccggccggatcatccattacaccgccctgctcgcaccactggacaggttcgagcagactgttctggatttccggaaaaccggcggcaaaggcatgaatatcactgttcccttcaaattcgaagcctttacactcgccagccggctgaccgatcgcgccagtgctgcacgtgcagtcaacactttccggtttgaagaaacaggagaaatactcggcgacaacaccgatggtgtcggattgatacgtgatatcgaggttaatctgaatttcccgctggcaggcaagcgcattctgctgatgggtgcaggtggtgccgcaagtggcgtcatcctgccactgttgcagcagcagcctgacctgctggccatcgccaaccgcacgccagataaagcagtgtcattacaacgccaattcgccagttacagcaatatcacaaccgggcattaccatgattttgccgggcagcatttcgatctcatcatcaatgccacttcagccagcctgcacaacgaactcccccccgtaccggcagatctgttccgtaacgcttttgcctacgacatgctgtacagcagcaggctgacaccgtttctggagcttgccagggtgcagggagctggatatctggcagatggtgccggcatgctggtagaacaggctgcagaatcctttctgctatggcacgggatccgcccggaaacgcagaccgtcatcagacagctcagggataatctgcgccaccctacctcgtga

SEQ ID NO: 22542 - protein, 276 aa, Nitrosomonas europaea
MDTYAVIGNPVAHSKSPFIHARFAQQTGRIIHYTALLAPLDRFEQTVLDFRKTGGKGMNITVPFKFEAFTLASRLTDRASAARAVNTFRFEETGEILGDNTDGVGLIRDIEVNLNFPLAGKRILLMGAGGAASGVILPLLQQQPDLLAIANRTPDKAVSLQRQFASYSNITTGHYHDFAGQHFDLIINATSASLHNELPPVPADLFRNAFAYDMLYSSRLTPFLELARVQGAGYLADGAGMLVEQAAESFLLWHGIRPETQTVIRQLRDNLRHPTS

SEQ ID NO: 22543 - DNA, 819 bp, Coxiella burnetii
  CDS (1)..(819)
atggataaatacgccgtcattggcaaccctgttgaacacagtttatcacctgttatttttcaagcgtttgaaaagcaaacgaatcactccttcgattatttaaaaataaaagcgccagtgaatggatttgctgccgccgtaaaaaaattccacgacgaaggagggaaaggcgctaatattactttgcctttcaaagaagaagcataccaattagctgataaacgcagtcaagaagccaatgaagcccacgtggccagcgctttgcaatttcgagaagacggtactatttatgctgtgaattatgatggactggggttagtgcaggatctcactcgcaatcacaatatcacactgactcaaaaatccattttaattgtcggcgcaggcggagcaacgcgcggtattttagggccgctactaaatgcagcaccggaaaaaatagttattgtcaatcgtacgccttctaaagcacacgcattagcgaaaatttttcatttgcgcggtgaaattcaaggcggcgggttcgatgaattagaacctatgcgatatgacgtcattattcatgccaccagcttagggcatcaaggaaaatttcctccacttcccgatggtctcattggctcgcagagttgttgctatgatctttcttatggcaaaattgcttcaccctttctacaatgggcaaaagatcaaggcgcaaaatataattttgatggccttggtatgctggtagaacacaacgccgcggttttttatttatggttcggcatttatcctgataccaatcctgttatcgaaatgcttcaagctcatttgtaa

SEQ ID NO: 22544 - protein, 272 aa, Coxiella burnetii
MDKYAVIGNPVEHSLSPVIFQAFEKQTNHSFDYLKIKAPVNGFAAAVKKFHDEGGKGANITLPFKEEAYQLADKRSQEANEAHVASALQFREDGTIYAVNYDGLGLVQDLTRNHNITLTQKSILIVGAGGATRGILGPLLNAAPEKIVIVNRTPSKAHALAKIFHLRGEIQGGGFDELEPMRYDVIIHATSLGHQGKFPPLPDGLIGSQSCCYDLSYGKIASPFLQWAKDQGAKYNFDGLGMLVEHNAAVFYLWFGIYPDTNPVIEMLQAHL

SEQ ID NO: 22545 - DNA, 2697 bp, Podospora anserina
  CDS (1)..(2697)
atggcttctactaccgtccccggtatgaagcgttcatacgcggccatggtctcgacttgtgagagcgactcgtccgagtcccgaccattgtcccgaggctggtcctcggacagccaaaatatggcttatgttcctggtcccggggctctcttccaggtgattggtgatcctatacctagagtgccacgctcagcaacccactcgccattggagcatgagattgtccaaacagcccgtccctacgacccagatgcctccattatcatcgtcggtatcaggggctcggggaaatccactttggccgtcatggcctcgaccgccatgaaccgaaaggtcgtcgagttggagcatgtttttcacgagaaaaccgggctatcgagtccagcttacaagagaaagcatggcgccactgactgtcaacgccgccaggcctctatccttcagcatgtatttgataaacataagcgaaacactatcgtggtcagctcatggatggataggagtgtgcaagtcatcctcgaagaccttggaagaacaaatcccgtcatatatgtccttcgagattcagaagccatcaggacccatttgaaggtcaacgatgcccgcaagttctgcgagcttttggatgccagcagtgcctttttccggagatgcacccgctttgagtttttcaatgcgtcagaagagcaaagcacagccaaagagaccatgggtgggagttctgatgaaattgctgccccctatctcaccctgaaacgagctgaacgacacttcctcaagtttctctccttgatactcccaaggggaaccatacccttcatcgaatcggccttcccgctggcttgcataccggcagaagaacggcggttcacctacgcaatctcactgcccctttcgtcgctcataaaagacaacctcgacgtccaggacctcgagacaggagcggatgcgattgagattgtgttggatgacctcgtcacagactttgccgctcacttacggcaactcggtcagctacccccagatagagccagagaaatcagccgcgtcgtggcccaagtaaggcgagacaccgtgattcctatcttcctccatgtagcgtttccggaggctgcgctgtctgacgagacttggcgatctatgtacagttcatatgtctcgcatgcccttcgtcttgccccggagtacatgactgttgatctacgactcgacagcgtgacgcttgccggcattctcaacatcaagggctcctgcaagatagtcgggaacgttcagttatcagatccccacccgccgtcttggaatgactccagctggcagtcctactaccagaaagcacagaattacggctgcgacatggtccgattcaccaggacagctgccagcatcgatgataactttggcatacatcgggtgcacgccatggttgagtcagcgcctagttcgagactgcccctgatcgcttacaatactggcgttcttggaaagcactcggcgtgcttcaacaggatactatcctctgttaaacccgaaggcatgagcaaagaccccggtggtgttgactcacatagcctggccatccgtccatttctcacggccaaacaagccaccgaagctctctactcagcctttctctacgatcacatgagactgtatgtttttggcgccaacgtggactacagtttatccccagcaatgcacaatgccgctctcaaagcttgcggcattccccaccactacgagccacattcgacaagcaacatatcaagtctcgagaagctcgtcagtgacccgcactttgctggtgcctcggtcggactgcctttcaaagtcgagataatcagcttgacgcattccctgagccgacatgctcgggctatcggcgcagtcaacactctgattccggttcggcacctcaacccggatggcagtattggcgatgacgtggctttgttcaatgacagaaatagggccgggcccgtcaaggctttgtacggggagaatacagactgggtgggaatccgggcatgtatccgccgaggtctctcgcccgccaacgccgtccgatccaccagtagcggactcgtgatcggagctggtggcatggctagggcagccgtgtacgccatgctgcagcttggagtcaagcagattgccatcttaaaccggaccgttgccaatgccgagaagcttgtttctcacttcgaaaggctcttggctcgcaatgacctaccttggttgagcgctggctccagaacccacgaaggcaccagattccacatccttcgctcccgagacgacacttggcccgagagcttcagacaccctaccatgatcgtatcttgcataccaacgcacagcattggagaccaccccgctcctgactttaccgtcccagcgtcgtggctgcaaagctcgacaggcggtgtcgtagtagagcttgcctacaagacccttatcacccctctgctggaacaagttcgccgtgaagctcatagagggtgggttacaatggatggcctggatctgctaccagaacaaggttttgcacagtttgaattgttcactggtcggcgcgcaccacgtcgattgatgaggagggaggtgttcagatcgtatcctgatgaccaagggcgtctgaactttgcgcggctgttgcagccgcggctcgacaacataactgcacaagaaccttga

SEQ ID NO: 22546 - protein, 898 aa, Podospora anserina
MASTTVPGMKRSYAAMVSTCESDSSESRPLSRGWSSDSQNMAYVPGPGALFQVIGDPIPRVPRSATHSPLEHEIVQTARPYDPDASIIIVGIRGSGKSTLAVMASTAMNRKVVELEHVFHEKTGLSSPAYKRKHGATDCQRRQASILQHVFDKHKRNTIVVSSWMDRSVQVILEDLGRTNPVIYVLRDSEAIRTHLKVNDARKFCELLDASSAFFRRCTRFEFFNASEEQSTAKETMGGSSDEIAAPYLTLKRAERHFLKFLSLILPRGTIPFIESAFPLACIPAEERRFTYAISLPLSSLIKDNLDVQDLETGADAIEIVLDDLVTDFAAHLRQLGQLPPDRAREISRVVAQVRRDTVIPIFLHVAFPEAALSDETWRSMYSSYVSHALRLAPEYMTVDLRLDSVTLAGILNIKGSCKIVGNVQLSDPHPPSWNDSSWQSYYQKAQNYGCDMVRFTRTAASIDDNFGIHRVHAMVESAPSSRLPLIAYNTGVLGKHSACFNRILSSVKPEGMSKDPGGVDSHSLAIRPFLTAKQATEALYSAFLYDHMRLYVFGANVDYSLSPAMHNAALKACGIPHHYEPHSTSNISSLEKLVSDPHFAGASVGLPFKVEIISLTHSLSRHARAIGAVNTLIPVRHLNPDGSIGDDVALFNDRNRAGPVKALYGENTDWVGIRACIRRGLSPANAVRSTSSGLVIGAGGMARAAVYAMLQLGVKQIAILNRTVANAEKLVSHFERLLARNDLPWLSAGSRTHEGTRFHILRSRDDTWPESFRHPTMIVSCIPTHSIGDHPAPDFTVPASWLQSSTGGVVVELAYKTLITPLLEQVRREAHRGWVTMDGLDLLPEQGFAQFELFTGRRAPRRLMRREVFRSYPDDQGRLNFARLLQPRLDNITAQEP

SEQ ID NO: 22547 - DNA, 777 bp, Pseudomonas syringae
  CDS (1)..(777)
atgcccgttatcgccaacagggatacgcagctgtgtatgtcgatggccgcacgtcccggaaacttcggcgtacgttttcataatcacctttttcagcagttggacctcaacttctattacaaaacattttcgcccaatgacctgacggcagctgttgccggtatacgctcactgggaatacgcggcagcgcggtgtcgatgccgttcaaagaagcctgcatcgagctggtcgacgagctggacgtatcagcggccgcgatccagtcgatcaataccatcgtcaataccgacgggcacttgaaggcgttcaacacggactacattgccgtggcgcaactgatggaaagccatgccgtgccacacagcgcatttgccctgcgcggcagcggcggaatggccaaagcggtggcgtttgccctgcgcgatgcaggtttcaccgacgggttgatcgtggcgcgtaaccagcaggccgggcagcgcctggcagaggcgtgtggttttcgctggcaggctgacctgggaagcgcgcgcccaccgttgctggtcaatgtcacgccgctgggtatgcaaggcccgcagggcgatgaactggcgtttgatatgcaggcaatcgaagccgctgacacgattttcgatgtggtcgccacgcccgccgatacaccgttgattcaggctgcacgtcgtctgggcaagcggctcgtgagcggcgatgaggtggccgctatccaggcgcttgagcagttcgtgctgtacaccggccattcgcccgaccgatga

SEQ ID NO: 22548 - protein, 258 aa, Pseudomonas syringae
MPVIANRDTQLCMSMAARPGNFGVRFHNHLFQQLDLNFYYKTFSPNDLTAAVAGIRSLGIRGSAVSMPFKEACIELVDELDVSAAAIQSINTIVNTDGHLKAFNTDYIAVAQLMESHAVPHSAFALRGSGGMAKAVAFALRDAGFTDGLIVARNQQAGQRLAEACGFRWQADLGSARPPLLVNVTPLGMQGPQGDELAFDMQAIEAADTIFDVVATPADTPLIQAARRLGKRLVSGDEVAAIQALEQFVLYTGHSPDR

SEQ ID NO: 22549 - DNA, 855 bp, Pseudomonas syringae
  CDS (1)..(855)
atgacccatgctgaacacacctccgtactcgccggcctgatcggctccggcatccaggcttcgcgaacgcccgccatgcatgagcacgaaggcgatgcacagggcctgcgctacctgtaccggctgatcgatatcgacgcgctgcaactggacatcaacgccctgccccggcttgtcgaaagcgcgcagaactgcggttttaccggcctgaatatcacctttccctgcaaacaggcggtcatcccgttgctggacgaactgtccgacgaagcgcgcggcatcggtgcggtcaacaccgtggttttcaaggacggaaaacgcatcgggcataacaccgactgtctgggttttgccgaaggtttccagcgcgggctggacaaagcgccacgtcagcatgtggtgcaaatgggcgcaggtggtgcgggcgctgccgtggctcatgcgctgctgagcgcaggcgtcgagcgcctcaccgtgttcgaggtcgagccgcagcgtgcgcaaggcctggtggacaacctcaatgagcatttcggtgccggacgcgcgcaggtcggtcttgacttgcctgcggcaatggccgaagccgacgggctggtcaataccacgccggtgggcatggccaagctgccgggcacgccgttgccggttgaactgctgcggcccgcgctgtgggtggctgaaatcatttacttcccgctggaaaccgagctgctcaagcacgcccgcacactgggctgccgtacgctggatggcagcactatggcggtgtttcaggcggtcaaggcgttcgagctgttcagtggccggtccgctgatgcgcaacggatgatggcgcacttccacaccctgtaa

SEQ ID NO: 22550 - protein, 284 aa, Pseudomonas syringae
MTHAEHTSVLAGLIGSGIQASRTPAMHEHEGDAQGLRYLYRLIDIDALQLDINALPRLVESAQNCGFTGLNITFPCKQAVIPLLDELSDEARGIGAVNTVVFKDGKRIGHNTDCLGFAEGFQRGLDKAPRQHVVQMGAGGAGAAVAHALLSAGVERLTVFEVEPQRAQGLVDNLNEHFGAGRAQVGLDLPAAMAEADGLVNTTPVGMAKLPGTPLPVELLRPALWVAEIIYFPLETELLKHARTLGCRTLDGSTMAVFQAVKAFELFSGRSADAQRMMAHFHTL

SEQ ID NO: 22551 - DNA, 825 bp, Pseudomonas syringae
  CDS (1)..(825)
atggaccagtatgtcgtcttcggtaaccccattggtcatagcaagtcgccgctgattcatcgcctgttcgccgagcaaaccggccaggcactgaattaccagaccgcgctggcaccgctggacgatttcacggcgtttgcccaggcgtttttccagaccgggcgtggtgccaacgtgacggtgccgttcaaggaggaggcgtttcgcctggccgacagcctgaccgagcgcgggcagcgtgcgggggccgtcaacaccctgagcaagctcgatgacgggacgctgctgggcgacaacaccgacggtgccgggctggtgcgcgacctgacggtcaattgcgcatgcagcttgcgcggtcagcgcgtgttgttgctgggcgcgggcggtgcggtgcgtggcgcgctggaaccgctgctggcagaaaagcccgccgtactggtgatcgccaatcgtacggtcgaaaaagccgaacgactggctcaggaatttgccgatctcggcccggtgtttgccagcagcttcgactggcttgaagagccggtggacctgatcatcaacgccacgtctgccagcctggccggggagctgccgcccatctccccgagcctgatccagcctggtgcgaccttttgctacgacatgatgtacagcaaagcgcccactgctttctgccgctgggccacagaacagggtgcggcgcagtcggttgatggcctggggatgctggtcgagcaggcggcagaagccttcctgttgtggcgcggcgtgcgcccggattcagcgcctgtattggcggagttgcgcagattgctggctgcgggttga

SEQ ID NO: 22552 - protein, 274 aa, Pseudomonas syringae
MDQYVVFGNPIGHSKSPLIHRLFAEQTGQALNYQTALAPLDDFTAFAQAFFQTGRGANVTVPFKEEAFRLADSLTERGQRAGAVNTLSKLDDGTLLGDNTDGAGLVRDLTVNCACSLRGQRVLLLGAGGAVRGALEPLLAEKPAVLVIANRTVEKAERLAQEFADLGPVFASSFDWLEEPVDLIINATSASLAGELPPISPSLIQPGATFCYDMMYSKAPTAFCRWATEQGAAQSVDGLGMLVEQAAEAFLLWRGVRPDSAPVLAELRRLLAAG

SEQ ID NO: 22553 - DNA, 840 bp, Pseudomonas putida
  CDS (1)..(840)
atgaccaaggagcctgttatgccgacaactcccagccgggacaccgtgctttgcatctctctggccggtcgccccggcaccttcggcgtgcgctttcacaaccacctgtaccagcagttgggcctggacttctactacaaggccatgcgcaccgatgacctgccggcggcggtggcagggatccgcgccctgggtattcgcggctgcggggtgtcgatgccgtacaaggaagcctgcatggccttggtcgacgaaatcgatccctcggcggcggccatcgagtcggtcaatacccttgtcaattgcaatggccacctcaaggcgtacaacaccgattacctggccgtgcgccaattgctggctcagcatcaggtcgatccgggcacggcctttgccctgcgaggcagcggtggcatggccaaggccgtggccagcgccttgcgcgatgccgggtttgccgaaggcatcatcgttgcacgcaacgagcaggccgggcgtcagttggcggatgtctgtggttatcgctgggtgcctgagccaggcgacatttgcccgcccatgctggtgaacgtgacgccgatcggtatggcaggcgggctggaggcagaagagctggcgtttcccgagcacgccatcgcggcggcggaacgggtgttcgatgtggtggcgatgccggcgcagacgccgttgattcgccgggctcaggcgttgggcaagccggtgatcactgggctggaggtcattgcgctgcaggcgctggaacagttcgtgttgtacaccggggtaaggccgacgcgggagcaggtggatgcggcggtggcatacgcgcgggctacctag

SEQ ID NO: 22554 - protein, 279 aa, Pseudomonas putida
MTKEPVMPTTPSRDTVLCISLAGRPGTFGVRFHNHLYQQLGLDFYYKAMRTDDLPAAVAGIRALGIRGCGVSMPYKEACMALVDEIDPSAAAIESVNTLVNCNGHLKAYNTDYLAVRQLLAQHQVDPGTAFALRGSGGMAKAVASALRDAGFAEGIIVARNEQAGRQLADVCGYRWVPEPGDICPPMLVNVTPIGMAGGLEAEELAFPEHAIAAAERVFDVVAMPAQTPLIRRAQALGKPVITGLEVIALQALEQFVLYTGVRPTREQVDAAVAYARAT

SEQ ID NO: 22555 - DNA, 819 bp, Pseudomonas putida
  CDS (1)..(819)
atgagcgaccgctacgcagtgatcggccgaccgatcaaccacaccaagtccccgctgattcatggcctgttcgcccaggccagcaaccagcagctggaatacggggctatcgaaggctcgctggacgacttcgaagcccaggtactgcagtttcgtagcgaaggcgggaagggcatgaacatcaccgccccgttcaagctgcgtgccttcgagctggccgaccggcgcagcgagcgggcgcaattggcacgggcggccaatgcgctgaagttcgaggatggccgcatcgtcgccgaaaacttcgatggcatcggtttgctgcgggacatcgaggagaaccttggcgagccgctgcgcaaccgccgtgtgctgctgctgggtgctggcggcgcggtgcgcggggcgttgctgccgttcctgcaggcggggcctagcgagctggtgatcgccaaccgggacatggccaaggcgctggcgctgcgtaacgagctcgatcactcgcgtctgcgcatcagccgctacgaagcgctggaagggcaatcgttcgacatcgtcgtcaacgccacctcggcgagcctgaccgcggacttgccgcccctgccggctgatgtgctgggcgaggcggccttggcctacgagctggcctatggcaaaggcctcacgcctttcctgcgcctggctcgcgagcagggccaggcgcgcctggccgatggcgtcggcatgctggtggagcaggccgccgaggcgtttgcctggtggcgcggggtgcggcccgacacacgtgcggtgatcaatcagctgacgattcccttggagtag

SEQ ID NO: 22556 - protein, 272 aa, Pseudomonas putida
MSDRYAVIGRPINHTKSPLIHGLFAQASNQQLEYGAIEGSLDDFEAQVLQFRSEGGKGMNITAPFKLRAFELADRRSERAQLARAANALKFEDGRIVAENFDGIGLLRDIEENLGEPLRNRRVLLLGAGGAVRGALLPFLQAGPSELVIANRDMAKALALRNELDHSRLRISRYEALEGQSFDIVVNATSASLTADLPPLPADVLGEAALAYELAYGKGLTPFLRLAREQGQARLADGVGMLVEQAAEAFAWWRGVRPDTRAVINQLTIPLE

SEQ ID NO: 22557 - DNA, 810 bp, Pseudomonas putida
  CDS (1)..(810)
atgattcgaggttccactgaactggtcgccatcgtcggttcgcccatcgcccaggtgaagtccccgcaaaacttcaacacctggttcaaccacaacaactgcaacctcgccatgctgcccatcgacctgcacgaggcggcgctggacagctttgcggataccctgcgtggctggcagaacctgcgcggttgcgtggtcaccgtgccttacaagcaggcgctggccaaccgcgtggacggcctgagcgagcgcgcggctgccctgggctcgatcaatgtgatacgtcgcgagcgcgacggacgcctgctgggcgacaatgtggacggcgccggcttcctcggcgctgcgcacaagcatggcttcgagccggcgggcaaacgggcactggtgatcggttgcggcggtgttggcagtgccattgcctatgcactggctgaggcagggatcgccagcataaccctctgcgaccccagcaccgcacgcatgggtgcggtatgcgaactgctcggcaacggcttccccgggcttacggtcagcacacagttcagtgggctggaagacttcgacctggtggccaacgcgtccccagtcggcatgggcacccgcgcagagctgccgttgtccgccgccctgctggctaccctgcagccagacaccctggtcgccgacgtggtcacctcacccgagatcaccccgctgctgaaccgcgcgcggcaagtaggttgcaggatccagactggcccggaaatggccttcgcccaactgggccaccttggcgccttcatgggcgtcacaccgttggagatctga

SEQ ID NO: 22558 - protein, 269 aa, Pseudomonas putida
MIRGSTELVAIVGSPIAQVKSPQNFNTWFNHNNCNLAMLPIDLHEAALDSFADTLRGWQNLRGCVVTVPYKQALANRVDGLSERAAALGSINVIRRERDGRLLGDNVDGAGFLGAAHKHGFEPAGKRALVIGCGGVGSAIAYALAEAGIASITLCDPSTARMGAVCELLGNGFPGLTVSTQFSGLEDFDLVANASPVGMGTRAELPLSAALLATLQPDTLVADVVTSPEITPLLNRARQVGCRIQTGPEMAFAQLGHLGAFMGVTPLEI

SEQ ID NO: 22559 - DNA, 849 bp, Pseudomonas putida
  CDS (1)..(849)
atgagccagcaagccatcctcgccggcctgatcggccgcggcatccaactgtcacgtaccccggccctgcacgaacacgaaggcgacgcccaggccctgcgctacctgtaccggctgatcgacgccgaccagttgcaactggacgacagcgccctgcccggcctgctcgaagccgcgcaacataccggtttcaccgggctgaacattacctacccgttcaagcaggcgatcctgccgttgctcgacgagctgtccgacgaggcccgtggtatcggcgcggtaaacaccgtggtgctcaaggacggcaagcgcgtcggccacaacaccgattgcctgggctttgccgaaggcttgcgccgtggcctgcccgacgttgcacggcgccaggtggtgcagatgggtgccggtggcgctggctcggccgtggcccatgccctgctgggtgaaggggtagaacggctggtgctgttcgaagtggatgcgacccgtgcgcaggcgttggtggacaacctgaacacccatttcggcgcggagcgcgccgtgcttggcaccgacctggccacagccttggccgaagcggacgggctggtcaacaccacgccggtgggcatggccaagctaccgggcacgccactgccggtggagttgttgcatccccgcctgtgggtggcagagatcatctacttcccgctggagaccgaactgctgcgcgcggcccgggcactgggctgccgcacgctggatggcagcaacatggcggtgttccaggcggtgaaggcattcgagctgttcagcgggcggcaggcggatgcggcgcggatgcaggcgcactttgccagtttcacctga

SEQ ID NO: 22560 - protein, 282 aa, Pseudomonas putida
MSQQAILAGLIGRGIQLSRTPALHEHEGDAQALRYLYRLIDADQLQLDDSALPGLLEAAQHTGFTGLNITYPFKQAILPLLDELSDEARGIGAVNTVVLKDGKRVGHNTDCLGFAEGLRRGLPDVARRQVVQMGAGGAGSAVAHALLGEGVERLVLFEVDATRAQALVDNLNTHFGAERAVLGTDLATALAEADGLVNTTPVGMAKLPGTPLPVELLHPRLWVAEIIYFPLETELLRAARALGCRTLDGSNMAVFQAVKAFELFSGRQADAARMQAHFASFT

SEQ ID NO: 22561 - DNA, 825 bp, Pseudomonas putida
  CDS (1)..(825)
atggaccagtacgtcgtttttggtaaccccatcggccacagcaagtcgccgctgatccaccgcctgttcgccgagcagaccggtcaggacctggaatatgccacgctgctggcgccgctggacgagttcagcgactgcgcgcgcggcttcttcaagcaaggcagtggcggcaatgtcaccgtgccgttcaaggaagaggccttccgcctgtgcgacagcctgaccccacgtgcccggcgcgcaggcgcagtgaacacgctgagcaagctggctgatggcaccctgcagggcgacaacaccgacggcgctggcctggtgcgcgacctgacggtgaatgccggggtcgagctggcgggcaagcgcattctcatcctcggtgccggtggcgccgtgcgcggcgtgctggagcctattctggcgcacaagccgcagtcgctggtgattgccaaccgtaccgtggaaaaggccgaacagctggcgcgcgagttcgatgaactggggccggttgtggccagcgggtttgcctggttgcaggagcctgtggatgtaatcatcaacgccacctcggcgagcctggccggggagttgccaccgattgccgacagcctggtcgaggcgggtcgtacggtttgctacgacatgatgtatggcaaggagccgacgccgttttgccagtgggctaccaagctgggggctgccaaggtactggatgggttggggatgctggctgagcaggcagctgaagccttctttatctggcgtggcgtgaggccggatacggcgccggtgttggctgaactgcgccggcaactcgctcggggctga

SEQ ID NO: 22562 - protein, 274 aa, Pseudomonas putida
MDQYVVFGNPIGHSKSPLIHRLFAEQTGQDLEYATLLAPLDEFSDCARGFFKQGSGGNVTVPFKEEAFRLCDSLTPRARRAGAVNTLSKLADGTLQGDNTDGAGLVRDLTVNAGVELAGKRILILGAGGAVRGVLEPILAHKPQSLVIANRTVEKAEQLAREFDELGPVVASGFAWLQEPVDVIINATSASLAGELPPIADSLVEAGRTVCYDMMYGKEPTPFCQWATKLGAAKVLDGLGMLAEQAAEAFFIWRGVRPDTAPVLAELRRQLARG

SEQ ID NO: 22563 - DNA, 885 bp, Lactobacillus plantarum
  CDS (1)..(885)
atggaaaaacgaatttcaggtaccactggtttatttaccttactcggctctccagtaggtcattcaggttcaccggcaatgtataactttagctttcaagagcaaggattagactatgcatatttagcttttgatgttaaaaaagcacaaatgccagaagcgattgatgcaatacgattatttaaggttcgcggtagcaacgtaacgatgccatgtaagggcgttgccgcaacacttgttgatgagttgtcaccggccgcaaagattgtgggggctattaatgtcattgttaacgataatggtaagttgacaggtcatattacggatggcattggttttgtacgcaatctgaaagagaacggtgtagatattgctggtaaaaagctagtcgtgattggtgctggtggtgctgctacggcgctacaagttcaatgtgcattagatggtgctaaatcattggctatttttaaccgtgaggacgacttttatgcgaatgccgaaaacactcaaaagaagattaaggaagcaaagccagaagtcgacgttaacgtctatcatctagaagaccaagacaagttaaaagctgagattgagaaggctgatattctggttaacgctactattgttggtatgaagccgctggacggtcaatcattagtcgatccaagctatttacgttcagacttggttgttgcggatactgtttacaaccccctaaagaccaagttaattgaagacgccgaggcattaggatgcacggtagcgccggggaaaggcatgttattgtggcaaggtgatgcagcatacacactctttacaggtaaggctatgccaacggccgaatatcaagcctacgaagcacgtcaagcagctaagcggcattag

SEQ ID NO: 22564 - protein, 294 aa, Lactobacillus plantarum
MEKRISGTTGLFTLLGSPVGHSGSPAMYNFSFQEQGLDYAYLAFDVKKAQMPEAIDAIRLFKVRGSNVTMPCKGVAATLVDELSPAAKIVGAINVIVNDNGKLTGHITDGIGFVRNLKENGVDIAGKKLVVIGAGGAATALQVQCALDGAKSLAIFNREDDFYANAENTQKKIKEAKPEVDVNVYHLEDQDKLKAEIEKADILVNATIVGMKPLDGQSLVDPSYLRSDLVVADTVYNPLKTKLIEDAEALGCTVAPGKGMLLWQGDAAYTLFTGKAMPTAEYQAYEARQAAKRH

SEQ ID NO: 22565 - DNA, 885 bp, Lactobacillus plantarum
  CDS (1)..(885)
atggaagcacgaattgatggacacacaactatgctaggccttttcggctcgccggttggccattcaggctcaccagcaatgtataactacagttttgaaaaggcaggtattaatgatgcatacctggcttttgacattcaggctgatgaaatggccagtgcgttaactaaaatgcgcgttttaaatatgcgtggtgctaacgtaacgatgccttgtaaaaaggttgctgcagaattagttgatgaattgtcaccagctgcagaattaatcggtgctgtgaatacgattgtcaataatgatggcgtgttagttggtcataatacggacggtgcgggctatgttgaaaatctacgccagcatggtgttgacccacagggaaagcgccttacggtgttaggtgctggtggtgctgctacagcaattgccgttcaaatggcactagatggcgctcaggcgattcatatctttaatcctaaggactcgttttatcaaaatgctgagttaacggctcaaaagatcatggataaagttcccgcatgccaagttactgtaggcgatattaatgaccaggaagtcttgacacaagcaattgcacaaagtgatattttggctaacgcaaccaaggccggtatggcaccgaatgttgaacaaactaatattaaggatatgaccgtttttcgttctgatttagttgtgacagatactgtttataatcctgctaccacaaaaatgttagcagatgcagctgaacatggaagcaaaacaattggcggtaaggggatgctggtttggcaaggtgccgcagcgttcaaattgtacacaggccaagaaatgcccgttgaagaagtaacgcaacggttcttctcagatgatgggggacgttaa

SEQ ID NO: 22566 - protein, 294 aa, Lactobacillus plantarum
MEARIDGHTTMLGLFGSPVGHSGSPAMYNYSFEKAGINDAYLAFDIQADEMASALTKMRVLNMRGANVTMPCKKVAAELVDELSPAAELIGAVNTIVNNDGVLVGHNTDGAGYVENLRQHGVDPQGKRLTVLGAGGAATAIAVQMALDGAQAIHIFNPKDSFYQNAELTAQKIMDKVPACQVTVGDINDQEVLTQAIAQSDILANATKAGMAPNVEQTNIKDMTVFRSDLVVTDTVYNPATTKMLADAAEHGSKTIGGKGMLVWQGAAAFKLYTGQEMPVEEVTQRFFSDDGGR

SEQ ID NO: 22567 - DNA, 885 bp, Lactobacillus plantarum
  CDS (1)..(885)
atggcagaacgaattgatgggcatactttactgattggtttaatggcgtatccaattcgtcattcaatgtccccaactatgcataacaatgcttttgctaaattaggactaaattacgcttacttagcatttgaagtgacgaatgaaacgctgccaagtgcaattgagtcaatcagaacacttgatatgcgtggctccaatatttcaatgccaaacaagcaaaaagtgattccattgcttgataagcttgatccagcagctaaaatggtgggtgcggttaatacaattgttaatgatgatggtgttttaacaggttatacgactgatggcatcggatttatgaaagcgctcgcggatgaaggcttggatattcgcgaacataaaatgacgctagctggtgctggtggtgccgggactgcgatcgcagtgcaggctgcattggatggtgtcaaagaaatatctatttttaatatgcacgatgcaacatgggcaaatgccgaacggaacgttaaactaattaatgagcagaccgactgtcacgccactttacactcattagaagatcgtgatgatttcaaacgggaaatccaaagctcttatatctatactgattcgacaggtgttggaatgaaaccacttgaagataagacgcttgtggacgatcctagttggttcagctcagaccaaattgtgtttgatacagtatatgcaccacgaacgactaaattaatgaaggtagctcgtcaagcaggattgaagcatgtttacaatggtttaggtatgatgcttgaacaaggtgcagcagcctttaagctgtggactggcgaagacatgccagttgattacattcatcagattctgtttagtgatgatcaggataaataa

SEQ ID NO: 22568 - protein, 294 aa, Lactobacillus plantarum
MAERIDGHTLLIGLMAYPIRHSMSPTMHNNAFAKLGLNYAYLAFEVTNETLPSAIESIRTLDMRGSNISMPNKQKVIPLLDKLDPAAKMVGAVNTIVNDDGVLTGYTTDGIGFMKALADEGLDIREHKMTLAGAGGAGTAIAVQAALDGVKEISIFNMHDATWANAERNVKLINEQTDCHATLHSLEDRDDFKREIQSSYIYTDSTGVGMKPLEDKTLVDDPSWFSSDQIVFDTVYAPRTTKLMKVARQAGLKHVYNGLGMMLEQGAAAFKLWTGEDMPVDYIHQILFSDDQDK

SEQ ID NO: 22569 - DNA, 894 bp, Lactobacillus plantarum
  CDS (1)..(894)
atgattgatggacaaacggcactctttggatttatcgcgcaccccgcgcggcacagtcgctcaccgcgaatgcataatttgagttttgactactgggggctaaatgcgcgctacttggcgtttgatgtggcaccggatggattggctggtacgcttgctggaattcgtagcatgggtatcgcgggggtgaacctttcaatgccattcaaacaaaccgttgtaccgctactagatggtttgacagtgcgagcgcaacggattcaagcggtcaatacgattaagaatgaagctggcaagctgattggtgacagcacggacggcgctggagtttttcaggatctcttacatcaaggtctgaacttggttgataagcacgtcatggttttaggcgcgggaggcgcaggtaaggcaatcattgcggcggctttagattatggtgtcgcgagtgtaacggtctttaaacgcaacaacgaacgctacgccggtgttcagcactggttggagcaactcagtaccacgacttcggtaccactccggctctgtgcctatgaagaccaagtacggatgcagcaagttgctcgtaccagcaatttgatcattaacgcgaccaatatcggcatgacgactgctggaacgccattaccaatctcaattatccagcaattagtcccacaacagacggtctatgatgtgatttaccaaccgctagaaacgacctttttgcgcttagcgcgtcagcaggggtgcgccacatataatggtttggggatgttgatttggcaaggtgccttggcttttgagttttggactggtaagcagatgccagttcaacaggtccgccaagatatgttagccagtattcaagcgactccgccgattacggcgcaggcttag

SEQ ID NO: 22570 - protein, 297 aa, Lactobacillus plantarum
MIDGQTALFGFIAHPARHSRSPRMHNLSFDYWGLNARYLAFDVAPDGLAGTLAGIRSMGIAGVNLSMPFKQTVVPLLDGLTVRAQRIQAVNTIKNEAGKLIGDSTDGAGVFQDLLHQGLNLVDKHVMVLGAGGAGKAIIAAALDYGVASVTVFKRNNERYAGVQHWLEQLSTTTSVPLRLCAYEDQVRMQQVARTSNLIINATNIGMTTAGTPLPISIIQQLVPQQTVYDVIYQPLETTFLRLARQQGCATYNGLGMLIWQGALAFEFWTGKQMPVQQVRQDMLASIQATPPITAQA

SEQ ID NO: 22571 - DNA, 771 bp, Clostridium tetani
  CDS (1)..(771)
atgaagtacacaggattattaggaaaaaatatatcttactcacaatcacctaagattcataatgaatattatgaaaaaaacaatattccatttaaatataaaatatttgatgtaaatgaagatgagctattttactttatagatacattatacagaaaaaacatagtaggatttaatgtaactataccttacaaaactaagattttaaaatatatagaaaagcttgtatacccagctgataaaataggagcagtcaatacggttgtagtgctaaaagacaaattaattggatttaatactgattactatggctttactgaaagtctaaaaagaagaaatgttgaattaagagataagaatgcattaattataggaaatggcggttcagctctttgtgtttattatgcattaatggacatagggtgtaaaaatttagatgttttatgtagaaataaagataaaaacatagaaaaattgaaagaaataagatgtttttacgatttttatgatattataaaatatgaacagtatgatataataataaattgtactcctttgggaggaaacaactatataaaaaatcttccaataaatttagaaaaaattaaattaaaaaaagatgtgataatatacgatttaaattataagacacaagatactatttttataaatcaggcaaaaagtatgaatataatggcaattaatggagaagatatgttaagactccaggcttataaggctattgatatatggggaatatatatatattaa

SEQ ID NO: 22572 - protein, 256 aa, Clostridium tetani
MKYTGLLGKNISYSQSPKIHNEYYEKNNIPFKYKIFDVNEDELFYFIDTLYRKNIVGFNVTIPYKTKILKYIEKLVYPADKIGAVNTVVVLKDKLIGFNTDYYGFTESLKRRNVELRDKNALIIGNGGSALCVYYALMDIGCKNLDVLCRNKDKNIEKLKEIRCFYDFYDIIKYEQYDIIINCTPLGGNNYIKNLPINLEKIKLKKDVIIYDLNYKTQDTIFINQAKSMNIMAINGEDMLRLQAYKAIDIWGIYIY

SEQ ID NO: 22573 - DNA, 990 bp, Bradyrhizobium japonicum
  CDS (1)..(990)
atgatatggccgcgacctgacggcgcgcaccttctcaagccggcgccgcatcacggccttgcggaagcgctgtgcgggaatcgtgcccgcgcgcttgacagagcccgcgggacgcgaaatggatcgcctccgatacgatccggggagaagatgaccgtgaccaaggctcccgcagcctgtttgatcggatggcccgccgcgcattcgcgctcgccgctgatccatcattattggctgcgcacgctcggtatcgccggcggctatgtcatcgaggccgtcccgcccgaggatctccgcgatttcgtgctgcggctgtcgctgcgcggcttcgtcggcgccaacgtcaccatcccgcacaaggagggcgtgctggcgctgtcgacgccagatgcgcgcgccaaggccgtcggcgccgccaacacgctgtggttcgaggacggcgagctgcgctcgaccaacaccgacgtcgagggcttcatcaacaatctcgatgccagcgcgcccggctgggacacggccgaggaggcgctggtgctcggggccggcggctccgcgcgcgcggtcgtgttcggcctgcgcgagcgcggcatcaaacgcatccatctcgccaatcgcaccatcgcgcgggccgagacgctggcgaagcagttcgggccgaacgtgcagcccgttacgtgggacgggatcgacgacgtgctgccgcgtgcaaaacttctcgtgaacacgacctcgctcggcatgcgcggtcagccttcactcgatgttgatgttgcacgcctgccgcaggcggccgtcgtcgccgatctcgtctatgtccccctggtgacgccgctgctcgccgcagcaaaggcacgcggcctcaggaccgccgacggtctcggcatgctgctgcaccaggccgtgcgcggcttcgagctgtggttcggccggcggccgcgggtcacggacgagctgcgcgcattggtcgaggccgatctcacaaagtcttga

SEQ ID NO: 22574 - protein, 329 aa, Bradyrhizobium japonicum
MIWPRPDGAHLLKPAPHHGLAEALCGNRARALDRARGTRNGSPPIRSGEKMTVTKAPAACLIGWPAAHSRSPLIHHYWLRTLGIAGGYVIEAVPPEDLRDFVLRLSLRGFVGANVTIPHKEGVLALSTPDARAKAVGAANTLWFEDGELRSTNTDVEGFINNLDASAPGWDTAEEALVLGAGGSARAVVFGLRERGIKRIHLANRTIARAETLAKQFGPNVQPVTWDGIDDVLPRAKLLVNTTSLGMRGQPSLDVDVARLPQAAVVADLVYVPLVTPLLAAAKARGLRTADGLGMLLHQAVRGFELWFGRRPRVTDELRALVEADLTKS

SEQ ID NO: 22575 - DNA, 828 bp, Bradyrhizobium japonicum
  CDS (1)..(828)
atgagcgatcgttacgcggtgatcggcaatccgatcggcttcagcaaatcgcccctcatccatggcactttcgccaagatgacgggacaggaccttgtctatgaggcgatcgaggccccactcgatggcttcaacgcacgagttgatcaattccggagagagggcgccaaggggctgaacatcacggccccgttcaagctcgatgctttcgcctacgcaaacgagctttcagagagcgccgaccgagctggcgccgcaaactgcttgaagttcgacggcgataggatcattgccgagaatttcgacgggatcggccttgtgcgcgacatcacggtcaatctcggggtcaagatggccggccggcgcgtcctgatgctcggtgccgggggcgcagcgcgtggcgcgctgctgccgttcctgcgtcaggagccatccgagctggttctcgtcaaccgaacgctgtcaaaagcggtggcactggccgaagagtttgccggttgtggacccctgatcgtcagcggctatactgaactggccgatcttgccgaaggctatgacgtcgtgatcaacgcgacatcggccagcctgcggggtgagatgccgccgcttccaggcaatgtcttccgcggtgcggagctggcgtacgagctcgcctacggcaaggggctcactccctttttgcaagcggcccgcgccgaaggcgtagccaagctggcggacggcgtcggcatgctggtggagcaggcggcggaagcttttgcctggtggcgcggcgttcgaccgagcacggctcaggtcatcgccgaactgactgtccccttgagctga

SEQ ID NO: 22576 - protein, 275 aa, Bradyrhizobium japonicum
MSDRYAVIGNPIGFSKSPLIHGTFAKMTGQDLVYEAIEAPLDGFNARVDQFRREGAKGLNITAPFKLDAFAYANELSESADRAGAANCLKFDGDRIIAENFDGIGLVRDITVNLGVKMAGRRVLMLGAGGAARGALLPFLRQEPSELVLVNRTLSKAVALAEEFAGCGPLIVSGYTELADLAEGYDVVINATSASLRGEMPPLPGNVFRGAELAYELAYGKGLTPFLQAARAEGVAKLADGVGMLVEQAAEAFAWWRGVRPSTAQVIAELTVPLS

SEQ ID NO: 22577 - DNA, 855 bp, Bradyrhizobium japonicum
  CDS (1)..(855)
atgcatcccaaatccagctttctcgtcggtctgatcggcagcggcatcgctgcgtctcgcaccccgcccatgcatgaagcggctgctgacgccgcgggcatccgctatctctacaagaagatcgatctgaccgagttgaagcttggtgccgaagcgctgccggacttgctcacggctgcaaggcggatgggcttcgacgggctgaacgtgacccatccctgcaagcaggcgattcttccgctcctggacgagctttcgcccgacgcggaggcgcttggcgccgtgaacaccgtggtcatcaggaacggtcgaatgaccggccacaacaccgactggttcggcttcgccgagaactttcgtcgcaacatgcaaggtgcaccactcggtcgggtcgttcaattcggcgccggcggagcgggcgccgcggtcgctttcgcgctgatgaagctcggcctgcaggaactgaccattatcgacgtcgacttggccaaggcacagagtttggtggatagcttgtccccccgatttgccgaagggcgcttaagggccggccgggatatcgctgcggacgtggctgccgcagacgggattgtaaatgcgacgccgatcggcatggacaaatatccaggcacgccgctgtcgacggctctgctgcgtcccgatctgtgggtcgccgagatcgtctacttcccgctggaaaccgccctgctgcgcgcggcgcgtgccctcggctgccgcaccgtcgatggtggtggcatggcgatcttccagggcaccgaagcattccgcctattcacgggcatctcacctgatccagacgtcttcttcgccacttttgcatccctgggagggtga

SEQ ID NO: 22578 - protein, 284 aa, Bradyrhizobium japonicum
MHPKSSFLVGLIGSGIAASRTPPMHEAAADAAGIRYLYKKIDLTELKLGAEALPDLLTAARRMGFDGLNVTHPCKQAILPLLDELSPDAEALGAVNTVVIRNGRMTGHNTDWFGFAENFRRNMQGAPLGRVVQFGAGGAGAAVAFALMKLGLQELTIIDVDLAKAQSLVDSLSPRFAEGRLRAGRDIAADVAAADGIVNATPIGMDKYPGTPLSTALLRPDLWVAEIVYFPLETALLRAARALGCRTVDGGGMAIFQGTEAFRLFTGISPDPDVFFATFASLGG

SEQ ID NO: 22579 - DNA, 804 bp, Bradyrhizobium japonicum
  CDS (1)..(804)
atgatcccggccccgtcaggcgccacgcggctccacgtcatcgtcggtgatcccatcgcgcaggtgcgctcgcccgcgggcgtgtcagccgccttcgccgcacgggggcacgacggtattctcgtgcccgttcaggtcgccccgggggatttgcccgacttcctctcggtggcggcgcgattgaaaaatctcgacggcatcgtcgttaccatcccgcacaaatttgcctgctaccaggcctgcacgagtgcgaccgatcgggcgcacttcctgcgcaccgtgaacctgatgcgccggcgcgccgacggctcatggcatggcgatatggtggatggcctcggcttcgtcggcgcagcgcgggcaaaggggatcgatcccggcggcatgcgcgcccttctggtcggcgccggcggcgccggctcggcgatcgcgctcgcgctggtcgaggccggcgtcggtgagctcgccattcacgacagcatggccgagcgccgcgacgcgctgatcggccggctcaatgggctcggcaaagcgccggtgcggaccggcaccatggaccccgccggcttcgacttcgtcgccaatgcgacgcccgccgggatgaaggacggcgacccgctgccggtcgacgtcgcgcgccttgcgccagccgcctattgcggctgcgtcatcaccaggccccaagtctcccccttcatcgccgcggctcgcaagatcggctgtgtcaccgggaccggtaccgacatgtaccagcagcaccagagcatcatggtggatttcctgctgggagcggaggctgggtga

SEQ ID NO: 22580 - protein, 267 aa, Bradyrhizobium japonicum
MIPAPSGATRLHVIVGDPIAQVRSPAGVSAAFAARGHDGILVPVQVAPGDLPDFLSVAARLKNLDGIVVTIPHKFACYQACTSATDRAHFLRTVNLMRRRADGSWHGDMVDGLGFVGAARAKGIDPGGMRALLVGAGGAGSAIALALVEAGVGELAIHDSMAERRDALIGRLNGLGKAPVRTGTMDPAGFDFVANATPAGMKDGDPLPVDVARLAPAAYCGCVITRPQVSPFIAAARKIGCVTGTGTDMYQQHQSIMVDFLLGAEAG

SEQ ID NO: 22581 - DNA, 810 bp, Bradyrhizobium japonicum
  CDS (1)..(810)
atgatcaacctcaacctgaccggcgccacgcgcctcaacatcatcgtcggcgaccccatcgcccaggtgaaatcgccggccggcgtcacgcaggccttcatcgaccgcggctatgacggcatcctggtgccggtgcagatcaacggcgcccgtctcaagacgttcctggcggccgcgaccgatgtccgcaatctcgacggcatcatcgtcacggtcccgcacaaatttgcctgctacgaattctgcgcaacctcgaccgaccgcgcccgtctactcggctcggtcaatatcatgcgccgacgccgcgaaggcggctggcatggcgaccacgtcgacgggctcggctttgtcggagctgtacgcgccaacggctacgacccgaccggtaagtgcgcgctgctggtcggcgcgggtggcgccggatcggcgatcgccatggcgctggtcgaagccggcgttcgctcgctggccattcacgacaatgaagctgcccgccgggaccagctgatcgcgaagctggccacactcggcaaggctgggatcgggccaggctcggccgatccgtccggcttcgaactcgtcgccaacgcaacgccgctcggcatgaaggccggagacccgcttccgctcgacgcatcgaagctcaaagccagcacgttcgtcggctgcgtcatcaccagcccggcggtctcgccgctcgtcgaggcggcgcggcgcctcggctgcaagacgtcgacgggcactgaaatgtacaacgcactgcagagctcgatggtcgacttcctgctcgcgcacgacggatcgaggtga

SEQ ID NO: 22582 - protein, 269 aa, Bradyrhizobium japonicum
MINLNLTGATRLNIIVGDPIAQVKSPAGVTQAFIDRGYDGILVPVQINGARLKTFLAAATDVRNLDGIIVTVPHKFACYEFCATSTDRARLLGSVNIMRRRREGGWHGDHVDGLGFVGAVRANGYDPTGKCALLVGAGGAGSAIAMALVEAGVRSLAIHDNEAARRDQLIAKLATLGKAGIGPGSADPSGFELVANATPLGMKAGDPLPLDASKLKASTFVGCVITSPAVSPLVEAARRLGCKTSTGTEMYNALQSSMVDFLLAHDGSR

SEQ ID NO: 22583 - DNA, 789 bp, Bradyrhizobium japonicum
  CDS (1)..(789)
atggagatcaccggcaagaccaagatcatgttcgtgctggcgcacccggtcgaccatgttcgcgcaagcgctgtcttgaacacctattttcagtccatcgacgacgacgtggcggtatcgccgcttcatgtgctgccggccgatctgggggcagttctcgcgagcgtcaggctgatgcgcaatgtcgtcggctttggtgtcacgatcccgcacaagacaggcgtgatcgaacatctggatgagacgacgccaacggcggcgctcatcggcgccgtcaatttcgtcaagcgaacggctgacggacgcctcatcggcgacaatctggacgcgcggggttttgtcgccagccttgcgcagcatcagattgcggttcgtggccggaaagtgctccaggtcggagcaggcggtgcggggcgcgcaaccgcattcggcctggccgaggccggcgcacgcgagctgaccatcatgaatcgggatggagcgaaggcgcatgcgctcgccgaggcggtgtcacggcgctatccggagacgaaggtcaatgccgggcgcgctgaggcacgcgcgttcgacctcatcgtcaatacgacgtcgctcggcatgaagacggatgaccctctgccgctcgatatcgagggagtgggtcccgcgaccgccgtcagcgacatcatcgtcacccccgaggtgacccggcttctggaacaggccgcagctcagggcgcgagaaccatcggcggcaagccgatgctcgacgcgcaaatggcccttgtcgcgcgctttattgcgcgatag

SEQ ID NO: 22584 - protein, 262 aa, Bradyrhizobium japonicum
MEITGKTKIMFVLAHPVDHVRASAVLNTYFQSIDDDVAVSPLHVLPADLGAVLASVRLMRNVVGFGVTIPHKTGVIEHLDETTPTAALIGAVNFVKRTADGRLIGDNLDARGFVASLAQHQIAVRGRKVLQVGAGGAGRATAFGLAEAGARELTIMNRDGAKAHALAEAVSRRYPETKVNAGRAEARAFDLIVNTTSLGMKTDDPLPLDIEGVGPATAVSDIIVTPEVTRLLEQAAAQGARTIGGKPMLDAQMALVARFIAR

SEQ ID NO: 22585 - DNA, 840 bp, Bradyrhizobium japonicum
  CDS (1)..(840)
atgtcgcaggacggatttggactggcgggtgtcatgggcatgccggtcgcgcattcgcgctcgcccatcattcataattattggctgaaggcgcacggcatccgcggcagctatgtcccgctggcggtgaagccggagcggctggaggatgcgcttgacgggctgattgcgctcgggttccgcggctgcaatgtcaccatgccgcacaagcagacggcgatgccgctgctgacccgcgtcaacgagaccgcgaagcgcatcggcgccgtcaacaccatcgtcgtcgaggcggacggcacgctctccggcttcaacaatgacggcaacggttttgtgcagagcctgcgcgacgccaaggctgactggcgcggcgatgccgggccgatcctgctgctcggggcaggcggcgcctcgcgcgccgtggtggtggcgctgctcgaaaatggcgcgcgcgagatccgcatcgccaaccgcacggccgagaaggcgcaggcgctcgccagggatttcggctccgccgtcagcaccattgcgtgggacgaccgcggcgctgcgctcggcgatgtcgccctgctcgtcaactgcaccgatcgcggcatggtcggcaaggccgcgctggagatcgacctgtcgcgcctgcggccggaaacgctcaccgccgatctcatctacacgccgctggaaacgccgttcctcgccgaagcccgcgcgcgcggctgcgtcacggtcaacgggctgggcctgctgctgaaccaggctaggctcgccttcaaggcttggttcggtgtcatgcccgacgtgacgccagagctgatcaaggccatcgaagcgacgttctga

SEQ ID NO: 22586 - protein, 279 aa, Bradyrhizobium japonicum
MSQDGFGLAGVMGMPVAHSRSPIIHNYWLKAHGIRGSYVPLAVKPERLEDALDGLIALGFRGCNVTMPHKQTAMPLLTRVNETAKRIGAVNTIVVEADGTLSGFNNDGNGFVQSLRDAKADWRGDAGPILLLGAGGASRAVVVALLENGAREIRIANRTAEKAQALARDFGSAVSTIAWDDRGAALGDVALLVNCTDRGMVGKAALEIDLSRLRPETLTADLIYTPLETPFLAEARARGCVTVNGLGLLLNQARLAFKAWFGVMPDVTPELIKAIEATF

SEQ ID NO: 22587 - DNA, 879 bp, Bradyrhizobium japonicum
  CDS (1)..(879)
atgtcgaagcgcggatacgccgccagcaagaaactcctcaccggcctgatcggcgcgccgatcgcgcattccgcttcccccgccatgcatgagcgcgccgccgaggcgctcggcctgcgcggtcactaccagctgatcgaggtcgcaggcgccgacgcggccggactgaggctgatgctcgaaggcgtgcggcggctcggctttgccggcgtcaacgtgacctatccttacaaggaagcggtggtcccactgctcgacgcactggcgccgggcgccgccgcgatgggcgcggtcaacaccgtcgttgtcagggacggccgcctgaccggccacaacaccgacaccaccggctttgcgcgcgcggtggcgccgctgctggcgccgtctggaaatgcggttgccgtgatcggcacgggcggcgtcggcaaggcgatcgccttcgcactggcgagccttgaggtcgccgacctccgcatcttcgactccgaaccggcgcgggccgaaaaacttgccgcactgcttgccaagcatggcggcgccagggtcgcgaaaagcgtcgaggacgcgctcgacggcgcgaccggcctcgtcaacggcacgccggtcggcatgctgccgaaccgcggcatgcctgttccggctgcgctgctgcacgagaagctctgggtggccgacgccgtctattcgccgctgatcacgccgctgctggccgcggcgcaggagcgcggcgcgaagatcatgaccgggcgggagcttgcgatctaccaggccgccgacgctttcgaactgttcaccggccttgccccatcgaccgaagtcatgggagaggcttttgacgaggtgatggcggcacgaagctcagcctatcacgcagcgtaa

SEQ ID NO: 22588 - protein, 292 aa, Bradyrhizobium japonicum
MSKRGYAASKKLLTGLIGAPIAHSASPAMHERAAEALGLRGHYQLIEVAGADAAGLRLMLEGVRRLGFAGVNVTYPYKEAVVPLLDALAPGAAAMGAVNTVVVRDGRLTGHNTDTTGFARAVAPLLAPSGNAVAVIGTGGVGKAIAFALASLEVADLRIFDSEPARAEKLAALLAKHGGARVAKSVEDALDGATGLVNGTPVGMLPNRGMPVPAALLHEKLWVADAVYSPLITPLLAAAQERGAKIMTGRELAIYQAADAFELFTGLAPSTEVMGEAFDEVMAARSSAYHAA

SEQ ID NO: 22589 - DNA, 747 bp, Bacteroides thetaiotaomicron
  CDS (1)..(747)
atggaaaaatacggtttaatcggctaccccttgcgacattcgttttcaatcggctactttaacgaaaagtttaggtccgaaggcatcaatgcggaatatgtgaatttcgagattcccaatatcaatgattttatggaagttattgaagagaatcccaacttgtgcgggctcaatgtcaccatcccctacaaagagcaagtgattccttttctgaacgaactcgatcgggatacagctaaaattggcgctgtaaacgtcattaagattatccgccaaccgaaaggaaaagtaaaactggtcggctacaattccgacatcatcggttttacacaatctattcagccgctgctacaacctcagcacaaaaaagcactgatcctcggcaccggaggtgcttccaaagctgtttatcacggactcaagaatctgggtatcgaaagcgtgtttgtatcgcggacacacaagaccgacgatatgctgacttacgaagaactgactccggaaatcatggaggaatacaccgtaatcgtcaactgtactccggtaggaatgtaccccaaagtagatttctgccccaacattccttacgaactgctcactccaaaccatttgctttacgatttgttatataatccgaacgtcactcttttcatgaaaaagggagaagcacaaggtgctgttacgaaaaacggtttggaaatgctacttttacaggcatttgccgcttgggaaatatggcaccgataa

SEQ ID NO: 22590 - protein, 248 aa, Bacteroides thetaiotaomicron
MEKYGLIGYPLRHSFSIGYFNEKFRSEGINAEYVNFEIPNINDFMEVIEENPNLCGLNVTIPYKEQVIPFLNELDRDTAKIGAVNVIKIIRQPKGKVKLVGYNSDIIGFTQSIQPLLQPQHKKALILGTGGASKAVYHGLKNLGIESVFVSRTHKTDDMLTYEELTPEIMEEYTVIVNCTPVGMYPKVDFCPNIPYELLTPNHLLYDLLYNPNVTLFMKKGEAQGAVTKNGLEMLLLQAFAAWEIWHR

SEQ ID NO: 22591 - DNA, 870 bp, Streptococcus mutans
  CDS (1)..(870)
atgcaaattgatggttatacacgtttagcagctgttgtcgcgacaccaattaaacattctatctcaccttttattcacaactacgcttttgaaaaaactggtatcaatggtgtttatgttgcttgggatattccagagtcagaactgcaagtaactttaaaaaatatcatgcgttatgatatgtttggcattaacatctccatgccttacaagcaggcagttattccttatcttgatgaagtaacgaaagcagcagatttaattggggctgttaatactattgttaatcgtgatggcagattgatcggttacaatacagatggttttggtttctttaagagtttgggaacctttgcagatttcgatgttgcagataaggttataaccatacttggtggcggaggagctgcaactgccattattgcacaagcagctatcaatggtgctaagaaaattaatatttttaatcaaacagcctttcttgaagaaacaaaagaaaaagctaaacaaatatcaagtaaaacaggcgctgctattgaagtgtttcctgttgaggacttaaacatgattcaaaaaaaggtattagtatctgatttatttgttaatgcgaccaatgttggtatggatggcaaatcaatgattattaatgatagttttgaatttccaccaaaccttatggttgcagatgtcatttatcaaccttttgaaacaccatttttacgcttagtacgcagtcgtgggttaaaggctgtgaatggtttgggcatgcttctttttcaggcggctgcagcttttgaactttggactggtaaagaaatgccgagtcaggaaatctggcaggctctagaaaaaaaatacaagtctaaataa

SEQ ID NO: 22592 - protein, 289 aa, Streptococcus mutans
MQIDGYTRLAAVVATPIKHSISPFIHNYAFEKTGINGVYVAWDIPESELQVTLKNIMRYDMFGINISMPYKQAVIPYLDEVTKAADLIGAVNTIVNRDGRLIGYNTDGFGFFKSLGTFADFDVADKVITILGGGGAATAIIAQAAINGAKKINIFNQTAFLEETKEKAKQISSKTGAAIEVFPVEDLNMIQKKVLVSDLFVNATNVGMDGKSMIINDSFEFPPNLMVADVIYQPFETPFLRLVRSRGLKAVNGLGMLLFQAAAAFELWTGKEMPSQEIWQALEKKYKSK

SEQ ID NO: 22593 - DNA, 879 bp, Streptococcus agalactiae
  CDS (1)..(879)
atgaattcattaaatggggaaactttactaactggtctaattgccaatcctgcacgccactctctatccccgttaatgtggaatacctcttttcaagaaaaaaacatgaattatgcctatctgacatttgaagtagaagagggtaaattaacagaagctgttcgaggtgtcagggcattgggtattcgtggtgttaatgtttcaatgccatttaaacagagtgttatccctttgctagatgatttatctcctcaagctaaattagtgggtgctgtaaatactatcgttaatcaaggtggaaccggacgtttagtaggccatatgacagatggcattggttgttttaaagctttagcagctcaaggtttcagtgctaaaaataaaataattacaatagctggtattggtggttcaggtaaagcagttgcagttcaagcagctatggagggagttgcggaaattagattatttaatcgtaacagctcaaattacgataaggtcattgacttatcagataaaattaaaaaacagtttcaaataaaggtagtcgttgattatctagaaaataagacagcatttaaagacgctattagaactagtcatttttatattgatgctactagtttaggaatgaggccattagataattatagtttaattaacgatccagaaattttaacaccgaatttagtagttgtcgacttggtttacaagcctaaagaaacagcattgttacgatttgttagacaaaatggagtgaaacatgcttataatggtctagggatgctgatttatcaaggagcagaagcatttcaattaataacgaatcaagaaatgcctattagcagtgttgagagagtattacaaactgaaaattaa

SEQ ID NO: 22594 - protein, 292 aa, Streptococcus agalactiae
MNSLNGETLLTGLIANPARHSLSPLMWNTSFQEKNMNYAYLTFEVEEGKLTEAVRGVRALGIRGVNVSMPFKQSVIPLLDDLSPQAKLVGAVNTIVNQGGTGRLVGHMTDGIGCFKALAAQGFSAKNKIITIAGIGGSGKAVAVQAAMEGVAEIRLFNRNSSNYDKVIDLSDKIKKQFQIKVVVDYLENKTAFKDAIRTSHFYIDATSLGMRPLDNYSLINDPEILTPNLVVVDLVYKPKETALLRFVRQNGVKHAYNGLGMLIYQGAEAFQLITNQEMPISSVERVLQTEN

SEQ ID NO: 22595 - DNA, 864 bp, Shewanella oneidensis
  CDS (1)..(864)
atgacagttacatccccaatagttgatcgctatgccgtatttggtcatccaatcggccacagtaaatccccctttattcatggccagtttgcggccttaacacaggaatctttgacctatgaagcgattctggcgcctattgatggttttgaagctagcttaaaaagctttttcagtagcggaggtaaaggtgccaatgtgacagttccctttaaagaacaagcttttgctctatgtgatagtttaagtgctgaggctgcactagcaggtgctgttaataccttaagcctgttggctgatggttcgatccgtggcgataacaccgatggtttagggttagttgccgaccttataagtcacctgggcagtttgcagcataagcgagtcttattagttggtgcaggcggcgcggcgcgtggatgtatcttgcctctgctcaacgccggagttggccagttggttatcacaaatcgcacccaaactaaggctaaggatttagtggatatttttagccaattagaagaggggatttacaaagataaacttcaagctttatctatgtctgagcttacgggggagtttgaattagtgatcaactcaacctcggccagtcttgcaggtgaattaccacccttgccccaatcaattatcggtagcactaccgtttgctacgatatgatgtatggcgcaatgcctacggcatttaaccaatgggcattacagcagggggctgctaaggtgattgatgggcttggaatgcttgtcggccaagcagctaagagctttgcgctctggcgcactgtcgagcctgacaccgctgtcgtgcttaaactgctcagggaaaaactacagttggacatctaa

SEQ ID NO: 22596 - protein, 287 aa, Shewanella oneidensis
MTVTSPIVDRYAVFGHPIGHSKSPFIHGQFAALTQESLTYEAILAPIDGFEASLKSFFSSGGKGANVTVPFKEQAFALCDSLSAEAALAGAVNTLSLLADGSIRGDNTDGLGLVADLISHLGSLQHKRVLLVGAGGAARGCILPLLNAGVGQLVITNRTQTKAKDLVDIFSQLEEGIYKDKLQALSMSELTGEFELVINSTSASLAGELPPLPQSIIGSTTVCYDMMYGAMPTAFNQWALQQGAAKVIDGLGMLVGQAAKSFALWRTVEPDTAVVLKLLREKLQLDI

SEQ ID NO: 22597 - DNA, 831 bp, Oceanobacillus iheyensis
  CDS (1)..(831)
atgacgttatctttaaaattgattggttatccaatagaacattcaatgtcaccatggattcataatgaatttctaaaacgttcaaatcttgaaggtacgtatgaactttttgaaataagcccggaagaaagctttgaagataatgtaacaacactcaaaaaatctgtcttgacgggttttaatgttacggtaccttataaacaaaagattatgcaattcttagatgaagttgatgatacagcaaatttaatgggggcagtaaatacggtatctattagagacgggaaatggattggatataatacagatggtataggttatttacgatctttatatgcagcatatcctttcttaaagggagtaacgaataagcgtgtattaatccttggagctggtggagcggcgcgtggtattttccatgccctagtaaatgaaggctataataatattaaaattgctaaccggactttaagccgagctgaatcaataattggaacaaataaacaagctttagcaatcagtttggaagaagctgcagaagagttacatcaatttgatttagttattcaaacgtctgccgttggaatgaatgaaccacgctcgattattatattagacaggattaatgaagatacggttgttagtgatatcgtatatcaaccgttagaaacccattttctgcaattagcaaaacaacgcactccctatattcaccatggacacactatgttgttatatcaagcacaagcagcttttgaaatatggacaggaacaaatgtcaatgtatccggaatggatatgcaaatcgaacaaatattgaaaggaagataa

SEQ ID NO: 22598 - protein, 276 aa, Oceanobacillus iheyensis
MTLSLKLIGYPIEHSMSPWIHNEFLKRSNLEGTYELFEISPEESFEDNVTTLKKSVLTGFNVTVPYKQKIMQFLDEVDDTANLMGAVNTVSIRDGKWIGYNTDGIGYLRSLYAAYPFLKGVTNKRVLILGAGGAARGIFHALVNEGYNNIKIANRTLSRAESIIGTNKQALAISLEEAAEELHQFDLVIQTSAVGMNEPRSIIILDRINEDTVVSDIVYQPLETHFLQLAKQRTPYIHHGHTMLLYQAQAAFEIWTGTNVNVSGMDMQIEQILKGR

SEQ ID NO: 22599 - DNA, 810 bp, Corynebacterium efficiens
  CDS (1)..(810)
atggtcaaccacgtcgacagggacaccaccctgtgtatttctcttgctgcacgtccgtccaaccacggggtccgcttccacaactggctctatgctgagctgggcctgaatttcctctacaaggccatcgccccggcggatatcaccgcggcggtggccggtatccgcgggttgaacatccggggtgcgggggtgtccatgccgtacaagggtgatgtgatcccgctgatcgatgcgcttgatccgagtgcggagcggatccggtcggtcaacaccattgtcaatgatgacggtcacctgaccggctacaacaccgattacaccgcggtgctcaacctgctcagggcccaccaggtcaacccggatctgcatgtggccctgcgtggttccggcgggatggccaacgccgtcatcgccgccctgaccgatcacgggatgcgcggcaccgtggtggcgcgcaatcacaccaccggtgcggccctggcccagcggtacggctgggagtactccgcgcaggtcccggagcacgcccaggttctggtcaatgtgaccccattgggaatgaatggacccgacgaggatgttgtagctttcgacagggatgagatcgaccgcgctgaggtcatcttcgactgtgtcgccttccccgtggagacccccctcatcaggctcgcgaggtcccagggtaagaagacgatcgacggtggagaggttgccgccctgcaggcagccgagcagttccacctgtacacgggcgtccgccccaccgatgagcagatcatcgccgctgaggagtacgcagcaccttaa

SEQ ID NO: 22600 - protein, 269 aa, Corynebacterium efficiens
MVNHVDRDTTLCISLAARPSNHGVRFHNWLYAELGLNFLYKAIAPADITAAVAGIRGLNIRGAGVSMPYKGDVIPLIDALDPSAERIRSVNTIVNDDGHLTGYNTDYTAVLNLLRAHQVNPDLHVALRGSGGMANAVIAALTDHGMRGTVVARNHTTGAALAQRYGWEYSAQVPEHAQVLVNVTPLGMNGPDEDVVAFDRDEIDRAEVIFDCVAFPVETPLIRLARSQGKKTIDGGEVAALQAAEQFHLYTGVRPTDEQIIAAEEYAAP

SEQ ID NO: 22601 - DNA, 855 bp, Corynebacterium efficiens
  CDS (1)..(855)
atgaaccacgacagtattctcctcggactgatcggcgaggacatctccctctcccgtaccccggccatgcacgaggcggagggcctcgcccagggcgcggcgaccgtctaccgacgcatcgacaccctcaccgaccgtgcccggggtcgctccctccaggagcttctcgacgccgcccgctccaccggtttcaacggcctcaacatcacccacccctacaagcaggcggtcctgccgctgctggatgaggtctccgagcaggccgcccagctgggtgcggtcaacaccgtcgtcatcggtgaggacggtcgcacgagcgggcacaacaccgatgtcaccgggttcgcccgcggactggaggagggcctgcccgacgccaccatgaccaccgtggtgcaggtcggcgccggcggcgtgggtaatgccgtggcctactccctggtcacccacggggtggaacagctgcaggtggcggacctggatccggcccgtgcgcaggcgctcgccgacgccatcaactctgccatcggtcgcgaggccgtccacggcatcgacgcccgtggtgtggaggaggccatcgccgccgcggacggcgtggtcaacgccaccccgatgggcatgctcgcccacccgggcaccgccttcgacacctcgtgcctgaccccacaccactgggtgggggatgtcgtgtacatgcccattgagactcagctgctcaaggacgcccgtgcgctgggttgccgcaccctggatggcacccgcatggcgatccaccaggcggtggatgccttccgcctgttcaccgggctggagcccgatgtggagcggatgcgcgcaacgttcctgtccctctag

SEQ ID NO: 22602 - protein, 284 aa, Corynebacterium efficiens
MNHDSILLGLIGEDISLSRTPAMHEAEGLAQGAATVYRRIDTLTDRARGRSLQELLDAARSTGFNGLNITHPYKQAVLPLLDEVSEQAAQLGAVNTVVIGEDGRTSGHNTDVTGFARGLEEGLPDATMTTVVQVGAGGVGNAVAYSLVTHGVEQLQVADLDPARAQALADAINSAIGREAVHGIDARGVEEAIAAADGVVNATPMGMLAHPGTAFDTSCLTPHHWVGDVVYMPIETQLLKDARALGCRTLDGTRMAIHQAVDAFRLFTGLEPDVERMRATFLSL

SEQ ID NO: 22603 - DNA, 831 bp, Corynebacterium efficiens
  CDS (1)..(831)
atgactgacaaacccacccaccgcgcggctgtactcggccaaccgatcggccattcacgctcgccggtgctccacaacgcgggttatgccgccctcggactggatgactgggcctatgatcgtttcgactgtgacgcggatgccctgcccggactggtaggtggtgcagatctgtcctaccgtggattctcggtaaccatgccggccaagttcgccgccctcgccttcgccgatgaggccaccgaacgagcccgtcgcatcggttccgccaacacgctggtgcgcaccgccaccgggtggcgtgccgacaacaccgatgtggacggcatccggggcgcgctggtcgaattgctcggcggtggggaactcgtcgacaagcgtgccgttgtggtcggtggtggcgggaccgcccggccggccatctgggcgctgctcgaagcgggcgtttcccacatcaccgtgatcaaccgcagcgaccgcaccggggagctgagcgagcttgtcgacgccttccccgccaccttgtcctacctcccgctggaggggggtgtggaggccgagaccacggccgcggcggtggtcatctccaccgtcccatcggcggccatcgaggggctggaggggaaactggcccacgcgccagtgctggatgtgatctatgatccctggccgaccccgttggtgactgtggcccggtcccggaacatccccgcagtgggcgggcatgtcatgctggcgcaccaggcctatggccagttcgagcagttcaccgggcaccccgccccgcgtgacgccatgcgcgcggccctggaggcctcactgggtatgtga

SEQ ID NO: 22604 - protein, 276 aa, Corynebacterium efficiens
MTDKPTHRAAVLGQPIGHSRSPVLHNAGYAALGLDDWAYDRFDCDADALPGLVGGADLSYRGFSVTMPAKFAALAFADEATERARRIGSANTLVRTATGWRADNTDVDGIRGALVELLGGGELVDKRAVVVGGGGTARPAIWALLEAGVSHITVINRSDRTGELSELVDAFPATLSYLPLEGGVEAETTAAAVVISTVPSAAIEGLEGKLAHAPVLDVIYDPWPTPLVTVARSRNIPAVGGHVMLAHQAYGQFEQFTGHPAPRDAMRAALEASLGM

SEQ ID NO: 22605 - DNA, 4857 bp, Thanatephorus cucumeris
  CDS (1)..(4857)
atggccactgccagcgtcgaacaacccgatcttaccaaggtttctatcctcggcaaggattccattcactgcggcttccacttgagcccgtacattgccgatacagtcctcactaatctccctgcatctacttatgttcttattaccgacacgcgcgttgccaagttccatctcgagtcgttcgaggccgcatttaccgacgctttggcggctaggcccaatacctctgctcgcttcttgacccatgtgattccccctggcgagaccagcaaaagccgcgagggcaaggccgaaatcgaagactttttgctcgacaactcgtgcacgcgtgatacggtcgttcttgccctgggtggtggagttatcggagacctcgttgggtttgtggccgcgaccttcatgcgtggtgtgcgctttgttcagatcccaacgactctattggccatggtcgactcgtcggttgggggcaagactgcgattgatacgcctcatggcaagaacctgatcggaagcttctggcagccatcctatgtgttcatcgacgccgcattcctcgagacacttccccagcgcgagtttgtaaacggtatggccgaagtgattaaaacggccgcgatctggaacgaagacgagttttcgatgctcgaggcttcggcgcctgcgctatttgccgccattggatcctcctcgtccacgacctctgcgggccgcactaccgccacccggtcagaggcccagtctcttctgttgcacgtgattaccgagagcattggagtcaaggcacacattgtgaccctcgacgaacgcgaaacgggtctgcgcaatctggtcaactttggacacactatcggtcatgcgatcgaggccgtgctcaccccgactattctccacggcgaatgtgttgccattggcatggttctcgaaggcgaagttgcccgacaactcggcgtactcagccaagtcggtgttggccgtattacccgtgccctcaaggcatacgggcttcctacatcgaccaaggacccgcggatcgccgctgtgccagcatcgcgtctcttgaccatcgataggttgcttgacattatgaagatcgacaagaagaactctggccccgaaaagaagattgtgctcctttcgcgaattggcaagacctatgaggagcgtgctacgggcgtcaaggatgaagtcattcgccgtgtgttggccgaagcttgccgtgtaatcccaggaatccctcggggcaaccctgttcgcatgagcacccccggcagcaagagcatctccaaccgtgcgctcgtactagccgctctcggcaatggcacctgtcgtcttcgaaatcttctccacagtgacgacactcaagtgatgatgagtgccctgattgaactcaagggtgccaaatttgcttgggaagatggtggtgaaacactcgtggttagtggtggcggaggtgcctttacaatccctcccgccggaaaggaactctatcttgggaacgctgggacggctgctcgcttcctcaccactgtctgcacgctcgtcggtcccgactcgtcatcggcaactgcttcttccgagttccccgaaggttacacgttcatcaccggcaatgctcgcatgaagcagcgcccgtgcggtccccttgtcgatgctctccgcgccaacggaagcaaggtcaagtatatcgagagcgagggctgcttgccgctgcacattggtgctggcggtctcaagggcggcacaattcagctcgcggccagtgtctccagccaatacgtatcgagtattcttctatgcgctccgtatgcccgggatgaagacgtcgtactcgagctcgtgggcggccaagtcatcagccagccgtacattgacatgaccctcgcgatgatgaagacctttggtgttgaagttacccgccgcaaggccgaggacggtacccttcttgatatctacgacattccacgcgcccaatataccaaccccgaaaagtatgccatcgagagtgacgcgagcagcgccacctaccctcttgccgtcgctgctatcaccggaactacttgcactattgaaaacatcggtacctcttcgctgcaaggtgatgccgggttcgcggtcaacgtcctcaagcgcatgggctgcaaggtcgagcaaagcgagaacgagacgactgtgaccggccctcccatcggccagctcaaggcgatcggattggtcgatatggaaaccatgaccgacgcattcttgactgcagtcgttgtagccgcagtttgcggagaaggaagtgcagaaggtctcgaatccgacgtgcccaagaataccactcgcattttgggtattgccaaccaacgtgtcaaggaatgcaaccgtattcgtgccatgatcgacgagctcgccaagtttggtgtcaagaccaaggaattggacgacggtctggaagtctacggtcagccgatcgagaccttgaacaagaacgtgtcggtgcactgctacgacgatcaccgcgtggcgatggcgttctccgttctggccactgtcgttcccggtactattctggaagagaagcgttgcgtcgaaaagacctggccaaactggtgggacgacctgaccaacaagattggtattgatgtcgaaggtatcgagctcgctcaccaaagcccagcggtcgccaagtacaacccagaggccacgatcattatcgttggtatgcgcggagctggcaagactcacattggaggcattgccgccgcgtctcttggatggaagtttatcgatgcagatcatgtgtttgaaggccgcacgggcgagctcgtctcgcagtacgtacgcagcaagggttggactgcgttccgccaagccgaatctcaaatcatccaagaccttttggctgaaaaccccacacgcacgatcatttcaactggaggcgggatcgtcgagtcgccactcaaccgcgcgctcttgtccggttacggtcgtgccacaggccctgtcgtgtacgtgatgcgagacgtgaacgaaattctaagctacctcggctcggagacggcgcgtcctgcttatggcgaagagatcgcagatgtctattggcgtcgcgaaccctggttccgagaagtctccacccacgagtatatatcttataccggaggattccatgccgcgaatggagcgactccgggcgaaatcgcttcggcatgccgcgacgagactgcacgattcttccgccagattaccggtatcaagcctaacctctccgaggcactcgcgcaaggcgaacgatcctttttcctgtcactcacctatcccgaccttctccctgccgtcccttcgatcccgctcctcactgccggcgccgatgccatcgaacttcgcgttgatttgctcaaccctagcggtgatccggttaccggtccccccaacattccctctttggactttgttgccacccagttgtcggctttgcgccacacctcgtctctccccgtcgtctttaccgtccgcactgcgtcccagggcggcgcctttcctgacacagctgaaaaggaagcattcgcgttgtacaaccttgcgctcaggcacggtgtcgagtacattgatgtcgaaatctcatggagcgacaagaagattcaggacctcgctgcgcgcaagggcgcttctcagatcatcgcatcgtggcacgactggagcggaaacatgaagtggaacggagccgtcgtcaaggaaaagtatgctttggccgagcgagtaggagacattgtcaagatcgtcggcaaagcgctctcgatcgaggacaactttgcgctccgggcatttgcggccgctcacacctccaagccgtttattggtatcaacatgggcgccgaaggccagctctcgcgtgtgcttaatactgcgtttactcccgtttcgcacccgcttttgccgactcgcgctgccccgggccagatgtctgtgcaagatattcacacggcattgcacctcaatggccaacttgcgcctcaaaagttctacctgttcggctcaccgatcgctcattcgatgtcgccccatctccacaacacagggttcgagaagctcggcttgccccacaagtatcatatcttcgagacggcgacgatcaccgacgaggtcaaggccgtgatccgggctcctgaatttggcggcgcgagcgtgacgattcccctcaagcttgatattatcccgctcctcgacgaagtttcgcccgaagccaaggccattggcgcggtcaacaccatcatcccacgcaagcgcgccgacgggtccacgagtctgtttggtaccaacaccgattggcgggcgatccacgacttggcgcgcaacaacctggtggtcggcattaccaacgagacgaccgcgcttgttctcggtgccggcggaacggcgcgtgcggctctgtatgcgatccatgcgctcggcatcaagacgatctacttgttcaaccgtacacgggcagcggcgcaagcgcttgccgatacgttccccacctttggtattattcctctcgactcgctcaactcgttccccaaggctgctcccaccgttgtcgtctctgctattcccgcaacaggtaccacgaccgaaaaagcgagcgacagtgccggagtatacctccccccaagcctgtttgaagctccatccggtgtagtggtcgagatggcctacaagcccgcggtgacgcctgtgctcggactcgcggccaagtcttctggctgggtgggcgtacgtggggtggatattttgtgcgaacaagggttctaccagtacgaggcttggactgggcgcaaggctcctcgggcggcgatgaaagccaaggtgatttcgttgtatgatagtcagcagtga

SEQ ID NO: 22606 - protein, 1618 aa, Thanatephorus cucumeris
MATASVEQPDLTKVSILGKDSIHCGFHLSPYIADTVLTNLPASTYVLITDTRVAKFHLESFEAAFTDALAARPNTSARFLTHVIPPGETSKSREGKAEIEDFLLDNSCTRDTVVLALGGGVIGDLVGFVAATFMRGVRFVQIPTTLLAMVDSSVGGKTAIDTPHGKNLIGSFWQPSYVFIDAAFLETLPQREFVNGMAEVIKTAAIWNEDEFSMLEASAPALFAAIGSSSSTTSAGRTTATRSEAQSLLLHVITESIGVKAHIVTLDERETGLRNLVNFGHTIGHAIEAVLTPTILHGECVAIGMVLEGEVARQLGVLSQVGVGRITRALKAYGLPTSTKDPRIAAVPASRLLTIDRLLDIMKIDKKNSGPEKKIVLLSRIGKTYEERATGVKDEVIRRVLAEACRVIPGIPRGNPVRMSTPGSKSISNRALVLAALGNGTCRLRNLLHSDDTQVMMSALIELKGAKFAWEDGGETLVVSGGGGAFTIPPAGKELYLGNAGTAARFLTTVCTLVGPDSSSATASSEFPEGYTFITGNARMKQRPCGPLVDALRANGSKVKYIESEGCLPLHIGAGGLKGGTIQLAASVSSQYVSSILLCAPYARDEDVVLELVGGQVISQPYIDMTLAMMKTFGVEVTRRKAEDGTLLDIYDIPRAQYTNPEKYAIESDASSATYPLAVAAITGTTCTIENIGTSSLQGDAGFAVNVLKRMGCKVEQSENETTVTGPPIGQLKAIGLVDMETMTDAFLTAVVVAAVCGEGSAEGLESDVPKNTTRILGIANQRVKECNRIRAMIDELAKFGVKTKELDDGLEVYGQPIETLNKNVSVHCYDDHRVAMAFSVLATVVPGTILEEKRCVEKTWPNWWDDLTNKIGIDVEGIELAHQSPAVAKYNPEATIIIVGMRGAGKTHIGGIAAASLGWKFIDADHVFEGRTGELVSQYVRSKGWTAFRQAESQIIQDLLAENPTRTIISTGGGIVESPLNRALLSGYGRATGPVVYVMRDVNEILSYLGSETARPAYGEEIADVYWRREPWFREVSTHEYISYTGGFHAANGATPGEIASACRDETARFFRQITGIKPNLSEALAQGERSFFLSLTYPDLLPAVPSIPLLTAGADAIELRVDLLNPSGDPVTGPPNIPSLDFVATQLSALRHTSSLPVVFTVRTASQGGAFPDTAEKEAFALYNLALRHGVEYIDVEISWSDKKIQDLAARKGASQIIASWHDWSGNMKWNGAVVKEKYALAERVGDIVKIVGKALSIEDNFALRAFAAAHTSKPFIGINMGAEGQLSRVLNTAFTPVSHPLLPTRAAPGQMSVQDIHTALHLNGQLAPQKFYLFGSPIAHSMSPHLHNTGFEKLGLPHKYHIFETATITDEVKAVIRAPEFGGASVTIPLKLDIIPLLDEVSPEAKAIGAVNTIIPRKRADGSTSLFGTNTDWRAIHDLARNNLVVGITNETTALVLGAGGTARAALYAIHALGIKTIYLFNRTRAAAQALADTFPTFGIIPLDSLNSFPKAAPTVVVSAIPATGTTTEKASDSAGVYLPPSLFEAPSGVVVEMAYKPAVTPVLGLAAKSSGWVGVRGVDILCEQGFYQYEAWTGRKAPRAAMKAKVISLYDSQQ

SEQ ID NO: 22607 - DNA, 1494 bp, uncultured proteobacterium
  CDS (1)..(1494)
atgtatttgcataaatccgcaattacccccacagttcaatcacaggtcacacaaaacatatccacaggtttatctcacatggatctcatcctcgcgtctcaatctgccacgcgccgtcgcattttaaactctgcacgaataagcgctcagtttatgtcaccgcaaattgatgaagaaaacattacgaaatctctgattgcagaacaggccctgccccgcgacattgccgacactctagccgaacataaagcgctaaaaatatcccgaaagaatccagatagttgggtgattggatgtgatcaaatactggtttttgagggcgaaattttcggaaagcccgcctcacccgaggcgctcaaaacctctctatctcgcctttctggaaaaacgcatcgtttgattactgctaatgtcatctacaaggatagcaaacctcaatggcgacatatttcaatcagccatatgtctatgcgttttatgagtgcggctgagatagacgcctatatagaagcttattgggaggatgtgaaacattcagccgggggctatcactttgaaaaaaagccagatctttttgccgatgttcgtggcaattggtttgatattatggggctttctatcgggccaatcatcagttttttgaaccaggccaatacaaccgccccgtttcaaacccctaaacttgcggcggttttgggtcatccgatagcgcagagcaaatcgcccctgatgcatgggcactggcttaagaaacatcaaatatcaggcgattatttcgccatcgacattccccccgcgcgctttagtgaaacggtgcgtatgctgtttgacctaggcttttcaggtttcaatgttaccattccgcataaggagcaagcattggcatttgcggatgacgccacccctccggcgcaacgcattggcgcatccaacactttgataaaaaaggacaacggcaatattactgccgataatacagacggttatggatttatgaccaatctgatctctcaaagcacgacgtggcagccaagcgctggtccgtctttggtgttgggcgcaggtggcgctgcgcgggcgattttggttgctcttttggacgctggcgcccccgagatttacctttgtaatcgtacccgtgcacgggcagaagatttggctgctgagatttcagatctcattgaagtgattgagtggcaggacaaagaggatattttgccaaaggtgttcaccgtggtgaacagcacctcgcttggtatgattggaaaacctgccttagatttcgatttgacccatgtgaatccgcgcgccctggttgctgatctcatttacgcccccctcgaaacccagcttttgaagggtgcgcgggcgcgtggatgtgaggtggtgggcggtattggtatgttattgcaccaaggtgtcccagggtttgaggcatggtttggcacccggcctgtggtggatcaagagctagagacattggtgctcacatga

SEQ ID NO: 22608 - protein, 497 aa, uncultured proteobacterium
MYLHKSAITPTVQSQVTQNISTGLSHMDLILASQSATRRRILNSARISAQFMSPQIDEENITKSLIAEQALPRDIADTLAEHKALKISRKNPDSWVIGCDQILVFEGEIFGKPASPEALKTSLSRLSGKTHRLITANVIYKDSKPQWRHISISHMSMRFMSAAEIDAYIEAYWEDVKHSAGGYHFEKKPDLFADVRGNWFDIMGLSIGPIISFLNQANTTAPFQTPKLAAVLGHPIAQSKSPLMHGHWLKKHQISGDYFAIDIPPARFSETVRMLFDLGFSGFNVTIPHKEQALAFADDATPPAQRIGASNTLIKKDNGNITADNTDGYGFMTNLISQSTTWQPSAGPSLVLGAGGAARAILVALLDAGAPEIYLCNRTRARAEDLAAEISDLIEVIEWQDKEDILPKVFTVVNSTSLGMIGKPALDFDLTHVNPRALVADLIYAPLETQLLKGARARGCEVVGGIGMLLHQGVPGFEAWFGTRPVVDQELETLVLT

SEQ ID NO: 22609 - DNA, 831 bp, Corynebacterium glutamicum
  CDS (1)..(831)
atgggttctcacatcactcaccgggcggccgtactcggctcacccatcgagcattccaaatccccagtcctccacaacaccggctataaagccctcggactggaccaatgggaatacgaccgctttgagtgcaccggcgacatgctccccggcatcgtctccggcgctgatgaaacctactgcggattctccgtcaccatgccgtctaaattcgcagctcttgaattcgccgacgaagtaaccgaacgcgcctgcgccatcggctccgcaaacaccttgctgcgcacggccaccggatggcgcgccgacaacaccgacgtcgacggcatcaggggagctctcggtgaactcctcggcggcgcatcactggccggcaaacacgccatcgtcatcggctccggcggcaccgcacgccccgccatctgggcactcatcgaagccggggtcgcccggatcacggtgctcaaccgctccgatcgcaccgccgaactgcaaacgcttttcgacgaaacccccaccaccttggcctacgccccgctcgagcatctccacatcgaagccgacgtcgtagtctctacagtgccctccgcagcaatcgcaggcctcgaagacacccttgcgatcgccccagtcctcgacgtcatctacgacccctggccaacaccactcgtagaagtcacacgagccaaaggcctcaaagctgtcggaggccacgtcatgctggcacaccagtcctacggacagtttgaacaattcaccggaatggatgcaccccgcgatgccatgcgtgaggctttggaagagtctttaggcatctcagaagaacactaa

SEQ ID NO: 22610 - protein, 276 aa, Corynebacterium glutamicum
MGSHITHRAAVLGSPIEHSKSPVLHNTGYKALGLDQWEYDRFECTGDMLPGIVSGADETYCGFSVTMPSKFAALEFADEVTERACAIGSANTLLRTATGWRADNTDVDGIRGALGELLGGASLAGKHAIVIGSGGTARPAIWALIEAGVARITVLNRSDRTAELQTLFDETPTTLAYAPLEHLHIEADVVVSTVPSAAIAGLEDTLAIAPVLDVIYDPWPTPLVEVTRAKGLKAVGGHVMLAHQSYGQFEQFTGMDAPRDAMREALEESLGISEEH

SEQ ID NO: 22611 - DNA, 807 bp, Corynebacterium glutamicum
  CDS (1)..(807)
atggtcaactacgtcgacagggaaacaaccctgtgcatctctctcgctgctcgtccatccaaccatggtgttcgtttccacaactggctttacgctgaacttggattgaactacctgtacaaggctgttgccccagcagatatcaccgctgcagtcgcaggtatccgtggtctgaacattcgcggcgcaggtgtctccatgccatacaagagcgatgtcatcccactcatcgatgagttgcatccttccgcagagcgcatacgttctgttaacaccatcgtcaacaatgacggacaccttgtcggatacaacaccgactacactgcggtgtaccacctccttgaagaacaccgcgtgaaccccaatgcacgagtagctatcaagggatccggcggcatggccaatgctgttgttgcagctcttgctgagtatggtctgagtggcaccgtcgttgcccgcaaccacaccaccggttctgcgctagcttcccgttacggttgggaatactccgcaactgttccggaagacgcaaaaattttggttaatgtaaccccaatgggaatgaatggacctgaccaagacgttgtatcttttggtgaggatgaagtagaccgagccgacgtaatctttgactgcgtagcattccccgtcgagaccccactgattaagttggccaaggaaaagggtaagcaaaccatcgacggcggagaagttgccgctcttcaggcagcagagcagttccacctctacaccggagttcttccaaccaacgaccagatcattgctgcggaggagttctccaagtaa

SEQ ID NO: 22612 - protein, 268 aa, Corynebacterium glutamicum
MVNYVDRETTLCISLAARPSNHGVRFHNWLYAELGLNYLYKAVAPADITAAVAGIRGLNIRGAGVSMPYKSDVIPLIDELHPSAERIRSVNTIVNNDGHLVGYNTDYTAVYHLLEEHRVNPNARVAIKGSGGMANAVVAALAEYGLSGTVVARNHTTGSALASRYGWEYSATVPEDAKILVNVTPMGMNGPDQDVVSFGEDEVDRADVIFDCVAFPVETPLIKLAKEKGKQTIDGGEVAALQAAEQFHLYTGVLPTNDQIIAAEEFSK

SEQ ID NO: 22613 - DNA, 750 bp, Fusobacterium nucleatum
  CDS (1)..(750)
atgcataaaactttttttgaagatatagggcttaaagatgaatataagttatatgaagttgacgagactgaaatagataattttaaaaactatatgcttgagaattctattgaaggagtgaatataactgttccctacaaaaaaatctttttagataaattaaattttataagtgatgaggcaaaagatataggagctataaatcttctctatataaaagataataaattctatggagataacactgattactatggttttaaatatacactgacaaaaaatgatatagatgtaaaaaataaaaagatagctattattggtaaaggtggagcaagtgcaagtgtggataaagtattaaaagatatgggagcaaaagatataactttctattttagaagggacaagttaagtaagatagaattcccagaaaatatggaaggggatataataattaatacaactcctgttggaatgtatcctaatatacacgataaccttgtaaatgaagaaattttaaagaattttaagatagcaatagatttaatttataatcctttggaaacagaatttttaaaaattgcaagaaaaaatggattaaaaactataaatggtatggatatgttgattgaacaagctttaaagactgatgaaattctatatgatattctattgtcaactcaacttagaaagaaaattagaaaaaaaatgaaaaagaaggtagaagaattctatgaaaataatggtgattaa

SEQ ID NO: 22614 - protein, 249 aa, Fusobacterium nucleatum
MHKTFFEDIGLKDEYKLYEVDETEIDNFKNYMLENSIEGVNITVPYKKIFLDKLNFISDEAKDIGAINLLYIKDNKFYGDNTDYYGFKYTLTKNDIDVKNKKIAIIGKGGASASVDKVLKDMGAKDITFYFRRDKLSKIEFPENMEGDIIINTTPVGMYPNIHDNLVNEEILKNFKIAIDLIYNPLETEFLKIARKNGLKTINGMDMLIEQALKTDEILYDILLSTQLRKKIRKKMKKKVEEFYENNGD

SEQ ID NO: 22615 - DNA, 4692 bp, Neurospora crassa
  CDS (1)..(4692)
atggctgagcccatctctaatcctacccggatcaacatcctgggcaaggacaacatcatcattgaccacggcatctggctgaactttgtcgcccaggacctcctccagaacatcaagtcctccacctacatcctcatcaccgacacgaacctctacaagacctacgtgccccctttccagtccgttttcgagaaggctgctccccaagatgtccgccttcttacctatgccatccctcccggcgagtactccaagggccgcgacaccaaggccgagatcgaggactggatgctctcgcaccaatgcactcgcgacaccgtcatcattgccctcggtggcggcgtcattggcgacatgatcggctacgtcgccgctaccttcatgcgcggcgtccgcttcgtccagtgcccgaccaccctcctcgccatggtcgactcctccatcggcggcaagactgccattgacgtgcccatgggcaagaacctgattggcgccttctggcagcccgagcgcatctacatcgacctcaccttcctcaacacactgcccgtgcgcgagttcatcaacggcatggccgaggtcatcaagaccgccgccatttgggacgagaacgagttcaccgccctcgaagagaacgcaaaggccatcctcgaggccgtccgctccaagaacaagtcggccgaccgtctggcccccatccgcgacatcctcaagcgcatcgttctcggttcggcccgcgtcaaggccgaggttgtctcgtcggacgagagagaaggcggactccgcaacttgctcaactttggacactccattggtcatgcttatgaggcgatcctgactcctcaggtcctccacggcgaagcggttgccattggcatggtcaaggaagctgagcttgcccgcttcctcggcgtcctccgccccagcgccgtcgctcgtctttccaagtgcattgccagctacgacctgcctacctctctgcaggacaagcgcatcgtcaagcttactgccggaaaggagtgcccagttgatgtgcttctccagaagatggccgttgacaagaagaacgagggccgcaagaagaagattgtcctactttccgccatcggaaagacctatgagcccaaggccagcgtcgtcgaggaccgcgccattcgcattgttctctcgccttgcatcagggtctttgctggtgtacccaaggatctcaacgtcagcgtcactccccctggatccaagagtatctccaaccgtgcccttattctggctgctctcggtgagggtaccacccgcattcataacttgctccattccgacgacacccaggtcatgctcaacgccgtcgcgcagctccagggtgcctccttctcttgggaagagggcgatgtgctcgtcgtcaagggcaacggtggcaagttgcaggctacctcgacccctctgtatctgggcaatgcgggaaccgcttctcggttcttgacctccgtggcggctctttgcaacccttccgacgtcaactctactgttttgactggcaatgcccgcatgaagcagagacccatcggtgctctcgttgatgccctgcgtgccaacggcgtcggtgtcaagtaccttgagaaggaacacagtttgcccgtgcaagttgatgctgctggcggccttgccggcggtgttatggagcttgctgccaccatctcgtcccagtacgtctcctcgctcttgatggccgccccctacgcccgcgagcccgtcacccttcgcctggttggcggtaagcccatctctcagccctacatcgacatgaccatcgctatgatggcttcgtttggtgtgcaagttcagcgatctgctgaggatcccaacacctactatatcccccagggcacctacaagaaccccgagacctatgtcgtcgagagcgatgccagctctgccacctaccctctcgccattgccgccatcactggcactacctgcaccgtccccaacattggctccaagtcgctccagggtgatgctcgcttcgccattgaggttctccgtcccatgggctgcaccgtcgagcagactgacgtctctaccaccgtgactggccctccaatcggcactctcaaggccatcccgcacgtcgatatggagcccatgactgatgctttcctcactgcgtccgtgctcgctgctgttgcctctggcaccactcagattactggcattgccaaccagagagtcaaggagtgcaaccgcatcttggcgatgaaggaccagcttgccaagttcggcgtgcactgcaatgagctcgaggacggtatcgaagtgattggcatcccttacactgagctgaagaacccaacggagggcatctactgctacgacgatcaccgtgtggccatgagcttcagtgtcctctccaccatctcgccccacccggtacttatccttgagcgtgagtgtactggcaagacatggcctggatggtgggataccatgtccaactacttcaaggtccatctcgaaggcgaggaggagccacacagcagccacgtatcccacgagaagcctcggaagggtaaccccaagtctatcttcatcatcggtatgcgtggcgctggcaagtccaccgctggcaagtggatgtccgaggttctcaaccgacctctcatcgatctcgatcatgagctcgagaggagagagggccaaacgattcccgagatcatccgcagcgagcggggctgggaaggcttcagaaaggctgagctcgaactccttgaggatgtgatcaagaacaaccctaccggacacatcttctcctgcggtggcggtattgtggagacagaggctgcccgaaagatgttgctttcctacagccaaaatggtggtattgtccttctagtccatcgtgataccgaccaagttgtcgagtacctcatgagggacaagtcccgccccgcctactccgagaacatccgggaggtctactatcgtcgcaagcccttctttgaggaatgcagcaacttccgctactacagccctcatcctgatgggtcaaaggctctgaccgaaccacccttcgacttcagccagttcctctccgtcatctgtgggcacagcaaccacctcgaggaagtgaagaagaagcctcattctttcttcgtctccctcacagtccccaacgtatccaaggcattggacatcatccccaaggtggttgtgggctccgatgccgtagagctgcgtgtagacttgctggaggattacgatccggaatttgtggccaagcaggttgcgctgcttcggtcggccgcgaggattcctatcgtctacactgtccgcactgtcagccaaggcggcaagttccccgatgacgattatgagttggccctcaagctttaccgcactggtctgcaggctggtgtggaatatctcgatctggagatgaccatgccagacgaggtcattgaagctgtgacgaatgaaaagggctatacccatatcattgcctctcaccatgaccccaaggcaacgctctcctggaagaacggcggttggatccagtactacaacaaagccctgcaacatggtgatgttgtcaagctcgttggtgtcgcccgcgaacttgctgacaattttgccctagcacgtttcaaggccagcctcgctgctgctcatgacaagcctctcattgccttgaacatgggtgcagctggcaagctgagccgcgtactaaatggcttcctgactccagtttcccacccagccctgccgtccaaggctgctccaggtcagctctcggcggctgaaatccgtcaggcgctggctcttatcggcgagctcgagcctcggtctttccaccttttcggaaaccccatctcggcttcgcggtcacccgcccttcacaatgctctcttccgcgacaacggcctgcctcatcagtattccctcttcgagactgataacgctgctgacgtcaaagacctgatccgggctcctgggtttggtggagcgtcggtaaccatccctctcaagcttgacatcatgcctttgctggacgaggtgtctgatgctgccaaggtcattggcgcggtcaataccatcattcctgttcgcaacggcgacaaggtaactcttcgcggtgacaacactgactggatgggcatggtgtatgcgctccgcaacgccggcgtcgtcaagtgcaccaaggagtctccgaccgccggtatggttgtcggagctggcggaactacccgagcggctgtccatgctttgcatgacctaggctttgccccaatctacgtcgttgctagaaacgccgaccgcgtcaaggctcttgcggagtcattccctgccgagtacgacatccgctcgttgagcacgccggaagaggtcgcggccgagtccactgcccagccttcggttgtgatcagcaccatccccgccgacaaacccattgaccagagcatgcgtgaggtcattgttgcttctcttcgtcacccgtcggtcgcggatggcaagcatgtcctgctggagatggcctacaccccgcgccacacccctctcatgcagctggcggaggatgcgcactggcagacgattcccggacttgaggttctcgccgctcagggctggtatcagttccaactctggaccggaatcaccccgatctacaccgatgcgcaggcggctgtcatgggtaactag

SEQ ID NO: 22616 - protein, 1563 aa, Neurospora crassa
MAEPISNPTRINILGKDNIIIDHGIWLNFVAQDLLQNIKSSTYILITDTNLYKTYVPPFQSVFEKAAPQDVRLLTYAIPPGEYSKGRDTKAEIEDWMLSHQCTRDTVIIALGGGVIGDMIGYVAATFMRGVRFVQCPTTLLAMVDSSIGGKTAIDVPMGKNLIGAFWQPERIYIDLTFLNTLPVREFINGMAEVIKTAAIWDENEFTALEENAKAILEAVRSKNKSADRLAPIRDILKRIVLGSARVKAEVVSSDEREGGLRNLLNFGHSIGHAYEAILTPQVLHGEAVAIGMVKEAELARFLGVLRPSAVARLSKCIASYDLPTSLQDKRIVKLTAGKECPVDVLLQKMAVDKKNEGRKKKIVLLSAIGKTYEPKASVVEDRAIRIVLSPCIRVFAGVPKDLNVSVTPPGSKSISNRALILAALGEGTTRIHNLLHSDDTQVMLNAVAQLQGASFSWEEGDVLVVKGNGGKLQATSTPLYLGNAGTASRFLTSVAALCNPSDVNSTVLTGNARMKQRPIGALVDALRANGVGVKYLEKEHSLPVQVDAAGGLAGGVMELAATISSQYVSSLLMAAPYAREPVTLRLVGGKPISQPYIDMTIAMMASFGVQVQRSAEDPNTYYIPQGTYKNPETYVVESDASSATYPLAIAAITGTTCTVPNIGSKSLQGDARFAIEVLRPMGCTVEQTDVSTTVTGPPIGTLKAIPHVDMEPMTDAFLTASVLAAVASGTTQITGIANQRVKECNRILAMKDQLAKFGVHCNELEDGIEVIGIPYTELKNPTEGIYCYDDHRVAMSFSVLSTISPHPVLILERECTGKTWPGWWDTMSNYFKVHLEGEEEPHSSHVSHEKPRKGNPKSIFIIGMRGAGKSTAGKWMSEVLNRPLIDLDHELERREGQTIPEIIRSERGWEGFRKAELELLEDVIKNNPTGHIFSCGGGIVETEAARKMLLSYSQNGGIVLLVHRDTDQVVEYLMRDKSRPAYSENIREVYYRRKPFFEECSNFRYYSPHPDGSKALTEPPFDFSQFLSVICGHSNHLEEVKKKPHSFFVSLTVPNVSKALDIIPKVVVGSDAVELRVDLLEDYDPEFVAKQVALLRSAARIPIVYTVRTVSQGGKFPDDDYELALKLYRTGLQAGVEYLDLEMTMPDEVIEAVTNEKGYTHIIASHHDPKATLSWKNGGWIQYYNKALQHGDVVKLVGVARELADNFALARFKASLAAAHDKPLIALNMGAAGKLSRVLNGFLTPVSHPALPSKAAPGQLSAAEIRQALALIGELEPRSFHLFGNPISASRSPALHNALFRDNGLPHQYSLFETDNAADVKDLIRAPGFGGASVTIPLKLDIMPLLDEVSDAAKVIGAVNTIIPVRNGDKVTLRGDNTDWMGMVYALRNAGVVKCTKESPTAGMVVGAGGTTRAAVHALHDLGFAPIYVVARNADRVKALAESFPAEYDIRSLSTPEEVAAESTAQPSVVISTIPADKPIDQSMREVIVASLRHPSVADGKHVLLEMAYTPRHTPLMQLAEDAHWQTIPGLEVLAAQGWYQFQLWTGITPIYTDAQAAVMGN

SEQ ID NO: 22617 - DNA, 948 bp, Ralstonia solanacearum
  CDS (1)..(948)
atgcatgacgacctccgcccctcgctgctggccgggctgatcggcgcgggcatccagcgctcgctgtcgccggccatgcaccagcaggaaggcgacgcgcaggggctgcgctacgtgtacaagcgcatcgacctggaggcgctgggcctgacgcccgatgcgctgccggaactgctcacggccgccgagcgcttcggcttcgccgggctcaacgtcacgcacccgtgcaagcagcgtgtgctgcactatctcgatgacctgtcggacgatgcccgcgcgctgggcgccgtcaacaccgtggtcttcgacaacggccgccgcatcggccacaacaccgactggtggggctttgccgagagcttcaagcgcggcctgcccggtgcgccgatggggcaggtggtgcagctcggcgcgggcggcgccggcgcggcggtggcgcacgcgatgctgacgctgggcgcgcagtcgctgacgctgttcgatgtggagccggagcgcgcgcggcaactggccgcgtcgctgtgcgggcgcttcggcccgggccgcgcgcaggccggcaccgacctggccgcggcgatggcggcggccgacggcctggtccacgcaacgcccaccggcatggccggccaccccggcctgccgctgccgcccgatctgctgcagtcgcggcactgggtggccgagatcgtctactttccgctggagaccgaactgctgcgccgcgcgcgcgcgctcggctgccgcacgctcgacggcggcggcatggccgtgttccaggcggtgggcgcgttcgagctgttcaccggcatcgcgccgaatgcgcaccggatgctggcccactttgccgcgctgcaggatgccgaggcaacggcgcatgccggcgccacagaccctcacggcgtcgcgcgaccgggcatcggtctcgctgccgttgcgctcggacgctga

SEQ ID NO: 22618 - protein, 315 aa, Ralstonia solanacearum
MHDDLRPSLLAGLIGAGIQRSLSPAMHQQEGDAQGLRYVYKRIDLEALGLTPDALPELLTAAERFGFAGLNVTHPCKQRVLHYLDDLSDDARALGAVNTVVFDNGRRIGHNTDWWGFAESFKRGLPGAPMGQVVQLGAGGAGAAVAHAMLTLGAQSLTLFDVEPERARQLAASLCGRFGPGRAQAGTDLAAAMAAADGLVHATPTGMAGHPGLPLPPDLLQSRHWVAEIVYFPLETELLRRARALGCRTLDGGGMAVFQAVGAFELFTGIAPNAHRMLAHFAALQDAEATAHAGATDPHGVARPGIGLAAVALGR

SEQ ID NO: 22619 - DNA, 921 bp, Ralstonia solanacearum
  CDS (1)..(921)
atgatatcgtttgaacaggcggccattctcgcggccgccagcgccccgccagtcgatcgctacggtgtgatcggcaatccgatctcgcacagcaagtcgccggccatccatgccgcctttgcgcagcagaccggccagctgatgcgctatgagcgcatctatgccgagctgattgcctttgacgagaccgtgttctcgttcatccgtgagggcgggcgggggctcaatgtgacggtgccgttcaagctcgatgcgtacgcactggcgacctcgctgtcgctgcgtgcggagtcggccggcgccgtcaacaccctcaagttcgacggcgatgcgattttcggcgacaacaccgatggcgtcggcctgatgcgcgatatcacgcacaacatcggcaacccgctggcgggtgagcgcgtgctgctgctcggcgcgggcggcgcggcgcgcggcatcctgctgccgctgctggagcacaagccgtcgcgcgtgttcatcgccaatcgcacagccgatcgcgccatcgggctggtgcagcgcttcgaggcagcggccaagctgcacgaggtcgagctggtgggcggcggcttcgacgacctggccgtcagcgacgtcttcgatgtcgtcatcaacgcgaccgcgggcagcctgcaggcccaggtgccgcccatcgagccgaccgtgttcggccccaacgcgctggcctacgacatgatgtacggctcgcagccgacggtgttcatgcagttcgccaagcggcatggtgcccgcgcgtgggacggcctgggcatgctggtggagcaggcggcggaatcgttcctggtctggcgcggcatgcgccccgacaccgcccccgtgctacaagccatgcgcgaggggctgcagggcgaggcggccgtggccgcgcgcgcgcatcagcgctga

SEQ ID NO: 22620 - protein, 306 aa, Ralstonia solanacearum
MISFEQAAILAAASAPPVDRYGVIGNPISHSKSPAIHAAFAQQTGQLMRYERIYAELIAFDETVFSFIREGGRGLNVTVPFKLDAYALATSLSLRAESAGAVNTLKFDGDAIFGDNTDGVGLMRDITHNIGNPLAGERVLLLGAGGAARGILLPLLEHKPSRVFIANRTADRAIGLVQRFEAAAKLHEVELVGGGFDDLAVSDVFDVVINATAGSLQAQVPPIEPTVFGPNALAYDMMYGSQPTVFMQFAKRHGARAWDGLGMLVEQAAESFLVWRGMRPDTAPVLQAMREGLQGEAAVAARAHQR

SEQ ID NO: 22621 - DNA, 819 bp, Salmonella typhimurium
  CDS (1)..(819)
atgacaaagcgcattaataaagacactcaggtctgcatgtccctggcggcacgcccaagtaacttcggtacacgctttcacaactatctgtacgaagcgctggatctcaattatctctacaaagctttttcgccgaccgatcttacgcaggccattagcggcgtgcgcgggttggggatccgtggatgcgcgatctctatgccgtttaaagaagcctgcattccgctggtggatgaactggatgcttccgctcaggccattcactcagttaataccattgtgaataccaatggccatctgaaggcgtacaacaccgattacattgcaatagctcgcttgctggcgaattacaaggtctctcccgacctggtgtttgctttgcgtggcagcggtggtatggcaaaggcggtggcctgcgcgctgaaggatgcggggtttacccgtggttatattgtcgcgattgatgaagcgtcaggtaaacaactggccgaactctatggctatgaatggcgcccggataccgacggtattgaagctgatttgttaattaacgccacgcctatcggaatggctggcggtaatgatgccgacaaactttcttattccgaacaggaagtggataaggcgagcgttatctttgatgtggtggcgctaccgcccgtcacgccgctaatccgctacgcccgtgaacgcggtaaaaccgtgattaccggttccgaagtgtttgctattcaggccgtggagcaatttgtcctttataccgggattcgcccggatgacgcgctgttccagaaagcagcggcctggtcacgcctgtaa

SEQ ID NO: 22622 - protein, 272 aa, Salmonella typhimurium
MTKRINKDTQVCMSLAARPSNFGTRFHNYLYEALDLNYLYKAFSPTDLTQAISGVRGLGIRGCAISMPFKEACIPLVDELDASAQAIHSVNTIVNTNGHLKAYNTDYIAIARLLANYKVSPDLVFALRGSGGMAKAVACALKDAGFTRGYIVAIDEASGKQLAELYGYEWRPDTDGIEADLLINATPIGMAGGNDADKLSYSEQEVDKASVIFDVVALPPVTPLIRYARERGKTVITGSEVFAIQAVEQFVLYTGIRPDDALFQKAAAWSRL

SEQ ID NO: 22623 - DNA, 789 bp, Pyrobaculum aerophilum
  CDS (1)..(789)
atgtacttcgctgtgattggggcgcacgtgaggggcaaatcggcgagtccggcgatgcacacagcctctttcaaggcgctgggcataaacgcagtttatatagccgtagacgtgcctaaagaggaattgggctgtttcgcccaaatagcgaggttgaatttcagaggctttaacgtgacaattccgcataaggaagaggtcgtaaagtttttagacgccctctcagcggaggcaagggcaattggcgcggtcaacacggtgttggtggagaggaatttaatggtgggctataacacagacgcccacgccgtgtataaactggcggggggacacatggagggcgcagaggtgttaatcctgggggcagggggagcagcgagggccgccctcttcgccgccataaaggcgggggctaaaaagatatacgtcaaaaaccgcacggcggagagggctgaggcgcttgcccgggagttccgggagaagttcgaaaggcctattgaggcaattccgtggagcggcgccgttaaggcggatgtcgtaataaacgccactcctatacacgacgcagtaattgcggatctcaccggcgcgtctctatacgtggagttcgtctacacgcctacgccgaggactaaaatggtggaagaggccgagaggcttggcgtaaaggtcgtagacggcgtggatctcttggtagagcagggcgcccaggccgagaaaatatggctgggtgtggagcccgacagggctgtgatgaaaaaagcagttttagagttcctaggcctatga

SEQ ID NO: 22624 - protein, 262 aa, Pyrobaculum aerophilum
MYFAVIGAHVRGKSASPAMHTASFKALGINAVYIAVDVPKEELGCFAQIARLNFRGFNVTIPHKEEVVKFLDALSAEARAIGAVNTVLVERNLMVGYNTDAHAVYKLAGGHMEGAEVLILGAGGAARAALFAAIKAGAKKIYVKNRTAERAEALAREFREKFERPIEAIPWSGAVKADVVINATPIHDAVIADLTGASLYVEFVYTPTPRTKMVEEAERLGVKVVDGVDLLVEQGAQAEKIWLGVEPDRAVMKKAVLEFLGL

SEQ ID NO: 22625 - DNA, 1503 bp, Oryza sativa
  CDS (1)..(1503)
atgacgctcctgtgcgtgccgctggtggcccgcacggtggaggcgatgcgggccgacgcggccgcggccgctgccgccggcgccgacctcgtcgagatccggctcgacttcatcggcagcaagttccgcccgcgggaggatctcccgcgcctgctccgcggctgcccgctccccgccatcgtcacctacagacccaattgggaaggaggccaatatgaaggtgatgatgctacaagatttgaagcactccgtttagcaatggagctaggagtaaattatgtcgatattgaattgaaggttgctgacaaatttatcagctttatttatgggagtaagccagagaagtgcaaacttattgtctcggcacataattatgaaagtactccatcctgtgaggagcttgcagatcttgtggctagaatacaagcagttggagctgatatagtgaaaatcgcaacaacagctaatgacattgttgatgtgtcacagatgttccaagtgatggtgcactgccaagtgcctatgattggactagttatgggcgaaaaaggtttaatgtcaagggtgttatcccccaagtttgggggatatctaacctttgggagtcttgatgctacaaaggtatcagcacctgggcagccaaccgtcgaagagctgatagacatttatgatataaggcgcataggacctgatacaaaggttctcggtgttatagccaacccagtaaaacagagcaagagcccagttttgcacaatacatgtcttcaatctgttggatacaatgctgtttatcttccacttttggcagacaacattgctagatttcttagcacatattcgtctccggatttttcaggattcagttgttctcttccttttaaagttgatgccgtacagtgttgtcatgaacatgatccagttgctaagtcaataggtgccataagcactataattaggaggccagatggcaaactactgggctacaataatgactacattggagcaatttgtgccattgaggatggcataggaggtccaggatcaaagaatgctgccgtcacacctttggctggcaggcttcttgttgttgtaggtgctggtggagctggcaaggcaattgcttacggggcaaaggagaagggtgcaagaattgtagtagcaaatcgtacctacgaaaaagcagtaagtcttgctgccgcggttggtggtcatgccctgagattagccgagcttgaaactttcaggcctgaagaagggatgatccttgctaatgcaacatcgttgggaatgtaccccaatgtggatggcacccctattccaaagcaagcactaagcttctacgatgttgtgttcgatgcggtatatgctccgaaagtcacccggcttctacgagaagcagaagaatgtggggttaaagttgtcagcggtgtggagatgtttctcagacaagccttgggtcagttcgagcgtttcacaaatggtattgaaggatttgattcttag

SEQ ID NO: 22626 - protein, 500 aa, Oryza sativa
MTLLCVPLVARTVEAMRADAAAAAAAGADLVEIRLDFIGSKFRPREDLPRLLRGCPLPAIVTYRPNWEGGQYEGDDATRFEALRLAMELGVNYVDIELKVADKFISFIYGSKPEKCKLIVSAHNYESTPSCEELADLVARIQAVGADIVKIATTANDIVDVSQMFQVMVHCQVPMIGLVMGEKGLMSRVLSPKFGGYLTFGSLDATKVSAPGQPTVEELIDIYDIRRIGPDTKVLGVIANPVKQSKSPVLHNTCLQSVGYNAVYLPLLADNIARFLSTYSSPDFSGFSCSLPFKVDAVQCCHEHDPVAKSIGAISTIIRRPDGKLLGYNNDYIGAICAIEDGIGGPGSKNAAVTPLAGRLLVVVGAGGAGKAIAYGAKEKGARIVVANRTYEKAVSLAAAVGGHALRLAELETFRPEEGMILANATSLGMYPNVDGTPIPKQALSFYDVVFDAVYAPKVTRLLREAEECGVKVVSGVEMFLRQALGQFERFTNGIEGFDS

SEQ ID NO: 22627 - DNA, 1596 bp, Oryza sativa
  CDS (1)..(1596)
atgacgctcctgtgcgtgccgctggtgtcgcgcacggtggaggcgatgcaggccgacgcggcggcggccgcggccgccggcgccgacctcgtcgagatccggctcgacttcatcgaggggttccgcccgcgggagcacctcccgagcctgctccgtggctgccctctccctgccctcgtcacctaccggaggcgggctccagattctgcgtccatttcccggtatatccgcagcgcgtgcgcagatgctttcacacccaattgggaaggaggccagtacgatggtgatgatgctacaagatttgaagcactccgtttagcaatggagttaggcgtagactatgttgatattgaattgaaggttgctgacaaatttatcagctttatttctggcagtaagccagagaagtgtaaacttattgtctcatcacacaattatgaaagtactccgtcctgcgaggagcttgcagatcttgtggctagaatacaagcagttggatctgacatagtgaaaatcgcaacaactgctagtgacattgctgatgtgtcacgaatgttccaagtgatggtgcactgccaagtgcctatgattggactagtgatgggcgaaaaaggtttaatgtcaagggtgttatcccccaagtttggaggatatctaacctttgggactcttgatgctacaaagatatcagcacctgggcagccaaccgtcaaagaactgttggacatttataatataaggcgtataggacctgatacaaaggttcttggtcttattgccaacccagtaaaacagagcaagagcccaattttgcacaataaatgtcttcaatctattggatacaatgctgtttatcttccacttttggcagatgaccttgctcgatttctcagcacatattcatctccggatttttcaggattcagttgctctcttcctttcaaagtggacgctgtacagtgttgccatgaacatgacccagttgctaagtcaatcggtgccataaacaccataattaggagaccagatggcaaactagtgggctacaatactgactacattggagcaatttctgctattgaggatggcataggaggcccaggatcaaaggatgctgccatctcacctttggctggcaggcttgttgttgttgtaggtgctggtggagctggtaaggcaattgcttatggggcaaaggagaagggtgcaagagttgtagtagcaaatcgtacctacgaaaaagcagtaagtcttgctgctgcagtgggtggtcatgccctgagattagccgagcttgaaactttcaggcctgaagaagggatgatccttgctaatgcgacatcattgggaatgtaccccaatgtggacggcacccctatcccaaagaaagcattaagcttctatgatgttgtatttgatgcggtatatgccccgaaagttacccggcttctacgagaagcagaagaatgtgggattaaagttgtcagcggtgtagagatgtttgtcagacaagccatgggtcagtttgagcatttcacaggtggtattgaagctcctgaaagcctgatgcgtgagatagctgccaaatacacataa

SEQ ID NO: 22628 - protein, 531 aa, Oryza sativa
MTLLCVPLVSRTVEAMQADAAAAAAAGADLVEIRLDFIEGFRPREHLPSLLRGCPLPALVTYRRRAPDSASISRYIRSACADAFTPNWEGGQYDGDDATRFEALRLAMELGVDYVDIELKVADKFISFISGSKPEKCKLIVSSHNYESTPSCEELADLVARIQAVGSDIVKIATTASDIADVSRMFQVMVHCQVPMIGLVMGEKGLMSRVLSPKFGGYLTFGTLDATKISAPGQPTVKELLDIYNIRRIGPDTKVLGLIANPVKQSKSPILHNKCLQSIGYNAVYLPLLADDLARFLSTYSSPDFSGFSCSLPFKVDAVQCCHEHDPVAKSIGAINTIIRRPDGKLVGYNTDYIGAISAIEDGIGGPGSKDAAISPLAGRLVVVVGAGGAGKAIAYGAKEKGARVVVANRTYEKAVSLAAAVGGHALRLAELETFRPEEGMILANATSLGMYPNVDGTPIPKKALSFYDVVFDAVYAPKVTRLLREAEECGIKVVSGVEMFVRQAMGQFEHFTGGIEAPESLMREIAAKYT

SEQ ID NO: 22629 - DNA, 783 bp, Sulfolobus tokodaii
  CDS (1)..(783)
atgcttgagataaattatgatacgaaacttttaggtgtagttggcgaaaatatatcatatacattatcaccagcgatacacaattattcttttcaagaattaggtattaatgctgtttatttagcatttgatataaaaagtgatgaatttaaagaaatattccctgggttagtcaaaatagcatatggtttgaatattactataccttataaggaaattgcaataaaatatgtagaagctcagagtgaagcaaaaagaattggtgcaataaatactatttttaatggcaaaggatataacacagattatattgcaattaagagtttggtacaagagagaatagataaatttgaaacgtgtactatattcggtgctggtggggcagctagggcagctatttttgctttacatgatttagattgctcaattaatgttataaataggagtaaagagaaagctgaaaaattaatagaagaaatgaggaataaaaatatagaaataaaaattacatataattgcaaaagtgatataatagttaattcgactcctaatccagattttgttccagatgagtgtgttaatggtaaattagtaatcgattttgtctataaaccagtcataacttcattgatcaagagggctcagaataagaatataaaaacaataaacggtatcgaaatccttgtaaggcaagcaatggaagctgaaaaaatttggtttggaaaatcattagaagatgaagaagtggtgaattatctttatgccaggaaactcatttggtga

SEQ ID NO: 22630 - protein, 260 aa, Sulfolobus tokodaii
MLEINYDTKLLGVVGENISYTLSPAIHNYSFQELGINAVYLAFDIKSDEFKEIFPGLVKIAYGLNITIPYKEIAIKYVEAQSEAKRIGAINTIFNGKGYNTDYIAIKSLVQERIDKFETCTIFGAGGAARAAIFALHDLDCSINVINRSKEKAEKLIEEMRNKNIEIKITYNCKSDIIVNSTPNPDFVPDECVNGKLVIDFVYKPVITSLIKRAQNKNIKTINGIEILVRQAMEAEKIWFGKSLEDEEVVNYLYARKLIW

SEQ ID NO: 22631 - DNA, 804 bp, Thermoplasma volcanium
  CDS (1)..(804)
atgatgcctcctgattatgtatttgggctcataggccatcccgtatcccactcaatagggcagattgtctacaacaggtatttccagaaaaagggattaaatgccatttatctatctattgatatatttccagagacgctaaaatatttcatgtcttatgcatccaagatggatgggttcaacgttacgatacctcataaaataagtataatggattacctagaccaaatagattgggaggcccgttcaataggatctgtcaacttagtaaaaactgaggatggattattaaagggcttcaacacagactactatggcatagaatatatgttcaaaaaaggcggcgtcgatgtaagcggaaagagcatagtcgtagcagggtctggagggatagctagaactgttatacactatttaattaagaacaatgctaaaagtgtgacagtaaaagccagagatgtcaaacttgcgaagaataaacttaatgcgtacgatgtagatataaaagaatatgccaataatgattatgacatatacatcaactgcacaccgctaggcacagaggccgtcggggatccattccctgaggttcaatttggcaaagggaaaatagcagtagatgtggtctataatcctccagttactccattccttaaaagagcaggcatttcgggatcaaaaacattgtctggtcttgatctttacattggccaggctattaaaacactggatatactaacatcaggatgcgacatcgataccttaattaattccgtaagggtggccgtaaatgaagttcgctga

SEQ ID NO: 22632 - protein, 267 aa, Thermoplasma volcanium
MMPPDYVFGLIGHPVSHSIGQIVYNRYFQKKGLNAIYLSIDIFPETLKYFMSYASKMDGFNVTIPHKISIMDYLDQIDWEARSIGSVNLVKTEDGLLKGFNTDYYGIEYMFKKGGVDVSGKSIVVAGSGGIARTVIHYLIKNNAKSVTVKARDVKLAKNKLNAYDVDIKEYANNDYDIYINCTPLGTEAVGDPFPEVQFGKGKIAVDVVYNPPVTPFLKRAGISGSKTLSGLDLYIGQAIKTLDILTSGCDIDTLINSVRVAVNEVR

SEQ ID NO: 22633 - DNA, 927 bp, Streptococcus pyogenes
  CDS (1)..(927)
atgcttgtactttatgttagtagtaaactaattaaacgtaggaggatgaaatttatgtattctgcattgcttggtaatccagttgaacattctatatcagatgaattatttgaatatctaaatcacaacataggagttctggatgaatataaacataaaaaaattttggtagactcagtgtgtttagaagataaaatcaaacatctgataaatgatccaaaatgtattggattaaatataactttaccttataaaagagaggtaatgaggtatattgacaatttagacagagtagcagagataactggatctgttaacaatatttataaatctggaaatataattacaggaactaatactgattggaaaggtatttataatacattagttttctttaatattagccatataacaaaatgttgtgttttaggtactggcggtactgctagagctgctattttcgctttacaaaaactacaaatctcaccaacagttgtatacagggagccaattagtgagaatacaagaagtttgataaagagtttccctgatttaaagtatattacatataaggaattggctgatcaacaaattttaaatgatatggaaatcataataaatactacaccagttggtatgataaattatgaagaaagtttacctataaattttgatcatttggacaatgttaattataaagataaatactttatggatgtagttttcaatcctttacatacgaaacttcatgaatattttggtaaaaaaggagcaaaaataattgatggtttatgggttttgatttttcagggaattgaagcattttcattgtggagtgataaaattaatgatggtaaatattttttttcaaaagatgatgttgtcctaattcatacatttctagaagggaagataaaaggaaaatga

SEQ ID NO: 22634 - protein, 308 aa, Streptococcus pyogenes
MLVLYVSSKLIKRRRMKFMYSALLGNPVEHSISDELFEYLNHNIGVLDEYKHKKILVDSVCLEDKIKHLINDPKCIGLNITLPYKREVMRYIDNLDRVAEITGSVNNIYKSGNIITGTNTDWKGIYNTLVFFNISHITKCCVLGTGGTARAAIFALQKLQISPTVVYREPISENTRSLIKSFPDLKYITYKELADQQILNDMEIIINTTPVGMINYEESLPINFDHLDNVNYKDKYFMDVVFNPLHTKLHEYFGKKGAKIIDGLWVLIFQGIEAFSLWSDKINDGKYFFSKDDVVLIHTFLEGKIKGK

SEQ ID NO: 22635 - DNA, 867 bp, Enterococcus faecalis
  CDS (1)..(867)
atgaaagaaataactggagccactcgtttagctgggctattcgcgaaacccagccaacacagtatttcaccgttgattcataatacagcatttcaaaatttaggagttgatgctcggtatctggcgtttgacgttggacaagagacattgccacaagcaattgaagcgattcgaacgtttcacatgttaggggccaacttatcaatgcccaataaagtggcggctgtaagttatatggatgaactaagtcctaccgctcaactggttggcgcaattaatacgattgtcaacaaagatggaaaactttacggagacagcacggatggtactggttttatgtggagtttgaaagagaaaaaggttgacgtttttcagaataaaatgaccatcttaggaacaggtggtgcagccttatcaatcattgcccaagctgctttagatggcgtgaaagaaatcgccgtttacaacaggaaaagcgcgggctttaacgacagtcaaaaaaaactggcaaatttcactgaacgaaccaactgtgtaattcatttaaacgatttagcggatactgaaaaactagcaaaagatgttgctgaaagcgtcttgttagttaatgcaacgagtgtgggtatgcatccacatgcgcatagtagtcctatagaaaattatgcaatgattcaaccgaagttatttgtgtatgatgctatttataatcccagagaaacacagttattaaaagaagcccgtttacgtggtgcagaaacaagcaacggcttggacatgctactttatcaaggcgctgctgcttttgaacaatggacaggacaaaaaatgcctgtatcagtcgtaaaacgtaaaattgaaaatagataa

SEQ ID NO: 22636 - protein, 288 aa, Enterococcus faecalis
MKEITGATRLAGLFAKPSQHSISPLIHNTAFQNLGVDARYLAFDVGQETLPQAIEAIRTFHMLGANLSMPNKVAAVSYMDELSPTAQLVGAINTIVNKDGKLYGDSTDGTGFMWSLKEKKVDVFQNKMTILGTGGAALSIIAQAALDGVKEIAVYNRKSAGFNDSQKKLANFTERTNCVIHLNDLADTEKLAKDVAESVLLVNATSVGMHPHAHSSPIENYAMIQPKLFVYDAIYNPRETQLLKEARLRGAETSNGLDMLLYQGAAAFEQWTGQKMPVSVVKRKIENR

SEQ ID NO: 22637 - DNA, 813 bp, Pasteurella multocida
  CDS (1)..(813)
atgattaataaagaaacgcagctttgtatttcactggcgggtaaaccgggtaattttggcacggcgttccataattacttatatcaaaagctagggctaaactatatttataaagcgttcaccacctccgatattgaacatgcggtaaaaggtgttcgtgcgctcggcattcggggctgtgcggtatccatgccctttaaagaaagctgtatgccgtttctcgatgaaatatcggcatcagctaaagccattgagtcggtgaatacgatagtgaatgaagatggctatttaaaagcctataacaccgattacattgcgatcagcaaattgattcaacagtatcaacttgataaacatcacaaggtgattgtgcaggggagcggtggcatggcgaaagccgttgttgcagcatttaaaaatgcgggctttcacgatttgagtgtgtatgcacgtaatgcaaccacaggacagtatttagcgaatctatatggatatcaatatatcaatcatttagaaggcaatgaagcatcgattttagtgaatgcaaccccgatggggatgtctggtggagaggaaaatacgctcgctttccctgaaagtctgattgagcaagccagcagcatatttgatgttgttgctttgcccgcagaaacaccattaattcaatatgcgaaacagcaaaataagcagaccatttcaggtgcggaagtgattgtcttgcaagcggtcgaacaattcgaactctacacgcatcaacgaccaagcgaaactttgattgccgaagccgctgagtttgcgcgttcaatccgttaa

SEQ ID NO: 22638 - protein, 270 aa, Pasteurella multocida
MINKETQLCISLAGKPGNFGTAFHNYLYQKLGLNYIYKAFTTSDIEHAVKGVRALGIRGCAVSMPFKESCMPFLDEISASAKAIESVNTIVNEDGYLKAYNTDYIAISKLIQQYQLDKHHKVIVQGSGGMAKAVVAAFKNAGFHDLSVYARNATTGQYLANLYGYQYINHLEGNEASILVNATPMGMSGGEENTLAFPESLIEQASSIFDVVALPAETPLIQYAKQQNKQTISGAEVIVLQAVEQFELYTHQRPSETLIAEAAEFARSIR

SEQ ID NO: 22639 - DNA, 852 bp, Xanthomonas oryzae
  CDS (1)..(852)
atgcccgtatcccgttatgccgtgttcggtcaccccgtcgcccattccctgtcgccggctatccatgccgacttcgggaagcagaccggcattgtgctggactacaccgccatcgatgcgccgccggaggacttcagtgccgcgctgcaacgcttcgccgatggaggcggcaagggtgcgaacgtcaccctgccgttgaaagaagcggcctgtgcgctggccagtagcctcagcgatcgcgcgcggctggccggggcggtgaacaccctggtgcgtcacgagggccagtggcagggcgagaacaccgacggtattggcctggtacgtgatctcaccgatcgtcatggcctggatctgcgcggtcgccgcgtcctgctgctgggcgccggcggcgctgcacgcggcgtggcgccggcactgctgcaagccggcattaccgaaatggtggtggtgaaccgctcgcccgagcgcgccgatgcgttgtgcgatacattgggcgaacccgggcgcgtggtgtcgcgttacatcgaagacctgcgcgatctgggcgacttcgagctgatcgtcaacgccaccgccgctggccgcgaccgcgacgctggggcattcgcgatgccgctggggctggtcaacagtcttaccgctgcggtcgatctgaactatggcgccactgccatcgcgttcctggcgtgggcgcgttcggcgcaatgccggtacgccatcgacggcttgggcatgctggtagagcatgccgccgaaagcttcgcgctgtggcatggcgtgcgcccagataccgacccggtctacgccgcgctgcgcgcgcgcgaggccgtgctggtcagtgccgactga

SEQ ID NO: 22640 - protein, 283 aa, Xanthomonas oryzae
MPVSRYAVFGHPVAHSLSPAIHADFGKQTGIVLDYTAIDAPPEDFSAALQRFADGGGKGANVTLPLKEAACALASSLSDRARLAGAVNTLVRHEGQWQGENTDGIGLVRDLTDRHGLDLRGRRVLLLGAGGAARGVAPALLQAGITEMVVVNRSPERADALCDTLGEPGRVVSRYIEDLRDLGDFELIVNATAAGRDRDAGAFAMPLGLVNSLTAAVDLNYGATAIAFLAWARSAQCRYAIDGLGMLVEHAAESFALWHGVRPDTDPVYAALRAREAVLVSAD

SEQ ID NO: 22641 - DNA, 813 bp, Streptomyces lavendulae
  CDS (1)..(813)
atggaattcctcgggccggcggccggtgtctcgggcgccacgcggctgtacgcggtgctgggtgatcccgtcgcccaggtcaaggcgcccggtctgctcaaccccctgctgagcgaaagcggtctggacgccgtggtggtgccggtgcacgtccgggcgcgggatctcgccgaggtggtcgaggggctcaagcggatcggcaatctggacggtctgctggtcaccgtgccgcacaaggcggccctgtgcgggctcgcggacgggctcgggccggcggccgccctcatcgggacggccaacgcgatgcggcgcgaacccgacggccgctggtacgccgagaacttcgacgggctcgggttcgtccagggtcttcaggcggccgggcacacggtgcgcgacaggcatgtggcactggtcggcgccggaggggcgggcagcgcgatcgccacggcgctgctgatggccgacgccgcgcgggtgtccgtgcacgacaccgaccgcgcccagctcgacgcgctgctgctgcggctcgggtcccgccggccggacgggatccgggcgctggggcccggcgatctggaggcggccgatttcgccgtcaacgcgacgcctctgggcatgcgttccgaggacccgctgcccttcgaccccgcgagggtgcgaccggatgccgtggtggtcgacgtcgtcatgaagccgcacgagacggcgctgctgagcgcggccgccaccgccgggcgccgtgtgcaccacggcatccatatgctggagcagcaggttccgtgctaccgcgcgttcttcgggtggccgtga

SEQ ID NO: 22642 - protein, 270 aa, Streptomyces lavendulae
MEFLGPAAGVSGATRLYAVLGDPVAQVKAPGLLNPLLSESGLDAVVVPVHVRARDLAEVVEGLKRIGNLDGLLVTVPHKAALCGLADGLGPAAALIGTANAMRREPDGRWYAENFDGLGFVQGLQAAGHTVRDRHVALVGAGGAGSAIATALLMADAARVSVHDTDRAQLDALLLRLGSRRPDGIRALGPGDLEAADFAVNATPLGMRSEDPLPFDPARVRPDAVVVDVVMKPHETALLSAAATAGRRVHHGIHMLEQQVPCYRAFFGWP

SEQ ID NO: 22643 - DNA, 843 bp, Streptomyces collinus
  CDS (1)..(843)
atgaccgacaccccgcagcaggcccccgccggcaccccccggcagaccctggtcagcggaaccacccggctctacgccgtcctcggcgacccggtcggccaggtccagtcgcccggactgctcaacccgctcttcgcccgcctcggcatcgacgccgtactcgttcccgtgcacgtccgccccgccgacctggagccggtcgtccgcgggctccagcgcgtcggcaacctcgacggcctgttcgtcaccgtcccgcacaagacggccgccgccctgctcgccgaccggcgcagccccaccgtcgagatcaccggcagcgccaacgcgctgcgccgtgaacccgacggtacgtggctcgccgagaatttcgacggctccggcttcgtcgcgggcctcgcccaggccggtcaccagccgaagggcgcccgcgtggcacttgtcggcgcgggcggggccggcagcgccatcgcggcggccctgctcgccgccggagcggaccggttgaccctcaccgaccccgacaccccacggctgaccgccctcgtcgaccggctggccgcccactggcccggccgcgtccgggccgccggcgaaccgcccctggccgacagcgaaatcgccgtcaacgccaccccgctcggcctgcgcccccgacgacccgctgcccttcccgccgcaagggctgccaccgggcgccgttgttgccgaattatcatgaaaccccgcgagacccggctgctgggcgaggccgacgcccacggaatccacacgcaccacggacggcacatgctcaccggacagatcgactcctaccgcgcgtttttcggactgcacacgccctga

SEQ ID NO: 22644 - protein, 280 aa, Streptomyces collinus
MTDTPQQAPAGTPRQTLVSGTTRLYAVLGDPVGQVQSPGLLNPLFARLGIDAVLVPVHVRPADLEPVVRGLQRVGNLDGLFVTVPHKTAAALLADRRSPTVEITGSANALRREPDGTWLAENFDGSGFVAGLAQAGHQPKGARVALVGAGGAGSAIAAALLAAGADRLTLTDPDTPRLTALVDRLAAHWPGRVRAAGEPPLADSEIAVNATPLGLRPRRPAALPAARAATGRRCCRIIMKPRETRLLGEADAHGIHTHHGRHMLTGQIDSYRAFFGLHTP

SEQ ID NO: 22645 - DNA, 4761 bp, Emericella nidulans
  CDS (1)..(4761)
atgtcgaaccctacaaaaatcagcatccttggccgggaaagcatcatcgctgatttcgggctttggcgaaactatgtggctaaagacctgatcagtgactgctcctctaccacctacgtccttgtcactgatacgaatatcggatcgatctacacccccagctttgaagaagcttttcgaaaacgtgccgccgagattactccctccccacgcctccttatttataatcgtccccccggagaagtttccaagtcccgacagacgaaggccgatattgaggattggatgttgagtcagaaccctccatgtggccgcgataccgttgtaattgcattgggtggaggagtcatcggagatctgacaggattcgtcgcttccacctacatgcgcggtgtccgttatgtgcaggttcccactactcttctggccatggtagattcatcgatcggcgggaaaactgccatcgacactccgctgggtaagaacctgatcggcgcaatctggcaaccgacgaaaatctacattgaccttgagttcttggagacgctgccggtgagagagttcatcaatggtatggcagaggtcatcaagacggcagcaatctctagcgaagaagagtttacagctttagaagagaacgcggagacaatcttgaaggcggtccgtcgcgaggtcacgccaggagaacatcggtttgagggcacagaagagattctgaaggcccgaattctggcatctgcgcggcacaaggcgtatgttgtctcagcagacgaacgtgaggggggtctccggaaccttttgaactggggtcactctattggccatgccattgaagccattctgacgccgcaaattctccacggagagtgtgtcgcaatcggcatggtgaaggaagcagaactggcccgtcatctcggtatcctgaagggcgttgcagtctcccgcattgtcaaatgtctcgctgcttacggactgcccacctcgctgaaggacgctcgcatccggaaattgaccgccggcaagcactgctcggtcgaccagttgatgtttaacatggctcttgacaagaagaacgatggtcccaagaagaaaattgtcctcctttccgccattggaactccatatgagacccgcgccagcgttgttgccaatgaggatattcgcgtggtccttgctcccagcattgaggtacacccaggtgttgcacactcctcgaatgtcatctgtgcacctcctggatccaaaagtatttcgaaccgggccttggtcttggccgccctcggctcaggtacttgccgcatcaaaaacctgctgcactccgatgatacagaagtgatgctaaatgccctggaaaggcttggtgctgcgaccttttcctgggaagaggaaggtgaagttctggtggtgaacgggaaagggggaaatctacaagcatcttcctcgccattgtaccttggaaacgctggtacagcttcccgattcctcacaaccgtcgctacccttgccaactcaagcactgttgattccagcgtccttactggtaataaccgcatgaagcaacgtcctattggggacttggtggatgcattgaccgccaacgtccttccattgaatacgtcgaaaggacgggccagtttgcctctcaagatcgctgcttcgggcggatttgccggagggaacatcaacctggccgccaaagtgtcgtcgcagtacgtctcttcactgctcatgtgtgctccttacgccaaggaacctgtcactctgaggttggtcggcgggaagcctatctcccaaccgtacattgatatgacaacggcaatgatgcgttcgtttggcattgatgtacaaaagtcgacaaccgaagagcacacctaccacattccccagggccgttacgtgaaccctgcggaatacgttatcgaaagtgacgccagctgtgccacttacccactcgccgttgcagccgtcactggcactacctgcaccgttcccaacattggctcggcttcgctgcaaggagatgctcgtttcgctgtcgaggttttgaggcctatggggtgtactgtggagcagactgaaacttctactactgttactggaccgtcggacggcatcttacgggccacttccaaacgtggatatggaaccaatgaccgatgcgttcctcggtgcttccgtactggcagccatcgcccgatggaaaagagtcaaaccacaccacccgtatctagcggtattgccaaccagcgtgtcaaagaatgcaaccgcattaaggccatgaaggatgagcttgccaagtttggagttatctgccgcgagcacgacgacggtctcgagattgacggtattgaccgctcaaacctgcgccagcccgttggcggtgttttctgctatgatgatcaccgagttgcattcagctttagtgtactctctctcgtgacaccccagccgacacttattctcgaaaaggaatgtgttgggaagacatggcccggctggtgggataccctccgtcagctattcaaggtgaagcttgagggcaaggaattagaagaagagcctgtggctgccagcgggcccgatcgcggtaacgcttcaatttacattattggcatgcgtggtgctggaaagtcgacagctggcaactgggtttctaaggctctcaaccggccattcgttgatttggatacagagcttgagactgttgagggcatgactattccggacatcatcaagacccgcggttggcaaggctttagaaatgcggagctggaaatcctgaaacgtaccttgaaggaacgctcgagaggatacgtttttgcttgtggtggcggtgtagttgagatgcctgaagctcggaaattgctgactgactaccataagaccaagggcaacgttctgctcctcatgcgtgacatcaagaagattatggactttttgtcaatcgacaagtcccgtcctgcttacgtcgaggatatgatgggcgtgtggcttcgacggaagccatggttccaggaatgcagtaatattcaatattacagccgagatgcttctcccagtgggctggctcgcgcgtccgaggactttaaccggttcctgcaggtagctaccgggcagattgacagcctcagtattatcaaggagaaagagcactctttctttgcgtcgctgactctaccggatctgcgtgaagctggcgacatcctcgaggaagtgtgtgtcggatctgacgctgtggagctacgggtcgatcttcttaaggatcccgcctcgaacaacgacattccgtctgttgactatgtcgtagagcagctctcttttctgcgaagtcgtgtcacactccctatcatcttcaccatccgtacccagagccagggcggtcgtttccccgataacgcccacgacgctgcgttggagctgtaccgtcttgcattcaggtccgggtgtgaatttgtcgatctcgatatcgctttccctgaagacatgctgcgggccgttacagagatgaagggcttctctaagatcattgcgtcgcaccacgaccccaagggcgagctttcttgggccaacatgtcctggatcaagttctacaataaagcgcttgaatatggtgacattatcaaacttgtgggtgttgcacgaaacatcgacgacaacacagccctgcggaagttcaagaactgggctgctgaagctcacgatgtccctctcatcgccataaacatgggtgaccaggggcagctgagccgcatcctcaacggcttcatgacacccgtgtctcaccctagcttgccattcaaggcagctcccggccaactctccgcaaccgagatccgcaagggcctgtctctcatgggtgaaatcaagcccaagaagttcgccatcttcggcagtcccatatcccaatcccgctccccagctctccacaacaccctatttgcccaggtcggcctcccccataactacacccgcctggagactacgaacgcccaagatgtgcaggagttcatccgctctcctgacttcggcggcgccttccgtaacaattcgctcaagctcgacatcatgccccttctcgacgaagttgccgcggaagccgagatcatcggagctgttaacacaatcattcccgtgtcgactggcaagaacactccatcacgcctagtcggccgcaacaccgactggcagggaatgattctgtccctccgcaaagcgggagtctacggacccaagagaaaggatcaagagcagtctgccctcgtcgtcggcggcggcggcacggcccgtgcagccatctacgccctgcacaacatgggctactctcccatctacatcgttggccgcaccccgtctaagctggaaaacatggtctctactttccccagcagctacaacatccgcatcgttgagagcccttcaagcttcgagtccgttccgcacgtcgcgattggtacaatccccgccgatcaaccaattgacccgactatgcgtgagacactgtgccacatgttcgagcgcgcgcaggaggcagacgctgaagctgtgaaggccattgagcatgcgccgcgtatcctgcttgagatggcgtacaagcctcaggtgaccgcactgatgaggctggcgtctgattcaggctggaagactattcctggtttggaggtgctagttggtcaagggtggtatcatagtttaaatactggactgggatctcgccgctatatgagagtgccagggcatgtagctcccccctcatttaactaa

SEQ ID NO: 22646 - protein, 1586 aa, Emericella nidulans
MSNPTKISILGRESIIADFGLWRNYVAKDLISDCSSTTYVLVTDTNIGSIYTPSFEEAFRKRAAEITPSPRLLIYNRPPGEVSKSRQTKADIEDWMLSQNPPCGRDTVVIALGGGVIGDLTGFVASTYMRGVRYVQVPTTLLAMVDSSIGGKTAIDTPLGKNLIGAIWQPTKIYIDLEFLETLPVREFINGMAEVIKTAAISSEEEFTALEENAETILKAVRREVTPGEHRFEGTEEILKARILASARHKAYVVSADEREGGLRNLLNWGHSIGHAIEAILTPQILHGECVAIGMVKEAELARHLGILKGVAVSRIVKCLAAYGLPTSLKDARIRKLTAGKHCSVDQLMFNMALDKKNDGPKKKIVLLSAIGTPYETRASVVANEDIRVVLAPSIEVHPGVAHSSNVICAPPGSKSISNRALVLAALGSGTCRIKNLLHSDDTEVMLNALERLGAATFSWEEEGEVLVVNGKGGNLQASSSPLYLGNAGTASRFLTTVATLANSSTVDSSVLTGNNRMKQRPIGDLVDALTANVLPLNTSKGRASLPLKIAASGGFAGGNINLAAKVSSQYVSSLLMCAPYAKEPVTLRLVGGKPISQPYIDMTTAMMRSFGIDVQKSTTEEHTYHIPQGRYVNPAEYVIESDASCATYPLAVAAVTGTTCTVPNIGSASLQGDARFAVEVLRPMGCTVEQTETSTTVTGPSDGILRATSKRGYGTNDRCVPRCFRTGSHRPMEKSQTTPPVSSGIANQRVKECNRIKAMKDELAKFGVICREHDDGLEIDGIDRSNLRQPVGGVFCYDDHRVAFSFSVLSLVTPQPTLILEKECVGKTWPGWWDTLRQLFKVKLEGKELEEEPVAASGPDRGNASIYIIGMRGAGKSTAGNWVSKALNRPFVDLDTELETVEGMTIPDIIKTRGWQGFRNAELEILKRTLKERSRGYVFACGGGVVEMPEARKLLTDYHKTKGNVLLLMRDIKKIMDFLSIDKSRPAYVEDMMGVWLRRKPWFQECSNIQYYSRDASPSGLARASEDFNRFLQVATGQIDSLSIIKEKEHSFFASLTLPDLREAGDILEEVCVGSDAVELRVDLLKDPASNNDIPSVDYVVEQLSFLRSRVTLPIIFTIRTQSQGGRFPDNAHDAALELYRLAFRSGCEFVDLDIAFPEDMLRAVTEMKGFSKIIASHHDPKGELSWANMSWIKFYNKALEYGDIIKLVGVARNIDDNTALRKFKNWAAEAHDVPLIAINMGDQGQLSRILNGFMTPVSHPSLPFKAAPGQLSATEIRKGLSLMGEIKPKKFAIFGSPISQSRSPALHNTLFAQVGLPHNYTRLETTNAQDVQEFIRSPDFGGAFRNNSLKLDIMPLLDEVAAEAEIIGAVNTIIPVSTGKNTPSRLVGRNTDWQGMILSLRKAGVYGPKRKDQEQSALVVGGGGTARAAIYALHNMGYSPIYIVGRTPSKLENMVSTFPSSYNIRIVESPSSFESVPHVAIGTIPADQPIDPTMRETLCHMFERAQEADAEAVKAIEHAPRILLEMAYKPQVTALMRLASDSGWKTIPGLEVLVGQGWYHSLNTGLGSRRYMRVPGHVAPPSFN

SEQ ID NO: 22647 - DNA, 822 bp, Buchnera aphidicola
  CDS (1)..(822)
atgtgtaaacttgaaaagtttaattacgctttgtttggaaatcctattgatcacagtcaatctcctaaaattcataatttttttgctacacaaacaggtattttgcatatttataaagctattaacattccattagatcaattttcttcagtagtttcagatttttttaaaaaaaatattaaaggtgctaatgtaacagcaccttttaaaaaagaagcgtattttttttctgataagttaactgaaagagcgaagattgcacaatctgtaaatactttaaagaaaataagcgataaatgtattttaggagataatactgacggtataggattattatctgatttagttagattaaattttataaaaaaaaatttttctatattaatacttggtgcaggaggtgctgtgaaaggtgttcttttgccacttttatctttgggatgttcagtttacattttaaatcgaactattttaaatgctaaaattttagttaaacaatttaataaatatggaaaaatttttgtttttgatagacaaaattttaaacaacaaaattttgatttagttatcaatgctatgtcaagaaatactgagaaaaaaaattttttacccttatctttaattacttctaaaacttttttttacgatatgaattatagtacacgcaatacaccctttattaattggtgttctaaagcaggaggaagctttatttctaatggaatagggatgctggtttttcaagcagcttattcttttttagaatggcacaatgtacttccagaaataaattatattattaatattttaaatataaaataa

SEQ ID NO: 22648 - protein, 273 aa, Buchnera aphidicola
MCKLEKFNYALFGNPIDHSQSPKIHNFFATQTGILHIYKAINIPLDQFSSVVSDFFKKNIKGANVTAPFKKEAYFFSDKLTERAKIAQSVNTLKKISDKCILGDNTDGIGLLSDLVRLNFIKKNFSILILGAGGAVKGVLLPLLSLGCSVYILNRTILNAKILVKQFNKYGKIFVFDRQNFKQQNFDLVINAMSRNTEKKNFLPLSLITSKTFFYDMNYSTRNTPFINWCSKAGGSFISNGIGMLVFQAAYSFLEWHNVLPEINYIINILNIK

SEQ ID NO: 22649 - DNA, 888 bp, Chlorobium tepidum
  CDS (1)..(888)
atgtcaaactctcagtccaaaaagattttcggactcatcggcaaacacgtcgattactcctggtcgccactgattcacaataccggattcgaggcactcgggcttccctgcgtctacaccattttcaacatcccttcgcccgaaatgatcggcgatgcactcaaaggaagccgtgctctcggcattgcgggattcagcgtaaccattccgtacaagaaaaccgtcgtgccattccttgacgaactctcacctgaagcgctctccatcggggcggtcaacaccatcgtcaacgacaacggacggctgctcggctacaatacggacatcgacggtttcgctgctccgctccttccgatggcggagtcgatccggaacaggccggtctgcatcttcggcaacggcggagccgcgctggccgccgtcgaagctttcaggctccgcttcaacccttcatcggtgctcctcgtggtgcgggatacgcagaaagccgaagatatgctcgaagagtacgcataccgcgacctcgtcaccatccatgcgggccgggagatcgaccagcccgcgtgcagcaaactgatccgcgattgccgcgtactggtcaacgcaacgccggtcggcactgccggaagaaacgatcacatccacagcatcctgccgaccggacacgggctcctgcacgatggccagatcgtttacgacatggtctacaatccgcccgaaacacccctgctcgccgaagcccgcgccgcaggagcaactgtcattgcgggcatcgagatgctcatcgcccaggccgcccgtgccttctccatctggacaggacaggaacttccggtcgatctggtcagaaaaaccgtactcgctgcaatcgaaaagagcgaaggctga

SEQ ID NO: 22650 - protein, 295 aa, Chlorobium tepidum
MSNSQSKKIFGLIGKHVDYSWSPLIHNTGFEALGLPCVYTIFNIPSPEMIGDALKGSRALGIAGFSVTIPYKKTVVPFLDELSPEALSIGAVNTIVNDNGRLLGYNTDIDGFAAPLLPMAESIRNRPVCIFGNGGAALAAVEAFRLRFNPSSVLLVVRDTQKAEDMLEEYAYRDLVTIHAGREIDQPACSKLIRDCRVLVNATPVGTAGRNDHIHSILPTGHGLLHDGQIVYDMVYNPPETPLLAEARAAGATVIAGIEMLIAQAARAFSIWTGQELPVDLVRKTVLAAIEKSEG

SEQ ID NO: 22651 - DNA, 816 bp, Clostridium perfringens
  CDS (1)..(816)
atgaagttatttggattaataggtgagaagttaggacatagtttatctccagagatacataataaagtttttaaagataataatatagatggattatataatcttttttctgtaaaaaaagattttgaaaataatattgtagaaagtctaaaatgcttaggagtaaagggagccaatgttacaataccatataaagagaaggttatggatcagctagatattatttcacatgaggccaaagttataggagcagtaaatactattttaataaaagatgggaaatcctatggttataacactgattattatggatttggtaaaatgctagaaagagcaaaggttaatattgaaggaaatagcttttttgttttaggagcagggggagcagctagaagtattttaaaatatttagaggatagcaaagctaaaaaaatagttttggtttctagggacaaagagaaagcttttaaaaaatttaaagatttcaatattaattttatgagttatggtgagcttgaagaaattaatgaagagtttgcgttaatcaatacaactccctgtggaatgtatcctaatacaaattcagtagctgtttcagaaaaggtaattaaaaagtttaaggttgctgtggatatagtctataatcctttagaaactaagtttttaaaaatggctaaggataatggtcttaaaacagtggatggattatttatgttagttggacaaggggttaaagctgaagagatttggaatggaataaaagtagataagtctacagaagaagagatatatgaagaattgaaatgtagattttaa

SEQ ID NO: 22652 - protein, 271 aa, Clostridium perfringens
MKLFGLIGEKLGHSLSPEIHNKVFKDNNIDGLYNLFSVKKDFENNIVESLKCLGVKGANVTIPYKEKVMDQLDIISHEAKVIGAVNTILIKDGKSYGYNTDYYGFGKMLERAKVNIEGNSFFVLGAGGAARSILKYLEDSKAKKIVLVSRDKEKAFKKFKDFNINFMSYGELEEINEEFALINTTPCGMYPNTNSVAVSEKVIKKFKVAVDIVYNPLETKFLKMAKDNGLKTVDGLFMLVGQGVKAEEIWNGIKVDKSTEEEIYEELKCRF

SEQ ID NO: 22653 - DNA, 852 bp, Corynebacterium glutamicum
  CDS (1)..(852)
atgaacgacagtattctcctcggcctaatcggccagggcctcgacctatcgcgcacccccgcaatgcacgaggcggaaggcctcgcgcagggacgtgcgacggtgtacaggcgcatcgacacgcttgggtcgcgtgcttccgggcaagatttaaagacgcttctcgacgccgccctctaccttggcttcaacggcctgaacatcactcacccgtacaaacaagcagtattacccctgcttgacgaagtctccgaacaagccacccaactcggcgcagtgaatactgtcgttatcgacgccaccggccacaccaccggccacaacaccgacgtctccggatttggccgcggaatggaagaaggcctccccaacgccaagctcgattccgtcgtgcaggtcggcgccggcggcgtaggaaacgcagtggcatacgccctggtcacccacggtgtgcagaaacttcaggtcgctgacctcgacacttcccgcgcgcaggcactggcagatgtcatcaacaacgcagtcggccgtgaagccgtcgtgggagtagacgcccgcggcatcgaagacgtcatcgccgccgccgacggagtagtcaacgcaacccccatgggaatgccagcacaccccggcaccgcctttgatgtcagctgcctcaccaaggatcactgggttggcgacgtcgtgtacatgcccatcgaaactgaacttctcaaagccgcccgtgccctcggctgcgaaaccctcgacggaacccgcatggcaatccaccaagccgtcgatgccttccgactgttcaccggcctcgaacccgacgtctcccgcatgcgggaaactttcctgtccctctaa

SEQ ID NO: 22654 - protein, 283 aa, Corynebacterium glutamicum
MNDSILLGLIGQGLDLSRTPAMHEAEGLAQGRATVYRRIDTLGSRASGQDLKTLLDAALYLGFNGLNITHPYKQAVLPLLDEVSEQATQLGAVNTVVIDATGHTTGHNTDVSGFGRGMEEGLPNAKLDSVVQVGAGGVGNAVAYALVTHGVQKLQVADLDTSRAQALADVINNAVGREAVVGVDARGIEDVIAAADGVVNATPMGMPAHPGTAFDVSCLTKDHWVGDVVYMPIETELLKAARALGCETLDGTRMAIHQAVDAFRLFTGLEPDVSRMRETFLSL

SEQ ID NO: 22655 - DNA, 819 bp, Escherichia coli O6
  CDS (1)..(819)
atggaaacctatgctgtttttggtaatccgatagcccacagcaaatcgccattcattcatcagcaatttgctcagcaactgaatattgaacatccctatgggcgtgtgttggcacccatcaatgatttcatcaacacactgaacactttctttagtgctggtggtaaaggtgcgaatgtgacggtaccttttaaagaagaggcttttgccagagcggatgagcttactgaacgggcagcgttggctggtgctgttaataccctcaagcggttagaagatggacgcctgctgggtgacaataccgatggtataggtttgttaagcgatctggaacgtctgtcttttatccgtcctggtttacgtattctgctcattggcgctggtggagcatctcgcggcgtactactgccactcctttccctggactgtgcggtgacaatcactaatcggacggtatcccgcgcggaagagttggctaaattgtttgcgcacactggcagtattcacgcgttgggtatggacgaactggaaggtcatgagtttgatctcattattaatgcaacatccagtggcatcagtggtgatattccggcgatcccgccatcgctcattcatccaggcatttattgctatgacatgttctatcagaaaggaaaaactccttttctggcatggtgtgagcagcgaggctcaaaacgtactgctgatggtttaggaatgctggtggcacaagcggctcatgccttccttctttggcatggcgttctgcctgatgtagaaccggtcatcaaactattgcaacaggagttgtcagcgtga

SEQ ID NO: 22656 - protein, 272 aa, Escherichia coli O6
METYAVFGNPIAHSKSPFIHQQFAQQLNIEHPYGRVLAPINDFINTLNTFFSAGGKGANVTVPFKEEAFARADELTERAALAGAVNTLKRLEDGRLLGDNTDGIGLLSDLERLSFIRPGLRILLIGAGGASRGVLLPLLSLDCAVTITNRTVSRAEELAKLFAHTGSIHALGMDELEGHEFDLIINATSSGISGDIPAIPPSLIHPGIYCYDMFYQKGKTPFLAWCEQRGSKRTADGLGMLVAQAAHAFLLWHGVLPDVEPVIKLLQQELSA

SEQ ID NO: 22657 - DNA, 843 bp, Methanosarcina acetivorans
  CDS (1)..(843)
atgaagcgagtttttggtgtatttggagaccctgtaggtcattctctttcccctgccatgcataattcagcgttttccgcacttggcatggactgcatctaccatgctttcagggtcaggccggaaaacctgagaaaagcaatcctgggagccgaagccatgggatttggagggcttaacctgacagtcccgttaaaagaagaagctctgaaactggatttcatcaggcctgacccccttgccgagagaatcggagcagtaaataccgtagttttcagtgaaacaggagaaatccggggatacaacaccgacggactcggagcaaggcaggctcttctcgaagctgcagtggaaataagggggtctaaagtggtggttgcaggggcaggaggagcagcaagagcagttgctttccagcttgcagccgacggtgccgagatcaccgtagtaaaccggaccgaagaaagggcagtcgaacttgcaaaagatgtcgcagctgcgtccctgccgggaaaaataaacggaaccgggctttcggggctaaaggaactgctgcgagatgcagacatcctgatcaataccacgactctcgggatgcatccgaacacggatacaacgattgcgacagcagaagaacttcacagcggccttactgtttttgatattgtctataaccctcttgagaccaggcttttaaaggaagcaaaggttgcaggggcaaaaaccgtaagcggggttttaatgctcgtctaccagggagcagaagctttcaaactctggacaggagtcgaagctccggccgaactcatgaaaaaaaccgtcctggaggctctgcaggcttga

SEQ ID NO: 22658 - protein, 280 aa, Methanosarcina acetivorans
MKRVFGVFGDPVGHSLSPAMHNSAFSALGMDCIYHAFRVRPENLRKAILGAEAMGFGGLNLTVPLKEEALKLDFIRPDPLAERIGAVNTVVFSETGEIRGYNTDGLGARQALLEAAVEIRGSKVVVAGAGGAARAVAFQLAADGAEITVVNRTEERAVELAKDVAAASLPGKINGTGLSGLKELLRDADILINTTTLGMHPNTDTTIATAEELHSGLTVFDIVYNPLETRLLKEAKVAGAKTVSGVLMLVYQGAEAFKLWTGVEAPAELMKKTVLEALQA

SEQ ID NO: 22659 - DNA, 873 bp, Methanopyrus kandleri
  CDS (1)..(873)
atgagcgtgtccgtatcggtcgacgctgaaaccaacgtcgtgggactcatcggacatcccgtcgagcactccctgtctccggccatgcacaacgccgcgttcaaggagctcggactgaactacgtgtacctggccttcgacgtgccaccggagaggctcgagggcgccgtccgaggtgccgccgatctggggatcgtcggccttaacgtgacgatacctcacaaagaagcggtcatggagctgtgcgatgagctagatcgcgacgccgaactgatcggggccgtgaacaccgtcaggttctcacggggtaaaatcgagggattcaacaccgacggcgaggggttcctgcgggcgctgcgggaagagacctacttcgatcctcgaggtaccaagtccgtgatcctcggtgcaggaggcgcggcccgcgccgtctccttcaagctcgccacggaaggggccgacgagatcgtcatcgccaaccgtacggtagaccgggcagagaggctcgcggaggagctgaaggagaaagtgggggtaaaggcacgcgccatagggctggacggggacgaaatcgagagggagcttcgggacgccgacctgctggttgacgccacgccggtcggtatgtacccgaacgaggacgaaccacccctcgttaccgctgaccaaatgcacgaggacttgatcgtgaacgacctcgtgtacaacccaccgaggacgcggctgctcgaggaggccgagaaggcgggagccaccccggtgagcggtgttggcatgttagtgtaccagggggcactggcgttcgagctgtggacgggggaagaggcaccggtggaggtcatgagggaagccgtcctggaacacctccgatga

SEQ ID NO: 22660 - protein, 290 aa, Methanopyrus kandleri
MSVSVSVDAETNVVGLIGHPVEHSLSPAMHNAAFKELGLNYVYLAFDVPPERLEGAVRGAADLGIVGLNVTIPHKEAVMELCDELDRDAELIGAVNTVRFSRGKIEGFNTDGEGFLRALREETYFDPRGTKSVILGAGGAARAVSFKLATEGADEIVIANRTVDRAERLAEELKEKVGVKARAIGLDGDEIERELRDADLLVDATPVGMYPNEDEPPLVTADQMHEDLIVNDLVYNPPRTRLLEEAEKAGATPVSGVGMLVYQGALAFELWTGEEAPVEVMREAVLEHLR

SEQ ID NO: 22661 - DNA, 843 bp, Methanosarcina mazei
  CDS (1)..(843)
atgaagcaggtttttggtgtatttggagaccctgtaggtcattccctttccccagccatgcataatgcagctttttcagcacttggcatggactgtatctatcacgctttcagggtcactccagaaaagctggaaaaagcgatccttggagctgaagctatgggatttggagggattaaccttacagttcccttgaaagaaaaggctttaaaacttgacttcgtcaagcctgacccccttgcaaagagaattggagcagtgaatactctggtattcgggaaaaagggagatatccagggatataacactgacgggcctggggcaaagcaggcgcttctggacactggagtggaaattagggggtccagaatggtggtcgcaggagcaggaggagcagcaagggcagttgcttttcagcttgcagccgacggtgcagatatcacagtaataaacaggacagaagaaagggcagtaggacttgcaagagaaatctcggctgcagaccttccgggaaaaatcagaggtaccgggctttcaggattaaaagaactgttaagggatgccgatgtcctgataaataccacaactctcggaatgcacccgaacacggacgcaactattgtaacagcagaagagcttcacagcggccttacagtttttgatatcgtatataacccacttgagacaaggcttttaagggaagccaggacatcaggagcaaaaacgataagcggggttttaatgctcgtctatcagggagcagaagctttcaggctctggacaggggttgagcctccgctggagcttatgaaaaagaccgtactggaggctctgcaagcttga

SEQ ID NO: 22662 - protein, 280 aa, Methanosarcina mazei
MKQVFGVFGDPVGHSLSPAMHNAAFSALGMDCIYHAFRVTPEKLEKAILGAEAMGFGGINLTVPLKEKALKLDFVKPDPLAKRIGAVNTLVFGKKGDIQGYNTDGPGAKQALLDTGVEIRGSRMVVAGAGGAARAVAFQLAADGADITVINRTEERAVGLAREISAADLPGKIRGTGLSGLKELLRDADVLINTTTLGMHPNTDATIVTAEELHSGLTVFDIVYNPLETRLLREARTSGAKTISGVLMLVYQGAEAFRLWTGVEPPLELMKKTVLEALQA

SEQ ID NO: 22663 - DNA, 810 bp, Neisseria mucosa
  CDS (1)..(810)
atgaacactgttccccgttatgccgttttcggcaaccccgtcgcgcacagcaaatcgccgcaaatccatcggcagtttgccttgcaggaaggcgtcgaaatcgaatatgagcgcatttgcgccgacaccggcggtttcgcgcaggcggtcgaagcgttttttgccgacggcgggcgcggggcgaatgttaccgtaccgttcaagcaggaagcgtttgccttgtcggacgaacattccgaacgcgcgttggcagcgggtgcggtcaatacgctgattttgctggaaaacggtaaaatacgcggcgacaataccgacggaatcggactgacggacgatatttcaaagaggctgggcgtggaactgtcaggtaaaaccgtcttgctgctcggcgcgggcggcgcggtgcgcggcgtgattcccgtattgaaagaataccgccccgcgcgcatcgttatcgccaaccggacccacaccaaagcggcggaaatggcggcgcatttcggtattgaagccatacctttggatgaactggaaggcggcttcgacatcatcatcaacggcacatccggcggcttaagcggacagcttcccgccgtatcgcccaaagtctttgaacattgcactttggcttacgatatggtttacggcgaagcggcagagccgtttttagcgttcgcccgccaatcaggcgcaaaacaaaccgccgacggattgggcatgctggtcggacaggcggcagcttcctaccggctttggcgcggtttcgcgcccgatgtcctgcccgtcgtccaatatatgagagagttataa

SEQ ID NO: 22664 - protein, 269 aa, Neisseria mucosa
MNTVPRYAVFGNPVAHSKSPQIHRQFALQEGVEIEYERICADTGGFAQAVEAFFADGGRGANVTVPFKQEAFALSDEHSERALAAGAVNTLILLENGKIRGDNTDGIGLTDDISKRLGVELSGKTVLLLGAGGAVRGVIPVLKEYRPARIVIANRTHTKAAEMAAHFGIEAIPLDELEGGFDIIINGTSGGLSGQLPAVSPKVFEHCTLAYDMVYGEAAEPFLAFARQSGAKQTADGLGMLVGQAAASYRLWRGFAPDVLPVVQYMREL

SEQ ID NO: 22665 - DNA, 810 bp, Neisseria pharyngis
  CDS (1)..(810)
atgaacactattccccgttatgccgttttcggcaaccccgtcgcgcacagcaaatcgccgcaaatccatcggcagtttgccttgcaggaaggcgtcgaaatcgaatacgaacgcatttgcgccgacatcggcggtttcgcgcaggcggttgaagcgttttttgccaacggcgggcgcggggcaaatgttaccgtaccgttcaaacaggaagcgtttgccttgtcggacgaacattcggaacgcgctttggcggcgggtgcggtcaatacgctgattttgctggaaaacggtaaaatacgcggcgacaataccgacggactcggactgacggacgatattgcaaagaggttgggcgtagagatttccgacaaaaccgtcttgctgctcggcgcgggcggcgcggtgcgcggcgtcattcccgtattaaaagaataccaccccgctcgcatcgttatcgccaaccgaacccatgccaaagcagcggaaatggcggtgcatttcgatatagatgccgtccctttggatgaactggaaggcggcttcgacatcatcatcaacggcacatccggcggcttaagcggacagcttcccgccgtttcgccgaaaatttttgaacattgcactttggcttacgatatggtttacggcgaagcggcagaaccgtttttagcgttcgcccgccaatcaggcgcaaaacaaaccgccgacggattgggcatgctggtcggacaggcggcggcttcctaccgtctctggcgcggctttgcgcccgatgtcctgcccgtcgtccaatatatgagagagttataa

SEQ ID NO: 22666 - protein, 269 aa, Neisseria pharyngis
MNTIPRYAVFGNPVAHSKSPQIHRQFALQEGVEIEYERICADIGGFAQAVEAFFANGGRGANVTVPFKQEAFALSDEHSERALAAGAVNTLILLENGKIRGDNTDGLGLTDDIAKRLGVEISDKTVLLLGAGGAVRGVIPVLKEYHPARIVIANRTHAKAAEMAVHFDIDAVPLDELEGGFDIIINGTSGGLSGQLPAVSPKIFEHCTLAYDMVYGEAAEPFLAFARQSGAKQTADGLGMLVGQAAASYRLWRGFAPDVLPVVQYMREL

SEQ ID NO: 22667 - DNA, 810 bp, Neisseria polysaccharea
  CDS (1)..(810)
atgaccgccctcccccgctacgccgttttcggcaatcccgtcgcacacagcaagtcgccgcagattcatcagcaatttacccttcaggaaggcgttgacatcgaatacggacgcatttgcgccgacatcgacggttttgcacaggcggtttcgacattttttgaaacaggcggctgcggtgcaaacgtaaccgtgccgttcaaacaagaagcttttgcgctggcggacgagcattccgaccgcgctttggcagcaggtgcggtcaatacgctgattctgttgaaaaacggcaagctgcgtggcgacaacaccgacggtatcggtttggtcaacgacatcacgcaggtcaaaaacattgccattgagggcaaaaccattttgcttttgggcgcgggcggcgcggtgcgcggcgtgattccggtattgaaagaacaccgccctgcccgtatcgtcattgccaaccgtacccacgccaaagccgaggaattggcgcggcttttcggcattgaagccgtcccgatggcagatttgaacggcggtttcgatatcatcatcaacggcacgtccggcggcttgagtggtcagcttcctgccgtcaatcctgaaattttccgcagctgccgccttgcctacgatatggtttacggcgacgcagcgcagacgtttttaaactttgcccaaagcaacggtgctgccgaagtttcagacggcctgggcatgctggtcggtcaggctgccgcctcctaccatatttggcgcgggtttacgcctgatatccgccccgtcatcgaatacatgaaagccctgtaa

SEQ ID NO: 22668 - protein, 269 aa, Neisseria polysaccharea
MTALPRYAVFGNPVAHSKSPQIHQQFTLQEGVDIEYGRICADIDGFAQAVSTFFETGGCGANVTVPFKQEAFALADEHSDRALAAGAVNTLILLKNGKLRGDNTDGIGLVNDITQVKNIAIEGKTILLLGAGGAVRGVIPVLKEHRPARIVIANRTHAKAEELARLFGIEAVPMADLNGGFDIIINGTSGGLSGQLPAVNPEIFRSCRLAYDMVYGDAAQTFLNFAQSNGAAEVSDGLGMLVGQAAASYHIWRGFTPDIRPVIEYMKAL

SEQ ID NO: 22669 - DNA, 810 bp, Pasteurella multocida
  CDS (1)..(810)
atggataaatacgcggtatggggcaatccaatcgcccaaagtaaatcaccacaaattcatcaaatctttgccaatcaaactcagcaacagatggaatacgtggcaatgttaggtgatgaacaagattttgaacagcaattacgcgtcttctttgaaaaaggcgccaaaggttgcaacattaccgcgccgtttaaagagcgggcgtttcagttagcggatcttcacagcgagcgttgtttgacggcggaagcctgtaataccttgaaaaaattagacgacgggcgtctctatggcgataacaccgatggagcaggtttagtcagtgatttacaacgcttaggttggcttaagccagaacaaaccattttgattttgggcgcaggtggcgcgacaaaaggtgtgttgttaccgttattacaagccaagcaacatattgtgttggctaaccgtaccttaagtaaggcagaggatttggcacaaaaatttgcgcaatatgggcaaatccaagcagttgagctggataatatccccgtgcaatccttcgatttaatcatcaacgccacctcatcaggcttgcacgggcaaacggtacagatgaaccctgaaattttgcaaaacgctaccgcactttacgatatgcaatatgctaaacaagccgatacgccgtttgtggcgttatgcaaacaattaggcaagcaaaacgtcagcgatggctttggtatgttggtggcacaagccgctcacgcttttcatttatggcgaggggtgatgccagaatttgaggcgttgctagaacaagagtggctttaa

SEQ ID NO: 22670 - protein, 269 aa, Pasteurella multocida
MDKYAVWGNPIAQSKSPQIHQIFANQTQQQMEYVAMLGDEQDFEQQLRVFFEKGAKGCNITAPFKERAFQLADLHSERCLTAEACNTLKKLDDGRLYGDNTDGAGLVSDLQRLGWLKPEQTILILGAGGATKGVLLPLLQAKQHIVLANRTLSKAEDLAQKFAQYGQIQAVELDNIPVQSFDLIINATSSGLHGQTVQMNPEILQNATALYDMQYAKQADTPFVALCKQLGKQNVSDGFGMLVAQAAHAFHLWRGVMPEFEALLEQEWL

SEQ ID NO: 22671 - DNA, 816 bp, Pyrococcus furiosus
  CDS (1)..(816)
atgataaacggagaaacaaaaatttatggaataattggcaatccagtaaaacactccttgagcccaataatgcacaacgccctattcaaaaaatttggaataaatgccatttacgtcccattcgaagtgaaaaaagatctaaagaatgcaataaacggtgttaaggcacttgacattcagggagtaaacgttacaatgccctacaaagaagaagttataaaattccttgatgagctctccgaagactctcaaaatataggaagcgtaaacactgttgtgaaccttgaaggaaagctagtggggtatacaacggatggaataggagccagaagagcattggagcgatttactcaggtagatggggccaacattttaattctaggagcaggaggtgctggaaaagcaattgcatatgaactctcaaaagttgcaaatgtcgtagtcttaaacagaaccatagagaaagccaagaggttagaaaagtttggaatagtgggagactccctagaagccctcccatattatgtcgagtgggcagatatactgattaatgcaacctcagttggaatgaatgaagaaaaaagtctagtaccaaagaatctcctaagacctgggctagttgttatggatatagtctacaaaccactaaacaccctacttcttagatatgctcaggaaaagggatgtatagctattgatggactttggatgctagtctatcaaggagcagagagttttagactttggactggagaggagggagacgtagaacttatgaggagggtcgcccttgcgtggcttagggaaaggaagtag

SEQ ID NO: 22672 - protein, 271 aa, Pyrococcus furiosus
MINGETKIYGIIGNPVKHSLSPIMHNALFKKFGINAIYVPFEVKKDLKNAINGVKALDIQGVNVTMPYKEEVIKFLDELSEDSQNIGSVNTVVNLEGKLVGYTTDGIGARRALERFTQVDGANILILGAGGAGKAIAYELSKVANVVVLNRTIEKAKRLEKFGIVGDSLEALPYYVEWADILINATSVGMNEEKSLVPKNLLRPGLVVMDIVYKPLNTLLLRYAQEKGCIAIDGLWMLVYQGAESFRLWTGEEGDVELMRRVALAWLRERK

SEQ ID NO: 22673 - DNA, 843 bp, Rhizobium loti
  CDS (1)..(843)
atggttgaggcaacgaagaaggccttcgtcaccgggcatccgatcaagcattcgcgctcgccgaagatccacggccactggctggcccagcacggcatcgacggcagctacgaggcgatcgacgtggcgccgcaggattttgccgaattcatcgcggcattgcaggcaaacgggtttcgcggcggcaatgtcaccattccgcacaaggaagccgccttcgctgttgcccagcgccgcgaccaggcggctgaagagatcggcgccgtcaacacgctgtggttcgaggacggcgtcctgcggggcggcaacaccgatggtcacggctttgccgccaatctcgatgactgcgcgccgggctgggcgaacaccggccccgcggtcgtgctcggcgccggcggcgcgtcgcgcgccgtcatccaggcgctgaagcaacgcggtttttccgacatccgcatcgtcaaccgcacgctcgcccgggcgcaggaattgcgggatcgtttcggcgccggcgtttcggcgcatggcacggcggcgaccgacgaattgctggccgacgccggcctgctggtcaacaccacggcacttggcatggtcggcaatgaaggcctcgccgccgatccggccttgctgccggaccatgccatcgtcaccgaccttgtctatgtgccgctcgaaacacccttgctcgccgccgcgcgcgccagggggctgaagacggtcgacggcctcggcatgctgctcaaccaggccgtgcccggcttcgaacattggttcggcgtcaggcctcaggtcacggctgagctgcgcgcactcatcgttgccgatctggtgccgaagccatga

SEQ ID NO: 22674 - protein, 280 aa, Rhizobium loti
MVEATKKAFVTGHPIKHSRSPKIHGHWLAQHGIDGSYEAIDVAPQDFAEFIAALQANGFRGGNVTIPHKEAAFAVAQRRDQAAEEIGAVNTLWFEDGVLRGGNTDGHGFAANLDDCAPGWANTGPAVVLGAGGASRAVIQALKQRGFSDIRIVNRTLARAQELRDRFGAGVSAHGTAATDELLADAGLLVNTTALGMVGNEGLAADPALLPDHAIVTDLVYVPLETPLLAAARARGLKTVDGLGMLLNQAVPGFEHWFGVRPQVTAELRALIVADLVPKP

SEQ ID NO: 22675 - DNA, 861 bp, Rhizobium meliloti
  CDS (1)..(861)
atgcatgattcacgtgaaacatttgttaaccatgcctttgtcaccggctatccggtgaagcattcgcgatcgccgctcattcatggccattggctgaaacagttcggaattcgggggagctaccgggcccacgaagttacgcccgaggcctttcccgatttcatgcggcagatcaaggaaggaagaaccgacttctgcggcggcaatgtcacgattccgcataaggaggccgccttccggctggccgatcggccggacgaactgagcgccgaactcggagcggccaacacgctctggctcgagaatggaaaaatccgcgcgacgaacaccgacgggcgtggcttcgtcgccaatctggacgagcgcgccaaaggatgggaccgaatctcggccgcggtgattctcggtgccggcggcgccagccgggccgtgatacaggcgatccgcgaccgcggggtcaagacgatccatgtggtgaaccgcacgcccgagagggcgagggaactggccgatcgcttcggcacggcggtgcacgcacattcgatggcggcgcttcccgaagtcgtttccggcgccggcctcttcgtcaacacgacgtcgctcggcatggacggcgagccggcgccggcgatcgacttttcgggcctggcacccgacgccgtcgtcaccgacatcgtctatgtgccattgaagacgccgctgttgcggcaggcggaagagcagggcttccgcatcgtcgacggacttggcatgcttctccatcaggcagtgcccggatttgaaaaatggttcggtctgaggccggtcgtcgacgaaacgctaagacagatcatcatcagcgatatggacaggcacgcatga

SEQ ID NO: 22676 - protein, 286 aa, Rhizobium meliloti
MHDSRETFVNHAFVTGYPVKHSRSPLIHGHWLKQFGIRGSYRAHEVTPEAFPDFMRQIKEGRTDFCGGNVTIPHKEAAFRLADRPDELSAELGAANTLWLENGKIRATNTDGRGFVANLDERAKGWDRISAAVILGAGGASRAVIQAIRDRGVKTIHVVNRTPERARELADRFGTAVHAHSMAALPEVVSGAGLFVNTTSLGMDGEPAPAIDFSGLAPDAVVTDIVYVPLKTPLLRQAEEQGFRIVDGLGMLLHQAVPGFEKWFGLRPVVDETLRQIIISDMDRHA

SEQ ID NO: 22677 - DNA, 819 bp, Salmonella typhimurium
  CDS (1)..(819)
atggaaacctatgctgtttttggaaatccgattgcgcacagcaaatcgccatttattcatcagcaatttgctcagcagctagatattgttcacccctatggtcgcgtgctggcccctattaataatttcattaatacgcttgatgcctttttcgcggcagggggaaaaggcgcaaacatcacagtaccttttaaagaggaggcgtttgcgcgttcggatgagttaacggaacgagcatcgctggcgggagccgtcaatacattaaaacggctggaagatggtcgtttgcttggcgacaatactgacggtatcggtttattaggcgatctcgaacgtttaaattttatccgcccaggattgcgtattttgctgattggcgcgggcggcgcatcccggggcgtgctgttacctctgctttctttggattgcgcggtcactatcaccaaccgtacagcttcacgtgccgaagcgttggcgaaaatctttgctcataccggcagcgttcatgccacggatatggacaagctggatggttgtgagtttgacctaattattaatgcgacctccagcggcatacggggcgaaatcccggcgataccagcgtcacttattcacccttccctctgttgctatgacatgttctatcaaaaagggaatacgccatttctctcctggtgtgtacaacagggcgcaaaacgctacgcagatgggctgggaatgctggtggggcaggctgcacatgccgttttgctttggcacggtgtattaccgcaggtcgagccagtgattgagcagctacagcaggaattattagcgtga

SEQ ID NO: 22678 - protein, 272 aa, Salmonella typhimurium
METYAVFGNPIAHSKSPFIHQQFAQQLDIVHPYGRVLAPINNFINTLDAFFAAGGKGANITVPFKEEAFARSDELTERASLAGAVNTLKRLEDGRLLGDNTDGIGLLGDLERLNFIRPGLRILLIGAGGASRGVLLPLLSLDCAVTITNRTASRAEALAKIFAHTGSVHATDMDKLDGCEFDLIINATSSGIRGEIPAIPASLIHPSLCCYDMFYQKGNTPFLSWCVQQGAKRYADGLGMLVGQAAHAVLLWHGVLPQVEPVIEQLQQELLA

SEQ ID NO: 22679 - DNA, 807 bp, Staphylococcus aureus
  CDS (1)..(807)
atgaaatttgcagttatcggaaatcctatttcacattccttgtcgcccgttatgcatagagcaaattttaattctttaggattagatgatacttatgaagctttaaatattccaattgaagattttcatttaattaaagaaattatttcgaaaaaagaattagatggctttaatatcacaattcctcataaagaacgtatcataccgtatttagatcatgttgatgaacaagcgattaatgcaggtgcagttaacactgttttgataaaagatgacaagtggatagggtataatacagatggtattggttatgttaaaggattgcacagcgtttatccagatttagaaaatgcatacattttaattttgggcgcaggtggtgcaagtaaaggtattgcttatgaattagcaaaatttgtaaagcccaaattaactgttgcgaatagaacgatggctcgttttgaatcttggaatttaaatataaaccaaatttcattagcagatgctgaaaagtatttagctgaattcgatatcgttattaatacaacaccagcgggtatggctggaaataacgaaagtattattaatttaaagcatctttctcccaatactttaatgagtgatattgtttatataccgtataaaacacctattttagaggaagcagagcgcaagggaaaccatatttataatggcttagatatgtttgtttaccaaggtgcggaaagctttaaaatttggactaataaagatgctgatattaattctatgaaaacagcagttttacaacaattaaaaggagaataa

SEQ ID NO: 22680 - protein, 268 aa, Staphylococcus aureus
MKFAVIGNPISHSLSPVMHRANFNSLGLDDTYEALNIPIEDFHLIKEIISKKELDGFNITIPHKERIIPYLDHVDEQAINAGAVNTVLIKDDKWIGYNTDGIGYVKGLHSVYPDLENAYILILGAGGASKGIAYELAKFVKPKLTVANRTMARFESWNLNINQISLADAEKYLAEFDIVINTTPAGMAGNNESIINLKHLSPNTLMSDIVYIPYKTPILEEAERKGNHIYNGLDMFVYQGAESFKIWTNKDADINSMKTAVLQQLKGE

SEQ ID NO: 22681 - DNA, 819 bp, Staphylococcus epidermidis
  CDS (1)..(819)
atgataaaagtgaaatttgcagtaattggaaaccccatttctcattcattatcgccattgatgcatcatgctaattttcaatctttaaatttggaaaacacgtatgaagcgataaatgtaccagttaatcaatttcaagacattaaaaaaataatttcagaaaagagcattgatggattcaatgttactattccacataaagaacgtattattccgtacctagatgatattaatgaacaagcgaaatctgttggggcggtaaatacagttttagttaaagatggtaagtggattggttataatactgatggaattggttatgttaatggtttaaaacaaatatatgaaggtatagaagacgcttatatattaattttaggtgcaggtggagcaagtaaaggtatagcaaatgaattatataaaatcgttcgtccgactttaacagttgcaaatagaacgatgtctcgttttaataattggtcgttaaatattaacaaaataaatttaagccatgcagaaagccatttagatgaatttgatattataataaacactacacctgctggtatgaacggcaatacagattctgtaatttctttaaatcgtttagcttcacatactttagtaagtgatattgtttataatccatataaaacaccaatactaatagaagctgaacaaagaggtaatccaatctataatggtcttgatatgttcgttcatcaaggtgctgaaagttttaaaatttggactaatctagaaccagatataaaagcaatgaaaaacatagtaattcaaaaattgaaaggagaattatga

SEQ ID NO: 22682 - protein, 272 aa, Staphylococcus epidermidis
MIKVKFAVIGNPISHSLSPLMHHANFQSLNLENTYEAINVPVNQFQDIKKIISEKSIDGFNVTIPHKERIIPYLDDINEQAKSVGAVNTVLVKDGKWIGYNTDGIGYVNGLKQIYEGIEDAYILILGAGGASKGIANELYKIVRPTLTVANRTMSRFNNWSLNINKINLSHAESHLDEFDIIINTTPAGMNGNTDSVISLNRLASHTLVSDIVYNPYKTPILIEAEQRGNPIYNGLDMFVHQGAESFKIWTNLEPDIKAMKNIVIQKLKGEL

SEQ ID NO: 22683 - DNA, 879 bp, Streptococcus pyogenes
  CDS (1)..(879)
atgtcagaacgtttatcaggccacaccctgttggtctctttgcttgctacccctattcgtcatagtttgtctcccaaaatgcacaatgaagcctatgctaaactggggctggattatgcctaccttgcttttgaagtagggacagagcaattagcagatgccgtgcaagggattcgtgccttaggaattcgtggctccaatgtgtctatgccaaataaagaagctattttacccttattggatgacttgtccccagctgctgagttggtcggtgcagtcaatacggttgtcaataaggatggtaaaggacatctcgtggggcatattacagacggtataggagcgctcagagccttggctgacgaaggagtgtcggtaaagaacaaaatcattaccctagcaggagttggtggggctgggaaagctatcgctgtccagctcgcttttgacggcgccaaagaggttcgtttgtttaaccgacaagctacacgtctaagtagcgttcaaaagcttgtgacaaaactgaaccagctaacaaggactaaagtaacccttcaagacttggaagatcagactgcctttaaggaggccatcagggaatctcatctatttattgatgctacaagtgtaggaatgaagcctttagaaaatctaagtttgattaccgaccccgagctcattcgcccagacttggtggtctttgacatcgtgtacagcccagcagaaaccaagttactagcctttgcccgtcaacatggcgcccaaaaagtcattaatgggctaggaatggtgctttatcaaggagcagaagcttttaaattaatcactggtcaagacatgccagttgacgctattaaacctcttttaggtgatgagtaa

SEQ ID NO: 22684 - protein, 292 aa, Streptococcus pyogenes
MSERLSGHTLLVSLLATPIRHSLSPKMHNEAYAKLGLDYAYLAFEVGTEQLADAVQGIRALGIRGSNVSMPNKEAILPLLDDLSPAAELVGAVNTVVNKDGKGHLVGHITDGIGALRALADEGVSVKNKIITLAGVGGAGKAIAVQLAFDGAKEVRLFNRQATRLSSVQKLVTKLNQLTRTKVTLQDLEDQTAFKEAIRESHLFIDATSVGMKPLENLSLITDPELIRPDLVVFDIVYSPAETKLLAFARQHGAQKVINGLGMVLYQGAEAFKLITGQDMPVDAIKPLLGDE

SEQ ID NO: 22685 - DNA, 861 bp, Synechococcus elongatus
  CDS (1)..(861)
atgccgaagatctctggccaaacccagcttctgggagtcattggtgacccgattgaacacaccctctcaccggcaatgcacaatgccgcgctggagtatttggggttgaactatgtctatgtgcccttttgggtcaagccacagcagttgggggtggcgatcgctggcctagaggccctgaacgtcgttggctttaatgtcaccattccccacaaggaaaccattcttccctatttagcggatgtcagcgacctcgcccagcaggtgggagcagtcaacaccgtctatcgcagtgaaaaaggatgggtgggtactaataccgatgtgcatggcttcttggcacccctgcggcaacaatcctgcctctggtcggaaattgctgttttagtcttgggctatggcggtgcggcgcgagccgtggtcaccgcctgttatgacttgggctgccggcagatctatatcagtggtcgccaaagggaacggctaggggcctttgttgccagttggccacagatcaccctccatccccttttatggtcagagcgagccacctgtttggcaaaaatcagccttgtggtcaataccactcccattggtatgagtccccatacgggcgccacccccctaacagccgaagacttggcaaaattacccgccactgccattgtctatgacctcatctacaagcctcgccccaccctgcttttgcaattggcgatggcacggggactgcaaaccttcgacggccttgccatgcttctccatcaaggagcggcagccttggagtactggcttggccaacccgcccccactgccatcatggccactgcccttgaaactgccctagggacggagaaataa

SEQ ID NO: 22686 - protein, 286 aa, Synechococcus elongatus
MPKISGQTQLLGVIGDPIEHTLSPAMHNAALEYLGLNYVYVPFWVKPQQLGVAIAGLEALNVVGFNVTIPHKETILPYLADVSDLAQQVGAVNTVYRSEKGWVGTNTDVHGFLAPLRQQSCLWSEIAVLVLGYGGAARAVVTACYDLGCRQIYISGRQRERLGAFVASWPQITLHPLLWSERATCLAKISLVVNTTPIGMSPHTGATPLTAEDLAKLPATAIVYDLIYKPRPTLLLQLAMARGLQTFDGLAMLLHQGAAALEYWLGQPAPTAIMATALETALGTEK

SEQ ID NO: 22687 - DNA, 807 bp, Thermoplasma acidophilum
  CDS (1)..(807)
atgaacggaaatagcattatcgggctgatcgggcatcccgtatcgcattccataggccagatactttacaacaggatctttcaggacatgggcatagacgccttttacttggcgatggatgttcacatgaacgttcttccagcattcctgaagaattctttttttctaaaagcgttcaacgtgacgataccgcacaaggtatctataattccattccttgatgatctggatgaaatagcatcacaaacacgttctgttaacctcgtgataagggaacagagccgcatgaagggatacaacaccgattactacggtctggactacgcactatcttttaatcaagttgagattgaggaaaaaagaatcgtgatagccggttccggcggcattgcaagaacagtaatcagatacatgctggatcatggcgcgcatagagttgacgttctgacgaggaatgcacagaatgccagaagaaatctggatattccaggcataggcctgcatgaaaatatcgatgaggactacgacatctacgtgaactgcacacccctgggcacacttggagacggcgatcccttctcgactgtcgatttccgcagcgggcgtacgggcatagatctcgtctacaatccacctgacactcccttcctgaagagaatgcggaatgcgggcggccgaacggtctccggcctggatgtcttcatagggcagggactccggacgctggaacttgtgttcgggatcaggccagacagtatcttcagagaatatgcagtggaggctctgaatgaaatacgcaagggttag

SEQ ID NO: 22688 - protein, 268 aa, Thermoplasma acidophilum
MNGNSIIGLIGHPVSHSIGQILYNRIFQDMGIDAFYLAMDVHMNVLPAFLKNSFFLKAFNVTIPHKVSIIPFLDDLDEIASQTRSVNLVIREQSRMKGYNTDYYGLDYALSFNQVEIEEKRIVIAGSGGIARTVIRYMLDHGAHRVDVLTRNAQNARRNLDIPGIGLHENIDEDYDIYVNCTPLGTLGDGDPFSTVDFRSGRTGIDLVYNPPDTPFLKRMRNAGGRTVSGLDVFIGQGLRTLELVFGIRPDSIFREYAVEALNEIRKG

SEQ ID NO: 22689 - DNA, 843 bp, Thermoanaerobacter tengcongensis
  CDS (1)..(843)
atgaaaattgacagcaccacaaaggtctttggacttattgggcatccagtcaaacacagtctttcacctttgatacataactcttcttttgaaaagctcaatttcaatggagtgtacgtggtctttgatgtagcccctgagttattagaaaatgctgtaaaaggactaaaagctttaggtataaagggatttaatgtgactgtccctcataaagagagcgtaatgaattatttggattttgtcacggaagaggcagaaaaaattggagctgtgaatacagttgtcaatgaaaatgggattttaaaaggctacaatacagacgtacagggattcatagattccttaaaagagttgaaagaggatgtaagaggaagaaaagcctttgtactgggggcaggaggagcatcaaaagctatatgttttgcccttgcaagggaaggagtagaatcaattgtaatagccaataggactttaaataaagcgaaagcgctggcagaatacataagggaagaatttaagatgaaatgcgattactgcagtatagaagaagtggaaaaatttaatgaaattgatattctcataaacacaacttctgtggggatgcatcctgaagtggggaactctccagtttctgaggaggtagtggcaaaggcaaattttgtgtatgatttaatatacaatccttctgagacgctttttttaaagtacgcaagaaaaaacggtgtaaaaagcgcaaatggcctctcaatgcttgtgaatcaggctagctatgctttttacctctggacaggagagttttttgacaaagactttgtgtatgagaaaataaggggagaaatgtag

SEQ ID NO: 22690 - protein, 280 aa, Thermoanaerobacter tengcongensis
MKIDSTTKVFGLIGHPVKHSLSPLIHNSSFEKLNFNGVYVVFDVAPELLENAVKGLKALGIKGFNVTVPHKESVMNYLDFVTEEAEKIGAVNTVVNENGILKGYNTDVQGFIDSLKELKEDVRGRKAFVLGAGGASKAICFALAREGVESIVIANRTLNKAKALAEYIREEFKMKCDYCSIEEVEKFNEIDILINTTSVGMHPEVGNSPVSEEVVAKANFVYDLIYNPSETLFLKYARKNGVKSANGLSMLVNQASYAFYLWTGEFFDKDFVYEKIRGEM

SEQ ID NO: 22691 - DNA, 834 bp, Vibrio parahaemolyticus
  CDS (1)..(834)
atgaccccgcaaatcgatcgttacgccgtgtttggtaaccctatcgggcacagcaagtcgccatttatccatacactctttgctcgtcaaactaatcagtccctaacatacaccgcagagtgtgcgcctgtgggtggatttatcgaggcggcgaaagcattttttgctgacggcggcaaaggctgtaacgtgaccttgccttttaaagaagatgcctatcaatttgctagccgtttgaccgagcgtgctcagcttgctggagcagtgaatacacttaagaagcttgatgatggtgaaatcattggtgataacactgatggtgcaggcttagtgcaggacttgttgcaacatcaagtcgttttagaaggcgcacgtatcctgatcataggagctggtggtgccgctcgaggagtgattaaaccattgctcgatcaaaaaccaacatctctaacgataactaatcgtacattttccaaagccgaagaattggcagaattgttttctgtgtatggccctgttacagcaaaagagatgaatatcgttgctgaagagttcgatatcataatcaactctacgtctgcatcattgagtggtgagttacctgcgatctcttcctcggtgttcgccgccaatagtacaagctacgacatgatgtatggcaaaggtgataccacatttaaccaatgggctaagcaacacggtgcggcacatgcttatgatggtttaggtatgttagttggccaagctgctgagagttttatgttatggcgcggtcttcgtcctggagccaaacagattttgcgtgaattaagaaagaaccttgaaggtcaataa

SEQ ID NO: 22692 - protein, 277 aa, Vibrio parahaemolyticus
MTPQIDRYAVFGNPIGHSKSPFIHTLFARQTNQSLTYTAECAPVGGFIEAAKAFFADGGKGCNVTLPFKEDAYQFASRLTERAQLAGAVNTLKKLDDGEIIGDNTDGAGLVQDLLQHQVVLEGARILIIGAGGAARGVIKPLLDQKPTSLTITNRTFSKAEELAELFSVYGPVTAKEMNIVAEEFDIIINSTSASLSGELPAISSSVFAANSTSYDMMYGKGDTTFNQWAKQHGAAHAYDGLGMLVGQAAESFMLWRGLRPGAKQILRELRKNLEGQ

SEQ ID NO: 22693 - DNA, 852 bp, Xanthomonas axonopodis
  CDS (1)..(852)
atgcccgtctcccgttatgccgtattcggtcaccccgtcgcccattcgctgtcgccggccatccatgccgacttcgggaagcagaccggcattgcgctggactacaccgccatcgacgcgtcgctggaagacttcagcgccgcgctgcaacgcttcgccgatgaaggcggcaaaggcgcgaacgtcaccctgccgttgaaggaagccgcctatgcgctggccagcagcctgagcgatcgcgcgcggctggccggggcggtgaacacgttggtgcgtaacgacggccagtggcagggcgacaacaccgacggcgccggcctggtgcgcgacctcaccgagcgccagggcctggatctgcgtggccgccgcgtgctgctgctgggcgccggcggcgctgctcgcggcgtggcgccggcgctgctggaggcgggcatcaccgcaatggtggtggtgaaccgctcgcccgagcgcgccgatgccttgtgcgatgcgctgggcgagccggcgcgggtgacgtcgcgttacatcgaggacctgcgcgagctcggcgatttcgaactgatcgtcaatgccactgccgccggccgcgaccgcgatgccggcgcgttcgcattgccactgggcctggtcaacagcctgactgccgcggtcgatctgaattacggcgataccgcgattgcgttccttgcctgggcgcgtgcggcgcaatgccggtacgccatcgacgggctgggcatgctggtggagcaggccgccgagagcttcgcgctgtggcatggcgtgcgcccggataccgacccggtctacgccgcgctgcgcgcgcgcgaggccgtgctgatcagtgccgactga

SEQ ID NO: 22694 - protein, 283 aa, Xanthomonas axonopodis
MPVSRYAVFGHPVAHSLSPAIHADFGKQTGIALDYTAIDASLEDFSAALQRFADEGGKGANVTLPLKEAAYALASSLSDRARLAGAVNTLVRNDGQWQGDNTDGAGLVRDLTERQGLDLRGRRVLLLGAGGAARGVAPALLEAGITAMVVVNRSPERADALCDALGEPARVTSRYIEDLRELGDFELIVNATAAGRDRDAGAFALPLGLVNSLTAAVDLNYGDTAIAFLAWARAAQCRYAIDGLGMLVEQAAESFALWHGVRPDTDPVYAALRAREAVLISAD

SEQ ID NO: 22695 - DNA, 852 bp, Xanthomonas campestris
  CDS (1)..(852)
atgcccgtatcccgttatgccgtgttcggacaccccgtcgcccattcgctgtcgccggccatccatgccgacttcgggaagcagaccggcatcgcgctggactacaccgccatcgacgccgcgccggaggaattcaccgccgcgctggagcgcttcgcggccgacggtggcaagggcgccaacgtgaccctgccgctgaaggaagccgcgttcgccctgtcggcgagcctgagcgaccgcgcgcgcgtggctggtgcggtgaacacgctggtgcgcaacgacggccagtggcagggcgacaacaccgatggcgccggcctggtgcgtgacctcaccgagcggcacggcctagatctgcgcggccgccgcgtgctgctgctgggcgccggcggtgccgcacgcggcgttgcgccggcgctgctggaggccggcatcaccgagatggtggtggtgaaccgctcgcccgagcgcgccgatgcgctgtgcgatgcgctgggcgaacccgggcgcgtggtgtcgcgctatctggaagacctgcgcgagctgggcgacttcgagctgatcgtcaatgccaccgctgccggccgcgatcgcgacgccggtgcgttcgcgctgccgctgggcctggtcaacagcctcactgcggcggtggacctcaattacggcgccaccgccatcgccttccttgcctgggcacgttcggcgcagtgccgctacgccatcgacggcctgggcatgctggtcgagcaggccgcggaaagctttgcgctgtggcacggcgtgcgcccgcagaccgacccggtgtacgacgcgctgcgtgcgcgcgacgccgtgttggtcagcgccgactga

SEQ ID NO: 22696 - protein, 283 aa, Xanthomonas campestris
MPVSRYAVFGHPVAHSLSPAIHADFGKQTGIALDYTAIDAAPEEFTAALERFAADGGKGANVTLPLKEAAFALSASLSDRARVAGAVNTLVRNDGQWQGDNTDGAGLVRDLTERHGLDLRGRRVLLLGAGGAARGVAPALLEAGITEMVVVNRSPERADALCDALGEPGRVVSRYLEDLRELGDFELIVNATAAGRDRDAGAFALPLGLVNSLTAAVDLNYGATAIAFLAWARSAQCRYAIDGLGMLVEQAAESFALWHGVRPQTDPVYDALRARDAVLVSAD

SEQ ID NO: 22697 - DNA, 867 bp, Salmonella typhimurium
  CDS (1)..(867)
atggatgttaccgcaaaatatgaattaattggtcttatggcgtatcctatccgtcatagcttatcgcccgaaatgcaaaacaaagcgttagaaaaagcggggctaccgtatacctatatggctttcgaagtggataacacgacgtttgccagcgccattgaaggactgaaagcattaaaaatgcgcggtacgggcgtctccatgccaaacaaacagctcgcgtgtgagtatgtcgatgaattaacgccagcagcaaaactggttggcgctatcaacaccattgttaacgatgacggctatctacgcggctacaacacggatggtacgggccatattcgggcaattaaagaaagcggtttcgatatgcggggaaaaaccatggtgctgctcggcgcgggaggcgcggctaccgccattggcgcccaggcagctattgaaggcattaaggaaattaaactgtttaaccgtaaagatgactttttcgaaaaagcggttgcctttgcgaagcgggtgaatgaaaacactgattgtgtcgttaccgtcaccgatcttgccgatcagcacgcttttactgaagcgcttgccagcgcagatattctgacgaacggcaccaaagttggcatgaaaccattggagaacgaatccctgatcggcgatgtttccctgctccgccctgaattgctggtcaccgaatgtgtttataatccgcatatgacaaagttattgcagcaggcgcaacaagctggttgcaaaacaattgatggttacggcatgttgttatggcaaggagccgaacagtttgaactgtggacaggaaaagcgtttccattggactatgtaaagcaggtgatgggattcacagcctga

SEQ ID NO: 22698 - protein, 288 aa, Salmonella typhimurium
MDVTAKYELIGLMAYPIRHSLSPEMQNKALEKAGLPYTYMAFEVDNTTFASAIEGLKALKMRGTGVSMPNKQLACEYVDELTPAAKLVGAINTIVNDDGYLRGYNTDGTGHIRAIKESGFDMRGKTMVLLGAGGAATAIGAQAAIEGIKEIKLFNRKDDFFEKAVAFAKRVNENTDCVVTVTDLADQHAFTEALASADILTNGTKVGMKPLENESLIGDVSLLRPELLVTECVYNPHMTKLLQQAQQAGCKTIDGYGMLLWQGAEQFELWTGKAFPLDYVKQVMGFTA

SEQ ID NO: 22699 - DNA, 25 bp, Artificial sequence
  (1)..(25): primer
atggaaacctatgctgtttttggta

SEQ ID NO: 22700 - DNA, 24 bp, Artificial sequence
  (1)..(24): primer
ttacgcggacaattcctcctgcaa

SEQ ID NO: 22701 - protein, 326 aa, Artificial sequence
  Variant (2)..(2): xaa in position 2 is any amino acid
  Variant (4)..(4): xaa in position 4 is any amino acid
  Variant (7)..(8): xaa in position 7 to 8 is any amino acid
  Variant (10)..(10): xaa in position 10 is any amino acid
  Variant (13)..(13): xaa in position 13 is any amino acid
  Variant (16)..(26): xaa in position 16 to 26 is any amino acid
  Variant (27)..(31): xaa in position 27 to 31 is any or no amino acid
  Variant (33)..(53): xaa in position 33 to 53 is any amino acid
  Variant (54)..(60): xaa in position 54 to 60 is any or no amino acid
  Variant (62)..(63): xaa in position 62 to 63 is any amino acid
  Variant (68)..(68): xaa in position 68 is any amino acid
  Variant (70)..(81): xaa in position 70 to 81 is any amino acid
  Variant (82)..(83): xaa in position 82 to 83 is any or no amino acid
  Variant (85)..(87): xaa in position 85 to 87 is any or no amino acid
  Variant (94)..(94): xaa in position 94 is any amino acid
  Variant (95)..(125): xaa in position 95 to 125 is any or no amino acid
  Variant (127)..(127): xaa in position 127 is any or no amino acid
  Variant (131)..(131): xaa in position 131 is any amino acid
  Variant (132)..(132): xaa in position 132 is any or no amino acid
  Variant (134)..(137): xaa in position 134 to 137 is any amino acid
  Variant (139)..(146): xaa in position 139 to 146 is any amino acid
  Variant (147)..(165): xaa in position 147 to 165 is any or no amino acid
  Variant (172)..(174): xaa in position 172 to 174 is any amino acid
  Variant (176)..(185): xaa in position 176 to 185 is any amino acid
  Variant (186)..(188): xaa in position 186 to 188 is any or no amino acid
  Variant (190)..(190): xaa in position 190 is any amino acid
  Variant (192)..(193): xaa in position 192 to 193 is any amino acid
  Variant (195)..(210): xaa in position 195 to 210 is any amino acid
  Variant (211)..(242): xaa in position 211 to 242 is any or no amino acid
  Variant (247)..(247): xaa in position 247 is any or no amino acid
  Variant (249)..(251): xaa in position 249 to 251 is any or no amino acid
  Variant (253)..(256): xaa in position 253 to 256 is any amino acid
  Variant (257)..(283): xaa in position 257 to 283 is any or no amino acid
  Variant (286)..(286): xaa in position 286 is any amino acid
  Variant (288)..(291): xaa in position 288 to 291 is any amino acid
  Variant (292)..(292): xaa in position 292 is any or no amino acid
  Variant (294)..(294): xaa in position 294 is any amino acid
  Variant (295)..(295): xaa in position 295 is any or no amino acid
  Variant (297)..(298): xaa in position 297 to 298 is any amino acid
  Variant (300)..(302): xaa in position 300 to 302 is any amino acid
  Variant (304)..(308): xaa in position 304 to 308 is any amino acid
  Variant (309)..(310): xaa in position 309 to 310 is any or no amino acid
  Variant (312)..(313): xaa in position 312 to 313 is any amino acid
  Variant (315)..(315): xaa in position 315 is any amino acid
  Variant (317)..(317): xaa in position 317 is any amino acid
  Variant (320)..(322): xaa in position 320 to 322 is any amino acid
  Variant (324)..(325): xaa in position 324 to 325 is any amino acid
VXGXPIXXSXSPXIHXXXXXXXXXXXXXXXXYXXXXXXXXXXXXXXXXXXXXXXXXXXXXGXXVTIPXKXXXXXXXXXXXXXXAXXXGAVNTLXXXXXXXXXXXXXXXXXXXXXXXXXXXXXXXXGXNTDXXGXXXXLXXXXXXXXXXXXXXXXXXXXXXXXXXXILGAGGXXXAXXXXXXXXXXXXXIXIXXRXXXXXXXXXXXXXXXXXXXXXXXXXXXXXXXXXXXXXXXXXXXXXXXXLIINXTXXXMXXXXXXXXXXXXXXXXXXXXXXXXXXXXXXXDMXYXXXXXTXXLXXAXXXGXXXXXXXGXXMXVXQAXXXFXXW

SEQ ID NO: 22702 - protein, 13 aa, Artificial sequence
  Variant (2)..(8): xaa in position 2 to 8 is any amino acid
  Variant (9)..(9): xaa in position 9 is any or no amino acid
  Variant (11)..(12): xaa in position 11 to 12 is any or no amino acid
GXXXXXXXXSXXP

SEQ ID NO: 22703 - protein, 31 aa, Artificial sequence
  Variant (2)..(4): xaa in position 2 to 4 is any amino acid
  Variant (5)..(5): xaa in position 5 is Gly, Asn, Ser or Thr
  Variant (6)..(6): xaa in position 6 is any amino acid
  Variant (7)..(7): xaa in position 7 is Pro or Ser
  Variant (8)..(8): xaa in position 8 is any amino acid
  Variant (10)..(22): xaa in position 10 to 22 is any amino acid
  Variant (23)..(23): xaa in position 23 is Ala, Cys, Gly, Ser or Val
  Variant (24)..(27): xaa in position 24 to 27 is any amino acid
  Variant (28)..(28): xaa in position 28 is Ala, Ser or Thr
  Variant (29)..(29): xaa in position 29 is any amino acid
GXXXXXXXKXXXXXXXXXXXXXXXXXXXXNT

SEQ ID NO: 22704 - protein, 11 aa, Artificial sequence
  Variant (4)..(5): xaa in position 4 to 5 is any amino acid
  Variant (6)..(6): xaa in position 6 is Ala or Gly
  Variant (7)..(10): xaa in position 7 to 10 is any amino acid
  Variant (11)..(11): xaa in position 11 is Phe, Ile, Leu or Met
NTDXXXXXXXX

SEQ ID NO: 22705 - protein, 9 aa, Artificial sequence
  Variant (2)..(2): xaa in position 2 is Ala, Gly, Ser or Thr
  Variant (5)..(5): xaa in position 5 is any or no amino acid
  Variant (7)..(8): xaa in position 7 to 8 is any amino acid
  Variant (9)..(9): xaa in position 9 is Ala, Gly, Ile, Leu or Val
GXGGXAXXX

SEQ ID NO: 22706 - protein, 34 aa, Artificial sequence
  Variant (2)..(20): xaa in position 2 to 20 is any amino acid
  Variant (21)..(22): xaa in position 21 to 22 is any or no amino acid
  Variant (24)..(25): xaa in position 24 to 25 is any amino acid
  Variant (26)..(26): xaa in position 26 is Ile, Leu, Met or Val
  Variant (27)..(29): xaa in position 27 to 29 is any amino acid
  Variant (31)..(31): xaa in position 31 is Ala or Gly
  Variant (32)..(33): xaa in position 32 to 33 is any amino acid
  Variant (34)..(34): xaa in position 34 is Ala, Gly, Asn, Gln, Ser or Thr
YXXXXXXXXXXXXXXXXXXXXXGXXXXXXQXXXX

SEQ ID NO: 22707 - DNA, 723 bp, Escherichia coli K12; identical to SEQ ID NO: 2001
  CDS (1)..(723)

SEQ ID NO: 22708 - protein, 240 aa, Escherichia coli K12; identical to SEQ ID NO: 2002

SEQ ID NO: 22709 - DNA, 507 bp, Aquifex aeolicus; identical to SEQ ID NO: 2003
  CDS (1)..(507)

SEQ ID NO: 22710 - protein, 168 aa, Aquifex aeolicus; identical to SEQ ID NO: 2004

SEQ ID NO: 22711 - DNA, 717 bp, Deinococcus radiodurans; identical to SEQ ID NO: 2005
  CDS (1)..(717)

SEQ ID NO: 22712 - protein, 238 aa, Deinococcus radiodurans; identical to SEQ ID NO: 2006

SEQ ID NO: 22713 - DNA, 498 bp, Campylobacter jejuni; identical to SEQ ID NO: 2007
  CDS (1)..(498)

SEQ ID NO: 22714 - protein, 165 aa, Campylobacter jejuni; identical to SEQ ID NO: 2008

SEQ ID NO: 22715 - DNA, 546 bp, Salmonella enterica subsp. enterica serovar Typhi; identical to SEQ ID NO: 2009
  CDS (1)..(546)

SEQ ID NO: 22716 - protein, 181 aa, Salmonella enterica subsp. enterica serovar Typhi; identical to SEQ ID NO: 2010

SEQ ID NO: 22717 - DNA, 522 bp, Salmonella enterica subsp. enterica serovar Typhi; identical to SEQ ID NO: 2011
  CDS (1)..(522)

SEQ ID NO: 22718 - protein, 173 aa, Salmonella enterica subsp. enterica serovar Typhi; identical to SEQ ID NO: 2012

SEQ ID NO: 22719 - DNA, 474 bp, Listeria innocua; identical to SEQ ID NO: 2013
  CDS (1)..(474)

SEQ ID NO: 22720 - protein, 157 aa, Listeria innocua; identical to SEQ ID NO: 2014

SEQ ID NO: 22721 - DNA, 474 bp, Listeria monocytogenes; identical to SEQ ID NO: 2015
  CDS (1)..(474)

SEQ ID NO: 22722 - protein, 157 aa, Listeria monocytogenes; identical to SEQ ID NO: 2016

SEQ ID NO: 22723 - DNA, 525 bp, Yersinia pestis; identical to SEQ ID NO: 2017
  CDS (1)..(525)

SEQ ID NO: 22724 - protein, 174 aa, Yersinia pestis; identical to SEQ ID NO: 2018

SEQ ID NO: 22725 - DNA, 546 bp, Nostoc sp. PCC 7120; identical to SEQ ID NO: 2019
  CDS (1)..(546)

SEQ ID NO: 22726 - protein, 181 aa, Nostoc sp. PCC 7120; identical to SEQ ID NO: 2020

SEQ ID NO: 22727 - DNA, 1479 bp, Thermotoga maritima; identical to SEQ ID NO: 2021
  CDS (1)..(1479)

SEQ ID NO: 22728 - protein, 492 aa, Thermotoga maritima; identical to SEQ ID NO: 2022

SEQ ID NO: 22729 - DNA, 525 bp, Vibrio cholerae; identical to SEQ ID NO: 2023
  CDS (1)..(525)

SEQ ID NO: 22730 - protein, 174 aa, Vibrio cholerae; identical to SEQ ID NO: 2024

SEQ ID NO: 22731 - DNA, 531 bp, Chlamydophila pneumoniae, Chlamydia pneumoniae; identical to SEQ ID NO: 2025
  CDS (1)..(531)

SEQ ID NO: 22732 - protein, 176 aa, Chlamydophila pneumoniae, Chlamydia pneumoniae; identical to SEQ ID NO: 2026

SEQ ID NO: 22733 - DNA, 477 bp, Streptococcus pneumoniae; identical to SEQ ID NO: 2027
  CDS (1)..(477)

SEQ ID NO: 22734 - protein, 158 aa, Streptococcus pneumoniae; identical to SEQ ID NO: 2028

SEQ ID NO: 22735 - DNA, 477 bp, Streptococcus pneumoniae; identical to SEQ ID NO: 2029
  CDS (1)..(477)

SEQ ID NO: 22736 - protein, 158 aa, Streptococcus pneumoniae; identical to SEQ ID NO: 2030

SEQ ID NO: 22737 - DNA, 543 bp, Xylella fastidiosa; identical to SEQ ID NO: 2031
  CDS (1)..(543)

SEQ ID NO: 22738 - protein, 180 aa, Xylella fastidiosa; identical to SEQ ID NO: 2032

SEQ ID NO: 22739 - DNA, 552 bp, Bacillus halodurans; identical to SEQ ID NO: 2033
  CDS (1)..(552)

SEQ ID NO: 22740 - protein, 183 aa, Bacillus halodurans; identical to SEQ ID NO: 2034

SEQ ID NO: 22741 - DNA, 489 bp, Helicobacter pylori; identical to SEQ ID NO: 2035
  CDS (1)..(489)

SEQ ID NO: 22742 - protein, 162 aa, Helicobacter pylori; identical to SEQ ID NO: 2036

SEQ ID NO: 22743 - DNA, 600 bp, Mycobacterium leprae; identical to SEQ ID NO: 2037
  CDS (1)..(600)

SEQ ID NO: 22744 - protein, 199 aa, Mycobacterium leprae; identical to SEQ ID NO: 2038

SEQ ID NO: 22745 - DNA, 543 bp, Haemophilus influenzae; identical to SEQ ID NO: 2039
  CDS (1)..(543)

SEQ ID NO: 22746 - protein, 180 aa, Haemophilus influenzae; identical to SEQ ID NO: 2040

SEQ ID NO: 22747 - DNA, 513 bp, Neisseria meningitidis; identical to SEQ ID NO: 2041
  CDS (1)..(513)

SEQ ID NO: 22748 - protein, 170 aa, Neisseria meningitidis; identical to SEQ ID NO: 2042

SEQ ID NO: 22749 - DNA, 603 bp, Caulobacter crescentus; identical to SEQ ID NO: 2043
  CDS (1)..(603)

SEQ ID NO: 22750 - protein, 200 aa, Caulobacter crescentus; identical to SEQ ID NO: 2044

SEQ ID NO: 22751 - DNA, 531 bp, Mycobacterium tuberculosis; identical to SEQ ID NO: 2045
  CDS (1)..(531)

SEQ ID NO: 22752 - protein, 176 aa, Mycobacterium tuberculosis; identical to SEQ ID NO: 2046

SEQ ID NO: 22753 - DNA, 489 bp, Lactococcus lactis subsp. lactis; identical to SEQ ID NO: 2047
  CDS (1)..(489)

SEQ ID NO: 22754 - protein, 162 aa, Lactococcus lactis subsp. lactis; identical to SEQ ID NO: 2048

SEQ ID NO: 22755 - DNA, 498 bp, Clostridium acetobutylicum; identical to SEQ ID NO: 2049
  CDS (1)..(498)

SEQ ID NO: 22756 - protein, 165 aa, Clostridium acetobutylicum; identical to SEQ ID NO: 2050

SEQ ID NO: 22757 - DNA, 519 bp, Pseudomonas aeruginosa; identical to SEQ ID NO: 2051
  CDS (1)..(519)

SEQ ID NO: 22758 - protein, 172 aa, Pseudomonas aeruginosa; identical to SEQ ID NO: 2052

SEQ ID NO: 22759 - DNA, 522 bp, Buchnera sp; identical to SEQ ID NO: 2053
  CDS (1)..(522)

SEQ ID NO: 22760 - protein, 173 aa, Buchnera sp; identical to SEQ ID NO: 2054

SEQ ID NO: 22761 - DNA, 501 bp, Agrobacterium tumefaciens; identical to SEQ ID NO: 2055
  CDS (1)..(501)

SEQ ID NO: 22762 - protein, 166 aa, Agrobacterium tumefaciens; identical to SEQ ID NO: 2056

SEQ ID NO: 22763 - DNA, 561 bp, Bacillus subtilis; identical to SEQ ID NO: 2057
  CDS (1)..(561)

SEQ ID NO: 22764 - protein, 186 aa, Bacillus subtilis; identical to SEQ ID NO: 2058

SEQ ID NO: 22765 - DNA, 810 bp, Escherichia coli; identical to SEQ ID NO: 2059
  CDS (286)..(810)

SEQ ID NO: 22766 - protein, 174 aa, Escherichia coli; identical to SEQ ID NO: 2060

SEQ ID NO: 22767 - DNA, 522 bp, Erwinia chrysanthemi; identical to SEQ ID NO: 2061
  CDS (1)..(522)

SEQ ID NO: 22768 - protein, 173 aa, Erwinia chrysanthemi; identical to SEQ ID NO: 2062

SEQ ID NO: 22769 - DNA, 1293 bp, Lycopersicon esculentum (tomato); identical to SEQ ID NO: 2063
  CDS (123)..(1025)

SEQ ID NO: 22770 - protein, 300 aa, Lycopersicon esculentum (tomato); identical to SEQ ID NO: 2064

SEQ ID NO: 22771 - DNA, 489 bp, Lactococcus lactis; identical to SEQ ID NO: 2065
  CDS (1)..(489)

SEQ ID NO: 22772 - protein, 162 aa, Lactococcus lactis; identical to SEQ ID NO: 2066

SEQ ID NO: 22773 - DNA, 570 bp, Synechocystis sp; identical to SEQ ID NO: 2067
  CDS (1)..(570)

SEQ ID NO: 22774 - protein, 189 aa, Synechocystis sp; identical to SEQ ID NO: 2068

SEQ ID NO: 22775 - DNA, 693 bp, Corynebacterium glutamicum; identical to SEQ ID NO: 2069
  CDS (101)..(673)

SEQ ID NO: 22776 - protein, 190 aa, Corynebacterium glutamicum; identical to SEQ ID NO: 2070

SEQ ID NO: 22777 - DNA, 522 bp, Erwinia carotovora subsp; identical to SEQ ID NO: 2071
  CDS (1)..(522)

SEQ ID NO: 22778 - protein, 173 aa, Erwinia carotovora subsp; identical to SEQ ID NO: 2072

SEQ ID NO: 22779 - DNA, 522 bp, Erwinia carotovora subsp; identical to SEQ ID NO: 2073
  CDS (1)..(522)

SEQ ID NO: 22780 - protein, 173 aa, Erwinia carotovora subsp; identical to SEQ ID NO: 2074

SEQ ID NO: 22781 - DNA, 543 bp, Acinetobacter sp; identical to SEQ ID NO: 2075
  CDS (1)..(543)

SEQ ID NO: 22782 - protein, 180 aa, Acinetobacter sp; identical to SEQ ID NO: 2076

SEQ ID NO: 22783 - DNA, 633 bp, Bartonella quintana; identical to SEQ ID NO: 2077
  CDS (1)..(633)

SEQ ID NO: 22784 - protein, 210 aa, Bartonella quintana; identical to SEQ ID NO: 2078

SEQ ID NO: 22785 - DNA, 633 bp, Bartonella henselae; identical to SEQ ID NO: 2079
  CDS (1)..(633)

SEQ ID NO: 22786 - protein, 210 aa, Bartonella henselae; identical to SEQ ID NO: 2080

SEQ ID NO: 22787 - DNA, 525 bp, Staphylococcus aureus subsp; identical to SEQ ID NO: 2081
  CDS (1)..(525)

SEQ ID NO: 22788 - protein, 174 aa, Staphylococcus aureus subsp; identical to SEQ ID NO: 2082

SEQ ID NO: 22789 - DNA, 528 bp, Photobacterium profundum; identical to SEQ ID NO: 2083
  CDS (1)..(528)

SEQ ID NO: 22790 - protein, 175 aa, Photobacterium profundum; identical to SEQ ID NO: 2084

SEQ ID NO: 22791 - DNA, 612 bp, Parachlamydia sp; identical to SEQ ID NO: 2085
  CDS (1)..(612)

SEQ ID NO: 22792 - protein, 203 aa, Parachlamydia sp; identical to SEQ ID NO: 2086

SEQ ID NO: 22793 - DNA, 918 bp, Rhodopseudomonas palustris; identical to SEQ ID NO: 2087
  CDS (1)..(918)

SEQ ID NO: 22794 - protein, 305 aa, Rhodopseudomonas palustris; identical to SEQ ID NO: 2088

SEQ ID NO: 22795 - DNA, 612 bp, Rhodopseudomonas palustris; identical to SEQ ID NO: 2089
  CDS (1)..(612)

SEQ ID NO: 22796 - protein, 203 aa, Rhodopseudomonas palustris; identical to SEQ ID NO: 2090

SEQ ID NO: 22797 - DNA, 522 bp, Corynebacterium diphtheriae; identical to SEQ ID NO: 2091
  CDS (1)..(522)

SEQ ID NO: 22798 - protein, 173 aa, Corynebacterium diphtheriae; identical to SEQ ID NO: 2092

SEQ ID NO: 22799 - DNA, 543 bp, Desulfovibrio vulgaris; identical to SEQ ID NO: 2093
  CDS (1)..(543)

SEQ ID NO: 22800 - protein, 180 aa, Desulfovibrio vulgaris; identical to SEQ ID NO: 2094

SEQ ID NO: 22801 - DNA, 528 bp, Desulfovibrio vulgaris; identical to SEQ ID NO: 2095
  CDS (1)..(528)

SEQ ID NO: 22802 - protein, 175 aa, Desulfovibrio vulgaris; identical to SEQ ID NO: 2096

SEQ ID NO: 22803 - DNA, 555 bp, Thermus thermophilus; identical to SEQ ID NO: 2097
  CDS (1)..(555)

SEQ ID NO: 22804 - protein, 184 aa, Thermus thermophilus; identical to SEQ ID NO: 2098

SEQ ID NO: 22805 - DNA, 513 bp, Bacillus cereus; identical to SEQ ID NO: 2099
  CDS (1)..(513)

SEQ ID NO: 22806 - protein, 170 aa, Bacillus cereus; identical to SEQ ID NO: 2100

SEQ ID NO: 22807 - DNA, 531 bp, Mycobacterium paratuberculosis; identical to SEQ ID NO: 2101
  CDS (1)..(531)

SEQ ID NO: 22808 - protein, 176 aa, Mycobacterium paratuberculosis; identical to SEQ ID NO: 2102

SEQ ID NO: 22809 - DNA, 528 bp, Geobacter sulfurreducens; identical to SEQ ID NO: 2103
  CDS (1)..(528)

SEQ ID NO: 22810 - protein, 175 aa, Geobacter sulfurreducens; identical to SEQ ID NO: 2104

SEQ ID NO: 22811 - DNA, 540 bp, Leptospira interrogans; identical to SEQ ID NO: 2105
  CDS (1)..(540)

SEQ ID NO: 22812 - protein, 179 aa, Leptospira interrogans; identical to SEQ ID NO: 2106

SEQ ID NO: 22813 - DNA, 501 bp, Wolinella succinogenes; identical to SEQ ID NO: 2107
  CDS (1)..(501)

SEQ ID NO: 22814 - protein, 166 aa, Wolinella succinogenes; identical to SEQ ID NO: 2108

SEQ ID NO: 22815 - DNA, 561 bp, Porphyromonas gingivalis; identical to SEQ ID NO: 2109
  CDS (1)..(561)

SEQ ID NO: 22816 - protein, 186 aa, Porphyromonas gingivalis; identical to SEQ ID NO: 2110

SEQ ID NO: 22817 - DNA, 525 bp, Photorhabdus luminescens; identical to SEQ ID NO: 2111
  CDS (1)..(525)

SEQ ID NO: 22818 - protein, 174 aa, Photorhabdus luminescens; identical to SEQ ID NO: 2112

SEQ ID NO: 22819 - DNA, 534 bp, Gloeobacter violaceus; identical to SEQ ID NO: 2113
  CDS (1)..(534)

SEQ ID NO: 22820 - protein, 177 aa, Gloeobacter violaceus; identical to SEQ ID NO: 2114

SEQ ID NO: 22821 - DNA, 555 bp, Chromobacterium violaceum; identical to SEQ ID NO: 2115
  CDS (1)..(555)

SEQ ID NO: 22822 - protein, 184 aa, Chromobacterium violaceum; identical to SEQ ID NO: 2116

SEQ ID NO: 22823 - DNA, 576 bp, Synechococcus sp; identical to SEQ ID NO: 2117
  CDS (1)..(576)

SEQ ID NO: 22824 - protein, 191 aa, Synechococcus sp; identical to SEQ ID NO: 2118

SEQ ID NO: 22825 - DNA, 564 bp, Rhodopirellula baltica; identical to SEQ ID NO: 2119
  CDS (1)..(564)

SEQ ID NO: 22826 - protein, 187 aa, Rhodopirellula baltica; identical to SEQ ID NO: 2120

SEQ ID NO: 22827 - DNA, 558 bp, Prochlorococcus marinus subsp; identical to SEQ ID NO: 2121
  CDS (1)..(558)

SEQ ID NO: 22828 - protein, 185 aa, Prochlorococcus marinus subsp; identical to SEQ ID NO: 2122

SEQ ID NO: 22829 - DNA, 579 bp, Prochlorococcus marinus; identical to SEQ ID NO: 2123
  CDS (1)..(579)

SEQ ID NO: 22830 - protein, 192 aa, Prochlorococcus marinus; identical to SEQ ID NO: 2124

SEQ ID NO: 22831 - DNA, 573 bp, Prochlorococcus marinus; identical to SEQ ID NO: 2125
  CDS (1)..(573)

SEQ ID NO: 22832 - protein, 190 aa, Prochlorococcus marinus; identical to SEQ ID NO: 2126

SEQ ID NO: 22833 - DNA, 558 bp, Candidatus Blochmannia floridanus; identical to SEQ ID NO: 2127
  CDS (1)..(558)

SEQ ID NO: 22834 - protein, 185 aa, Candidatus Blochmannia floridanus; identical to SEQ ID NO: 2128

SEQ ID NO: 22835 - DNA, 636 bp, Bordetella bronchiseptica; identical to SEQ ID NO: 2129
  CDS (1)..(636)

SEQ ID NO: 22836 - protein, 211 aa, Bordetella bronchiseptica; identical to SEQ ID NO: 2130

SEQ ID NO: 22837 - DNA, 864 bp, Oryza sativa; identical to SEQ ID NO: 2131
  CDS (1)..(864)

SEQ ID NO: 22838 - protein, 287 aa, Oryza sativa; identical to SEQ ID NO: 2132

SEQ ID NO: 22839 - DNA, 471 bp, Bacillus cereus; identical to SEQ ID NO: 2133
  CDS (1)..(471)

SEQ ID NO: 22840 - protein, 156 aa, Bacillus cereus; identical to SEQ ID NO: 2134

SEQ ID NO: 22841 - DNA, 498 bp, Bacillus anthracis; identical to SEQ ID NO: 2135
  CDS (1)..(498)

SEQ ID NO: 22842 - protein, 165 aa, Bacillus anthracis; identical to SEQ ID NO: 2136

SEQ ID NO: 22843 - DNA, 522 bp, Chlamydophila caviae; identical to SEQ ID NO: 2137
  CDS (1)..(522)

SEQ ID NO: 22844 - protein, 173 aa, Chlamydophila caviae; identical to SEQ ID NO: 2138

SEQ ID NO: 22845 - DNA, 516 bp, Streptomyces avermitilis; identical to SEQ ID NO: 2139
  CDS (1)..(516)

SEQ ID NO: 22846 - protein, 171 aa, Streptomyces avermitilis; identical to SEQ ID NO: 2140

SEQ ID NO: 22847 - DNA, 636 bp, Nitrosomonas europaea; identical to SEQ ID NO: 2141
  CDS (1)..(636)

SEQ ID NO: 22848 - protein, 211 aa, Nitrosomonas europaea; identical to SEQ ID NO: 2142

SEQ ID NO: 22849 - DNA, 507 bp, Enterococcus faecalis; identical to SEQ ID NO: 2143
  CDS (1)..(507)

SEQ ID NO: 22850 - protein, 168 aa, Enterococcus faecalis; identical to SEQ ID NO: 2144

SEQ ID NO: 22851 - DNA, 540 bp, Coxiella burnetii; identical to SEQ ID NO: 2145
  CDS (1)..(540)

SEQ ID NO: 22852 - protein, 179 aa, Coxiella burnetii; identical to SEQ ID NO: 2146

SEQ ID NO: 22853 - DNA, 510 bp, Tropheryma whipplei; identical to SEQ ID NO: 2147
  CDS (1)..(510)

SEQ ID NO: 22854 - protein, 169 aa, Tropheryma whipplei; identical to SEQ ID NO: 2148

SEQ ID NO: 22855 - DNA, 468 bp, Shigella flexneri; identical to SEQ ID NO: 2149
  CDS (1)..(468)

SEQ ID NO: 22856 - protein, 155 aa, Shigella flexneri; identical to SEQ ID NO: 2150

SEQ ID NO: 22857 - DNA, 903 bp, Azoarcus evansii; identical to SEQ ID NO: 2151
  CDS (1)..(903)

SEQ ID NO: 22858 - protein, 300 aa, Azoarcus evansii; identical to SEQ ID NO: 2152

SEQ ID NO: 22859 - DNA, 522 bp, Lactobacillus plantarum; identical to SEQ ID NO: 2153
  CDS (1)..(522)

SEQ ID NO: 22860 - protein, 173 aa, Lactobacillus plantarum; identical to SEQ ID NO: 2154

SEQ ID NO: 22861 - DNA, 504 bp, Clostridium tetani; identical to SEQ ID NO: 2155
  CDS (1)..(504)

SEQ ID NO: 22862 - protein, 167 aa, Clostridium tetani; identical to SEQ ID NO: 2156

SEQ ID NO: 22863 - DNA, 909 bp, Bradyrhizobium japonicum; identical to SEQ ID NO: 2157
  CDS (1)..(909)

SEQ ID NO: 22864 - protein, 302 aa, Bradyrhizobium japonicum; identical to SEQ ID NO: 2158

SEQ ID NO: 22865 - DNA, 735 bp, Bradyrhizobium japonicum; identical to SEQ ID NO: 2159
  CDS (1)..(735)

SEQ ID NO: 22866 - protein, 244 aa, Bradyrhizobium japonicum; identical to SEQ ID NO: 2160

SEQ ID NO: 22867 - DNA, 528 bp, Bacteroides thetaiotaomicron; identical to SEQ ID NO: 2161
  CDS (1)..(528)

SEQ ID NO: 22868 - protein, 175 aa, Bacteroides thetaiotaomicron; identical to SEQ ID NO: 2162

SEQ ID NO: 22869 - DNA, 477 bp, Streptococcus mutans; identical to SEQ ID NO: 2163
  CDS (1)..(477)

SEQ ID NO: 22870 - protein, 158 aa, Streptococcus mutans; identical to SEQ ID NO: 2164

SEQ ID NO: 22871 - DNA, 513 bp, Streptococcus agalactiae; identical to SEQ ID NO: 2165
  CDS (1)..(513)

SEQ ID NO: 22872 - protein, 170 aa, Streptococcus agalactiae; identical to SEQ ID NO: 2166

SEQ ID NO: 22873 - DNA, 603 bp, Brucella suis; identical to SEQ ID NO: 2167
  CDS (1)..(603)

SEQ ID NO: 22874 - protein, 200 aa, Brucella suis; identical to SEQ ID NO: 2168

SEQ ID NO: 22875 - DNA, 912 bp, Thauera aromatica; identical to SEQ ID NO: 2169
  CDS (1)..(912)

SEQ ID NO: 22876 - protein, 303 aa, Thauera aromatica; identical to SEQ ID NO: 2170

SEQ ID NO: 22877 - DNA, 1300 bp, Arabidopsis thaliana; identical to SEQ ID NO: 2171
  CDS (113)..(1024)

SEQ ID NO: 22878 - protein, 303 aa, Arabidopsis thaliana; identical to SEQ ID NO: 2172

SEQ ID NO: 22879 - DNA, 903 bp, Arabidopsis thaliana; identical to SEQ ID NO: 2173
  CDS (1)..(903)

SEQ ID NO: 22880 - protein, 300 aa, Arabidopsis thaliana; identical to SEQ ID NO: 2174

SEQ ID NO: 22881 - DNA, 576 bp, Chlorobium tepidum; identical to SEQ ID NO: 2175
  CDS (1)..(576)

SEQ ID NO: 22882 - protein, 191 aa, Chlorobium tepidum; identical to SEQ ID NO: 2176

SEQ ID NO: 22883 - DNA, 492 bp, Streptococcus pyogenes; identical to SEQ ID NO: 2177
  CDS (1)..(492)

SEQ ID NO: 22884 - protein, 163 aa, Streptococcus pyogenes; identical to SEQ ID NO: 2178

SEQ ID NO: 22885 - DNA, 543 bp, Xanthomonas campestris; identical to SEQ ID NO: 2179
  CDS (1)..(543)

SEQ ID NO: 22886 - protein, 180 aa, Xanthomonas campestris; identical to SEQ ID NO: 2180

SEQ ID NO: 22887 - DNA, 543 bp, Xanthomonas axonopodis; identical to SEQ ID NO: 2181
  CDS (1)..(543)

SEQ ID NO: 22888 - protein, 180 aa, Xanthomonas axonopodis; identical to SEQ ID NO: 2182

SEQ ID NO: 22889 - DNA, 531 bp, Methanosarcina mazei; identical to SEQ ID NO: 2183
  CDS (1)..(531)

SEQ ID NO: 22890 - protein, 176 aa, Methanosarcina mazei; identical to SEQ ID NO: 2184

SEQ ID NO: 22891 - DNA, 516 bp, Thermoanaerobacter tengcongensis; identical to SEQ ID NO: 2185
  CDS (1)..(516)

SEQ ID NO: 22892 - protein, 171 aa, Thermoanaerobacter tengcongensis; identical to SEQ ID NO: 2186

SEQ ID NO: 22893 - DNA, 519 bp, Fusobacterium nucleatum; identical to SEQ ID NO: 2187
  CDS (1)..(519)

SEQ ID NO: 22894 - protein, 172 aa, Fusobacterium nucleatum; identical to SEQ ID NO: 2188

SEQ ID NO: 22895 - DNA, 528 bp, Methanosarcina acetivorans; identical to SEQ ID NO: 2189
  CDS (1)..(528)

SEQ ID NO: 22896 - protein, 175 aa, Methanosarcina acetivorans; identical to SEQ ID NO: 2190

SEQ ID NO: 22897 - DNA, 516 bp, Clostridium perfringens; identical to SEQ ID NO: 2191
  CDS (1)..(516)

SEQ ID NO: 22898 - protein, 171 aa, Clostridium perfringens; identical to SEQ ID NO: 2192

SEQ ID NO: 22899 - DNA, 573 bp, Ralstonia solanacearum; identical to SEQ ID NO: 2193
  CDS (1)..(573)

SEQ ID NO: 22900 - protein, 190 aa, Ralstonia solanacearum; identical to SEQ ID NO: 2194

SEQ ID NO: 22901 - DNA, 579 bp, Rhizobium meliloti; identical to SEQ ID NO: 2195
  CDS (1)..(579)

SEQ ID NO: 22902 - protein, 192 aa, Rhizobium meliloti; identical to SEQ ID NO: 2196

SEQ ID NO: 22903 - DNA, 7122 bp, Rhizobium loti; identical to SEQ ID NO: 2197
  CDS (1)..(7122)

SEQ ID NO: 22904 - protein, 2373 aa, Rhizobium loti; identical to SEQ ID NO: 2198

SEQ ID NO: 22905 - DNA, 612 bp, Rhizobium loti; identical to SEQ ID NO: 2199
  CDS (1)..(612)

SEQ ID NO: 22906 - protein, 203 aa, Rhizobium loti; identical to SEQ ID NO: 2200

SEQ ID NO: 22907 - DNA, 516 bp, Streptomyces coelicolor; identical to SEQ ID NO: 2201
  CDS (1)..(516)

SEQ ID NO: 22908 - protein, 171 aa, Streptomyces coelicolor; identical to SEQ ID NO: 2202

SEQ ID NO: 22909 - DNA, 843 bp, Arabidopsis thaliana; identical to SEQ ID NO: 2203
  CDS (1)..(843)

SEQ ID NO: 22910 - protein, 280 aa, Arabidopsis thaliana; identical to SEQ ID NO: 2204

SEQ ID NO: 22911 - DNA, 1623 bp, Bifidobacterium longum; identical to SEQ ID NO: 2205
  CDS (1)..(1623)

SEQ ID NO: 22912 - protein, 540 aa, Bifidobacterium longum; identical to SEQ ID NO: 2206

SEQ ID NO: 22913 - DNA, 525 bp, Buchnera aphidicola; identical to SEQ ID NO: 2207
  CDS (1)..(525)

SEQ ID NO: 22914 - protein, 174 aa, Buchnera aphidicola; identical to SEQ ID NO: 2208

SEQ ID NO: 22915 - DNA, 510 bp, Corynebacterium efficiens; identical to SEQ ID NO: 2209
  CDS (1)..(510)

SEQ ID NO: 22916 - protein, 169 aa, Corynebacterium efficiens; identical to SEQ ID NO: 2210

SEQ ID NO: 22917 - DNA, 525 bp, Haemophilus ducreyi; identical to SEQ ID NO: 2211
  CDS (1)..(525)

SEQ ID NO: 22918 - protein, 174 aa, Haemophilus ducreyi; identical to SEQ ID NO: 2212

SEQ ID NO: 22919 - DNA, 504 bp, Helicobacter hepaticus; identical to SEQ ID NO: 2213
  CDS (1)..(504)

SEQ ID NO: 22920 - protein, 167 aa, Helicobacter hepaticus; identical to SEQ ID NO: 2214

SEQ ID NO: 22921 - DNA, 552 bp, Oceanobacillus iheyensis; identical to SEQ ID NO: 2215
  CDS (1)..(552)

SEQ ID NO: 22922 - protein, 183 aa, Oceanobacillus iheyensis; identical to SEQ ID NO: 2216

SEQ ID NO: 22923 - DNA, 528 bp, Pasteurella multocida; identical to SEQ ID NO: 2217
  CDS (1)..(528)

SEQ ID NO: 22924 - protein, 175 aa, Pasteurella multocida; identical to SEQ ID NO: 2218

SEQ ID NO: 22925 - DNA, 522 bp, Photorhabdus luminescens; identical to SEQ ID NO: 2219
  CDS (1)..(522)

SEQ ID NO: 22926 - protein, 173 aa, Photorhabdus luminescens; identical to SEQ ID NO: 2220

SEQ ID NO: 22927 - DNA, 519 bp, Pseudomonas putida; identical to SEQ ID NO: 2221
  CDS (1)..(519)

SEQ ID NO: 22928 - protein, 172 aa, Pseudomonas putida; identical to SEQ ID NO: 2222

SEQ ID NO: 22929 - DNA, 519 bp, Pseudomonas syringae; identical to SEQ ID NO: 2223
  CDS (1)..(519)

SEQ ID NO: 22930 - protein, 172 aa, Pseudomonas syringae; identical to SEQ ID NO: 2224

SEQ ID NO: 22931 - DNA, 516 bp, Shewanella oneidensis; identical to SEQ ID NO: 2225
  CDS (1)..(516)

SEQ ID NO: 22932 - protein, 171 aa, Shewanella oneidensis; identical to SEQ ID NO: 2226

SEQ ID NO: 22933 - DNA, 519 bp, Staphylococcus epidermidis; identical to SEQ ID NO: 2227
  CDS (7)..(519)

SEQ ID NO: 22934 - protein, 170 aa, Staphylococcus epidermidis; identical to SEQ ID NO: 2228

SEQ ID NO: 22935 - DNA, 552 bp, Synechococcus elongatus; identical to SEQ ID NO: 2229
  CDS (1)..(552)

SEQ ID NO: 22936 - protein, 183 aa, Synechococcus elongatus; identical to SEQ ID NO: 2230

SEQ ID NO: 22937 - DNA, 519 bp, Vibrio parahaemolyticus; identical to SEQ ID NO: 2231
  CDS (1)..(519)

SEQ ID NO: 22938 - protein, 172 aa, Vibrio parahaemolyticus; identical to SEQ ID NO: 2232

SEQ ID NO: 22939 - DNA, 519 bp, Vibrio vulnificus; identical to SEQ ID NO: 2233
  CDS (1)..(519)

SEQ ID NO: 22940 - protein, 172 aa, Vibrio vulnificus; identical to SEQ ID NO: 2234

SEQ ID NO: 22941 - DNA, 522 bp, Wigglesworthia glossinidia brevipalpis; identical to SEQ ID NO: 2235
  CDS (1)..(522)

SEQ ID NO: 22942 - protein, 173 aa, Wigglesworthia glossinidia brevipalpis; identical to SEQ ID NO: 2236

SEQ ID NO: 22943 - DNA, 543 bp, Xylella fastidiosa; identical to SEQ ID NO: 2237
  CDS (1)..(543)

SEQ ID NO: 22944 - protein, 180 aa, Xylella fastidiosa; identical to SEQ ID NO: 2238

SEQ ID NO: 22945 - DNA, 22 bp, Artificial sequence
  (1)..(22): primer
atggtagcaaggcagcgcgctt

SEQ ID NO: 22946 - DNA, 25 bp, Artificial sequence
  (1)..(25): primer
ttagttgctttccagcatgtgaata

SEQ ID NO: 22947 - protein, 160 aa, Artificial sequence; identical to SEQ ID NO: 2905
  Variant (2)..(2): xaa in position 2 is any amino acid
  Variant (4)..(5): xaa in position 4 to 5 is any amino acid
  Variant (7)..(7): xaa in position 7 is any amino acid
  Variant (10)..(12): xaa in position 10 to 12 is any amino acid
  Variant (14)..(16): xaa in position 14 to 16 is any amino acid
  Variant (18)..(25): xaa in position 18 to 25 is any amino acid
  Variant (27)..(27): xaa in position 27 is any amino acid
  Variant (29)..(30): xaa in position 29 to 30 is any amino acid
  Variant (32)..(46): xaa in position 32 to 46 is any amino acid
  Variant (48)..(50): xaa in position 48 to 50 is any amino acid
  Variant (53)..(54): xaa in position 53 to 54 is any amino acid
  Variant (57)..(58): xaa in position 57 to 58 is any amino acid
  Variant (60)..(78): xaa in position 60 to 78 is any amino acid
  Variant (82)..(104): xaa in position 82 to 104 is any amino acid
  Variant (106)..(114): xaa in position 106 to 114 is any amino acid
  Variant (116)..(124): xaa in position 116 to 124 is any amino acid
  Variant (127)..(155): xaa in position 127 to 155 is any amino acid
  Variant (157)..(159): xaa in position 157 to 159 is any amino acid

SEQ ID NO: 22948 - protein, 26 aa, Artificial sequence
  Variant (2)..(2): xaa in position 2 is any amino acid
  Variant (3)..(3): xaa in position 3 is Met, Arg, Pro or Ala
  Variant (4)..(4): xaa in position 4 is Gly or Ala
  Variant (5)..(5): xaa in position 5 is Ala, Ser, Val, Cys or Thr
  Variant (8)..(8): xaa in position 8 is Ser or Thr
  Variant (9)..(9): xaa in position 9 is any amino acid
  Variant (10)..(10): xaa in position 10 is Ile, Val, Leu or Thr
  Variant (11)..(11): xaa in position 11 is Gly, Ala or Ser
  Variant (12)..(13): xaa in position 12 to 13 is any amino acid
  Variant (14)..(14): xaa in position 14 is Leu, Val, Ile or Met
  Variant (15)..(15): xaa in position 15 is Ala, Ser or Asp
  Variant (16)..(19): xaa in position 16 to 19 is any amino acid
  Variant (20)..(23): xaa in position 20 to 23 is any or no amino acid
  Variant (24)..(24): xaa in position 24 is Asp or Glu
  Variant (25)..(25): xaa in position 25 is any amino acid
  Variant (26)..(26): xaa in position 26 is Asp or Asn
GXXXXGKXXXXXXXXXXXXXXXXXXX

SEQ ID NO: 22949 - protein, 75 aa, Artificial sequence; identical to SEQ ID NO: 2904
  Variant (1)..(1): xaa in position 1 is Glu, Trp, Gln or Asp
  Variant (2)..(3): xaa in position 2 to 3 is any amino acid
  Variant (4)..(4): xaa in position 4 is Phe, Leu or Tyr
  Variant (5)..(5): xaa in position 5 is Arg or Leu
  Variant (6)..(7): xaa in position 6 to 7 is any amino acid
  Variant (9)..(11): xaa in position 9 to 11 is any amino acid
  Variant (12)..(12): xaa in position 12 is Leu, Ile, Val, Ala, Phe or Thr
  Variant (13)..(20): xaa in position 13 to 20 is any amino acid
  Variant (21)..(23): xaa in position 21 to 23 is any or no amino acid
  Variant (24)..(24): xaa in position 24 is Val, Ile, Leu or Thr
  Variant (25)..(25): xaa in position 25 is Leu, Ile or Val
  Variant (26)..(26): xaa in position 26 is Ala, Ser or Thr
  Variant (27)..(27): xaa in position 27 is Thr, Leu, Ala, Ser or Pro
  Variant (30)..(30): xaa in position 30 is Gly or Ser
  Variant (31)..(31): xaa in position 31 is any amino acid
  Variant (32)..(32): xaa in position 32 is Val, Ile, Phe, Pro, Tyr or Leu
  Variant (33)..(45): xaa in position 33 to 45 is any amino acid
  Variant (46)..(53): xaa in position 46 to 53 is any or no amino acid
  Variant (54)..(54): xaa in position 54 is Leu, Ile or Val
  Variant (55)..(63): xaa in position 55 to 63 is any amino acid
  Variant (64)..(64): xaa in position 64 is Arg, Asn or Asp
  Variant (65)..(69): xaa in position 65 to 69 is any amino acid
  Variant (70)..(73): xaa in position 70 to 73 is any or no amino acid
  Variant (74)..(74): xaa in position 74 is Arg, Lys or Leu
  Variant (75)..(75): xaa in position 75 is Pro or Gly

SEQ ID NO: 22950 - DNA, 1242 bp, Escherichia coli K12; identical to SEQ ID NO: 19626
  CDS (1)..(1242): transl_table=11

SEQ ID NO: 22951 - protein, 413 aa, Escherichia coli K12; identical to SEQ ID NO: 19627

SEQ ID NO: 22952 - DNA, 1212 bp, Caenorhabditis elegans; identical to SEQ ID NO: 19628
  CDS (1)..(1212)

SEQ ID NO: 22953 - protein, 403 aa, Caenorhabditis elegans; identical to SEQ ID NO: 19629

SEQ ID NO: 22954 - DNA, 1329 bp, Saccharomyces cerevisiae; identical to SEQ ID NO: 19630
  CDS (1)..(1329)

SEQ ID NO: 22955 - protein, 442 aa, Saccharomyces cerevisiae; identical to SEQ ID NO: 19631

SEQ ID NO: 22956 - DNA, 1380 bp, Homo sapiens; identical to SEQ ID NO: 19632
  CDS (1)..(1380)

SEQ ID NO: 22957 - protein, 459 aa, Homo sapiens; identical to SEQ ID NO: 19633

SEQ ID NO: 22958 - DNA, 1380 bp, Mus musculus; identical to SEQ ID NO: 19634
  CDS (1)..(1380)

SEQ ID NO: 22959 - protein, 459 aa, Mus musculus [sequence omitted]

SEQ ID NO: 22960 - DNA, 1302 bp, Mesorhizobium loti MAFF303099; identical to SEQ ID NO: 19636
  CDS (1)..(1302): transl_table=11

SEQ ID NO: 22961 - protein, 433 aa, Mesorhizobium loti MAFF303099; identical to SEQ ID NO: 19637

SEQ ID NO: 22962 - DNA, 1263 bp, Mesorhizobium loti MAFF303099; identical to SEQ ID NO: 19638
  CDS (1)..(1263): transl_table=11

SEQ ID NO: 22963 - protein, 420 aa, Mesorhizobium loti MAFF303099; identical to SEQ ID NO: 19639

SEQ ID NO: 22964 - DNA, 1245 bp, Clostridium acetobutylicum ATCC 824; identical to SEQ ID NO: 19640
  CDS (1)..(1245): transl_table=11

SEQ ID NO: 22965 - protein, 414 aa, Clostridium acetobutylicum ATCC 824; identical to SEQ ID NO: 19641

SEQ ID NO: 22966 - DNA, 1239 bp, Helicobacter pylori 26695; identical to SEQ ID NO: 19642
  CDS (1)..(1239): transl_table=11

SEQ ID NO: 22967 - protein, 412 aa, Helicobacter pylori 26695; identical to SEQ ID NO: 19643

SEQ ID NO: 22968 - DNA, 1248 bp, Aquifex aeolicus VF5; identical to SEQ ID NO: 19644
  CDS (1)..(1248): transl_table=11

SEQ ID NO: 22969 - protein, 415 aa, Aquifex aeolicus VF5; identical to SEQ ID NO: 19645

SEQ ID NO: 22970 - DNA, 1257 bp, Chlamydia trachomatis D/UW-3/CX; identical to SEQ ID NO: 19646
  CDS (1)..(1257): transl_table=11

SEQ ID NO: 22971 - protein, 418 aa, Chlamydia trachomatis D/UW-3/CX; identical to SEQ ID NO: 19647

SEQ ID NO: 22972 - DNA, 1281 bp, Rickettsia prowazekii str. Madrid E; identical to SEQ ID NO: 19648
  CDS (1)..(1281): transl_table=11

SEQ ID NO: 22973 - protein, 426 aa, Rickettsia prowazekii str. Madrid E; identical to SEQ ID NO: 19649

SEQ ID NO: 22974 - DNA, 1239 bp, Helicobacter pylori J99; identical to SEQ ID NO: 19650
  CDS (1)..(1239): transl_table=11

SEQ ID NO: 22975 - protein, 412 aa, Helicobacter pylori J99; identical to SEQ ID NO: 19651

SEQ ID NO: 22976 - DNA, 1239 bp, Thermotoga maritima MSB8; identical to SEQ ID NO: 19652
  CDS (1)..(1239): transl_table=11

SEQ ID NO: 22977 - protein, 412 aa, Thermotoga maritima MSB8; identical to SEQ ID NO: 19653

SEQ ID NO: 22978 - DNA, 1245 bp, Vibrio cholerae O1 biovar eltor str. N16961; identical to SEQ ID NO: 19654
  CDS (1)..(1245): transl_table=11

SEQ ID NO: 22979 - protein, 414 aa, Vibrio cholerae O1 biovar eltor str. N16961; identical to SEQ ID NO: 19655

SEQ ID NO: 22980 - DNA, 1236 bp, Bacillus halodurans C-125; identical to SEQ ID NO: 19656
  CDS (1)..(1236): transl_table=11

SEQ ID NO: 22981 - protein, 411 aa, Bacillus halodurans C-125; identical to SEQ ID NO: 19657

SEQ ID NO: 22982 - DNA, 1221 bp, Pasteurella multocida subsp. multocida str. Pm70; identical to SEQ ID NO: 19658
  CDS (1)..(1221): transl_table=11

SEQ ID NO: 22983 - protein, 406 aa, Pasteurella multocida subsp. multocida str. Pm70; identical to SEQ ID NO: 19659

SEQ ID NO: 22984 - DNA, 1269 bp, Pseudomonas aeruginosa PAO1; identical to SEQ ID NO: 19660
  CDS (1)..(1269): transl_table=11

SEQ ID NO: 22985 - protein, 422 aa, Pseudomonas aeruginosa PAO1; identical to SEQ ID NO: 19661

SEQ ID NO: 22986 - DNA, 1245 bp, Pseudomonas aeruginosa PAO1; identical to SEQ ID NO: 19662
  CDS (1)..(1245): transl_table=11

SEQ ID NO: 22987 - protein, 414 aa, Pseudomonas aeruginosa PAO1; identical to SEQ ID NO: 19663

SEQ ID NO: 22988 - DNA, 1230 bp, Lactococcus lactis subsp. lactis Il1403; identical to SEQ ID NO: 19664
  CDS (1)..(1230): transl_table=11

SEQ ID NO: 22989 - protein, 409 aa, Lactococcus lactis subsp. lactis Il1403; identical to SEQ ID NO: 19665

SEQ ID NO: 22990 - DNA, 1248 bp, Neisseria meningitidis MC58; identical to SEQ ID NO: 19666
  CDS (1)..(1248): transl_table=11

SEQ ID NO: 22991 - protein, 415 aa, Neisseria meningitidis MC58; identical to SEQ ID NO: 19667

SEQ ID NO: 22992 - DNA, 1215 bp, Campylobacter jejuni subsp. jejuni NCTC 11168; identical to SEQ ID NO: 19668
  CDS (1)..(1215): transl_table=11

SEQ ID NO: 22993 - protein, 404 aa, Campylobacter jejuni subsp. jejuni NCTC 11168; identical to SEQ ID NO: 19669

SEQ ID NO: 22994 - DNA, 1248 bp, Neisseria meningitidis Z2491; identical to SEQ ID NO: 19670
  CDS (1)..(1248): transl_table=11

SEQ ID NO: 22995 - protein, 415 aa, Neisseria meningitidis Z2491; identical to SEQ ID NO: 19671

SEQ ID NO: 22996 - DNA, 1287 bp, Deinococcus radiodurans R1; identical to SEQ ID NO: 19672
  CDS (1)..(1287): transl_table=11

SEQ ID NO: 22997 - protein, 428 aa, Deinococcus radiodurans R1; identical to SEQ ID NO: 19673

SEQ ID NO: 22998 - DNA, 1257 bp, Chlamydia muridarum Nigg; identical to SEQ ID NO: 19674
  CDS (1)..(1257): transl_table=11

SEQ ID NO: 22999 - protein, 418 aa, Chlamydia muridarum Nigg; identical to SEQ ID NO: 19675

SEQ ID NO: 23000 - DNA, 1236 bp, Xylella fastidiosa 9a5c; identical to SEQ ID NO: 19676
  CDS (1)..(1236): transl_table=11

SEQ ID NO: 23001 - protein, 411 aa, Xylella fastidiosa 9a5c; identical to SEQ ID NO: 19677

SEQ ID NO: 23002 - DNA, 1236 bp, Streptococcus pneumoniae TIGR4; identical to SEQ ID NO: 19678
  CDS (1)..(1236): transl_table=11

SEQ ID NO: 23003 - protein, 411 aa, Streptococcus pneumoniae TIGR4; identical to SEQ ID NO: 19679

SEQ ID NO: 23004 - DNA, 1236 bp, Clostridium acetobutylicum ATCC 824; identical to SEQ ID NO: 19680
  CDS (1)..(1236): transl_table=11

SEQ ID NO: 23005 - protein, 411 aa, Clostridium acetobutylicum ATCC 824; identical to SEQ ID NO: 19681

SEQ ID NO: 23006 - DNA, 1329 bp, Agrobacterium tumefaciens str. C58; identical to SEQ ID NO: 19682
  CDS (1)..(1329): transl_table=11

SEQ ID NO: 23007 - protein, 442 aa, Agrobacterium tumefaciens str. C58; identical to SEQ ID NO: 19683

SEQ ID NO: 23008 - DNA, 1383 bp, Agrobacterium tumefaciens str. C58; identical to SEQ ID NO: 19684
  CDS (1)..(1383): transl_table=11

SEQ ID NO: 23009 - protein, 460 aa, Agrobacterium tumefaciens str. C58; identical to SEQ ID NO: 19685

SEQ ID NO: 23010 - DNA, 1245 bp, Streptococcus pneumoniae R6; identical to SEQ ID NO: 19686
  CDS (1)..(1245): transl_table=11

SEQ ID NO: 23011 - protein, 414 aa, Streptococcus pneumoniae R6; identical to SEQ ID NO: 19687

SEQ ID NO: 23012 - DNA, 1287 bp, Rickettsia conorii str. Malish 7; identical to SEQ ID NO: 19688
  CDS (1)..(1287): transl_table=11

SEQ ID NO: 23013 - protein, 428 aa, Rickettsia conorii str. Malish 7; identical to SEQ ID NO: 19689

SEQ ID NO: 23014 - DNA, 1245 bp, Staphylococcus aureus subsp. aureus Mu50; identical to SEQ ID NO: 19690
  CDS (1)..(1245): transl_table=11

SEQ ID NO: 23015 - protein, 414 aa, Staphylococcus aureus subsp. aureus Mu50; identical to SEQ ID NO: 19691

SEQ ID NO: 23016 - DNA, 1242 bp, Bacillus subtilis subsp. subtilis str. 168; identical to SEQ ID NO: 19692
  CDS (1)..(1242): transl_table=11

SEQ ID NO: 23017 - protein, 413 aa, Bacillus subtilis subsp. subtilis str. 168; identical to SEQ ID NO: 19693

SEQ ID NO: 23018 - DNA, 1281 bp, Caulobacter crescentus CB15; identical to SEQ ID NO: 19694
  CDS (1)..(1281): transl_table=11

SEQ ID NO: 23019 - protein, 426 aa, Caulobacter crescentus CB15; identical to SEQ ID NO: 19695

SEQ ID NO: 23020 - DNA, 1251 bp, Chlamydophila pneumoniae AR39; identical to SEQ ID NO: 19696
  CDS (1)..(1251): transl_table=11

SEQ ID NO: 23021 - protein, 416 aa, Chlamydophila pneumoniae AR39; identical to SEQ ID NO: 19697

SEQ ID NO: 23022 - DNA, 1242 bp, Listeria monocytogenes EGD-e; identical to SEQ ID NO: 19698
  CDS (1)..(1242): transl_table=11

SEQ ID NO: 23023 - protein, 413 aa, Listeria monocytogenes EGD-e; identical to SEQ ID NO: 19699

SEQ ID NO: 23024 - DNA, 1242 bp, Listeria innocua Clip11262; identical to SEQ ID NO: 19700
  CDS (1)..(1242): transl_table=11

SEQ ID NO: 23025 - protein, 413 aa, Listeria innocua Clip11262; identical to SEQ ID NO: 19701

SEQ ID NO: 23026 - DNA, 1251 bp, Nostoc sp. PCC 7120; identical to SEQ ID NO: 19702
  CDS (1)..(1251): transl_table=11

SEQ ID NO: 23027 - protein, 416 aa, Nostoc sp. PCC 7120; identical to SEQ ID NO: 19703

SEQ ID NO: 23028 - DNA, 1233 bp, Ralstonia solanacearum GMI1000; identical to SEQ ID NO: 19704
  CDS (1)..(1233): transl_table=11

SEQ ID NO: 23029 - protein, 410 aa, Ralstonia solanacearum GMI1000; identical to SEQ ID NO: 19705

SEQ ID NO: 23030 - DNA, 1263 bp, Agrobacterium tumefaciens str. C58; identical to SEQ ID NO: 19706
  CDS (1)..(1263): transl_table=11

SEQ ID NO: 23031 - protein, 420 aa, Agrobacterium tumefaciens str. C58; identical to SEQ ID NO: 19707

SEQ ID NO: 23032 - DNA, 1299 bp, Agrobacterium tumefaciens str. C58; identical to SEQ ID NO: 19708
  CDS (1)..(1299): transl_table=11

SEQ ID NO: 23033 - protein, 432 aa, Agrobacterium tumefaciens str. C58; identical to SEQ ID NO: 19709

SEQ ID NO: 23034 - DNA, 1242 bp, Clostridium perfringens str. 13; identical to SEQ ID NO: 19710
  CDS (1)..(1242): transl_table=11

SEQ ID NO: 23035 - protein, 413 aa, Clostridium perfringens str. 13; identical to SEQ ID NO: 19711

SEQ ID NO: 23036 - DNA, 1281 bp, Schizosaccharomyces pombe 972h-; identical to SEQ ID NO: 19712
  CDS (1)..(1281)

SEQ ID NO: 23037 - protein, 426 aa, Schizosaccharomyces pombe 972h-; identical to SEQ ID NO: 19713

SEQ ID NO: 23038 - DNA, 1242 bp, Fusobacterium nucleatum subsp. nucleatum ATCC 25586; identical to SEQ ID NO: 19714
  CDS (1)..(1242): transl_table=11

SEQ ID NO: 23039 - protein, 413 aa, Fusobacterium nucleatum subsp. nucleatum ATCC 25586; identical to SEQ ID NO: 19715

SEQ ID NO: 23040 - DNA, 1230 bp, Thermoanaerobacter tengcongensis MB4; identical to SEQ ID NO: 19716
  CDS (1)..(1230): transl_table=11

SEQ ID NO: 23041 - protein, 409 aa, Thermoanaerobacter tengcongensis MB4; identical to SEQ ID NO: 19717

SEQ ID NO: 23042 - DNA, 1287 bp, Streptomyces coelicolor A3(2); identical to SEQ ID NO: 19718
  CDS (1)..(1287): transl_table=11

SEQ ID NO: 23043 - protein, 428 aa, Streptomyces coelicolor A3(2); identical to SEQ ID NO: 19719

SEQ ID NO: 23044 - DNA, 1269 bp, Streptomyces coelicolor A3(2); identical to SEQ ID NO: 19720
  CDS (1)..(1269): transl_table=11

SEQ ID NO: 23045 - protein, 422 aa, Streptomyces coelicolor A3(2); identical to SEQ ID NO: 19721

SEQ ID NO: 23046 - DNA, 1290 bp, Streptomyces coelicolor A3(2); identical to SEQ ID NO: 19722
  CDS (1)..(1290): transl_table=11

SEQ ID NO: 23047 - protein, 429 aa, Streptomyces coelicolor A3(2); identical to SEQ ID NO: 19723

SEQ ID NO: 23048 - DNA, 1224 bp, Streptomyces coelicolor A3(2); identical to SEQ ID NO: 19724
  CDS (1)..(1224): transl_table=11

SEQ ID NO: 23049 - protein, 407 aa, Streptomyces coelicolor A3(2); identical to SEQ ID NO: 19725

SEQ ID NO: 23050 - DNA, 1236 bp, Xanthomonas axonopodis pv. citri str. 306; identical to SEQ ID NO: 19726
  CDS (1)..(1236): transl_table=11

SEQ ID NO: 23051 - protein, 411 aa, Xanthomonas axonopodis pv. citri str. 306; identical to SEQ ID NO: 19727

SEQ ID NO: 23052 - DNA, 1317 bp, Drosophila melanogaster; identical to SEQ ID NO: 19728
  CDS (1)..(1317)

SEQ ID NO: 23053 - protein, 438 aa, Drosophila melanogaster; identical to SEQ ID NO: 19729

SEQ ID NO: 23054 - DNA, 1242 bp, Chlorobium tepidum TLS; identical to SEQ ID NO: 19730
  CDS (1)..(1242): transl_table=11

SEQ ID NO: 23055 - protein, 413 aa, Chlorobium tepidum TLS; identical to SEQ ID NO: 19731

SEQ ID NO: 23056 - DNA, 1029 bp, Yersinia pestis KIM; identical to SEQ ID NO: 19732
  CDS (1)..(1029): transl_table=11

SEQ ID NO: 23057 - protein, 342 aa, Yersinia pestis KIM; identical to SEQ ID NO: 19733

SEQ ID NO: 23058 - DNA, 1263 bp, Thermosynechococcus elongatus BP-1; identical to SEQ ID NO: 19734
  CDS (1)..(1263): transl_table=11

SEQ ID NO: 23059 - protein, 420 aa, Thermosynechococcus elongatus BP-1; identical to SEQ ID NO: 19735

SEQ ID NO: 23060 - DNA, 1233 bp, Streptococcus agalactiae 2603V/R; identical to SEQ ID NO: 19736
  CDS (1)..(1233): transl_table=11

SEQ ID NO: 23061 - protein, 410 aa, Streptococcus agalactiae 2603V/R; identical to SEQ ID NO: 19737

SEQ ID NO: 23062 - DNA, 1239 bp, Oceanobacillus iheyensis HTE831; identical to SEQ ID NO: 19738
  CDS (1)..(1239): transl_table=11

SEQ ID NO: 23063 - protein, 412 aa, Oceanobacillus iheyensis HTE831; identical to SEQ ID NO: 19739

SEQ ID NO: 23064 - DNA, 1263 bp, Brucella suis 1330; identical to SEQ ID NO: 19740
  CDS (1)..(1263): transl_table=11

SEQ ID NO: 23065 - protein, 420 aa, Brucella suis 1330; identical to SEQ ID NO: 19741

SEQ ID NO: 23066 - DNA, 1425 bp, Plasmodium falciparum 3D7; identical to SEQ ID NO: 19742
  CDS (1)..(1425)

SEQ ID NO: 23067 - protein, 474 aa, Plasmodium falciparum 3D7; identical to SEQ ID NO: 19743

SEQ ID NO: 23068 - DNA, 1239 bp, Shewanella oneidensis MR-1; identical to SEQ ID NO: 19744
  CDS (1)..(1239): transl_table=11

SEQ ID NO: 23069 - protein, 412 aa, Shewanella oneidensis MR-1; identical to SEQ ID NO: 19745

SEQ ID NO: 23070 - DNA, 1233 bp, Streptococcus mutans UA159; identical to SEQ ID NO: 19746
  CDS (1)..(1233): transl_table=11

SEQ ID NO: 23071 - protein, 410 aa, Streptococcus mutans UA159; identical to SEQ ID NO: 19747

SEQ ID NO: 23072 - DNA, 1245 bp, Pseudomonas putida KT2440; identical to SEQ ID NO: 19748
  CDS (1)..(1245): transl_table=11

SEQ ID NO: 23073 - protein, 414 aa, Pseudomonas putida KT2440; identical to SEQ ID NO: 19749

SEQ ID NO: 23074 - DNA, 1314 bp, Pseudomonas putida KT2440; identical to SEQ ID NO: 19750
  CDS (1)..(1314): transl_table=11

SEQ ID NO: 23075 - protein, 437 aa, Pseudomonas putida KT2440; identical to SEQ ID NO: 19751

SEQ ID NO: 23076 - DNA, 1263 bp, Vibrio vulnificus CMCP6; identical to SEQ ID NO: 19752
  CDS (1)..(1263): transl_table=11

SEQ ID NO: 23077 - protein, 420 aa, Vibrio vulnificus CMCP6; identical to SEQ ID NO: 19753

SEQ ID NO: 23078 - DNA, 1263 bp, Bradyrhizobium japonicum USDA 110; identical to SEQ ID NO: 19754
  CDS (1)..(1263): transl_table=11

SEQ ID NO: 23079 - protein, 420 aa, Bradyrhizobium japonicum USDA 110; identical to SEQ ID NO: 19755

SEQ ID NO: 23080 - DNA, 1266 bp, Bradyrhizobium japonicum USDA 110; identical to SEQ ID NO: 19756
  CDS (1)..(1266): transl_table=11

SEQ ID NO: 23081 - protein, 421 aa, Bradyrhizobium japonicum USDA 110; identical to SEQ ID NO: 19757

SEQ ID NO: 23082 - DNA, 1236 bp, Xylella fastidiosa Temecula1; identical to SEQ ID NO: 19758
  CDS (1)..(1236): transl_table=11

SEQ ID NO: 23083 - protein, 411 aa, Xylella fastidiosa Temecula1; identical to SEQ ID NO: 19759

SEQ ID NO: 23084 - DNA, 1245 bp, Clostridium tetani E88; identical to SEQ ID NO: 19760
  CDS (1)..(1245): transl_table=11

SEQ ID NO: 23085 - protein, 414 aa, Clostridium tetani E88; identical to SEQ ID NO: 19761

SEQ ID NO: 23086 - DNA, 1233 bp, Lactobacillus plantarum WCFS1; identical to SEQ ID NO: 19762
  CDS (1)..(1233): transl_table=11

SEQ ID NO: 23087 - protein, 410 aa, Lactobacillus plantarum WCFS1; identical to SEQ ID NO: 19763

SEQ ID NO: 23088 - DNA, 1245 bp, Pseudomonas syringae pv. tomato str. DC3000; identical to SEQ ID NO: 19764
  CDS (1)..(1245): transl_table=11

SEQ ID NO: 23089 - protein, 414 aa, Pseudomonas syringae pv. tomato str. DC3000; identical to SEQ ID NO: 19765

SEQ ID NO: 23090 - DNA, 1251 bp, Vibrio parahaemolyticus RIMD 2210633; identical to SEQ ID NO: 19766
  CDS (1)..(1251): transl_table=11

SEQ ID NO: 23091 - protein, 416 aa, Vibrio parahaemolyticus RIMD 2210633; identical to SEQ ID NO: 19767

SEQ ID NO: 23092 - DNA, 1212 bp, Vibrio parahaemolyticus RIMD 2210633; identical to SEQ ID NO: 19768
  CDS (1)..(1212): transl_table=11

SEQ ID NO: 23093 - protein, 403 aa, Vibrio parahaemolyticus RIMD 2210633; identical to SEQ ID NO: 19769

SEQ ID NO: 23094 - DNA, 1233 bp, Streptococcus pyogenes SSI-1; identical to SEQ ID NO: 19770
  CDS (1)..(1233): transl_table=11

SEQ ID NO: 23095 - protein, 410 aa, Streptococcus pyogenes SSI-1; identical to SEQ ID NO: 19771

SEQ ID NO: 23096 - DNA, 1242 bp, Salmonella enterica subsp. enterica serovar Typhi Ty2; identical to SEQ ID NO: 19772
  CDS (1)..(1242): transl_table=11

SEQ ID NO: 23097 - protein, 413 aa, Salmonella enterica subsp. enterica serovar Typhi Ty2; identical to SEQ ID NO: 19773

SEQ ID NO: 23098 - DNA, 1263 bp, Bacteroides thetaiotaomicron VPI-5482; identical to SEQ ID NO: 19774
  CDS (1)..(1263): transl_table=11

SEQ ID NO: 23099 - protein, 420 aa, Bacteroides thetaiotaomicron VPI-5482; identical to SEQ ID NO: 19775

SEQ ID NO: 23100 - DNA, 1239 bp, Enterococcus faecalis V583; identical to SEQ ID NO: 19776
  CDS (1)..(1239): transl_table=11

SEQ ID NO: 23101 - protein, 412 aa, Enterococcus faecalis V583; identical to SEQ ID NO: 19777

SEQ ID NO: 23102 - DNA, 1236 bp, Enterococcus faecalis V583; identical to SEQ ID NO: 19778
  CDS (1)..(1236): transl_table=11

SEQ ID NO: 23103 - protein, 411 aa, Enterococcus faecalis V583; identical to SEQ ID NO: 19779

SEQ ID NO: 23104 - DNA, 1245 bp, Coxiella burnetii RSA 493; identical to SEQ ID NO: 19780
  CDS (1)..(1245): transl_table=11

SEQ ID NO: 23105 - protein, 414 aa, Coxiella burnetii RSA 493; identical to SEQ ID NO: 19781

SEQ ID NO: 23106 - DNA, 1221 bp, Streptomyces avermitilis MA-4680; identical to SEQ ID NO: 19782
  CDS (1)..(1221): transl_table=11

SEQ ID NO: 23107 - protein, 406 aa, Streptomyces avermitilis MA-4680; identical to SEQ ID NO: 19783

SEQ ID NO: 23108 - DNA, 1251 bp, Streptomyces avermitilis MA-4680; identical to SEQ ID NO: 19784
  CDS (1)..(1251): transl_table=11

SEQ ID NO: 23109 - protein, 416 aa, Streptomyces avermitilis MA-4680; identical to SEQ ID NO: 19785

SEQ ID NO: 23110 - DNA, 1272 bp, Streptomyces avermitilis MA-4680; identical to SEQ ID NO: 19786
  CDS (1)..(1272): transl_table=11

SEQ ID NO: 23111 - protein, 423 aa, Streptomyces avermitilis MA-4680; identical to SEQ ID NO: 19787

SEQ ID NO: 23112 - DNA, 1251 bp, Chlamydophila caviae GPIC; identical to SEQ ID NO: 19788
  CDS (1)..(1251): transl_table=11

SEQ ID NO: 23113 - protein, 416 aa, Chlamydophila caviae GPIC; identical to SEQ ID NO: 19789

SEQ ID NO: 23114 - DNA, 1239 bp, Bacillus cereus ATCC 14579; identical to SEQ ID NO: 19790
  CDS (1)..(1239): transl_table=11

SEQ ID NO: 23115 - protein, 412 aa, Bacillus cereus ATCC 14579; identical to SEQ ID NO: 19791

SEQ ID NO: 23116 - DNA, 1242 bp, Nitrosomonas europaea ATCC 19718; identical to SEQ ID NO: 19792
  CDS (1)..(1242): transl_table=11

SEQ ID NO: 23117 - protein, 413 aa, Nitrosomonas europaea ATCC 19718; identical to SEQ ID NO: 19793

SEQ ID NO: 23118 - DNA, 1626 bp, Arabidopsis thaliana; identical to SEQ ID NO: 19794
  CDS (1)..(1626)

SEQ ID NO: 23119 - protein, 541 aa, Arabidopsis thaliana; identical to SEQ ID NO: 19795

SEQ ID NO: 23120 - DNA, 1266 bp, Streptomyces rochei; identical to SEQ ID NO: 19796
  CDS (1)..(1266): transl_table=11

SEQ ID NO: 23121 - protein, 421 aa, Streptomyces rochei; identical to SEQ ID NO: 19797

SEQ ID NO: 23122 - DNA, 1236 bp, Helicobacter hepaticus ATCC 51449; identical to SEQ ID NO: 19798
  CDS (1)..(1236): transl_table=11

SEQ ID NO: 23123 - protein, 411 aa, Helicobacter hepaticus ATCC 51449; identical to SEQ ID NO: 19799

SEQ ID NO: 23124 - DNA, 1290 bp, Rhodopirellula baltica SH 1; identical to SEQ ID NO: 19800
  CDS (1)..(1290): transl_table=11

SEQ ID NO: 23125 - protein, 429 aa, Rhodopirellula baltica SH 1; identical to SEQ ID NO: 19801

SEQ ID NO: 23126 - DNA, 1290 bp, Rhodopirellula baltica SH 1; identical to SEQ ID NO: 19802
  CDS (1)..(1290): transl_table=11

SEQ ID NO: 23127 - protein, 429 aa, Rhodopirellula baltica SH 1; identical to SEQ ID NO: 19803

SEQ ID NO: 23128 - DNA, 1248 bp, Prochlorococcus marinus subsp. marinus str. CCMP1375; identical to SEQ ID NO: 19804
  CDS (1)..(1248): transl_table=11

SEQ ID NO: 23129 - protein, 415 aa, Prochlorococcus marinus subsp. marinus str. CCMP1375; identical to SEQ ID NO: 19805

SEQ ID NO: 23130 - DNA, 1230 bp, Bordetella bronchiseptica RB50; identical to SEQ ID NO: 19806
  CDS (1)..(1230): transl_table=11

SEQ ID NO: 23131 - protein, 409 aa, Bordetella bronchiseptica RB50; identical to SEQ ID NO: 19807

SEQ ID NO: 23132 - DNA, 1245 bp, Prochlorococcus marinus subsp. pastoris str. CCMP1986; identical to SEQ ID NO: 19808
  CDS (1)..(1245): transl_table=11

SEQ ID NO: 23133 - protein, 414 aa, Prochlorococcus marinus subsp. pastoris str. CCMP1986; identical to SEQ ID NO: 19809

SEQ ID NO: 23134 - DNA, 1248 bp, Prochlorococcus marinus str. MIT 9313; identical to SEQ ID NO: 19810
  CDS (1)..(1248): transl_table=11

SEQ ID NO: 23135 - protein, 415 aa, Prochlorococcus marinus str. MIT 9313; identical to SEQ ID NO: 19811

SEQ ID NO: 23136 - DNA, 1248 bp, Synechococcus sp. WH 8102; identical to SEQ ID NO: 19812
  CDS (1)..(1248): transl_table=11

SEQ ID NO: 23137 - protein, 415 aa, Synechococcus sp. WH 8102; identical to SEQ ID NO: 19813

SEQ ID NO: 23138 - DNA, 1242 bp, Chromobacterium violaceum ATCC 12472; identical to SEQ ID NO: 19814
  CDS (1)..(1242): transl_table=11

SEQ ID NO: 23139 - protein, 413 aa, Chromobacterium violaceum ATCC 12472; identical to SEQ ID NO: 19815

SEQ ID NO: 23140 - DNA, 1257 bp, Porphyromonas gingivalis W83; identical to SEQ ID NO: 19816
  CDS (1)..(1257): transl_table=11

SEQ ID NO: 23141 - protein, 418 aa, Porphyromonas gingivalis W83; identical to SEQ ID NO: 19817

SEQ ID NO: 23142 - DNA, 1242 bp, Wolinella succinogenes DSM 1740; identical to SEQ ID NO: 19818
  CDS (1)..(1242): transl_table=11

SEQ ID NO: 23143 - protein, 413 aa, Wolinella succinogenes DSM 1740; identical to SEQ ID NO: 19819

SEQ ID NO: 23144 - DNA, 1272 bp, Gloeobacter violaceus PCC 7421; identical to SEQ ID NO: 19820
  CDS (1)..(1272): transl_table=11

SEQ ID NO: 23145 - protein, 423 aa, Gloeobacter violaceus PCC 7421; identical to SEQ ID NO: 19821

SEQ ID NO: 23146 - DNA, 1248 bp, Gloeobacter violaceus PCC 7421; identical to SEQ ID NO: 19822
  CDS (1)..(1248): transl_table=11

SEQ ID NO: 23147 - protein, 415 aa, Gloeobacter violaceus PCC 7421; identical to SEQ ID NO: 19823

SEQ ID NO: 23148 - DNA, 1251 bp, Photorhabdus luminescens subsp. laumondii TTO1; identical to SEQ ID NO: 19824
  CDS (1)..(1251): transl_table=11

SEQ ID NO: 23149 - protein, 416 aa, Photorhabdus luminescens subsp. laumondii TTO1; identical to SEQ ID NO: 19825

SEQ ID NO: 23150 - DNA, 1242 bp, Vibrio vulnificus YJ016; identical to SEQ ID NO: 19826
  CDS (1)..(1242): transl_table=11

SEQ ID NO: 23151 - protein, 413 aa, Vibrio vulnificus YJ016; identical to SEQ ID NO: 19827

SEQ ID NO: 23152 - DNA, 1266 bp, Rhodopseudomonas palustris CGA009; identical to SEQ ID NO: 19828
  CDS (1)..(1266): transl_table=11

SEQ ID NO: 23153 - protein, 421 aa, Rhodopseudomonas palustris CGA009; identical to SEQ ID NO: 19829

SEQ ID NO: 23154 - DNA, 1233 bp, Geobacter sulfurreducens PCA; identical to SEQ ID NO: 19830
  CDS (1)..(1233): transl_table=11

SEQ ID NO: 23155 - protein, 410 aa, Geobacter sulfurreducens PCA; identical to SEQ ID NO: 19831

SEQ ID NO: 23156 - DNA, 1251 bp, Mycobacterium avium subsp. paratuberculosis K-10; identical to SEQ ID NO: 19832
  CDS (1)..(1251): transl_table=11

SEQ ID NO: 23157 - protein, 416 aa, Mycobacterium avium subsp. paratuberculosis K-10; identical to SEQ ID NO: 19833

SEQ ID NO: 23158 - DNA, 1272 bp, Wolbachia endosymbiont of Drosophila melanogaster; identical to SEQ ID NO: 19834
  CDS (1)..(1272): transl_table=11

SEQ ID NO: 23159 - protein, 423 aa, Wolbachia endosymbiont of Drosophila melanogaster; identical to SEQ ID NO: 19835

SEQ ID NO: 23160 - DNA, 1272 bp, Bdellovibrio bacteriovorus HD100; identical to SEQ ID NO: 19836
  CDS (1)..(1272): transl_table=11

SEQ ID NO: 23161 - protein, 423 aa, Bdellovibrio bacteriovorus HD100; identical to SEQ ID NO: 19837

SEQ ID NO: 23162 - DNA, 1236 bp, Treponema denticola ATCC 35405; identical to SEQ ID NO: 19838
  CDS (1)..(1236): transl_table=11

SEQ ID NO: 23163 - protein, 411 aa, Treponema denticola ATCC 35405; identical to SEQ ID NO: 19839

SEQ ID NO: 23164 - DNA, 1239 bp, Bacillus cereus ATCC 10987; identical to SEQ ID NO: 19840
  CDS (1)..(1239): transl_table=11

SEQ ID NO: 23165 - protein, 412 aa, Bacillus cereus ATCC 10987; identical to SEQ ID NO: 19841

SEQ ID NO: 23166 - DNA, 1302 bp, Eremothecium gossypii; identical to SEQ ID NO: 19842
  CDS (1)..(1302)

SEQ ID NO: 23167 - protein, 433 aa, Eremothecium gossypii; identical to SEQ ID NO: 19843

SEQ ID NO: 23168 - DNA, 1335 bp, Anopheles gambiae str. PEST; identical to SEQ ID NO: 19844
  CDS (1)..(1335)

SEQ ID NO: 23169 - protein, 444 aa, Anopheles gambiae str. PEST; identical to SEQ ID NO: 19845

SEQ ID NO: 23170 - DNA, 1524 bp, Oryza sativa (japonica cultivar-group); identical to SEQ ID NO: 19846
  CDS (1)..(1524)

SEQ ID NO: 23171 - protein, 507 aa, Oryza sativa (japonica cultivar-group); identical to SEQ ID NO: 19847

SEQ ID NO: 23172 - DNA, 1245 bp, Anopheles gambiae str. PEST; identical to SEQ ID NO: 19848
  CDS (1)..(1245)

SEQ ID NO: 23173 - protein, 414 aa, Anopheles gambiae str. PEST; identical to SEQ ID NO: 19849

SEQ ID NO: 23174 - DNA, 1227 bp, Thermus thermophilus HB27; identical to SEQ ID NO: 19850
  CDS (1)..(1227): transl_table=11

SEQ ID NO: 23175 - protein, 408 aa, Thermus thermophilus HB27; identical to SEQ ID NO: 19851

SEQ ID NO: 23176 - DNA, 1257 bp, Parachlamydia sp. UWE25; identical to SEQ ID NO: 19852
  CDS (1)..(1257): transl_table=11

SEQ ID NO: 23177 - protein, 418 aa, Parachlamydia sp. UWE25; identical to SEQ ID NO: 19853

SEQ ID NO: 23178 - DNA, 1248 bp, Desulfovibrio vulgaris subsp. vulgaris str. Hildenborough; identical to SEQ ID NO: 19854
  CDS (1)..(1248): transl_table=11

SEQ ID NO: 23179 - protein, 415 aa, Desulfovibrio vulgaris subsp. vulgaris str. Hildenborough; identical to SEQ ID NO: 19855

SEQ ID NO: 23180 - DNA, 1242 bp, Listeria monocytogenes str. 4b F2365; identical to SEQ ID NO: 19856
  CDS (1)..(1242): transl_table=11

SEQ ID NO: 23181 - protein, 413 aa, Listeria monocytogenes str. 4b F2365; identical to SEQ ID NO: 19857

SEQ ID NO: 23182 - DNA, 1239 bp, Bacillus anthracis str. Sterne; identical to SEQ ID NO: 19858
  CDS (1)..(1239): transl_table=11

SEQ ID NO: 23183 - protein, 412 aa, Bacillus anthracis str. Sterne; identical to SEQ ID NO: 19859

SEQ ID NO: 23184 - DNA, 1263 bp, Bartonella quintana str. Toulouse; identical to SEQ ID NO: 19860
  CDS (1)..(1263): transl_table=11

SEQ ID NO: 23185 - protein, 420 aa, Bartonella quintana str. Toulouse; identical to SEQ ID NO: 19861

SEQ ID NO: 23186 - DNA, 1263 bp, Bartonella henselae str. Houston-1; identical to SEQ ID NO: 19862
  CDS (1)..(1263): transl_table=11

SEQ ID NO: 23187 - protein, 420 aa, Bartonella henselae str. Houston-1; identical to SEQ ID NO: 19863

SEQ ID NO: 23188 - DNA, 1245 bp, Staphylococcus aureus subsp. aureus MRSA252; identical to SEQ ID NO: 19864
  CDS (1)..(1245): transl_table=11

SEQ ID NO: 23189 - protein, 414 aa, Staphylococcus aureus subsp. aureus MRSA252; identical to SEQ ID NO: 19865

SEQ ID NO: 23190 - DNA, 1245 bp, Staphylococcus aureus subsp. aureus MSSA476; identical to SEQ ID NO: 19866
  CDS (1)..(1245): transl_table=11

SEQ ID NO: 23191 - protein, 414 aa, Staphylococcus aureus subsp. aureus MSSA476; identical to SEQ ID NO: 19867

SEQ ID NO: 23192 - DNA, 1242 bp, Erwinia carotovora subsp. atroseptica SCRI1043; identical to SEQ ID NO: 19868
  CDS (1)..(1242): transl_table=11

SEQ ID NO: 23193 - protein, 413 aa, Erwinia carotovora subsp. atroseptica SCRI1043; identical to SEQ ID NO: 19869

SEQ ID NO: 23194 - DNA, 1290 bp, Erwinia carotovora subsp. atroseptica SCRI1043; identical to SEQ ID NO: 19870
  CDS (1)..(1290): transl_table=11

SEQ ID NO: 23195 - protein, 429 aa, Erwinia carotovora subsp. atroseptica SCRI1043; identical to SEQ ID NO: 19871

SEQ ID NO: 23196 - DNA, 1272 bp, Propionibacterium acnes KPA171202; identical to SEQ ID NO: 19872
  CDS (1)..(1272): transl_table=11

SEQ ID NO: 23197 - protein, 423 aa, Propionibacterium acnes KPA171202; identical to SEQ ID NO: 19873

SEQ ID NO: 23198 - DNA, 1233 bp, Streptococcus pyogenes MGAS10394; identical to SEQ ID NO: 19874
  CDS (1)..(1233): transl_table=11

SEQ ID NO: 23199 - protein, 410 aa, Streptococcus pyogenes MGAS10394; identical to SEQ ID NO: 19875

SEQ ID NO: 23200 - DNA, 1263 bp, Leifsonia xyli subsp. xyli str. CTCB07; identical to SEQ ID NO: 19876
  CDS (1)..(1263): transl_table=11

SEQ ID NO: 23201 - protein, 420 aa, Leifsonia xyli subsp. xyli str. CTCB07; identical to SEQ ID NO: 19877

SEQ ID NO: 23202 - DNA, 1245 bp, Desulfotalea psychrophila LSv54; identical to SEQ ID NO: 19878
  CDS (1)..(1245): transl_table=11

SEQ ID NO: 23203 - protein, 414 aa, Desulfotalea psychrophila LSv54; identical to SEQ ID NO: 19879

SEQ ID NO: 23204 - DNA, 1281 bp, Rickettsia typhi str. Wilmington; identical to SEQ ID NO: 19880
  CDS (1)..(1281): transl_table=11

SEQ ID NO: 23205 - protein, 426 aa, Rickettsia typhi str. Wilmington; identical to SEQ ID NO: 19881

SEQ ID NO: 23206 - DNA, 1275 bp, Yersinia pseudotuberculosis IP 32953; identical to SEQ ID NO: 19882
  CDS (1)..(1275): transl_table=11

SEQ ID NO: 23207 - protein, 424 aa, Yersinia pseudotuberculosis IP 32953; identical to SEQ ID NO: 19883

SEQ ID NO: 23208 - DNA, 1242 bp, Yersinia pseudotuberculosis IP 32953; identical to SEQ ID NO: 19884
  CDS (1)..(1242): transl_table=11

SEQ ID NO: 23209 - protein, 413 aa, Yersinia pseudotuberculosis IP 32953; identical to SEQ ID NO: 19885

SEQ ID NO: 23210 - DNA, 1242 bp, Symbiobacterium thermophilum IAM 14863; identical to SEQ ID NO: 19886
  CDS (1)..(1242): transl_table=11

SEQ ID NO: 23211 - protein, 413 aa, Symbiobacterium thermophilum IAM 14863; identical to SEQ ID NO: 19887

SEQ ID NO: 23212 - DNA, 1239 bp, Bacillus licheniformis ATCC 14580; identical to SEQ ID NO: 19888
  CDS (1)..(1239): transl_table=11

SEQ ID NO: 23213 - protein, 412 aa, Bacillus licheniformis ATCC 14580; identical to SEQ ID NO: 19889

SEQ ID NO: 23214 - DNA, 1221 bp, Mannheimia succiniciproducens MBEL55E; identical to SEQ ID NO: 19890
  CDS (1)..(1221): transl_table=11

SEQ ID NO: 23215 - protein, 406 aa, Mannheimia succiniciproducens MBEL55E; identical to SEQ ID NO: 19891

SEQ ID NO: 23216 - DNA, 1230 bp, Legionella pneumophila subsp. pneumophila str. Philadelphia 1; identical to SEQ ID NO: 19892
  CDS (1)..(1230): transl_table=11

SEQ ID NO: 23217 - protein, 409 aa, Legionella pneumophila subsp. pneumophila str. Philadelphia 1; identical to SEQ ID NO: 19893

SEQ ID NO: 23218 - DNA, 1293 bp, Legionella pneumophila subsp. pneumophila str. Philadelphia 1; identical to SEQ ID NO: 19894
  CDS (1)..(1293): transl_table=11

SEQ ID NO: 23219 - protein, 430 aa, Legionella pneumophila subsp. pneumophila str. Philadelphia 1; identical to SEQ ID NO: 19895

SEQ ID NO: 23220 - DNA, 1239 bp, Legionella pneumophila subsp. pneumophila str. Philadelphia 1; identical to SEQ ID NO: 19896
  CDS (1)..(1239): transl_table=11

SEQ ID NO: 23221 - protein, 412 aa, Legionella pneumophila subsp. pneumophila str. Philadelphia 1; identical to SEQ ID NO: 19897

SEQ ID NO: 23222 - DNA, 1263 bp, Bacteroides fragilis YCH46; identical to SEQ ID NO: 19898
  CDS (1)..(1263): transl_table=11

SEQ ID NO: 23223 - protein, 420 aa, Bacteroides fragilis YCH46; identical to SEQ ID NO: 19899

SEQ ID NO: 23224 - DNA, 1239 bp, Burkholderia mallei ATCC 23344; identical to SEQ ID NO: 19900
  CDS (1)..(1239): transl_table=11

SEQ ID NO: 23225 - protein, 412 aa, Burkholderia mallei ATCC 23344; identical to SEQ ID NO: 19901

SEQ ID NO: 23226 - DNA, 1206 bp, Methylococcus capsulatus str. Bath; identical to SEQ ID NO: 19902
  CDS (1)..(1206): transl_table=11

SEQ ID NO: 23227 - protein, 401 aa, Methylococcus capsulatus str. Bath; identical to SEQ ID NO: 19903

SEQ ID NO: 23228 - DNA, 1251 bp, Nocardia farcinica IFM 10152; identical to SEQ ID NO: 19904
  CDS (1)..(1251): transl_table=11

SEQ ID NO: 23229 - protein, 416 aa, Nocardia farcinica IFM 10152; identical to SEQ ID NO: 19905

SEQ ID NO: 23230 - DNA, 1230 bp, Legionella pneumophila str. Paris; identical to SEQ ID NO: 19906
  CDS (1)..(1230): transl_table=11

SEQ ID NO: 23231 - protein, 409 aa, Legionella pneumophila str. Paris; identical to SEQ ID NO: 19907

SEQ ID NO: 23232 - DNA, 1293 bp, Legionella pneumophila str. Paris; identical to SEQ ID NO: 19908
  CDS (1)..(1293): transl_table=11

SEQ ID NO: 23233 - protein, 430 aa, Legionella pneumophila str. Paris; identical to SEQ ID NO: 19909

SEQ ID NO: 23234 - DNA, 1239 bp, Legionella pneumophila str. Paris; identical to SEQ ID NO: 19910
  CDS (1)..(1239): transl_table=11

SEQ ID NO: 23235 - protein, 412 aa, Legionella pneumophila str. Paris; identical to SEQ ID NO: 19911

SEQ ID NO: 23236 - DNA, 1239 bp, Legionella pneumophila str. Lens; identical to SEQ ID NO: 19912
  CDS (1)..(1239): transl_table=11

SEQ ID NO: 23237 - protein, 412 aa, Legionella pneumophila str. Lens; identical to SEQ ID NO: 19913

SEQ ID NO: 23238 - DNA, 1242 bp, Photobacterium profundum SS9; identical to SEQ ID NO: 19914
  CDS (1)..(1242): transl_table=11

SEQ ID NO: 23239 - protein, 413 aa, Photobacterium profundum SS9; identical to SEQ ID NO: 19915

SEQ ID NO: 23240 - DNA, 1233 bp, Streptococcus thermophilus LMG 18311; identical to SEQ ID NO: 19916
  CDS (1)..(1233): transl_table=11

SEQ ID NO: 23241 - protein, 410 aa, Streptococcus thermophilus LMG 18311; identical to SEQ ID NO: 19917

SEQ ID NO: 23242 - DNA, 1227 bp, Thermus thermophilus HB8; identical to SEQ ID NO: 19918
  CDS (1)..(1227): transl_table=11

SEQ ID NO: 23243 - protein, 408 aa, Thermus thermophilus HB8; identical to SEQ ID NO: 19919

SEQ ID NO: 23244 - DNA, 1239 bp, Geobacillus kaustophilus HTA426; identical to SEQ ID NO: 19920
  CDS (1)..(1239): transl_table=11

SEQ ID NO: 23245 - protein, 412 aa, Geobacillus kaustophilus HTA426; identical to SEQ ID NO: 19921

SEQ ID NO: 23246 - DNA, 1242 bp, Salmonella enterica subsp. enterica serovar Paratyphi A str. ATCC; identical to SEQ ID NO: 19922
  CDS (1)..(1242): transl_table=11

SEQ ID NO: 23247 - protein, 413 aa, Salmonella enterica subsp. enterica serovar Paratyphi A str. ATCC; identical to SEQ ID NO: 19923

SEQ ID NO: 23248 - DNA, 1284 bp, Anaplasma marginale str. St. Maries; identical to SEQ ID NO: 19924
  CDS (1)..(1284): transl_table=11

SEQ ID NO: 23249 - protein, 427 aa, Anaplasma marginale str. St. Maries; identical to SEQ ID NO: 19925

SEQ ID NO: 23250 - DNA, 1239 bp, Azoarcus sp. EbN1; identical to SEQ ID NO: 19926
  CDS (1)..(1239): transl_table=11

SEQ ID NO: 23251 - protein, 412 aa, Azoarcus sp. EbN1; identical to SEQ ID NO: 19927

SEQ ID NO: 23252 - DNA, 1299 bp, Zymomonas mobilis subsp. mobilis ZM4; identical to SEQ ID NO: 19928
  CDS (1)..(1299): transl_table=11

SEQ ID NO: 23253 - protein, 432 aa, Zymomonas mobilis subsp. mobilis ZM4; identical to SEQ ID NO: 19929

SEQ ID NO: 23254 - DNA, 1209 bp, Silicibacter pomeroyi DSS-3; identical to SEQ ID NO: 19930
  CDS (1)..(1209): transl_table=11

SEQ ID NO: 23255 - protein, 402 aa, Silicibacter pomeroyi DSS-3; identical to SEQ ID NO: 19931

SEQ ID NO: 23256 - DNA, 1266 bp, Silicibacter pomeroyi DSS-3; identical to SEQ ID NO: 19932
  CDS (1)..(1266): transl_table=11

SEQ ID NO: 23257 - protein, 421 aa, Silicibacter pomeroyi DSS-3; identical to SEQ ID NO: 19933

SEQ ID NO: 23258 - DNA, 1260 bp, Francisella tularensis subsp. tularensis SCHU S4; identical to SEQ ID NO: 19934
  CDS (1)..(1260): transl_table=11

SEQ ID NO: 23259 - protein, 419 aa, Francisella tularensis subsp. tularensis SCHU S4; identical to SEQ ID NO: 19935

SEQ ID NO: 23260 - DNA, 1254 bp, Synechococcus elongatus PCC 6301; identical to SEQ ID NO: 19936
  CDS (1)..(1254): transl_table=11

SEQ ID NO: 23261 - protein, 417 aa, Synechococcus elongatus PCC 6301; identical to SEQ ID NO: 19937

SEQ ID NO: 23262 - DNA, 1242 bp, Bacillus clausii KSM-K16; identical to SEQ ID NO: 19938
  CDS (1)..(1242): transl_table=11

SEQ ID NO: 23263 - protein, 413 aa, Bacillus clausii KSM-K16; identical to SEQ ID NO: 19939

SEQ ID NO: 23264 - DNA, 1215 bp, Campylobacter jejuni RM1221; identical to SEQ ID NO: 19940
  CDS (1)..(1215): transl_table=11

SEQ ID NO: 23265 - protein, 404 aa, Campylobacter jejuni RM1221; identical to SEQ ID NO: 19941

SEQ ID NO: 23266 - DNA, 1272 bp, Ehrlichia ruminantium str. Welgevonden; identical to SEQ ID NO: 19942
  CDS (1)..(1272): transl_table=11

SEQ ID NO: 23267 - protein, 423 aa, Ehrlichia ruminantium str. Welgevonden; identical to SEQ ID NO: 19943

SEQ ID NO: 23268 - DNA, 1269 bp, Dehalococcoides ethenogenes 195; identical to SEQ ID NO: 19944
  CDS (1)..(1269): transl_table=11

SEQ ID NO: 23269 - protein, 422 aa, Dehalococcoides ethenogenes 195; identical to SEQ ID NO: 19945

SEQ ID NO: 23270 - DNA, 1245 bp, Staphylococcus epidermidis RP62A; identical to SEQ ID NO: 19946
  CDS (1)..(1245): transl_table=11

SEQ ID NO: 23271 - protein, 414 aa, Staphylococcus epidermidis RP62A; identical to SEQ ID NO: 19947

SEQ ID NO: 23272 - DNA, 1287 bp, Gluconobacter oxydans 621H; identical to SEQ ID NO: 19948
  CDS (1)..(1287): transl_table=11

SEQ ID NO: 23273 - protein, 428 aa, Gluconobacter oxydans 621H; identical to SEQ ID NO: 19949

SEQ ID NO: 23274 - DNA, 1272 bp, Ehrlichia ruminantium str. Gardel; identical to SEQ ID NO: 19950
  CDS (1)..(1272): transl_table=11

SEQ ID NO: 23275 - protein, 423 aa, Ehrlichia ruminantium str. Gardel; identical to SEQ ID NO: 19951

SEQ ID NO: 23276 - DNA, 1269 bp, Wolbachia endosymbiont strain TRS of Brugia malayi; identical to SEQ ID NO: 19952
  CDS (1)..(1269): transl_table=11

SEQ ID NO: 23277 - protein, 422 aa, Wolbachia endosymbiont strain TRS of Brugia malayi; identical to SEQ ID NO: 19953

SEQ ID NO: 23278 - DNA, 1299 bp, Xanthomonas oryzae pv. oryzae KACC10331; identical to SEQ ID NO: 19954
  CDS (1)..(1299): transl_table=11

SEQ ID NO: 23279 - protein, 432 aa, Xanthomonas oryzae pv. oryzae KACC10331; identical to SEQ ID NO: 19955

SEQ ID NO: 23280 - DNA, 1245 bp, Vibrio fischeri ES114; identical to SEQ ID NO: 19956
  CDS (1)..(1245): transl_table=11

SEQ ID NO: 23281 - protein, 414 aa, Vibrio fischeri ES114; identical to SEQ ID NO: 19957

SEQ ID NO: 23282 - DNA, 1248 bp, Neisseria gonorrhoeae FA 1090; identical to SEQ ID NO: 19958
  CDS (1)..(1248): transl_table=11

SEQ ID NO: 23283 - protein, 415 aa, Neisseria gonorrhoeae FA 1090; identical to SEQ ID NO: 19959

SEQ ID NO: 23284 - DNA, 1263 bp, Bacteroides fragilis NCTC 9343; identical to SEQ ID NO: 19960
  CDS (1)..(1263): transl_table=11

SEQ ID NO: 23285 - protein, 420 aa, Bacteroides fragilis NCTC 9343; identical to SEQ ID NO: 19961

SEQ ID NO: 23286 - DNA, 1251 bp, Chlamydophila abortus S26/3; identical to SEQ ID NO: 19962
  CDS (1)..(1251): transl_table=11

SEQ ID NO: 23287 - protein, 416 aa, Chlamydophila abortus S26/3; identical to SEQ ID NO: 19963

SEQ ID NO: 23288 - DNA, 1263 bp, Brucella abortus biovar 1 str. 9-941; identical to SEQ ID NO: 19964
  CDS (1)..(1263): transl_table=11

SEQ ID NO: 23289 - protein, 420 aa, Brucella abortus biovar 1 str. 9-941; identical to SEQ ID NO: 19965

SEQ ID NO: 23290 - DNA, 1236 bp, Xanthomonas campestris pv. campestris str. 8004; identical to SEQ ID NO: 19966
  CDS (1)..(1236): transl_table=11

SEQ ID NO: 23291 - protein, 411 aa, Xanthomonas campestris pv. campestris str. 8004; identical to SEQ ID NO: 19967

SEQ ID NO: 23292 - DNA, 1281 bp, Rickettsia felis URRWXCal2; identical to SEQ ID NO: 19968
  CDS (1)..(1281): transl_table=11

SEQ ID NO: 23293 - protein, 426 aa, Rickettsia felis URRWXCal2; identical to SEQ ID NO: 19969

SEQ ID NO: 23294 - DNA, 1245 bp, Staphylococcus haemolyticus JCSC1435; identical to SEQ ID NO: 19970
  CDS (1)..(1245): transl_table=11

SEQ ID NO: 23295 - protein, 414 aa, Staphylococcus haemolyticus JCSC1435; identical to SEQ ID NO: 19971

SEQ ID NO: 23296 - DNA, 1245 bp, Pseudomonas fluorescens Pf-5; identical to SEQ ID NO: 19972
  CDS (1)..(1245): transl_table=11

SEQ ID NO: 23297 - protein, 414 aa, Pseudomonas fluorescens Pf-5; identical to SEQ ID NO: 19973

SEQ ID NO: 23298 - DNA, 1269 bp, Pseudomonas fluorescens Pf-5; identical to SEQ ID NO: 19974
  CDS (1)..(1269): transl_table=11

SEQ ID NO: 23299 - protein, 422 aa, Pseudomonas fluorescens Pf-5; identical to SEQ ID NO: 19975

SEQ ID NO: 23300 - DNA, 1416 bp, Psychrobacter arcticum 273-4; identical to SEQ ID NO: 19976
  CDS (1)..(1416): transl_table=11

SEQ ID NO: 23301 - protein, 471 aa, Psychrobacter arcticum 273-4; identical to SEQ ID NO: 19977

SEQ ID NO: 23302 - DNA, 1239 bp, Colwellia psychrerythraea 34H; identical to SEQ ID NO: 19978
  CDS (1)..(1239): transl_table=11

SEQ ID NO: 23303 - protein, 412 aa, Colwellia psychrerythraea 34H; identical to SEQ ID NO: 19979

SEQ ID NO: 23304 - DNA, 1212 bp, Colwellia psychrerythraea 34H; identical to SEQ ID NO: 19980
  CDS (1)..(1212): transl_table=11

SEQ ID NO: 23305 - protein, 403 aa, Colwellia psychrerythraea 34H; identical to SEQ ID NO: 19981

SEQ ID NO: 23306 - DNA, 1245 bp, Pseudomonas syringae pv. phaseolicola 1448A; identical to SEQ ID NO: 19982
  CDS (1)..(1245): transl_table=11

SEQ ID NO: 23307 - protein, 414 aa, Pseudomonas syringae pv. phaseolicola 1448A; identical to SEQ ID NO: 19983

SEQ ID NO: 23308 - DNA, 1233 bp, Streptococcus pyogenes MGAS5005; identical to SEQ ID NO: 19984
  CDS (1)..(1233): transl_table=11

SEQ ID NO: 23309 - protein, 410 aa, Streptococcus pyogenes MGAS5005; identical to SEQ ID NO: 19985

SEQ ID NO: 23310 - DNA, 1236 bp, Dechloromonas aromatica RCB; identical to SEQ ID NO: 19986
  CDS (1)..(1236): transl_table=11

SEQ ID NO: 23311 - protein, 411 aa, Dechloromonas aromatica RCB; identical to SEQ ID NO: 19987

SEQ ID NO: 23312 - DNA, 1263 bp, Thermobifida fusca YX; identical to SEQ ID NO: 19988
  CDS (1)..(1263): transl_table=11

SEQ ID NO: 23313 - protein, 420 aa, Thermobifida fusca YX; identical to SEQ ID NO: 19989

SEQ ID NO: 23314 - DNA, 1239 bp, Thermobifida fusca YX; identical to SEQ ID NO: 19990
  CDS (1)..(1239): transl_table=11

SEQ ID NO: 23315 - protein, 412 aa, Thermobifida fusca YX; identical to SEQ ID NO: 19991

SEQ ID NO: 23316 - DNA, 1248 bp, Prochlorococcus marinus str. NATL2A; identical to SEQ ID NO: 19992
  CDS (1)..(1248): transl_table=11

SEQ ID NO: 23317 - protein, 415 aa, Prochlorococcus marinus str. NATL2A; identical to SEQ ID NO: 19993

SEQ ID NO: 23318 - DNA, 1233 bp, Ralstonia eutropha JMP134; identical to SEQ ID NO: 19994
  CDS (1)..(1233): transl_table=11

SEQ ID NO: 23319 - protein, 410 aa, Ralstonia eutropha JMP134; identical to SEQ ID NO: 19995

SEQ ID NO: 23320 - DNA, 1245 bp, Staphylococcus saprophyticus subsp. saprophyticus ATCC 15305; identical to SEQ ID NO: 19996
  CDS (1)..(1245): transl_table=11

SEQ ID NO: 23321 - protein, 414 aa, Staphylococcus saprophyticus subsp. saprophyticus ATCC 15305; identical to SEQ ID NO: 19997

SEQ ID NO: 23322 - DNA, 1269 bp, Ehrlichia canis str. Jake; identical to SEQ ID NO: 19998
  CDS (1)..(1269): transl_table=11

SEQ ID NO: 23323 - protein, 422 aa, Ehrlichia canis str. Jake; identical to SEQ ID NO: 19999

SEQ ID NO: 23324 - DNA, 1269 bp, Dehalococcoides sp. CBDB1; identical to SEQ ID NO: 20000
  CDS (1)..(1269): transl_table=11

SEQ ID NO: 23325 - protein, 422 aa, Dehalococcoides sp. CBDB1; identical to SEQ ID NO: 20001

SEQ ID NO: 23326 - DNA, 1233 bp, Thiobacillus denitrificans ATCC 25259; identical to SEQ ID NO: 20002
  CDS (1)..(1233): transl_table=11

SEQ ID NO: 23327 - protein, 410 aa, Thiobacillus denitrificans ATCC 25259; identical to SEQ ID NO: 20003

SEQ ID NO: 23328 - DNA, 1215 bp, Pseudomonas syringae pv. syringae B728a; identical to SEQ ID NO: 20004
  CDS (1)..(1215)

SEQ ID NO: 23329 - protein, 404 aa, Pseudomonas syringae pv. syringae B728a; identical to SEQ ID NO: 20005

SEQ ID NO: 23330 - DNA, 1215 bp, Pseudomonas aeruginosa UCBPP-PA14; identical to SEQ ID NO: 20006
  CDS (1)..(1215)

SEQ ID NO: 23331 - protein, 404 aa, Pseudomonas aeruginosa UCBPP-PA14; identical to SEQ ID NO: 20007

SEQ ID NO: 23332 - DNA, 1215 bp, Pseudomonas fluorescens PfO-1; identical to SEQ ID NO: 20008
  CDS (1)..(1215)

SEQ ID NO: 23333 - protein, 404 aa, Pseudomonas fluorescens PfO-1; identical to SEQ ID NO: 20009

SEQ ID NO: 23334 - DNA, 1236 bp, Enterococcus faecium DO; identical to SEQ ID NO: 20010
  CDS (1)..(1236): transl_table=11

SEQ ID NO: 23335 - protein, 411 aa, Enterococcus faecium DO; identical to SEQ ID NO: 20011

SEQ ID NO: 23336 - DNA, 1308 bp, Neurospora crassa; identical to SEQ ID NO: 20012
  CDS (1)..(1308): n means a or g or c or t/u, s means g or c

SEQ ID NO: 23337 - protein, 435 aa, Neurospora crassa; identical to SEQ ID NO: 20013
  Xaa in the positions 84, 155, 174, 226, 302, 328, 332, 345, 346, 349, 356, 384, 422 and 434 is unknown

SEQ ID NO: 23338 - DNA, 1425 bp, Perilla frutescens; identical to SEQ ID NO: 20014
  CDS (1)..(1425)

SEQ ID NO: 23339 - protein, 474 aa, Perilla frutescens; identical to SEQ ID NO: 20015

SEQ ID NO: 23340 - DNA, 1593 bp, Perilla frutescens; identical to SEQ ID NO: 20016
  CDS (1)..(1593)

SEQ ID NO: 23341 - protein, 530 aa, Perilla frutescens; identical to SEQ ID NO: 20017

SEQ ID NO: 23342 - DNA, 1278 bp, Streptomyces roseofulvus; identical to SEQ ID NO: 20018
  CDS (1)..(1278): transl_table=11

SEQ ID NO: 23343 - protein, 425 aa, Streptomyces roseofulvus; identical to SEQ ID NO: 20019

SEQ ID NO: 23344 - DNA, 1467 bp, Capsicum chinense; identical to SEQ ID NO: 20020
  CDS (1)..(1467)

SEQ ID NO: 23345 - protein, 488 aa, Capsicum chinense; identical to SEQ ID NO: 20021

SEQ ID NO: 23346 - DNA, 1554 bp, Cuphea wrightii; identical to SEQ ID NO: 20022
  CDS (1)..(1554)

SEQ ID NO: 23347 - protein, 517 aa, Cuphea wrightii; identical to SEQ ID NO: 20023

SEQ ID NO: 23348 - DNA, 1623 bp, Cuphea wrightii; identical to SEQ ID NO: 20024
  CDS (1)..(1623)

SEQ ID NO: 23349 - protein, 540 aa, Cuphea wrightii; identical to SEQ ID NO: 20025

SEQ ID NO: 23350 - DNA, 1488 bp, Hordeum vulgare; identical to SEQ ID NO: 20026
  CDS (1)..(1488)

SEQ ID NO: 23351 - protein, 495 aa, Hordeum vulgare; identical to SEQ ID NO: 20027

SEQ ID NO: 23352 - DNA, 1470 bp, Hordeum vulgare; identical to SEQ ID NO: 20028
  CDS (1)..(1470)

SEQ ID NO: 23353 - protein, 489 aa, Hordeum vulgare; identical to SEQ ID NO: 20029

SEQ ID NO: 23354 - DNA, 1608 bp, Ricinus communis; identical to SEQ ID NO: 20030
  CDS (1)..(1608)

SEQ ID NO: 23355 - protein, 535 aa, Ricinus communis; identical to SEQ ID NO: 20031

SEQ ID NO: 23356 - DNA, 1410 bp, Ricinus communis; identical to SEQ ID NO: 20032
  CDS (1)..(1410)

SEQ ID NO: 23357 - protein, 469 aa, Ricinus communis; identical to SEQ ID NO: 20033

SEQ ID NO: 23358 - DNA, 1269 bp, Pseudomonas syringae pv; identical to SEQ ID NO: 20034
  CDS (1)..(1269): transl_table=11

SEQ ID NO: 23359 - protein, 422 aa, Pseudomonas syringae pv; identical to SEQ ID NO: 20035

SEQ ID NO: 23360 - DNA, 1272 bp, Streptomyces glaucescens; identical to SEQ ID NO: 20036
  CDS (1)..(1272): transl_table=11

SEQ ID NO: 23361 - protein, 423 aa, Streptomyces glaucescens; identical to SEQ ID NO: 20037

SEQ ID NO: 23362 - DNA, 1269 bp, Streptomyces griseus; identical to SEQ ID NO: 20038
  CDS (1)..(1269): transl_table=11

SEQ ID NO: 23363 - protein, 422 aa, Streptomyces griseus; identical to SEQ ID NO: 20039

SEQ ID NO: 23364 - DNA, 1293 bp, Streptomyces nogalater; identical to SEQ ID NO: 20040
  CDS (1)..(1293): transl_table=11

SEQ ID NO: 23365 - protein, 430 aa, Streptomyces nogalater; identical to SEQ ID NO: 20041

SEQ ID NO: 23366 - DNA, 1260 bp, Streptomyces peucetius; identical to SEQ ID NO: 20042
  CDS (1)..(1260): transl_table=11

SEQ ID NO: 23367 - protein, 419 aa, Streptomyces peucetius; identical to SEQ ID NO: 20043

SEQ ID NO: 23368 - DNA, 1278 bp, Streptomyces roseofulvus; identical to SEQ ID NO: 20044
  CDS (1)..(1278): transl_table=11

SEQ ID NO: 23369 - protein, 425 aa, Streptomyces roseofulvus; identical to SEQ ID NO: 20045

SEQ ID NO: 23370 - DNA, 1467 bp, Glycine max; identical to SEQ ID NO: 20046
  CDS (1)..(1467)

SEQ ID NO: 23371 - protein, 488 aa, Glycine max; identical to SEQ ID NO: 20047

SEQ ID NO: 23372 - DNA, 1470 bp, Glycine max; identical to SEQ ID NO: 20048
  CDS (1)..(1470)

SEQ ID NO: 23373 - protein, 489 aa, Glycine max; identical to SEQ ID NO: 20049

SEQ ID NO: 23374 - DNA, 1299 bp, Streptomyces spiramyceticus; identical to SEQ ID NO: 20050
  CDS (1)..(1299): transl_table=11

SEQ ID NO: 23375 - protein, 432 aa, Streptomyces spiramyceticus; identical to SEQ ID NO: 20051

SEQ ID NO: 23376 - DNA, 1218 bp, Saccharopolyspora erythraea; identical to SEQ ID NO: 20052
  CDS (1)..(1218): transl_table=11

SEQ ID NO: 23377 - protein, 405 aa, Saccharopolyspora erythraea; identical to SEQ ID NO: 20053

SEQ ID NO: 23378 - DNA, 1269 bp, Streptomyces griseoruber; identical to SEQ ID NO: 20054
  CDS (1)..(1269): transl_table=11

SEQ ID NO: 23379 - protein, 422 aa, Streptomyces griseoruber; identical to SEQ ID NO: 20055

SEQ ID NO: 23380 - DNA, 1398 bp, Oryza sativa; identical to SEQ ID NO: 20056
  CDS (1)..(1398)

SEQ ID NO: 23381 - protein, 465 aa, Oryza sativa; identical to SEQ ID NO: 20057

SEQ ID NO: 23382 - DNA, 1254 bp, Treponema hyodysenteriae; identical to SEQ ID NO: 20058
  CDS (1)..(1254): transl_table=11

SEQ ID NO: 23383 - protein, 417 aa, Treponema hyodysenteriae; identical to SEQ ID NO: 20059

SEQ ID NO: 23384 - DNA, 1269 bp, Rhizobium sp; identical to SEQ ID NO: 20060
  CDS (1)..(1269): transl_table=11

SEQ ID NO: 23385 - protein, 422 aa, Rhizobium sp; identical to SEQ ID NO: 20061

SEQ ID NO: 23386 - DNA, 1305 bp, Plasmodium yoelii yoelii; identical to SEQ ID NO: 20062
  CDS (1)..(1305)

SEQ ID NO: 23387 - protein, 434 aa, Plasmodium yoelii yoelii; identical to SEQ ID NO: 20063

SEQ ID NO: 23388 - DNA, 1275 bp, Streptomyces murayamaensis; identical to SEQ ID NO: 20064
  CDS (1)..(1275): transl_table=11

SEQ ID NO: 23389 - protein, 424 aa, Streptomyces murayamaensis; identical to SEQ ID NO: 20065

SEQ ID NO: 23390 - DNA, 1446 bp, Dictyostelium discoideum; identical to SEQ ID NO: 20066
  CDS (1)..(1446)

SEQ ID NO: 23391 - protein, 481 aa, Dictyostelium discoideum; identical to SEQ ID NO: 20067

SEQ ID NO: 23392 - DNA, 1248 bp, Heliobacillus mobilis; identical to SEQ ID NO: 20068
  CDS (1)..(1248): transl_table=11

SEQ ID NO: 23393 - protein, 415 aa, Heliobacillus mobilis; identical to SEQ ID NO: 20069

SEQ ID NO: 23394 - DNA, 1626 bp, Arabidopsis thaliana; identical to SEQ ID NO: 20070
  CDS (1)..(1626)

SEQ ID NO: 23395 - protein, 541 aa, Arabidopsis thaliana; identical to SEQ ID NO: 20071

SEQ ID NO: 23396 - DNA, 1272 bp, Streptomyces galilaeus; identical to SEQ ID NO: 20072
  CDS (1)..(1272): transl_table=11

SEQ ID NO: 23397 - protein, 423 aa, Streptomyces galilaeus; identical to SEQ ID NO: 20073

SEQ ID NO: 23398 - DNA, 1617 bp, Cuphea lanceolata; identical to SEQ ID NO: 20074
  CDS (1)..(1617)

SEQ ID NO: 23399 - protein, 538 aa, Cuphea lanceolata; identical to SEQ ID NO: 20075

SEQ ID NO: 23400 - DNA, 1371 bp, Coriandrum sativum; identical to SEQ ID NO: 20076
  CDS (1)..(1371)

SEQ ID NO: 23401 - protein, 456 aa, Coriandrum sativum; identical to SEQ ID NO: 20077

SEQ ID NO: 23402 - DNA, 1236 bp, Xanthomonas albilineans; identical to SEQ ID NO: 20078
  CDS (1)..(1236): transl_table=11

SEQ ID NO: 23403 - protein, 411 aa, Xanthomonas albilineans; identical to SEQ ID NO: 20079

SEQ ID NO: 23404 - DNA, 1272 bp, Streptomyces maritimus; identical to SEQ ID NO: 20080
  CDS (1)..(1272): transl_table=11

SEQ ID NO: 23405 - protein, 423 aa, Streptomyces maritimus; identical to SEQ ID NO: 20081

SEQ ID NO: 23406 - DNA, 1272 bp, Streptomyces galilaeus; identical to SEQ ID NO: 20082
  CDS (1)..(1272): transl_table=11

SEQ ID NO: 23407 - protein, 423 aa, Streptomyces galilaeus; identical to SEQ ID NO: 20083

SEQ ID NO: 23408 - DNA, 1635 bp, Brassica napus; identical to SEQ ID NO: 20084
  CDS (1)..(1635)

SEQ ID NO: 23409 - protein, 544 aa, Brassica napus; identical to SEQ ID NO: 20085

SEQ ID NO: 23410 - DNA, 1302 bp, Brassica napus; identical to SEQ ID NO: 20086
  CDS (1)..(1302)

SEQ ID NO: 23411 - protein, 433 aa, Brassica napus; identical to SEQ ID NO: 20087

SEQ ID NO: 23412 - DNA, 1467 bp, Glycine max; identical to SEQ ID NO: 20088
  CDS (1)..(1467)

SEQ ID NO: 23413 - protein, 488 aa, Glycine max; identical to SEQ ID NO: 20089

SEQ ID NO: 23414 - DNA, 1410 bp, Glycine max; identical to SEQ ID NO: 20090
  CDS (1)..(1410)

SEQ ID NO: 23415 - protein, 469 aa, Glycine max; identical to SEQ ID NO: 20091

SEQ ID NO: 23416 - DNA, 1410 bp, Glycine max; identical to SEQ ID NO: 20092
  CDS (1)..(1410)

SEQ ID NO: 23417 - protein, 469 aa, Glycine max; identical to SEQ ID NO: 20093

SEQ ID NO: 23418 - DNA, 1722 bp, Elaeis guineensis var; identical to SEQ ID NO: 20094
  CDS (1)..(1722)

SEQ ID NO: 23419 - protein, 573 aa, Elaeis guineensis var; identical to SEQ ID NO: 20095

SEQ ID NO: 23420 - DNA, 1248 bp, Vibrio marinus; identical to SEQ ID NO: 20096
  CDS (1)..(1248): transl_table=11

SEQ ID NO: 23421 - protein, 415 aa, Vibrio marinus; identical to SEQ ID NO: 20097

SEQ ID NO: 23422 - DNA, 1260 bp, Streptomyces rochei; identical to SEQ ID NO: 20098
  CDS (1)..(1260): transl_table=11

SEQ ID NO: 23423 - protein, 419 aa, Streptomyces rochei; identical to SEQ ID NO: 20099

SEQ ID NO: 23424 - DNA, 1689 bp, Arabidopsis thaliana; identical to SEQ ID NO: 20100
  CDS (1)..(1689)

SEQ ID NO: 23425 - protein, 562 aa, Arabidopsis thaliana; identical to SEQ ID NO: 20101

SEQ ID NO: 23426 - DNA, 1605 bp, Cuphea hookeriana; identical to SEQ ID NO: 20102
  CDS (1)..(1605)

SEQ ID NO: 23427 - protein, 534 aa, Cuphea hookeriana; identical to SEQ ID NO: 20103

SEQ ID NO: 23428 - DNA, 1641 bp, Cuphea pulcherrima; identical to SEQ ID NO: 20104
  CDS (1)..(1641)

SEQ ID NO: 23429 - protein, 546 aa, Cuphea pulcherrima; identical to SEQ ID NO: 20105

SEQ ID NO: 23430 - DNA, 1329 bp, Saccharomyces cerevisiae; identical to SEQ ID NO: 20106
  CDS (1)..(1329)

SEQ ID NO: 23431 - protein, 442 aa, Saccharomyces cerevisiae; identical to SEQ ID NO: 20107

SEQ ID NO: 23432 - DNA, 1251 bp, Mycobacterium leprae; identical to SEQ ID NO: 20108
  CDS (1)..(1251): transl_table=11

SEQ ID NO: 23433 - protein, 416 aa, Mycobacterium leprae; identical to SEQ ID NO: 20109

SEQ ID NO: 23434 - DNA, 1221 bp, Haemophilus influenzae; identical to SEQ ID NO: 20110
  CDS (1)..(1221): transl_table=11

SEQ ID NO: 23435 - protein, 406 aa, Haemophilus influenzae; identical to SEQ ID NO: 20111

SEQ ID NO: 23436 - DNA, 1266 bp, Rhizobium meliloti; identical to SEQ ID NO: 20112
  CDS (1)..(1266): transl_table=11

SEQ ID NO: 23437 - protein, 421 aa, Rhizobium meliloti; identical to SEQ ID NO: 20113

SEQ ID NO: 23438 - DNA, 1251 bp, Synechocystis sp; identical to SEQ ID NO: 20114
  CDS (1)..(1251): transl_table=11

SEQ ID NO: 23439 - protein, 416 aa, Synechocystis sp; identical to SEQ ID NO: 20115

SEQ ID NO: 23440 - DNA, 1245 bp, Vibrio cholerae; identical to SEQ ID NO: 20116
  CDS (1)..(1245)

SEQ ID NO: 23441 - protein, 414 aa, Vibrio cholerae; identical to SEQ ID NO: 19655

SEQ ID NO: 23442 - DNA, 1248 bp, Vibrio harveyi; identical to SEQ ID NO: 20118
  CDS (1)..(1248)

SEQ ID NO: 23443 - protein, 415 aa, Vibrio harveyi; identical to SEQ ID NO: 20119

SEQ ID NO: 23444 - DNA, 1272 bp, Streptomyces coelicolor; identical to SEQ ID NO: 20120
  CDS (1)..(1272): transl_table=11

SEQ ID NO: 23445 - protein, 423 aa, Streptomyces coelicolor; identical to SEQ ID NO: 20121

SEQ ID NO: 23446 - DNA, 1269 bp, Streptomyces halstedii; identical to SEQ ID NO: 20122
  CDS (1)..(1269): transl_table=11

SEQ ID NO: 23447 - protein, 422 aa, Streptomyces halstedii; identical to SEQ ID NO: 20123

SEQ ID NO: 23448 - DNA, 1422 bp, Arabidopsis thaliana; identical to SEQ ID NO: 20124
  CDS (1)..(1422)

SEQ ID NO: 23449 - protein, 473 aa, Arabidopsis thaliana; identical to SEQ ID NO: 20125

SEQ ID NO: 23450 - DNA, 1389 bp, Hordeum vulgare; identical to SEQ ID NO: 20126
  CDS (1)..(1389)

SEQ ID NO: 23451 - protein, 462 aa, Hordeum vulgare; identical to SEQ ID NO: 20127

SEQ ID NO: 23452 - DNA, 1386 bp, Arabidopsis thaliana; identical to SEQ ID NO: 20128
  CDS (1)..(1386)

SEQ ID NO: 23453 - protein, 461 aa, Arabidopsis thaliana; identical to SEQ ID NO: 20129

SEQ ID NO: 23454 - DNA, 24 bp, Artificial sequence
  (1)..(24): primer
atgtctaagcgtcgtgtagttgtg

SEQ ID NO: 23455 - DNA, 27 bp, Artificial sequence
  (1)..(27): primer
ttagatctttttaaagatcaaagaacc

SEQ ID NO: 23456 - protein, 494 aa, Artificial sequence; identical to SEQ ID NO: 20132
  Variant (10)..(10): xaa in position 10 is any amino acid
  Variant (16)..(21): xaa in position 16 to 21 is any amino acid
  Variant (23)..(24): xaa in position 23 to 24 is any amino acid
  Variant (26)..(27): xaa in position 26 to 27 is any amino acid
  Variant (29)..(30): xaa in position 29 to 30 is any amino acid
  Variant (33)..(34): xaa in position 33 to 34 is any amino acid
  Variant (36)..(45): xaa in position 36 to 45 is any amino acid
  Variant (46)..(57): xaa in position 46 to 57 is any or no amino acid
  Variant (60)..(60): xaa in position 60 is any amino acid
  Variant (62)..(69): xaa in position 62 to 69 is any amino acid
  Variant (70)..(86): xaa in position 70 to 86 is any or no amino acid
  Variant (88)..(89): xaa in position 88 to 89 is any amino acid
  Variant (94)..(97): xaa in position 94 to 97 is any amino acid
  Variant (101)..(101): xaa in position 101 is any amino acid
  Variant (104)..(105): xaa in position 104 to 105 is any amino acid
  Variant (108)..(109): xaa in position 108 to 109 is any amino acid
  Variant (111)..(117): xaa in position 111 to 117 is any amino acid
  Variant (118)..(131): xaa in position 118 to 131 is any or no amino acid
  Variant (133)..(133): xaa in position 133 is any amino acid
  Variant (136)..(136): xaa in position 136 is any amino acid
  Variant (145)..(157): xaa in position 145 to 157 is any amino acid
  Variant (158)..(172): xaa in position 158 to 172 is any or no amino acid
  Variant (174)..(179): xaa in position 174 to 179 is any or no amino acid
  Variant (181)..(181): xaa in position 181 is any amino acid
  Variant (183)..(184): xaa in position 183 to 184 is any amino acid
  Variant (187)..(188): xaa in position 187 to 188 is any amino acid
  Variant (190)..(191): xaa in position 190 to 191 is any amino acid
  Variant (193)..(193): xaa in position 193 is any amino acid
  Variant (196)..(196): xaa in position 196 is any amino acid
  Variant (200)..(201): xaa in position 200 to 201 is any amino acid
  Variant (203)..(204): xaa in position 203 to 204 is any amino acid
  Variant (206)..(211): xaa in position 206 to 211 is any amino acid
  Variant (215)..(215): xaa in position 215 is any amino acid
  Variant (217)..(220): xaa in position 217 to 220 is any amino acid
  Variant (223)..(223): xaa in position 223 is any amino acid
  Variant (225)..(227): xaa in position 225 to 227 is any amino acid
  Variant (229)..(230): xaa in position 229 to 230 is any amino acid
  Variant (232)..(232): xaa in position 232 is any amino acid
  Variant (234)..(244): xaa in position 234 to 244 is any or no amino acid
  Variant (246)..(246): xaa in position 246 is any amino acid
  Variant (249)..(249): xaa in position 249 is any amino acid
  Variant (252)..(252): xaa in position 252 is any amino acid
  Variant (254)..(254): xaa in position 254 is any amino acid
  Variant (255)..(255): xaa in position 255 is any or no amino acid
  Variant (257)..(258): xaa in position 257 to 258 is any amino acid
  Variant (260)..(260): xaa in position 260 is any amino acid
  Variant (265)..(265): xaa in position 265 is any amino acid
  Variant (267)..(267): xaa in position 267 is any amino acid
  Variant (272)..(272): xaa in position 272 is any amino acid
  Variant (273)..(274): xaa in position 273 to 274 is any or no amino acid
  Variant (276)..(277): xaa in position 276 to 277 is any or no amino acid
  Variant (279)..(279): xaa in position 279 is any or no amino acid
  Variant (281)..(282): xaa in position 281 to 282 is any or no amino acid
  Variant (289)..(290): xaa in position 289 to 290 is any amino acid
  Variant (292)..(292): xaa in position 292 is any amino acid
  Variant (307)..(308): xaa in position 307 to 308 is any amino acid
  Variant (312)..(313): xaa in position 312 to 313 is any amino acid
  Variant (317)..(317): xaa in position 317 is any amino acid
  Variant (319)..(319): xaa in position 319 is any amino acid
  Variant (323)..(323): xaa in position 323 is any amino acid
  Variant (325)..(325): xaa in position 325 is any amino acid
  Variant (327)..(327): xaa in position 327 is any amino acid
  Variant (329)..(329): xaa in position 329 is any amino acid
  Variant (332)..(332): xaa in position 332 is any amino acid
  Variant (336)..(336): xaa in position 336 is any amino acid
  Variant (338)..(338): xaa in position 338 is any amino acid
  Variant (339)..(340): xaa in position 339 to 340 is any or no amino acid
  Variant (342)..(342): xaa in position 342 is any amino acid
  Variant (344)..(346): xaa in position 344 to 346 is any amino acid
  Variant (347)..(347): xaa in position 347 is any or no amino acid
  Variant (349)..(350): xaa in position 349 to 350 is any amino acid
  Variant (353)..(354): xaa in position 353 to 354 is any amino acid
  Variant (356)..(356): xaa in position 356 is any amino acid
  Variant (358)..(363): xaa in position 358 to 363 is any or no amino acid
  Variant (365)..(365): xaa in position 365 is any amino acid
  Variant (375)..(376): xaa in position 375 to 376 is any amino acid
  Variant (377)..(377): xaa in position 377 is any or no amino acid
  Variant (379)..(380): xaa in position 379 to 380 is any amino acid
  Variant (382)..(383): xaa in position 382 to 383 is any amino acid
  Variant (386)..(389): xaa in position 386 to 389 is any amino acid
  Variant (391)..(392): xaa in position 391 to 392 is any amino acid
  Variant (393)..(406): xaa in position 393 to 406 is any or no amino acid
  Variant (408)..(408): xaa in position 408 is any or no amino acid
  Variant (410)..(410): xaa in position 410 is any amino acid
  Variant (415)..(416): xaa in position 415 to 416 is any amino acid
  Variant (419)..(419): xaa in position 419 is any amino acid
  Variant (430)..(431): xaa in position 430 to 431 is any amino acid
  Variant (433)..(433): xaa in position 433 is any amino acid
  Variant (436)..(441): xaa in position 436 to 441 is any amino acid
  Variant (446)..(452): xaa in position 446 to 452 is any amino acid
  Variant (453)..(459): xaa in position 453 to 459 is any or no amino acid
  Variant (461)..(462): xaa in position 461 to 462 is any amino acid
  Variant (464)..(473): xaa in position 464 to 473 is any amino acid
  Variant (474)..(480): xaa in position 474 to 480 is any or no amino acid
  Variant (484)..(484): xaa in position 484 is any amino acid
  Variant (490)..(490): xaa in position 490 is any amino acid
  Variant (492)..(493): xaa in position 492 to 493 is any amino acid

SEQ ID NO: 23457 - protein, 31 aa, Artificial sequence; identical to SEQ ID NO: 20133
  Variant (2)..(2): xaa in position 2 is any amino acid
  Variant (3)..(3): xaa in position 3 is any or no amino acid
  Variant (5)..(5): xaa in position 5 is Ile or Val
  Variant (8)..(8): xaa in position 8 is any amino acid
  Variant (10)..(11): xaa in position 10 to 11 is any amino acid
  Variant (12)..(12): xaa in position 12 is Ala, Ser or Thr
  Variant (13)..(14): xaa in position 13 to 14 is any amino acid
  Variant (15)..(15): xaa in position 15 is Ala or Gly
  Variant (16)..(16): xaa in position 16 is any amino acid
  Variant (17)..(17): xaa in position 17 is Asp, Glu, Gly, Asn, Ser or Thr
  Variant (18)..(27): xaa in position 18 to 27 is any amino acid
  Variant (29)..(30): xaa in position 29 to 30 is any amino acid
  Variant (31)..(31): xaa in position 31 is Ala or Gly

SEQ ID NO: 23458 - protein, 10 aa, Artificial sequence
  Variant (2)..(4): xaa in position 2 to 4 is any amino acid
  Variant (6)..(6): xaa in position 6 is Ala, Cys, Asn, Ser, Thr or Val
  Variant (7)..(8): xaa in position 7 to 8 is any amino acid
  Variant (10)..(10): xaa in position 10 is Ala, Cys, Asp, Gly, Asn or Ser
GXXXGXXXGX

SEQ ID NO: 23459 - protein, 45 aa, Artificial sequence; identical to SEQ ID NO: 20135
  Variant (2)..(5): xaa in position 2 to 5 is any amino acid
  Variant (6)..(6): xaa in position 6 is Asp or Asn
  Variant (7)..(7): xaa in position 7 is any amino acid
  Variant (8)..(8): xaa in position 8 is Ala, Gly, Ile, Leu, Pro or Val
  Variant (9)..(9): xaa in position 9 is Ala, Gly, Pro, Ser or Thr
  Variant (10)..(10): xaa in position 10 is Ala or Gly
  Variant (11)..(12): xaa in position 11 to 12 is any amino acid
  Variant (13)..(13): xaa in position 13 is Ala, Gly, Ser or Thr
  Variant (14)..(14): xaa in position 14 is Ile, Leu, Met or Val
  Variant (15)..(19): xaa in position 15 to 19 is any amino acid
  Variant (21)..(25): xaa in position 21 to 25 is any amino acid
  Variant (26)..(27): xaa in position 26 to 27 is any or no amino acid
  Variant (29)..(30): xaa in position 29 to 30 is any or no amino acid
  Variant (32)..(33): xaa in position 32 to 33 is Ala, Ser or Thr
  Variant (34)..(34): xaa in position 34 is Ala, Gly or Ser
  Variant (35)..(36): xaa in position 35 to 36 is any amino acid
  Variant (37)..(37): xaa in position 37 is Ala, Cys, Asn, Ser or Thr
  Variant (38)..(38): xaa in position 38 is Phe, Ile, Leu, Met or Val
  Variant (39)..(40): xaa in position 39 to 40 is any amino acid
  Variant (41)..(41): xaa in position 41 is Ala, Gly or Ser
  Variant (42)..(44): xaa in position 42 to 44 is any amino acid
  Variant (45)..(45): xaa in position 45 is Ile, Leu or Val

SEQ ID NO: 23460 - protein, 37 aa, Artificial sequence; identical to SEQ ID NO: 20136
  Variant (2)..(6): xaa in position 2 to 6 is any amino acid
  Variant (8)..(8): xaa in position 8 is Asp, Asn or Ser
  Variant (12)..(12): xaa in position 12 is Ile, Leu or Met
  Variant (13)..(13): xaa in position 13 is Ala, Gly or Ser
  Variant (14)..(14): xaa in position 14 is Asp, Glu or Gly
  Variant (16)..(16): xaa in position 16 is Ala, Cys, Gly or Ser
  Variant (17)..(17): xaa in position 17 is Ala or Gly
  Variant (18)..(18): xaa in position 18 is any amino acid
  Variant (19)..(19): xaa in position 19 is Phe, Ile, Leu, Met or Val
  Variant (20)..(20): xaa in position 20 is Ile, Leu, Met or Val
  Variant (21)..(21): xaa in position 21 is Phe, Ile, Leu, Met or Val
  Variant (23)..(23): xaa in position 23 is Ala, Asp, Glu, Ser or Thr
  Variant (24)..(26): xaa in position 24 to 26 is any amino acid
  Variant (28)..(29): xaa in position 28 to 29 is any amino acid
  Variant (31)..(31): xaa in position 31 is any amino acid
  Variant (33)..(33): xaa in position 33 is any amino acid
  Variant (34)..(34): xaa in position 34 is Ile, Pro or Val
  Variant (35)..(36): xaa in position 35 to 36 is any amino acid

SEQ ID NO: 23461 - protein, 23 aa, Artificial sequence
  Variant (2)..(2): xaa in position 2 is Ile, Leu or Val
  Variant (3)..(3): xaa in position 3 is Asn or Ser
  Variant (4)..(4): xaa in position 4 is Ala, Cys, Thr or Val
  Variant (6)..(6): xaa in position 6 is Ala or Gly
  Variant (7)..(7): xaa in position 7 is Ser or Thr
  Variant (8)..(8): xaa in position 8 is Ala, Gly or Ser
  Variant (10)..(11): xaa in position 10 to 11 is any amino acid
  Variant (12)..(12): xaa in position 12 is any or no amino acid
  Variant (14)..(15): xaa in position 14 to 15 is any amino acid
  Variant (17)..(18): xaa in position 17 to 18 is any amino acid
  Variant (19)..(22): xaa in position 19 to 22 is any or no amino acid
YXXXHXXXTXXXDXXEXXXXXXA

SEQ ID NO: 23462 - protein, 32 aa, Artificial sequence; identical to SEQ ID NO: 20138
  Variant (3)..(3): xaa in position 3 is Gly or Ser
  Variant (4)..(5): xaa in position 4 to 5 is any amino acid
  Variant (8)..(8): xaa in position 8 is any or no amino acid
  Variant (10)..(10): xaa in position 10 is any or no amino acid
  Variant (12)..(12): xaa in position 12 is Ala or Gly
  Variant (13)..(13): xaa in position 13 is Ala, Ser or Thr
  Variant (15)..(15): xaa in position 15 is Ala, Gly, Asn, Ser or Val
  Variant (16)..(16): xaa in position 16 is any amino acid
  Variant (18)..(30): xaa in position 18 to 30 is any amino acid
  Variant (31)..(31): xaa in position 31 is any or no amino acid

SEQ ID NO: 23463 - DNA, 1071 bp, Escherichia coli K12
  CDS (1)..(1071)
atgatgagtcagaagtatctttttatcgatcgcgatggaaccctgattagcgaaccgccgagtgattttcaggtggaccgttttgataaactcgcctttgaaccgggcgtgatcccggaactgctgaagctgcaaaaagcgggctacaagctggtgatgatcactaatcaggatggtcttggaacacaaagtttcccacaggcggatttcgatggcccgcacaacctgatgatgcagatcttcacctcgcaaggcgtacagtttgatgaagtgctgatttgtccgcacctgcccgccgatgagtgcgactgccgtaagccgaaagtaaaactggtggaacgttatctggctgagcaagcgatggatcgcgctaacagttatgtgattggcgatcgcgcgaccgacattcaactggcggaaaacatgggcattactggtttacgctacgaccgcgaaaccctgaactggccaatgattggcgagcaactcaccagacgtgaccgttacgctcacgtagtgcgtaataccaaagagacgcagattgacgttcaggtgtggctggatcgtgaaggtggcagcaagattaacaccggcgttggcttctttgatcatatgctggatcagatcgctacccacggcggtttccgcatggaaatcaacgtcaaaggcgacctctatatcgacgatcaccacaccgtcgaagataccggcctggcgctgggcgaagcgctaaaaatcgccctcggagacaaacgcggtatttgccgctttggttttgtgctaccgatggacgaatgccttgcccgctgcgcgctggatatctctggtcgcccgcacctggaatataaagccgagtttacctaccagcgcgtgggcgatctcagcaccgaaatgatcgagcacttcttccgttcgctctcatacaccatgggcgtgacgctacacctgaaaaccaaaggtaaaaacgatcatcaccgtgtagagagtctgttcaaagcctttggtcgcaccctgcgccaggccatccgcgtggaaggcgataccctgccctcgtcgaaaggagtgctgtaa

SEQ ID NO: 23464 - protein, 356 aa, Escherichia coli K12
MMSQKYLFIDRDGTLISEPPSDFQVDRFDKLAFEPGVIPELLKLQKAGYKLVMITNQDGLGTQSFPQADFDGPHNLMMQIFTSQGVQFDEVLICPHLPADECDCRKPKVKLVERYLAEQAMDRANSYVIGDRATDIQLAENMGITGLRYDRETLNWPMIGEQLTRRDRYAHVVRNTKETQIDVQVWLDREGGSKINTGVGFFDHMLDQIATHGGFRMEINVKGDLYIDDHHTVEDTGLALGEALKIALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 23465 - DNA, 1068 bp, Yersinia pestis
  CDS (1)..(1068)
atgagccagaaatttctttttattgaccgcgacggcaccatcattgccgagccaccaactgattatcaggttgaccggttggataaactggcgctggagcctgatgtcattcccgcattactggcgttgcaaaaagcagactacaaactggtgatgatcactaatcaggatggcctcggcaccagcagtttcccgcaggaaaccttcgatccgccacataacctgatgatgcaaatcctgacgtctcaggggatcaattttgaacagatactgatttgcccacatctgccagaggataactgcacctgtcgcaaaccgaaaaccgcgctggtagaaagctatctggcagatggcgtgatgaacagcaccaatagctatgtcatcggtgaccgtgaaactgacctacaactggccgagaacatgggcatcagcgggttacgttatcagcgtgatggcttgaactggacgcaaattgccaaacaactgacccagcgcgaccgccacgcctatgttaatcgcgtgaccaaagaaaccgccattgacgttaatgtttggctggatcgcgaagggggaagcaaaattaaaaccggcgtgggcttcttcgaccatatgctggatcaaatcgccacccacggcggttttcgcatggatattcaggtcagcggcgatctgtatatcgatgatcaccacacagtggaagataccgcgctggcactgggcgaagcgatcaacatcgcactgggtgacaaacggggtattggccgctttggttttgtattgccgatggatgagtgcctggcacgctgtgccttggatatttctggtcgcccgcatttggaatacaaagctgaatttaactaccagcgtgtcggcgatctaagcaccgagatggtcgagcacttcttccgctccctttcgtatgccatggcctgtaccttgcacctgaaaaccaaaggtcgcaacgatcatcaccgagtagaaagcctgtttaaagtatttggtcgtaccttgcgtcaagccattcgcgttgaaggcaataccctgccaagttcaaaaggagtgctgtaa

SEQ ID NO: 23466 - protein, 355 aa, Yersinia pestis
MSQKFLFIDRDGTIIAEPPTDYQVDRLDKLALEPDVIPALLALQKADYKLVMITNQDGLGTSSFPQETFDPPHNLMMQILTSQGINFEQILICPHLPEDNCTCRKPKTALVESYLADGVMNSTNSYVIGDRETDLQLAENMGISGLRYQRDGLNWTQIAKQLTQRDRHAYVNRVTKETAIDVNVWLDREGGSKIKTGVGFFDHMLDQIATHGGFRMDIQVSGDLYIDDHHTVEDTALALGEAINIALGDKRGIGRFGFVLPMDECLARCALDISGRPHLEYKAEFNYQRVGDLSTEMVEHFFRSLSYAMACTLHLKTKGRNDHHRVESLFKVFGRTLRQAIRVEGNTLPSSKGVL

SEQ ID NO: 23467 - DNA, 1068 bp, Salmonella enterica subsp. enterica serovar Typhi
  CDS (1)..(1068)
atgagtcagaagtatcttttcatcgaccgggacggaaccttaatttccgaaccgccgagcgattttcaggtagaccactttgataaactggcctttgagccagaggtgattcccgtattgctgaagctgcaaaaagccggttttaagctggtgatgatcactaaccaggatggacttggcacgcaaagcttcccgcaggcggacttcgacggaccgcacaacctgatgatgcagattttcacttctcagggcgtatgctttgatgaggtgctgatctgccctcacctgcccgcagacgactgcgactgccgcaagcccaaagtgaagctggtggagcgttatcttgcggaacaagcgatggatagcgccaacagctatgtgattggcgatcgtgcaaccgatatccaactcgctgataatatgggcattactggtttacgctatcaccgtgaaacgttgaactggacgatgattggcgaacagctaacgaaacgcgatcgctatgcgcatgtggtccgcaacaccaaagagacacagattgatgtcagcgtctggctggatcgcgaaggcaacagcaagattaataccggcgtcggcttctttgaccatatgctcgatcaaatcgccacccacggcggctttcgcatggagattaccgttaagggcgatctctatatcgacgatcaccacacggtagaagataccgggctggcgctcggtgaggcgttaaaactggcactcggcgacaagcgcggtatctgccgttttggctttgtactaccgatggatgaatgtctggcgcgctgcgcgctggatatttccggtcgtccgcatctggaatataaagctgaatttacctaccagcgtgtgggcgatttgagcacagagatgattgaacactttttccgctcactctcttacacgatgggcgtcactctgcatctcaagactaaaggtaagaacgatcaccaccgtgtcgaaagtttgtttaaagcctttggtcggacgctacgccaggctattcgcgtggagggcgatacattaccgtcctcgaaaggagtgctgtga

SEQ ID NO: 23468 - protein, 355 aa, Salmonella enterica subsp. enterica serovar Typhi
MSQKYLFIDRDGTLISEPPSDFQVDHFDKLAFEPEVIPVLLKLQKAGFKLVMITNQDGLGTQSFPQADFDGPHNLMMQIFTSQGVCFDEVLICPHLPADDCDCRKPKVKLVERYLAEQAMDSANSYVIGDRATDIQLADNMGITGLRYHRETLNWTMIGEQLTKRDRYAHVVRNTKETQIDVSVWLDREGNSKINTGVGFFDHMLDQIATHGGFRMEITVKGDLYIDDHHTVEDTGLALGEALKLALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 23469 - DNA, 1074 bp, Vibrio cholerae
  CDS (1)..(1074)
atgagcaaacaacaaaaaattctttttatcgaccgcgacggcaccttaattgttgagccgccagtggattttcaagttgaccgtttggacaaactcaaacttgagccttatgtgatcccaagcctgctcaagctacaagaggcgggttatcgtttggtgatggtgaccaatcaggatggtttaggcacttcaagctacccgcaagcggatttcgatgcgccgcataacatgatgatggacatttttgaatcgcaaggcgtgaagtttaatgatgtgctgatttgcccgcactttgagcgtgataactgttcgtgccgcaaaccgaaacttggcttggtcaaagagtatctgcaaggtggcaaagtcgatttcaaatcgtcagccgtgattggcgatcgcatgaccgatctgcaactggctgaaaatatggcgattcgcggtattcaataccacccacaaaccatggggtggctggatatcgttaaagatctcaccaccaagccacgtgttgcccaagtggtgcgtaaaaccaaagagaccgatattcaggttctagtcaatcttgaccaaactggcggtaatcagattgaaactggattgggcttttttgatcacatgctagatcaaatcgcgacccacggcggtttccaactgcaactgaaagtggtgggcgatctgcacattgatgatcaccacacggtggaagataccgccttggcactagggcaagcactgcgtgaagcactgggtgacaaacgtggtattggacgctttggtttcacattgcccatggatgagtgtttggcacagtgcgcgttggatctctcgggccgcccgtatctgaaatttgatgcgagctttagccgcccgcaagtgggcgatctgtcgactgagatggtgtatcacttctttcgctcattgaccgatactttggcgtgtactctgcacctctcttccagtggcgataacgatcaccacatcattgagagcctgtttaaagcgtttggccgcacgctgcgtcaagccatcacggtgcaaggtaacgatctgccgagcagtaaaggggtgctctga

SEQ ID NO: 23470 - protein, 357 aa, Vibrio cholerae
MSKQQKILFIDRDGTLIVEPPVDFQVDRLDKLKLEPYVIPSLLKLQEAGYRLVMVTNQDGLGTSSYPQADFDAPHNMMMDIFESQGVKFNDVLICPHFERDNCSCRKPKLGLVKEYLQGGKVDFKSSAVIGDRMTDLQLAENMAIRGIQYHPQTMGWLDIVKDLTTKPRVAQVVRKTKETDIQVLVNLDQTGGNQIETGLGFFDHMLDQIATHGGFQLQLKVVGDLHIDDHHTVEDTALALGQALREALGDKRGIGRFGFTLPMDECLAQCALDLSGRPYLKFDASFSRPQVGDLSTEMVYHFFRSLTDTLACTLHLSSSGDNDHHIIESLFKAFGRTLRQAITVQGNDLPSSKGVL

SEQ ID NO: 23471 - DNA, 1128 bp, Xylella fastidiosa
  CDS (1)..(1128)
atgacccccatcgtgtttattgaccgtgacggcacgctcattgaagagccgcctgattttcagattgatgcctacgaaaaactgcgccttgtcaacggcgtgatcccggcattgctgaagctccgtgatgccggctatcactttgtgatcgtcaccaaccaagatggattgggcagccctgcgtatccccaagccagctttgatggccccaatgcgttgatgctgcagattttcagtagccaaggcatcgtcttccgcgatgtgctgatcgatcgtagctggccgaccgacaacgcgcccacccgtaaaccaggcatcggcttgatggtcgcctaccttcaagatcgcgacattgattgggcgcgctcggcaatggtgggcgaccgccccacagatctgcaatttgccgagaatctcaacattcgcggattccaattgcgtaccccgcaatttggtggtgattgggattgggacggcattgctcacaccttggccgatgcgccgcgccgcgccgtggtacagcgtcacaccaaggagacaaccatccgtgtcgagattgatttggatggcgcaccccaggcgcggatcaccaccggattaccgttttttgatcatatgctcgaacagatcgccaaacatgccggcatttccttacagatcagtgctgttggggatctgcatatcgacgaacatcacacgatagaagataccggcttggcgctaggtcaggcagtgcgccaagccttgggggacaaacgcggtattggccgctatggattcgatccgccccagctgccgtggcaggtgagcggcgcggcggcacacggtggctttaccctaccgatggatgagacccaagccagcgctgtgttggacttcagcggccgcccgtattgtgtctttgaaggaaccttcgtccgtgagcgcgtcggcgatatgcccaccgaactggtaccgcactttttccgctccctgtgcgatgcctccgggatgaacttgcacttgagcgtgcatggcgacaacgaccatcacaaagtagaagcgtgtttcaaggcgctggcgcgtgccttgcgtcaggcgttacaacgccacggccacgtgcttccttctaccaagggggcgttatga

SEQ ID NO: 23472 - protein, 375 aa, Xylella fastidiosa
MTPIVFIDRDGTLIEEPPDFQIDAYEKLRLVNGVIPALLKLRDAGYHFVIVTNQDGLGSPAYPQASFDGPNALMLQIFSSQGIVFRDVLIDRSWPTDNAPTRKPGIGLMVAYLQDRDIDWARSAMVGDRPTDLQFAENLNIRGFQLRTPQFGGDWDWDGIAHTLADAPRRAVVQRHTKETTIRVEIDLDGAPQARITTGLPFFDHMLEQIAKHAGISLQISAVGDLHIDEHHTIEDTGLALGQAVRQALGDKRGIGRYGFDPPQLPWQVSGAAAHGGFTLPMDETQASAVLDFSGRPYCVFEGTFVRERVGDMPTELVPHFFRSLCDASGMNLHLSVHGDNDHHKVEACFKALARALRQALQRHGHVLPSTKGAL

SEQ ID NO: 23473 - DNA, 1065 bp, Salmonella typhimurium
  CDS (1)..(1065)
atgagtcagaagtatcttttgatcgaccgggacggaaccttaatttccgaaccgccgagcgattttcaggtagaccgctttgataaactggcctttgagccagaggtgattcccgtattgctgaagctgcaaaaagccggttttaagctggtgatgatcactaatcaggatggacttggcacgcaaagcttcccgcaggcggacttcgacggaccgcacaacctgatgatgcagattttcacctctcagggcgtatcgtttgatgaggtgctgatctgccctcacctgcccgcagacgactgcgactgccgcaagcccaaagtgaagctggtggagcgttatcttgcggaacaagcgatggatagcgccaacagctatgtgattggcgatcgtgcgaccgatatccagctcgctgatagcatgggcattactggtttacgctatcaccgtgaaacgctgaactggacgatgattggcgaacagctaacgaaacgcgatcgttatgcgcatgtggtccgcaacaccaaagaaacacagattgatgtcagcgtctggctggatcgcgaaggcaacagcaagattaataccggcgtcggcttctttgaccatatgctcgatcaaatcgccacccacggcggctttcgcatggagattaccgttaagggcgatctctatatcgacgatcaccacacggtagaagataccggactggcgctgcgtgaggcattaaaactggcactgcgcgacaagcgcggtatctgccgttttggctttgtactaccgatggatgaatgtcttgcctgcgcgctggatatttccggtcgtccgcatctggaatataaagctgaatttacctaccagcgtgtgggcaatttgagcacagagatgattgaacactttttccgctcactctcttacacgatgggcgtcactctgcatctcaagactaaaggtaagaacgatcaccaccgtgtcgaaagtttgtttaaagcctttggtcggaccgtacgccaggctattcgcgtggagggcgatacattaccgtcctcgaaaggagtgctgtga

SEQ ID NO: 23474 - protein, 354 aa, Salmonella typhimurium
MSQKYLLIDRDGTLISEPPSDFQVDRFDKLAFEPEVIPVLLKLQKAGFKLVMITNQDGLGTQSFPQADFDGPHNLMMQIFTSQGVSFDEVLICPHLPADDCDCRKPKVKLVERYLAEQAMDSANSYVIGDRATDIQLADSMGITGLRYHRETLNWTMIGEQLTKRDRYAHVVRNTKETQIDVSVWLDREGNSKINTGVGFFDHMLDQIATHGGFRMEITVKGDLYIDDHHTVEDTGLALREALKLALRDKRGICRFGFVLPMDECLACALDISGRPHLEYKAEFTYQRVGNLSTEMIEHFFRSLSYTMGVTLHLKTKGKNDHHRVESLFKAFGRTVRQAIRVEGDTLPSSKGVL

SEQ ID NO: 23475 - DNA, 1059 bp, Campylobacter jejuni
  CDS (1)..(1059)
atgagtcaaaaaatcctttttatagatagagatggcactttaatagaggagccaaaaagcgattttcaaatcgatactcttgaaaaattgcgttttgaaaaagatgctattcccactcttttaaaactaaaaaaatttggatttaaatttgttatggtaagcaatcaagacggtcttggaacaccaagttttccaaaggaaaattttgaaatcgctcatgaaaaaatgcttgatattttaaaaagttgcggtatagaatttcaagatatttttatttgtccgcattttgaaaatgaaaattgtgcttgcagaaaacctaaaaccgctatgttagaagagtatatcaaacacgaactttatgataaggaacaaagttttgttataggagatcgtgagagtgatatgatcttggcttcaaatttaggcgtgcgtggtttaaaatacggcgaactttcttggaaagaaatagaaaatgaaattttaagttcttttagaagcgcgagttatcaaagaactactaaagaaacagatataaaagtaaaggtatgcttaaatgggggtaaggttagcattaaaacaggtattgatttttttgatcacatgttagagcaaatcgctgtacatggaggtatagggcttgaaatttcttgtaaaggagatttggaaatcgatgagcatcatagcgttgaagatgtagccttagcacttggagcttgtatcaaaaaagctttaggggataaaatcggcattgcaagatatggttttgctttacctatggatgagtgtttggcaagttgtgcaatggatttttgcaatcgtccccatttagtctataaagccaaatttaaaaaatctcatttaggggctttaagcacagaaatgatcgagcactttttttattctttaagctatgctatgggcgtgagtttgcatttaaaagttaaaggcaaaaacgatcatcataaagccgaagggctttttaaagcctttgcaaaagctttgaaaatggcagtaaaaatagaaagtgaaaatttagccagctctaaaggagtgatatga

SEQ ID NO: 23476 - protein, 352 aa, Campylobacter jejuni
MSQKILFIDRDGTLIEEPKSDFQIDTLEKLRFEKDAIPTLLKLKKFGFKFVMVSNQDGLGTPSFPKENFEIAHEKMLDILKSCGIEFQDIFICPHFENENCACRKPKTAMLEEYIKHELYDKEQSFVIGDRESDMILASNLGVRGLKYGELSWKEIENEILSSFRSASYQRTTKETDIKVKVCLNGGKVSIKTGIDFFDHMLEQIAVHGGIGLEISCKGDLEIDEHHSVEDVALALGACIKKALGDKIGIARYGFALPMDECLASCAMDFCNRPHLVYKAKFKKSHLGALSTEMIEHFFYSLSYAMGVSLHLKVKGKNDHHKAEGLFKAFAKALKMAVKIESENLASSKGVI

SEQ ID NO: 23477 - DNA, 1089 bp, Haemophilus influenzae
  CDS (1)..(1089)
atgcaacctactctttttatcgaccgagacggcacattaattgatgaaccaaaaactgatttccaaattgacagtttagagaaactaaaattagaaccgaaagtgattcccgcactcctcagactgaaagcgaaataccgttttgtgatagtttctaatcaagatgggcttggtacggatgcttttccgcaaacagattttgataagccccacaatgtaatgatggcattatttgaatctcagggcattacctttgatgaagtactcatttgcccgcataagcccgaagaaaattgtctatgtcgcaaaccaaaaattaagttgcttgatcactatattcgtaaaaatttattcgatattgaccgctcttttgtcattggtgaccgagagaccgatgtgcaattagcagaaaatctaggtattcgagctattcaatacgatccacagaaaatgaattgggatctgattgcagaaaaattgttgggggaaacggtcacaaactgtggcaaacgtccgccacgttttgcagaagtaattcgtcaaactaaagagaccgatattaaagtgcaggtttggctagatgaagctggtgtaaatgaaatcaaaaccggcgttggtttttttgaccatatgctcgatcaaatcgccacacacggtgggtttagaatgaacgtgcagtgtaaaggcgatttatggattgacgaacatcacacggtggaggacaccgctctcgcccttggacaagcactgaaacaagccgttggtgacaaacgtggtattgcccgtttcggctttgtgcttccaatggacgaatgtaaagcagaatgtgctttagatttatcgggcagaccttggatcaaattcaatgcctgctttaaacgcgataaagtgggcgattttagtacggaactcactgaacatttctttcaatctttggcattttcaatgcttgccacgcttcatttaaatgtcacaggtaataacgatcatcataaaatagagagcttatttaaagcctttgggagaacattaagacaggcgattcggattgaaggaaatgaaatgccaagttcaaaaggagttttatag

SEQ ID NO: 23478 - protein, 362 aa, Haemophilus influenzae
MQPTLFIDRDGTLIDEPKTDFQIDSLEKLKLEPKVIPALLRLKAKYRFVIVSNQDGLGTDAFPQTDFDKPHNVMMALFESQGITFDEVLICPHKPEENCLCRKPKIKLLDHYIRKNLFDIDRSFVIGDRETDVQLAENLGIRAIQYDPQKMNWDLIAEKLLGETVTNCGKRPPRFAEVIRQTKETDIKVQVWLDEAGVNEIKTGVGFFDHMLDQIATHGGFRMNVQCKGDLWIDEHHTVEDTALALGQALKQAVGDKRGIARFGFVLPMDECKAECALDLSGRPWIKFNACFKRDKVGDFSTELTEHFFQSLAFSMLATLHLNVTGNNDHHKIESLFKAFGRTLRQAIRIEGNEMPSSKGVL

SEQ ID NO: 23479 - DNA, 1125 bp, Bacteroides fragilis
  CDS (1)..(1125)
atgaaaaagaaagtactttttattgaccgtgatggcacgcttgtcattgagccgcctgtcgactatcagctcgattcactggagaagcttgaattctatcctaaagttttccgcaatttgggctttattcgcagtaaacttgattttgagtttgtcatggtgaccaatcaggatggtttgggcacctcttctttcccggaagaaactttttggccggcgcacaatctgatgttgaaaactctggccggagaaggtattacgttcgatgatatcctgatagatcgtagtatgcccgaagattgtgcttctacgaggaagccgcgtacaggaatgttgactaagtatatttccaatccggaatatgatctggagggcagctttgtcattggagatcgtccgacagatgtagaattggccaaaaatataggttgccgtgccatttaccttcaggaatccattgatttgctgaaagaaaagggactggaaacttattgtgctcttgccactactgattgggatcgggtggctgagttcctttttgcaggagagcggagagcagaaatacgcaggacaacgaaagaaaccgatatcctagtagctctcaatctggatggtaagggtacttgtgacatttctaccgggttaggtttctttgaccatatgcttgagcagattggtaaacattccggtatggatttaacgatccgggtgaagggggacctcgaggtagacgaacatcataccatcgaagatacggctatcgcattgggtgagtgtatctatcaggcgctgggtagtaaaagaggaattgaacgttacggttatgctttgcccatggatgattgcctttgcagggtatgcctggatttcggaggacgtccgtggttggtatgggatgccgagtttaagcgtgaaaagataggagaaatgcctaccgagatgtttttacacttttttaagtctctgagtgatgcagccaagatgaacctcaatattaaggctgaggggcagaatgagcatcacaagatagagggaatattcaaagcgctggcccgtgcgttgaagatggcgttgaagagggatatctatcatttcgaattgccgtccagtaaaggagttttgtaa

SEQ ID NO: 23480 - protein, 374 aa, Bacteroides fragilis
MKKKVLFIDRDGTLVIEPPVDYQLDSLEKLEFYPKVFRNLGFIRSKLDFEFVMVTNQDGLGTSSFPEETFWPAHNLMLKTLAGEGITFDDILIDRSMPEDCASTRKPRTGMLTKYISNPEYDLEGSFVIGDRPTDVELAKNIGCRAIYLQESIDLLKEKGLETYCALATTDWDRVAEFLFAGERRAEIRRTTKETDILVALNLDGKGTCDISTGLGFFDHMLEQIGKHSGMDLTIRVKGDLEVDEHHTIEDTAIALGECIYQALGSKRGIERYGYALPMDDCLCRVCLDFGGRPWLVWDAEFKREKIGEMPTEMFLHFFKSLSDAAKMNLNIKAEGQNEHHKIEGIFKALARALKMALKRDIYHFELPSSKGVL

SEQ ID NO: 23481 - DNA, 1098 bp, Mannheimia succiniciproducens MBEL55E
  CDS (1)..(1098)
atgactcaacaaccaaccctattcatcgaccgtgacggcacgttaatcgacgagccgaaaaccgattttcaaattgacagtttagaaaagctcaaattcgaacgtaatgtgattccggcgttgctcaaattaaaaaatcgttatcgttttgtgatggtatcgaatcaagacggcctgggaacggattcatttccgcaggaagattttgataagccgcataatgccatgttagctgtttttcgttcgcaaggcattgaatttgatgatattttaatctgcccacataagccggaagacaactgtgattgccgtaaaccgaaaatcaaattgttgaaaaagtacatcgataaaaaattatttgatcccgcagacagctttgttatcggcgatcggccgacagacgttcaactggctgaaaatctgggtattcgcgcattgcagtatcatccggaaaatttagactgggatatgatcgccgaaaaattattacgggaaccggtagcggatccgaaaggtttaggtcaaccgcgtcatgccgttgtggctcgcaaaaccaaagaaaccgacatcaaagtggaagtctggttggatgaagccggggtgaatcaaattaataccggtatcggtttttttgatcatatgcttgatcaaatcgctactcatggcgggtttcgcatgaatgtcagctgcaaaggcgatttgcatattgacgatcatcataccatcgaagatgtcgcattggcactgggcgcggcgttaaaagaggctatcggcaataagcgcggtattcagcgatttggttttgtgctgcctatggacgaatgcaaagcggaatgcgccctggatttatccggtcgcccgtatttcaaattcaaagcgaaattcaatcgtgacaaagtgggcgatttcagcaccgaaatgacggagcattttttccagtctattgcctataccttgcttgcaaccttgcatttatccgttaaaggcgacaatgctcaccatcaaatcgaagccttgtttaaagctttcggcagaactttgcgccaggcgattaaaatcgaaggaaatgaaatgccgagcagtaagggcgtgttgtaa

SEQ ID NO: 23482 - protein, 365 aa, Mannheimia succiniciproducens MBEL55E
MTQQPTLFIDRDGTLIDEPKTDFQIDSLEKLKFERNVIPALLKLKNRYRFVMVSNQDGLGTDSFPQEDFDKPHNAMLAVFRSQGIEFDDILICPHKPEDNCDCRKPKIKLLKKYIDKKLFDPADSFVIGDRPTDVQLAENLGIRALQYHPENLDWDMIAEKLLREPVADPKGLGQPRHAVVARKTKETDIKVEVWLDEAGVNQINTGIGFFDHMLDQIATHGGFRMNVSCKGDLHIDDHHTIEDVALALGAALKEAIGNKRGIQRFGFVLPMDECKAECALDLSGRPYFKFKAKFNRDKVGDFSTEMTEHFFQSIAYTLLATLHLSVKGDNAHHQIEALFKAFGRTLRQAIKIEGNEMPSSKGVL

SEQ ID NO: 23483 - DNA, 1068 bp, Erwinia carotovora
  CDS (1)..(1068)
atgggccagaaatacctctttatcgaccgtgacggaacattgattgctgaaccgcctgaggattttcaggttgaccgtttggataaactggcgctggaaccagatgtcattccgtcgctgctggcactgcaaaaggccggttatacgctggtgatgattaccaatcaggatgggctaggaaccgatagctttccgcaggaaaccttcgatccaccgcacaacctgatgatgcagattctgacatcgcagggcatccattttgagcacgtgctgatctgtccgcatttaccggcagataactgcacctgtcgcaaacccaagaccgaactggtaacggcctatttgaacggcggcctgatggatgtggcaaatagctacgtcatcggcgaccgccaaaccgatattcagttggcgcaaaatatgggcattaccggcctgctctaccagcgtggcgggctgaactggcaagcaattactgaccagctaaccaagcgtaaccgccatgcacacgtcaaccgagttacgcgtgaaaccgcgattgatgtaaacgtctggctggatcaggaaggcggcagcaaaattaacaccggtgttggcttcttcgatcacatgttggatcaaatcgccacccacggcggtttccgcatgaacattgaagtgaaaggcgatctgtacattgacgatcaccacacggtggaagataccggtctggcgctgggcgaagccctgaataacgcgctgggcgacaaacgcggcattggccgttttggcttcattctgccgatggatgagtgtctggcacgctgtgcgctggatatttcagggcgtccgcatctggaatataaagccgaattcaactatcagcgcgttggcgatctgagtacggaaatggtcgaacacttcttccgctcactgtcttattccatggcctgtacgctgcacctgaaaaccaaagggcgtaacgatcatcaccgtgtggaaagcctgtttaaagtcttcggacgcacgctacgtcaggcaattcgcgtcgagggtgacacgttgccgagctcgaaaggggtgctctga

SEQ ID NO: 23484 - protein, 355 aa, Erwinia carotovora
MGQKYLFIDRDGTLIAEPPEDFQVDRLDKLALEPDVIPSLLALQKAGYTLVMITNQDGLGTDSFPQETFDPPHNLMMQILTSQGIHFEHVLICPHLPADNCTCRKPKTELVTAYLNGGLMDVANSYVIGDRQTDIQLAQNMGITGLLYQRGGLNWQAITDQLTKRNRHAHVNRVTRETAIDVNVWLDQEGGSKINTGVGFFDHMLDQIATHGGFRMNIEVKGDLYIDDHHTVEDTGLALGEALNNALGDKRGIGRFGFILPMDECLARCALDISGRPHLEYKAEFNYQRVGDLSTEMVEHFFRSLSYSMACTLHLKTKGRNDHHRVESLFKVFGRTLRQAIRVEGDTLPSSKGVL

SEQ ID NO: 23485 - DNA, 1125 bp, Bacteroides thetaiotaomicron
  CDS (1)..(1125)
atgaagaagaaaatattgtttatagatagggacgggacattggtcattgaacctcccattgattatcagcttgattcactggaaaagctggaattttatccgagagtcttccgtaatttgggctttatccgtagcaagcttgattttgaatttgtgatggttaccaatcaggacgggctgggtacatcttcgtttccggaagacactttctggcctgctcacaacttgatgctgaaaacattggccggagaaggcattacctttgatgatattctgatcgaccgtagttttccggaagataatgcgccgactcgcaaaccgcgtacaggaatgttgacgaagtatattgataatccggaatatgatcttgcggaaagctttgtaatcggtgatcgtcctactgatgtggagctggcaaagaatcttggttgccgtgctatttatctgcaagaagcaacagatgatttgaaagagaaaggtctggaagaagtttgtgcacttgcaacaacagactgggatcaggtggcagagtttctttttgccggtgagcggaaagcagaagttcgccgtacaacgaaggagactgatatttatgtgtctctcaatcttgatggaaatggaggctgtgatatttctaccggtcttggcttcttcgatcatatgcttgaacaaataggcaagcattccggaatggatctgaccattcgggtaaaaggcgacctggaagtggatgaacatcacaccattgaggatactgccatcgctttgggagaatgtatttatcaggctttgggcagtaagcgcggaatcgaacgttatggttatgctttgcctatggatgattgcctttgtcaggtttgccttgatttcggaggtcgtccttggttagtatgggatgcagagttcaatcgtgaaaaaataggggagatgccgacggagatgttcctgcatttctttaaatcattgagtgatgctgcaaaaatgaatctgaacatcaaggctgaaggacagaatgagcatcacaagatagaaggtatctttaaagcgcttgcacgtgccctgaaaatggcattgaaaagagatatctatcattttgagcttccttcgagcaaaggagtactataa

SEQ ID NO: 23486 - protein, 374 aa, Bacteroides thetaiotaomicron
MKKKILFIDRDGTLVIEPPIDYQLDSLEKLEFYPRVFRNLGFIRSKLDFEFVMVTNQDGLGTSSFPEDTFWPAHNLMLKTLAGEGITFDDILIDRSFPEDNAPTRKPRTGMLTKYIDNPEYDLAESFVIGDRPTDVELAKNLGCRAIYLQEATDDLKEKGLEEVCALATTDWDQVAEFLFAGERKAEVRRTTKETDIYVSLNLDGNGGCDISTGLGFFDHMLEQIGKHSGMDLTIRVKGDLEVDEHHTIEDTAIALGECIYQALGSKRGIERYGYALPMDDCLCQVCLDFGGRPWLVWDAEFNREKIGEMPTEMFLHFFKSLSDAAKMNLNIKAEGQNEHHKIEGIFKALARALKMALKRDIYHFELPSSKGVL

SEQ ID NO: 23487 - DNA, 1068 bp, Buchnera aphidicola
  CDS (1)..(1068)
atgaaacaaaaaatattatttattgatcgagatggaacattaattcatgaaccatctaatgattgtcaagtggatgcaattaataaacttgaatttaaaaaatatattatttcttcactatgtcaattaatgaattttggttataaatttgttatggtgacaaaccaagatggtcttggcagtaaatcatttcctcgggaaaattttaatattccacatttttttatgttaaacatttttcgttcagaaggaataatatttgaagatgttttaatttgtcctcattttttagatgataattgtgattgtcgtaaacctcaaactaaactgttaaaaccttggttgaaaaaaaataagatagataaacaacgcagttatgtaattggtgatcgagaaactgatatggaattagcaaaaaatataaatttaacaggtatacaatacaaggagaaagaatttaattggatagatattacaaaagaaattataaaaagaaatagatatagagaagtgattcgagaaacaaaagaaacttatatacatataaagttatggttggatttagaacatcatagttgtatccaaactggtattaatttttttgatcatatgttagaacaattatctattcatagcggaatttcaatgtatattttagcaaaaggagatttgcaaattgatgaccatcatactatagaagatactggaattgtcttaggagaggcattatctcaagcattaaacaataaaaatggtttatctagatatggttttgttttgcctatggatgaaagtcaagcaaaatgcattatagatttatcaaatcgtccatatttatcttttaatgctcactttaaacataaaatggttggtgatatgaatactgatatggttgaacattttttttattctctttgttgttctatgaaaatcaccttacatatagatgttaaaggaaaaaatgatcatcattgtattgaaagtttgtttaaagcatttggacgtgcactccgcaaggcagtaaaaatagaaggaaatacactgccaacatctaaagggattttataa

SEQ ID NO: 23488 - protein, 355 aa, Buchnera aphidicola
MKQKILFIDRDGTLIHEPSNDCQVDAINKLEFKKYIISSLCQLMNFGYKFVMVTNQDGLGSKSFPRENFNIPHFFMLNIFRSEGIIFEDVLICPHFLDDNCDCRKPQTKLLKPWLKKNKIDKQRSYVIGDRETDMELAKNINLTGIQYKEKEFNWIDITKEIIKRNRYREVIRETKETYIHIKLWLDLEHHSCIQTGINFFDHMLEQLSIHSGISMYILAKGDLQIDDHHTIEDTGIVLGEALSQALNNKNGLSRYGFVLPMDESQAKCIIDLSNRPYLSFNAHFKHKMVGDMNTDMVEHFFYSLCCSMKITLHIDVKGKNDHHCIESLFKAFGRALRKAVKIEGNTLPTSKGIL

SEQ ID NO: 23489 - DNA, 1074 bp, Buchnera aphidicola
  CDS (1)..(1074)
atgtctgaaaaagttttattcattgatcgtgatggtacgttaatttctgaacccttagataattttcaagtagacagttttgataaattagaatttaaacaagatgttatttcttcattaattacattaaaaaaatttaattacaaatttgttatggttactaatcaagatggtttaggatcaaaaaatttcccttataaaagttttataagacctcatgaatttatgatagatgtatttttatctcaaggtataaaatttgaagaagtgttgatttgtccacatgagttaaagagtggttgccaatgtagaaaacctaatttaggaatggttcagcattggttattgaatgatatgttagataagcagcattcttgtgttataggtgatagaaaaactgacatgattttagctaataatatggggattttgggaatacgctatggaacaaagcaaggtaattcatggagtgatattgtatttaagttaacaaaaaaacatgatagacatgccaaagtagttcgtaatactaaagaaactaatgtaagtatagaagtatggttagacaagcaaggaggtagtttaataaacactggattgaatatgtttaatcatatgttagatcaaatagcagtacatagttgtattcgaatgaaaattatttcgagtggtgatatttgtgttgatgatcatcatacagtagaagatgtaggaattgttttaggtaaagctattttaaaagctttaggtaataaactaggtattaataggtttggttttgcattgcctatggatgatagttctagttattgtttgttagatatttccggtcggccttttctaaaatttcgttcatatttcaaacatcaatatataggagatatgagttcggaaatggttagacatttttttcaatctttagcctttgctatgaaatgcactttgcatttacgaagcatgggaattaatgatcatcatcgtttagaaagtttatttaaagtttttggaaaaacgttaaaacaagcgattgttgttagtggaaaaaatttaccgagttctaagggattgctataa

SEQ ID NO: 23490 - protein, 357 aa, Buchnera aphidicola
MSEKVLFIDRDGTLISEPLDNFQVDSFDKLEFKQDVISSLITLKKFNYKFVMVTNQDGLGSKNFPYKSFIRPHEFMIDVFLSQGIKFEEVLICPHELKSGCQCRKPNLGMVQHWLLNDMLDKQHSCVIGDRKTDMILANNMGILGIRYGTKQGNSWSDIVFKLTKKHDRHAKVVRNTKETNVSIEVWLDKQGGSLINTGLNMFNHMLDQIAVHSCIRMKIISSGDICVDDHHTVEDVGIVLGKAILKALGNKLGINRFGFALPMDDSSSYCLLDISGRPFLKFRSYFKHQYIGDMSSEMVRHFFQSLAFAMKCTLHLRSMGINDHHRLESLFKVFGKTLKQAIVVSGKNLPSSKGLL

SEQ ID NO: 23491 - DNA, 1074 bp, Candidatus Blochmannia floridanus
  CDS (1)..(1074)
atgaatgacaaaattttatttatagatcgagacggtactttaattcacgaaccaaaagataattttcagattgattcattagataaattactattagaaccatatgttattcccactctcatagctctaaaaaatattaaatttaaatttattatagtaacaaatcaaaatggattaggtactgacttatttcctaaaaccaaatttaataaacctcatcagtttatgatccaaatatttaaatcacaaggaataaaatttgatcaaatactaatttgcccacacttacctgaagatcaatgtaattgtcgtaaaccaaaaactggtttaatatcctgttggttaaaaaataaatcattagatatgccgaatagctatgtcataggagatcgagatactgacatacaattcgctcacaatataggcattcaaggaataaaatatcatcaaatacattttaattggaaaaaaattcacaaatatttaatgcaaaatagtcatagagtagcgcacatccaacgtataaccaatgaaactaatgtagatgtaaaaatatggcttaatcaatgcgatcaaaataaaatcaatactggtattcatttctttgatcatatgttagaacaaatagctattcatgcaaaaattcgtatgcatatcatcacaaaaggtgatttacatattgatgatcatcatacaattgaagataccgcattatctttaggagaagcattaaatcaagcgttaggagacaaacgaggaattggtcgttttggatttactctacccatggacgaaagcattgcgcaatgtatattagatttatctggtcgtacatattttgattatcaagcagagtattctcttcaaaaaataggaaattttagtactcatatgatagaacacttttttagatcattatcttcaaaaatgcactgtacgttacatctcaaagtaataggcaataacgatcaccacaaagcagaaagtttatttaaatcttttggaaaatcattaaatcaagctatttatatacaacacaatcaaatccctagctctaaaggtattttactatga

SEQ ID NO: 23492 - protein, 357 aa, Candidatus Blochmannia floridanus
MNDKILFIDRDGTLIHEPKDNFQIDSLDKLLLEPYVIPTLIALKNIKFKFIIVTNQNGLGTDLFPKTKFNKPHQFMIQIFKSQGIKFDQILICPHLPEDQCNCRKPKTGLISCWLKNKSLDMPNSYVIGDRDTDIQFAHNIGIQGIKYHQIHFNWKKIHKYLMQNSHRVAHIQRITNETNVDVKIWLNQCDQNKINTGIHFFDHMLEQIAIHAKIRMHIITKGDLHIDDHHTIEDTALSLGEALNQALGDKRGIGRFGFTLPMDESIAQCILDLSGRTYFDYQAEYSLQKIGNFSTHMIEHFFRSLSSKMHCTLHLKVIGNNDHHKAESLFKSFGKSLNQAIYIQHNQIPSSKGILL

SEQ ID NO: 23493 - DNA, 1092 bp, Pasteurella multocida
  CDS (1)..(1092)
atgacacaacaatctattctttttatcgaccgtgacgggactttaattgatgaacccaaaaccgattttcaaattgacagtttggaaaaattacaatttgagccgaatgttatccccgcgttattaaagctcaaaccctattaccgtttcgtaatggtcagtaaccaagacgggctaggtacggcatctttcccacaggaaaattttgataaaccgcacaatgcgatgatggcgttatttaaatcacaaggtatcgagtttgatgaggtgttaatttgccctcataaacctgaagacgagtgcgattgtcgtaagccgaaaattaaattattgaaaaaatacattgataaaaaattgtttgaccctaccaccagctttgtaattggcgatcgtgccactgacgtgcaactggcagaaaatctcggtattcgagccttgcaatatgatcgtgaaaagctcaattgggatctgattgtggaaaaattgttgccaaaacagaccgcacttttagaccgtaaaccacgctatgcggaagtggttcgcaccaccaaagaaacggacattaaagtgcaagtgtggttggacgaaacagggatgaacgacatcaaaacgggtgtgggctttttcgaccatatgcttgatcaaatcgccacccacggtggctttagaatgaatgtgtactgcaaaggcgatttgtggattgacgaacatcacaccgtcgaagacactgccctcgccctcggtaccgcattaaaacaagcccttggcgataaacgaggcattcaacgctttggctttgtgttaccaatggacgaatgcaaggcagaatgtacgatggatctgtctggtcgcccgtatttcaaattcaaagccaaatttaaacgcgataaagtgggtgatttcagcaccgaaatgaccgagcattttttccaatctctcgcttataccttaatggcaaccttacatctcaaaaccaaaggcgataacgaccaccacaaaatcgaaagcctgtttaaagtgtttgggcgtacgttaagacagtgtattaaggttgaagggaatgagttgccgagtagtaagggggttttgtga

SEQ ID NO: 23494 - protein, 363 aa, Pasteurella multocida
MTQQSILFIDRDGTLIDEPKTDFQIDSLEKLQFEPNVIPALLKLKPYYRFVMVSNQDGLGTASFPQENFDKPHNAMMALFKSQGIEFDEVLICPHKPEDECDCRKPKIKLLKKYIDKKLFDPTTSFVIGDRATDVQLAENLGIRALQYDREKLNWDLIVEKLLPKQTALLDRKPRYAEVVRTTKETDIKVQVWLDETGMNDIKTGVGFFDHMLDQIATHGGFRMNVYCKGDLWIDEHHTVEDTALALGTALKQALGDKRGIQRFGFVLPMDECKAECTMDLSGRPYFKFKAKFKRDKVGDFSTEMTEHFFQSLAYTLMATLHLKTKGDNDHHKIESLFKVFGRTLRQCIKVEGNELPSSKGVL

SEQ ID NO: 23495 - DNA, 1068 bp, Photorhabdus luminescens
  CDS (1)..(1068)
atgaaccagaaactcctgtttattgatcgggacggtacgctgatcactgaaccgccaacagattttcaagttgatcgtctggataaactggcactggaaaccgaggttattcctgctctgcttgccctgcaaaaatcggggttcaggctgattatgatcactaatcaggatggtcttggcacagatagttttccattagaacaatttgaaccgccacataacctgatgatgcagattttcagttctcaaggcatccattttgatgaagttttaatctgccctcacaagccagaagagaactgtcattgccgtaagccaaaaataaaactggtggaaaaatatctaacagaaggcttgatggataccgcgaacagctatgtgattggtgaccgggaaaccgatctgcaactggccaaaaatatgggcattcaggggttacattatcatccgaaaaaccttggctggttcgctatctgtgaacaactaacccgtcaagaccgtcacgctcatgttcaacgtatcactaaagagacatccatcaacattgacgtttggcttgatcatgaaggtagcagcgatatcaataccggtgtcgggttctttgaccatatgttggatcagattgctacccacggtggtttccgcatgcatgttcaggttaaaggcgatctctgtattgatgatcaccataccgttgaggataccggtctggcattgggggaagcattgaaactggcgttgggagataaacggggcatttgccgttttggttttgtgttgccaatggatgaatgccttgcccgctgtgctctcgatatttctggtcgccctcatctggaatataaagctgaattcaaacaccagcgggtgggtgatctgagcactgaaatgattgagcacttctttcgttcactctcttatgcaatggcctgtacactacatctgaaaacgaaaggcagcaacgatcatcacagagcagaaagcctatttaaagcctttggccgaacactacgtcaggcaattcgggtagaaggcgatacattgccaagttccaaaggggttctgtga

SEQ ID NO: 23496 - protein, 355 aa, Photorhabdus luminescens
MNQKLLFIDRDGTLITEPPTDFQVDRLDKLALETEVIPALLALQKSGFRLIMITNQDGLGTDSFPLEQFEPPHNLMMQIFSSQGIHFDEVLICPHKPEENCHCRKPKIKLVEKYLTEGLMDTANSYVIGDRETDLQLAKNMGIQGLHYHPKNLGWFAICEQLTRQDRHAHVQRITKETSINIDVWLDHEGSSDINTGVGFFDHMLDQIATHGGFRMHVQVKGDLCIDDHHTVEDTGLALGEALKLALGDKRGICRFGFVLPMDECLARCALDISGRPHLEYKAEFKHQRVGDLSTEMIEHFFRSLSYAMACTLHLKTKGSNDHHRAESLFKAFGRTLRQAIRVEGDTLPSSKGVL

SEQ ID NO: 23497 - DNA, 1086 bp, Photobacterium profundum
  CDS (1)..(1086)
atgagcaaagaaaaaattctatttattgatcgtgatggcaccttaattgttgagccacccgttgattttcaagttgatcgattagataaactcaagctagaaccgtttgttatacctgcgctgttaacactgcaagatgcagggtacaagcttgtgatggtgacaaaccaagacggtttaggaacagatagctacccacaagcggatttcgatgcaccgcaaaatatgatgatggaaatcttcgagtcgcaaggcgtgaagtttgatgatgtattaatttgcccacacttcaatgaagacaactgcagctgccgaaaaccaaagttaggtttagtgaaaagttacctgcagcaaggtcgggttgatttcgcaacctcagcagtgattggtgatcgtcaaactgatcttcagttagctgaaaatatggcgattaaaggtattcaatacaatccacttcctaccgataagagcagcttgaactggcaacagattgtaaaagacctaacaacaaaccctcgcattgctgaagttgtacgtaccaccaaagaaactgacattcgcgttaaagtgaatttagatgaaacgggcggtaactctattgagacgggcttggggttctttgaccacatgctcgatcaaattgcgacacacggtggctttcaaatgcaggttaatgtgaaaggtgacttacacatcgatgatcaccacagcattgaagatacagccctcgcattaggccaagcactcaaagaagcactgggtgataagcgcggtattggtcgttttggctttagcttgccaatggatgaatgcttagcgcaatgtgcattagatttatcgggtcgcccttatttaaagtttgaagcagagtttggacgcgatcaggttggcgatctttcaactgaaatggtatcgcacttcttccgctctcttactgatacgctggcgtgtaccttgcacctttcatcgacaggccataacgatcaccacattgtagaaagcttgttcaaagcatttggtcgcacattacgccaagcaattcgtgttgacggtaatgagctaccaagcagtaaaggagtgctgtaa

SEQ ID NO: 23498 - protein, 361 aa, Photobacterium profundum
MSKEKILFIDRDGTLIVEPPVDFQVDRLDKLKLEPFVIPALLTLQDAGYKLVMVTNQDGLGTDSYPQADFDAPQNMMMEIFESQGVKFDDVLICPHFNEDNCSCRKPKLGLVKSYLQQGRVDFATSAVIGDRQTDLQLAENMAIKGIQYNPLPTDKSSLNWQQIVKDLTTNPRIAEVVRTTKETDIRVKVNLDETGGNSIETGLGFFDHMLDQIATHGGFQMQVNVKGDLHIDDHHSIEDTALALGQALKEALGDKRGIGRFGFSLPMDECLAQCALDLSGRPYLKFEAEFGRDQVGDLSTEMVSHFFRSLTDTLACTLHLSSTGHNDHHIVESLFKAFGRTLRQAIRVDGNELPSSKGVL

SEQ ID NO: 23499 - DNA, 1092 bp, Shewanella oneidensis
  CDS (1)..(1092)
atgaacccagtatttacccctaatgtcgcgcaaaaaatactttttatcgatcgcgatggcaccttgattgaagagccggttacagataagcaagtcgataaccttgccaagctggtattcgagccccaagtgatccccgccttactgcgcctgcaaaaagccggttttcgtttggtgatggtcagcaatcaggatggactcggtaccccgtccttcccgcaggaagatttcgatgcgccgcacaatatgatgatgcaaatcctctccagccaaggggttaagtttgaagatgtgctaatttgcccacactttaacgatgagaattgtagctgccgcaaacccaagctgggactggtgaaagactttttgacccaaggctttatcgattttacccagtccgcggtgattggtgacagacacacagatgtggaactgggcaatgccatggggattatcagctttcaatatcagcgaggcagtctaggttggaacgccattgccgatgcattactcaacaagggccgcagcgcgactgtggtgcgtaccaccaaggaaaccgatattcgcgtgacagtcgatctcgacaatgccagcaaaggcacgattaacactggcattggctttttcgaccatatgctggatcaaatcgccacccacgggaatttcaaaatggaggtgaatgtcgatggagatctcgagatagacgatcaccacagcgttgaagataccgcattggcgattggggatgcactgcgccaagcgcttggcgataaacgcggtattgcccgttttggttttagtttgcctatggatgaggccaagggcgaatgcttactcgatctttccggcaggccttttattaaatttgctgcccaatttgaacgggaaaaagtcggtgaaatggccaccgaaatggtgccgcactttttccgctcctttgccgatggtttgcgctgcaccctgcatgtggccgccgagggagacaacgatcaccacaaggtagaagcactctttaaggtgctgggccgcgcactgcgtcaagcagtaaaagtggaaggtgatgtattgccctcgagtaaaggcgttctctaa

SEQ ID NO: 23500 - protein, 363 aa, Shewanella oneidensis
MNPVFTPNVAQKILFIDRDGTLIEEPVTDKQVDNLAKLVFEPQVIPALLRLQKAGFRLVMVSNQDGLGTPSFPQEDFDAPHNMMMQILSSQGVKFEDVLICPHFNDENCSCRKPKLGLVKDFLTQGFIDFTQSAVIGDRHTDVELGNAMGIISFQYQRGSLGWNAIADALLNKGRSATVVRTTKETDIRVTVDLDNASKGTINTGIGFFDHMLDQIATHGNFKMEVNVDGDLEIDDHHSVEDTALAIGDALRQALGDKRGIARFGFSLPMDEAKGECLLDLSGRPFIKFAAQFEREKVGEMATEMVPHFFRSFADGLRCTLHVAAEGDNDHHKVEALFKVLGRALRQAVKVEGDVLPSSKGVL

SEQ ID NO: 23501 - DNA, 1074 bp, Vibrio vulnificus
  CDS (1)..(1074)
atgagcaaacaacaaaaaatcctttttatcgaccgtgacggcactttgatcgtggaaccacctgtcgattttcaagtagaccgtttagataagctaaaactagagccatttgttatcccaagcctgttgtcgttacaagatgcaggataccgtctagtgatggtcaccaaccaagacggccttggaacagacagctatccgcaagaagattttgatgctccacacaatatgatgatggagatctttgaatctcaaggtgtgaaatttgatgatgttctgatctgtcctcactttgaaaaagacaattgctcttgtcgcaaaccgaaattgggcttagtaaaagagtaccttcaagcgggtaaagtggatttccagaactcgttcgtgattggcgatcgtcaaaccgatcttcaacttgcagagaacatggccattcgtggcattcaatacaacccagaaatcatgggttggaaacggatcctgaaagatctgacggtgaaagcgcgtgttgctgaagtggttcgcaccacgaaagaaacggacatcaaagtattcgttaatcttgatgaacaaggcggtaacgcgatatcaaccggtcttggtttcttcgaccacatgttagatcaaatcgccactcacggtggcttccagatggtgtgcaaagtggaaggtgacttgcatattgatgatcaccacacggtagaagataccgctctcgcgctggggcaagcattgaaagaagcactgggtgacaagcgtggtattggccgctttggcttcagcctgccaatggacgagtgcttggcacaatgtgcactagacctatctggtcgtccttaccttaagtttgacgcgcagttcagccgtgagcaggtcggtgacttatccactgagatggtggttcacttcttccgttctttgacggataccctagcgtgtacgctgcacctttcttctgcgggcaacaatgatcaccacatcattgaaagtctattcaaagcgtttggtcgtactctgcgccaagcaatcaaagtagaaggcactgagctaccaagtagtaaaggcgtgctgtaa

SEQ ID NO: 23502 - protein, 357 aa, Vibrio vulnificus
MSKQQKILFIDRDGTLIVEPPVDFQVDRLDKLKLEPFVIPSLLSLQDAGYRLVMVTNQDGLGTDSYPQEDFDAPHNMMMEIFESQGVKFDDVLICPHFEKDNCSCRKPKLGLVKEYLQAGKVDFQNSFVIGDRQTDLQLAENMAIRGIQYNPEIMGWKRILKDLTVKARVAEVVRTTKETDIKVFVNLDEQGGNAISTGLGFFDHMLDQIATHGGFQMVCKVEGDLHIDDHHTVEDTALALGQALKEALGDKRGIGRFGFSLPMDECLAQCALDLSGRPYLKFDAQFSREQVGDLSTEMVVHFFRSLTDTLACTLHLSSAGNNDHHIIESLFKAFGRTLRQAIKVEGTELPSSKGVL

SEQ ID NO: 23503 - DNA, 1128 bp, Xanthomonas campestris
  CDS (1)..(1128)
atgaccccgattcttttcgtcgaccgcgatggcacgctgattaccgagccggccgatttccagatcgacgcctacgaaaagctgcgctttgtcgacggcgtgattccggccatgctcaagctgcgcgatgccggctaccagttcgtcatcgtcagcaaccaggacggtctgggcagcgagagctatccgcaggcatccttcgacggccccaacaacctgatgctgcagatcttcgccagccagggcatcgtgttccgcgaagtgctgatcgactgcagctggccggccgacaacgcgccgacgcgcaagccgggcgttggcctgatggtgccgtacctgcaggaccgcaccatcgactggagccgttcggcgatggtgggcgaccgcatcaccgacatccagttcgcgcagaacctcaacatccgcgggttccagctgcgcaccgagcagttcggcggcgattgggactgggccggcatcgcacacgaactggccgatgccccgcgccgcgcggtggtccagcgcaataccaaggaaacccgcatccgcgtggagctcgacctggaccgcgtggccgaaccgcacaccgccaccgggctgccgttcttcgatcacatgctcgagcagatcggcaagcacggcgggtttgcgctggatatccgcgccgaaggcgacctgcacatcgatgagcaccacaccatcgaagacactggcttggcgctggggcaggccttgcgcgaagccttgggcgacaagcgcggtattggccgctatggctttgatccggacgacagcccatggcgcgtagcgggcgacaccacacagcacggctttaccttgccgatggacgaaaccatcgccagtgctgcgctggatttcagcggccggccatacttcgtgttcgacggcgacttcaaacgcgagcgcgttggcgacatgcccaccgagctggtgccgcacttcttccgttcggtgtgcgatgcatccggattgaatctgcatctgcacgtgcgcggcgagaacgatcaccacaaggtggaaggctgcttcaaggcattggcgcgtgcactgcgccaggcgatccgccgcgagggcaccgcgttgccatccaccaagggggcgctatga

SEQ ID NO: 23504 - protein, 375 aa, Xanthomonas campestris
MTPILFVDRDGTLITEPADFQIDAYEKLRFVDGVIPAMLKLRDAGYQFVIVSNQDGLGSESYPQASFDGPNNLMLQIFASQGIVFREVLIDCSWPADNAPTRKPGVGLMVPYLQDRTIDWSRSAMVGDRITDIQFAQNLNIRGFQLRTEQFGGDWDWAGIAHELADAPRRAVVQRNTKETRIRVELDLDRVAEPHTATGLPFFDHMLEQIGKHGGFALDIRAEGDLHIDEHHTIEDTGLALGQALREALGDKRGIGRYGFDPDDSPWRVAGDTTQHGFTLPMDETIASAALDFSGRPYFVFDGDFKRERVGDMPTELVPHFFRSVCDASGLNLHLHVRGENDHHKVEGCFKALARALRQAIRREGTALPSTKGAL

SEQ ID NO: 23505 - DNA, 27 bp, Artificial sequence
  (1)..(27): primer
atgatgagtcagaagtatctttttatc

SEQ ID NO: 23506 - DNA, 23 bp, Artificial sequence
  (1)..(23): primer
ttacagcactcctttcgacgagg

SEQ ID NO: 23507 - protein, 392 aa, Artificial sequence
  Variant (6)..(8): xaa in position 6 to 8 is any amino acid
  Variant (11)..(14): xaa in position 11 to 14 is any amino acid
  Variant (16)..(16): xaa in position 16 is any amino acid
  Variant (18)..(20): xaa in position 18 to 20 is any amino acid
  Variant (23)..(47): xaa in position 23 to 47 is any amino acid
  Variant (50)..(50): xaa in position 50 is any amino acid
  Variant (54)..(57): xaa in position 54 to 57 is any amino acid
  Variant (59)..(61): xaa in position 59 to 61 is any amino acid
  Variant (63)..(68): xaa in position 63 to 68 is any amino acid
  Variant (70)..(76): xaa in position 70 to 76 is any amino acid
  Variant (78)..(79): xaa in position 78 to 79 is any amino acid
  Variant (81)..(84): xaa in position 81 to 84 is any amino acid
  Variant (86)..(96): xaa in position 86 to 96 is any amino acid
  Variant (100)..(117): xaa in position 100 to 117 is any amino acid
  Variant (119)..(121): xaa in position 119 to 121 is any amino acid
  Variant (125)..(126): xaa in position 125 to 126 is any amino acid
  Variant (128)..(163): xaa in position 128 to 163 is any amino acid
  Variant (165)..(185): xaa in position 165 to 185 is any amino acid
  Variant (187)..(191): xaa in position 187 to 191 is any amino acid
  Variant (193)..(193): xaa in position 193 is any amino acid
  Variant (195)..(195): xaa in position 195 is any amino acid
  Variant (198)..(204): xaa in position 198 to 204 is any amino acid
  Variant (206)..(214): xaa in position 206 to 214 is any amino acid
  Variant (217)..(219): xaa in position 217 to 219 is any amino acid
  Variant (221)..(221): xaa in position 221 is any amino acid
  Variant (225)..(225): xaa in position 225 is any amino acid
  Variant (227)..(229): xaa in position 227 to 229 is any amino acid
  Variant (231)..(240): xaa in position 231 to 240 is any amino acid
  Variant (243)..(245): xaa in position 243 to 245 is any amino acid
  Variant (247)..(247): xaa in position 247 is any amino acid
  Variant (250)..(251): xaa in position 250 to 251 is any amino acid
  Variant (254)..(264): xaa in position 254 to 264 is any amino acid
  Variant (266)..(268): xaa in position 266 to 268 is any amino acid
  Variant (270)..(270): xaa in position 270 is any amino acid
  Variant (272)..(273): xaa in position 272 to 273 is any amino acid
  Variant (275)..(293): xaa in position 275 to 293 is any amino acid
  Variant (295)..(296): xaa in position 295 to 296 is any amino acid
  Variant (301)..(308): xaa in position 301 to 308 is any amino acid
  Variant (310)..(312): xaa in position 310 to 312 is any amino acid
  Variant (314)..(327): xaa in position 314 to 327 is any amino acid
  Variant (329)..(336): xaa in position 329 to 336 is any amino acid
  Variant (340)..(340): xaa in position 340 is any amino acid
  Variant (342)..(349): xaa in position 342 to 349 is any amino acid
  Variant (351)..(355): xaa in position 351 to 355 is any amino acid
  Variant (357)..(357): xaa in position 357 is any amino acid
  Variant (359)..(359): xaa in position 359 is any amino acid
  Variant (362)..(363): xaa in position 362 to 363 is any amino acid
  Variant (365)..(366): xaa in position 365 to 366 is any amino acid
  Variant (369)..(390): xaa in position 369 to 390 is any amino acid
DRDGTXXXEPXXXXQXDXXXKLXXXXXXXXXXXXXXXXXXXXXXXXXNQXGLGXXXXPXXXFXXXXXXMXXXXXXXGXXFXXXXIXXXXXXXXXXXRKPXXXXXXXXXXXXXXXXXXSXXXGDRXXDXXXXXXXXXXXXXXXXXXXXXXXXXXXXXXXXXXXXWXXXXXXXXXXXXXXXXXXXXXRXXXXXRXTXETXXXXXXXLXXXXXXXXXTGXXXFXHMLXQXXXHXXXXXXXXXXGDXXXDXHHXXEDXXXXXXXXXXXAXXXKXGXXRXXXXXXXXXXXXXXXXXXXGXXLPMDXXXXXXXXDXXXRXXXXXXXXXXXXXXGXXXXXXXXHFFXSXXXXXXXXLXXXXXGXNXHHXXEXXFKXXXXXXXXXXXXXXXXXXXXXXKG

SEQ ID NO: 23508 - protein, 397 aa, Artificial sequence
  Variant (11)..(11): xaa in position 11 is any amino acid
  Variant (14)..(15): xaa in position 14 to 15 is any amino acid
  Variant (17)..(17): xaa in position 17 is any amino acid
  Variant (19)..(19): xaa in position 19 is any amino acid
  Variant (21)..(23): xaa in position 21 to 23 is any amino acid
  Variant (26)..(30): xaa in position 26 to 30 is any amino acid
  Variant (34)..(34): xaa in position 34 is any amino acid
  Variant (36)..(37): xaa in position 36 to 37 is any amino acid
  Variant (39)..(46): xaa in position 39 to 46 is any amino acid
  Variant (49)..(50): xaa in position 49 to 50 is any amino acid
  Variant (58)..(58): xaa in position 58 is any amino acid
  Variant (60)..(60): xaa in position 60 is any amino acid
  Variant (62)..(64): xaa in position 62 to 64 is any amino acid
  Variant (66)..(67): xaa in position 66 to 67 is any amino acid
  Variant (70)..(71): xaa in position 70 to 71 is any amino acid
  Variant (73)..(77): xaa in position 73 to 77 is any amino acid
  Variant (81)..(82): xaa in position 81 to 82 is any amino acid
  Variant (84)..(86): xaa in position 84 to 86 is any amino acid
  Variant (92)..(96): xaa in position 92 to 96 is any amino acid
  Variant (98)..(98): xaa in position 98 is any amino acid
  Variant (103)..(105): xaa in position 103 to 105 is any amino acid
  Variant (107)..(109): xaa in position 107 to 109 is any amino acid
  Variant (111)..(116): xaa in position 111 to 116 is any amino acid
  Variant (118)..(120): xaa in position 118 to 120 is any amino acid
  Variant (122)..(122): xaa in position 122 is any amino acid
  Variant (128)..(128): xaa in position 128 is any amino acid
  Variant (131)..(132): xaa in position 131 to 132 is any amino acid
  Variant (135)..(135): xaa in position 135 is any amino acid
  Variant (137)..(138): xaa in position 137 to 138 is any amino acid
  Variant (140)..(143): xaa in position 140 to 143 is any amino acid
  Variant (145)..(166): xaa in position 145 to 166 is any amino acid
  Variant (168)..(169): xaa in position 168 to 169 is any amino acid
  Variant (171)..(173): xaa in position 171 to 173 is any amino acid
  Variant (175)..(188): xaa in position 175 to 188 is any amino acid
  Variant (190)..(190): xaa in position 190 is any amino acid
  Variant (192)..(192): xaa in position 192 is any amino acid
  Variant (194)..(194): xaa in position 194 is any amino acid
  Variant (196)..(196): xaa in position 196 is any amino acid
  Variant (201)..(201): xaa in position 201 is any amino acid
  Variant (203)..(203): xaa in position 203 is any amino acid
  Variant (205)..(207): xaa in position 205 to 207 is any amino acid
  Variant (210)..(215): xaa in position 210 to 215 is any amino acid
  Variant (217)..(217): xaa in position 217 is any amino acid
  Variant (220)..(221): xaa in position 220 to 221 is any amino acid
  Variant (228)..(228): xaa in position 228 is any amino acid
  Variant (232)..(232): xaa in position 232 is any amino acid
  Variant (234)..(234): xaa in position 234 is any amino acid
  Variant (236)..(243): xaa in position 236 to 243 is any amino acid
  Variant (247)..(247): xaa in position 247 is any amino acid
  Variant (250)..(250): xaa in position 250 is any amino acid
  Variant (254)..(254): xaa in position 254 is any amino acid
  Variant (258)..(258): xaa in position 258 is any amino acid
  Variant (263)..(263): xaa in position 263 is any amino acid
  Variant (265)..(267): xaa in position 265 to 267 is any amino acid
  Variant (271)..(271): xaa in position 271 is any amino acid
  Variant (276)..(276): xaa in position 276 is any amino acid
  Variant (278)..(296): xaa in position 278 to 296 is any amino acid
  Variant (299)..(299): xaa in position 299 is any amino acid
  Variant (305)..(306): xaa in position 305 to 306 is any amino acid
  Variant (308)..(308): xaa in position 308 is any amino acid
  Variant (310)..(310): xaa in position 310 is any amino acid
  Variant (313)..(313): xaa in position 313 is any amino acid
  Variant (318)..(322): xaa in position 318 to 322 is any amino acid
  Variant (324)..(324): xaa in position 324 is any amino acid
  Variant (326)..(330): xaa in position 326 to 330 is any amino acid
  Variant (332)..(334): xaa in position 332 to 334 is any amino acid
  Variant (338)..(339): xaa in position 338 to 339 is any amino acid
  Variant (343)..(343): xaa in position 343 is any amino acid
  Variant (346)..(352): xaa in position 346 to 352 is any amino acid
  Variant (356)..(358): xaa in position 356 to 358 is any amino acid
  Variant (360)..(360): xaa in position 360 is any amino acid
  Variant (365)..(366): xaa in position 365 to 366 is any amino acid
  Variant (368)..(368): xaa in position 368 is any amino acid
  Variant (372)..(374): xaa in position 372 to 374 is any amino acid
  Variant (376)..(376): xaa in position 376 is any amino acid
  Variant (378)..(378): xaa in position 378 is any amino acid
  Variant (381)..(386): xaa in position 381 to 386 is any amino acid
  Variant (388)..(389): xaa in position 388 to 389 is any amino acid
  Variant (396)..(396): xaa in position 396 is any amino acid
LFIDRDGTLIXEPXXDXQXDXXXKLXXXXXVIPXLXXLXXXXXXXXVMXXNQDGLGTXSXPXXXFXXPHXXMXXXXXSQGXXFXXXLICPHXXXXXCXCRKPXXXLXXXYXXXXXXDXXXSXVIGDRXTDXXLAXNXXIXXXXYXXXXXXXXXXXXXXXXXXXXXXWXXIXXXLXXXXXXXXXXXXXXRXAXVXRXTKETXIXVXXXLDXXXXXXIXTGXXFFDHMLXQIAXHXGXXXXXXXXGDLXIDXHHTXEDTXLALGXAXXXALGXKRGIXRXXXXXXXXXXXXXXXXXXXGFXLPMDEXXAXCXLDXSGRPXXXXXAXFXXXXXGXXXTEMXXHFFXSLXXXXXXXLHLXXXGXNDHHXXEXLFKXXXRXLXQAXXXXXXGXXLPSSKGXL

SEQ ID NO: 23509 - protein, 25 aa, Artificial sequence
  Variant (1)..(1): xaa in position 1 is Leu or Val
  Variant (2)..(2): xaa in position 2 is Phe or Leu
  Variant (3)..(3): xaa in position 3 is Ile or Val
  Variant (9)..(9): xaa in position 9 is Leu or Ile
  Variant (10)..(10): xaa in position 10 is Ile or Val
  Variant (11)..(11): xaa in position 11 is any amino acid
  Variant (14)..(14): xaa in position 14 is any amino acid
  Variant (15)..(15): xaa in position 15 is any or no amino acid
  Variant (16)..(16): xaa in position 16 is Asp or Asn
  Variant (17)..(17): xaa in position 17 is any amino acid
  Variant (19)..(19): xaa in position 19 is Val, Ile or Leu
  Variant (21)..(22): xaa in position 21 to 22 is any amino acid
  Variant (23)..(23): xaa in position 23 is Asp, Glu, Ala or Asn
XXXDRDGTXXXEPXXXXQXDXXXKL

SEQ ID NO: 23510 - protein, 22 aa, Artificial sequence
  Variant (1)..(1): xaa in position 1 is Tyr or Phe
  Variant (2)..(2): xaa in position 2 is any amino acid
  Variant (3)..(3): xaa in position 3 is Phe or Leu
  Variant (4)..(4): xaa in position 4 is Val or Ile
  Variant (5)..(5): xaa in position 5 is Met or Ile
  Variant (6)..(6): xaa in position 6 is Val or Ile
  Variant (7)..(7): xaa in position 7 is Thr or Ser
  Variant (10)..(10): xaa in position 10 is Asp or Asn
  Variant (14)..(14): xaa in position 14 is Thr or Ser
  Variant (15)..(15): xaa in position 15 is any amino acid
  Variant (16)..(16): xaa in position 16 is Ser, Ala, Asn or Leu
  Variant (17)..(17): xaa in position 17 is Phe or Tyr
  Variant (19)..(21): xaa in position 19 to 21 is any amino acid
XXXXXXXNQXGLGXXXXPXXXF

SEQ ID NO: 23511 - protein, 42 aa, Artificial sequence
  Variant (4)..(6): xaa in position 4 to 6 is any amino acid
  Variant (7)..(7): xaa in position 7 is Leu or Met
  Variant (8)..(8): xaa in position 8 is Val, Ile, Leu or Met
  Variant (9)..(10): xaa in position 9 to 10 is any amino acid
  Variant (11)..(11): xaa in position 11 is Tyr, Trp or Phe
  Variant (12)..(12): xaa in position 12 is Leu or Ile
  Variant (13)..(17): xaa in position 13 to 17 is any amino acid
  Variant (18)..(18): xaa in position 18 is Asp or Asn
  Variant (19)..(21): xaa in position 19 to 21 is any amino acid
  Variant (23)..(23): xaa in position 23 is any amino acid
  Variant (24)..(24): xaa in position 24 is Val or Met
  Variant (25)..(25): xaa in position 25 is Ile or Val
  Variant (29)..(29): xaa in position 29 is any amino acid
  Variant (30)..(30): xaa in position 30 is Thr or Ser
  Variant (32)..(32): xaa in position 32 is Ile, Val, Leu or Met
  Variant (33)..(33): xaa in position 33 is any amino acid
  Variant (34)..(34): xaa in position 34 is Leu or Phe
  Variant (35)..(35): xaa in position 35 is Ala or Gly
  Variant (36)..(36): xaa in position 36 is any amino acid
  Variant (37)..(37): xaa in position 37 is Asn, Ala or Ser
  Variant (38)..(38): xaa in position 38 is Met, Leu or Ile
  Variant (39)..(39): xaa in position 39 is Gly, Ala or Asn
  Variant (40)..(40): xaa in position 40 is Ile, Leu, Val or Cys
  Variant (41)..(41): xaa in position 41 is any amino acid
  Variant (42)..(42): xaa in position 42 is Gly, Ala or Ser
RKPXXXXXXXXXXXXXXXXXXSXXXGDRXXDXXXXXXXXXXX

SEQ ID NO: 23512 - protein, 45 aa, Artificial sequence
  Variant (2)..(2): xaa in position 2 is any amino acid
  Variant (3)..(3): xaa in position 3 is Ala or Arg
  Variant (4)..(4): xaa in position 4 is any amino acid
  Variant (5)..(5): xaa in position 5 is Val, Ile or Tyr
  Variant (6)..(6): xaa in position 6 is any amino acid
  Variant (8)..(8): xaa in position 8 is any amino acid
  Variant (10)..(10): xaa in position 10 is Lys, Asn or Arg
  Variant (13)..(13): xaa in position 13 is any amino acid
  Variant (14)..(14): xaa in position 14 is Ile or Val
  Variant (15)..(15): xaa in position 15 is any amino acid
  Variant (16)..(16): xaa in position 16 is Val or Ile
  Variant (17)..(17): xaa in position 17 is any amino acid
  Variant (18)..(18): xaa in position 18 is Val, Leu or Ile
  Variant (19)..(19): xaa in position 19 is any amino acid
  Variant (21)..(21): xaa in position 21 is Asp or Asn
  Variant (22)..(26): xaa in position 22 to 26 is any amino acid
  Variant (27)..(27): xaa in position 27 is any or no amino acid
  Variant (28)..(28): xaa in position 28 is Ile or Thr
  Variant (29)..(29): xaa in position 29 is any amino acid
  Variant (32)..(32): xaa in position 32 is Leu, Val or Ile
  Variant (33)..(33): xaa in position 33 is any amino acid
  Variant (34)..(34): xaa in position 34 is Phe or Met
  Variant (36)..(36): xaa in position 36 is Asp or Asn
  Variant (40)..(40): xaa in position 40 is Asp or Glu
  Variant (42)..(42): xaa in position 42 is Ile or Leu
  Variant (43)..(43): xaa in position 43 is Ala, Gly or Ser
  Variant (44)..(44): xaa in position 44 is any amino acid
RXXXXXRXTXETXXXXXXXLXXXXXXXXXTGXXXFXHMLXQXXXH

SEQ ID NO: 23513 - protein, 61 aa, Artificial sequence
  Variant (3)..(3): xaa in position 3 is Leu or Ile
  Variant (4)..(4): xaa in position 4 is any amino acid
  Variant (5)..(5): xaa in position 5 is Ile or Val
  Variant (7)..(7): xaa in position 7 is Asp or Glu
  Variant (10)..(10): xaa in position 10 is Thr or Ser
  Variant (11)..(11): xaa in position 11 is Val or Ile
  Variant (14)..(14): xaa in position 14 is Thr or Val
  Variant (15)..(15): xaa in position 15 is Ala or Gly
  Variant (16)..(16): xaa in position 16 is Leu or Ile
  Variant (17)..(17): xaa in position 17 is Ala, Val or Ser
  Variant (18)..(18): xaa in position 18 is Leu or Ile
  Variant (19)..(19): xaa in position 19 is Gly or Arg
  Variant (20)..(20): xaa in position 20 is any amino acid
  Variant (21)..(21): xaa in position 21 is Ala or Cys
  Variant (22)..(22): xaa in position 22 is Leu, Ile or Val
  Variant (23)..(24): xaa in position 23 to 24 is any amino acid
  Variant (26)..(26): xaa in position 26 is Leu, Ile or Val
  Variant (27)..(27): xaa in position 27 is Gly, Asn or Arg
  Variant (28)..(28): xaa in position 28 is Asp, Asn or Ser
  Variant (30)..(30): xaa in position 30 is any amino acid
  Variant (32)..(32): xaa in position 32 is Ile or Leu
  Variant (33)..(33): xaa in position 33 is any amino acid
  Variant (35)..(35): xaa in position 35 is Phe or Tyr
  Variant (36)..(53): xaa in position 36 to 53 is any or no amino acid
  Variant (55)..(55): xaa in position 55 is Phe or Tyr
  Variant (56)..(56): xaa in position 56 is any amino acid
  Variant (61)..(61): xaa in position 61 is Glu or Asp
GDXXXDXHHXXEDXXXXXXXXXXXAXXXKXGXXRXXXXXXXXXXXXXXXXXXXGXXLPMDX

SEQ ID NO: 23514 - protein, 68 aa, Artificial sequence
  Variant (1)..(1): xaa in position 1 is Val, Ile or Leu
  Variant (3)..(3): xaa in position 3 is any amino acid
  Variant (4)..(4): xaa in position 4 is Leu, Met or Phe
  Variant (5)..(5): xaa in position 5 is any amino acid
  Variant (6)..(6): xaa in position 6 is Thr or Ser
  Variant (7)..(7): xaa in position 7 is Glu, His or Asp
  Variant (8)..(8): xaa in position 8 is Met or Leu
  Variant (9)..(10): xaa in position 9 to 10 is any amino acid
  Variant (14)..(14): xaa in position 14 is any amino acid
  Variant (16)..(16): xaa in position 16 is Leu, Ile, Val or Phe
  Variant (17)..(22): xaa in position 17 to 22 is any amino acid
  Variant (23)..(23): xaa in position 23 is Thr, Asn or Ser
  Variant (25)..(25): xaa in position 25 is His or Asn
  Variant (26)..(26): xaa in position 26 is Leu, Ile or Val
  Variant (27)..(29): xaa in position 27 to 29 is any amino acid
  Variant (31)..(31): xaa in position 31 is any amino acid
  Variant (33)..(33): xaa in position 33 is Asp, Glu or Ala
  Variant (36)..(37): xaa in position 36 to 37 is any amino acid
  Variant (39)..(39): xaa in position 39 is Ser, Gly or Ala
  Variant (40)..(40): xaa in position 40 is Leu, Cys or Ile
  Variant (43)..(43): xaa in position 43 is Ala, Val or Ser
  Variant (44)..(44): xaa in position 44 is Phe or Leu
  Variant (45)..(45): xaa in position 45 is Gly or Ala
  Variant (46)..(46): xaa in position 46 is Arg or Lys
  Variant (47)..(47): xaa in position 47 is Thr, Ala or Ser
  Variant (48)..(48): xaa in position 48 is Leu or Val
  Variant (49)..(49): xaa in position 49 is Arg, Lys or Asn
  Variant (50)..(50): xaa in position 50 is Gln, Met or Lys
  Variant (51)..(51): xaa in position 51 is Ala or Cys
  Variant (52)..(52): xaa in position 52 is Ile, Leu or Val
  Variant (53)..(53): xaa in position 53 is any amino acid
  Variant (54)..(55): xaa in position 54 to 55 is any or no amino acid
  Variant (56)..(56): xaa in position 56 is Val, Ile or Arg
  Variant (57)..(57): xaa in position 57 is any amino acid
  Variant (58)..(58): xaa in position 58 is Gly, His or Ser
  Variant (59)..(60): xaa in position 59 to 60 is any amino acid
  Variant (61)..(61): xaa in position 61 is Leu, Met or Ile
  Variant (62)..(62): xaa in position 62 is Pro or Ala
  Variant (63)..(64): xaa in position 63 to 64 is Ser or Thr
  Variant (67)..(67): xaa in position 67 is any amino acid
  Variant (68)..(68): xaa in position 68 is Leu or Ile
XGXXXXXXXXHFFXSXXXXXXXXLXXXXXGXNXHHXXEXXFKXXXXXXXXXXXXXXXXXXXXXXKGXX

SEQ ID NO: 23515 - DNA, 1347 bp, Escherichia coli
  CDS (1)..(1347)
atggtcatgagccagaaaaccctgtttacaaagtctgctctcgcagtcgcagtggcacttatctccacccaggcctggtcggcaggctttcagttaaacgaattttcttcctctggcctgggccgggcttattcaggggaaggcgcaattgccgatgatgcaggtaacgtcagccgtaaccccgcattgattactatgtttgaccgcccgacattttctgcgggtgcggtttatattgacccggatgtaaatatcagcggaacgtctccatctggtcgtagcctgaaagccgataacatcgcgcctacggcatgggttccgaacatgcactttgttgcaccgattaacgaccaatttggttggggcgcttctattacctctaactatggtctggctacagagtttaacgatacttatgcaggcggctctgtcgggggtacaaccgaccttgaaaccatgaacctgaacttaagcggtgcgtatcgcttaaataatgcatggagctttggtcttggtttcaacgccgtctacgctcgcgcgaaaattgaacgtttcgcaggcgatctggggcagttggttgctggccaaattatgcaatctcctgctggccaaactcagcaagggcaagcattggcagctaccgccaacggtattgacagtaataccaaaatcgctcatctgaacggtaaccagtggggctttggctggaacgccggaatcctgtatgaactggataaaaataaccgctatgcactgacctaccgttctgaagtgaaaattgacttcaaaggtaactacagcagcgatcttaatcgtgcgtttaataactacggtttgccaattcctaccgcgacaggtggcgcaacgcaatcgggttatctgacgctgaacctgcctgaaatgtgggaagtgtcaggttataaccgtgttgatccacagtgggcgattcactatagcctggcttacaccagctggagtcagttccagcagctgaaagcgacctcaaccagtggcgacacgctgttccagaaacatgaaggctttaaagatgcttaccgcatcgcgttgggtaccacttattactacgatgataactggaccttccgtaccggtatcgcctttgatgacagcccagttcctgcacagaatcgttctatctccattccggaccaggaccgtttctggctgagtgcaggtacgacttacgcatttaataaagatgcttcagtcgacgttggtgtttcttatatgcacggtcagagcgtgaaaattaacgaaggcccataccagttcgagtctgaaggtaaagcctggctgttcggtactaactttaactacgcgttctga

SEQ ID NO: 23516 - protein, 448 aa, Escherichia coli
MVMSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGQTQQGQALAATANGIDSNTKIAHLNGNQWGFGWNAGILYELDKNNRYALTYRSEVKIDFKGNYSSDLNRAFNNYGLPIPTATGGATQSGYLTLNLPEMWEVSGYNRVDPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 23517 - DNA, 1212 bp, Aquifex aeolicus VF5
  CDS (1)..(1212): transl_table=11
gtgaaaagattagccctttctgcacttctgatcccggctatttccttagcggttggatatagagttcctgaacagtccattcgttccactggaaccgcagcttcttacacctcaactgtggagcacgccgattctgtacacttcaaccctgcaaacatgtcatttctgaaggacaggtggtactttgaactgggaagcagattaatatatctgcccaaaataaagtttaagggaaacgttcttgaccctgttcaaaaacgctacgtttacgtggatacgcgttccgaggacgaaacacacttcgtcccgtacttccacatggtattccctgaggttaaaaatttcaggttcggtatttcctttgttacacctgcaggtctctccaagaggtgggacgatgttccggtgagtgcctacgctaagaggtttacactaaaggtttacgaacttgactttgccctgtcgtacagggtaaacgaaaagttctccgtaggtggaggtttgaggggagtttacgcaagcggaaaagtgaaactctattatccgaatgtttacaacttaaaacttgatggggatacagatgtaaagcccggttactacctctccttcactttcaagcccactgagaactttaacatatccgcggtatacaggtcaaaagttgatttggatatagagggtgatgcgaagggaaatataggattacatagagtgaatacttcgggagatgtcagcgttcctcttccggcagaattgagaatttcaggttcatacgtgtggaataacactacctttgagcttactctcgagagaacgttctggtcctcctacgactacctcgacttcaattacaaggatcctgtcgcagaaaaccagttcggaaaacccatagagaaggattgggaagatgtgaacacatacaggttcggattacagcacaaatttggcgatagctttaagggactgctcggtatagcgtacagtgaatctccgataccttcaaaaagcttagggtttgaattgccggagcccaaaagcgtatggattctttccctcggagggatatacaaccttacgaaaaactgggaagtaggattctcttacctataccttgcaaaggacagcagaaaggttgataaccagaggataaagggagagttttcggatataagcgctcacctctttacgctttcagttggggcaaagttttag

SEQ ID NO: 23518 - protein, 403 aa, Aquifex aeolicus VF5
MKRLALSALLIPAISLAVGYRVPEQSIRSTGTAASYTSTVEHADSVHFNPANMSFLKDRWYFELGSRLIYLPKIKFKGNVLDPVQKRYVYVDTRSEDETHFVPYFHMVFPEVKNFRFGISFVTPAGLSKRWDDVPVSAYAKRFTLKVYELDFALSYRVNEKFSVGGGLRGVYASGKVKLYYPNVYNLKLDGDTDVKPGYYLSFTFKPTENFNISAVYRSKVDLDIEGDAKGNIGLHRVNTSGDVSVPLPAELRISGSYVWNNTTFELTLERTFWSSYDYLDFNYKDPVAENQFGKPIEKDWEDVNTYRFGLQHKFGDSFKGLLGIAYSESPIPSKSLGFELPEPKSVWILSLGGIYNLTKNWEVGFSYLYLAKDSRKVDNQRIKGEFSDISAHLFTLSVGAKF

SEQ ID NO: 23519 - DNA, 1299 bp, Vibrio cholerae O1 biovar eltor str. N16961
  CDS (1)..(1299): transl_table=11
atgaaaaccaataagactctcctctcctgtgctgtggctttcggtttagccagcgtttctacctttactcaagcggcaggtttccagcttgctgaatattcagcaacgggtcttggccgtgcttacgccggtgaagccgcgatggcagacaatgccagcgcacaatggcgcaaccctgcaatgctgacctatttagaaggcactcaagtttctgccggcgcaatttacgtgaatccaaacgtggatgttgagggtacagtaaaccacgcacaactaggtaaaactcacgcatcttcaaacgattttgcccacgatgcagtgattccgaatttctatctgtcacaccagttaaacgaacaaatggcactgggttttgctcttggtactaactacggtatggaaaccgatctgggtactgagtttgcagcctctcactttggcaaccaagcgagcgtgatcagcaaagaagcgaacctcaatattgcttaccaaatcttgcctcaattgagcattggtggtggtgtgcgttatgtgatgggtgaaggtcatttcggtgcaactgcgccagcaaaaaatctgattcgtcatcctgttactaacaacgtcatgactttacctaaaggtacaaccttaaaatatatggaaggtgaagataactcttggggttggcaagtaggcagtgcatggcaaatcaatcaagatcaccgcgtaggtttcgcctataaatcggaagtggtgatggattttgaaggccatgcagaaggagtcagttacggtagttataaacctggcatgatgtctgtgactctaccagcgacggctgaactggcaagcttccaccaactcaatgaccaatgggcgattcacgctagcattaactggacagattggagttcattcaaagagttgacggctgtgttcccagaaaaatctgacctcatcaaatcagaaaactgggaagacaactaccgctttgctttgggcacaacgtatcaatacgatgctaaactcgctctgcgtgcgggcgtcgcatacgacacatcagcggtagacgataaaaaccgcacagcaaccatcccggaaacagaccgtacttgggtaagtgtcggcggtagttatgttgctacgccacaactgactctcgatgccggttttacctatatctttgcgaaagatgccaccatcaacgaacctcgtgacgcttcagaccaaactgcagccgcaatcggtggtgcatttacaggtaatgtatcaggcaatgtatggctgatcggtgttcaagcgaactaccgcttctaa

SEQ ID NO: 23520 - protein, 432 aa, Vibrio cholerae O1 biovar eltor str. N16961
MKTNKTLLSCAVAFGLASVSTFTQAAGFQLAEYSATGLGRAYAGEAAMADNASAQWRNPAMLTYLEGTQVSAGAIYVNPNVDVEGTVNHAQLGKTHASSNDFAHDAVIPNFYLSHQLNEQMALGFALGTNYGMETDLGTEFAASHFGNQASVISKEANLNIAYQILPQLSIGGGVRYVMGEGHFGATAPAKNLIRHPVTNNVMTLPKGTTLKYMEGEDNSWGWQVGSAWQINQDHRVGFAYKSEVVMDFEGHAEGVSYGSYKPGMMSVTLPATAELASFHQLNDQWAIHASINWTDWSSFKELTAVFPEKSDLIKSENWEDNYRFALGTTYQYDAKLALRAGVAYDTSAVDDKNRTATIPETDRTWVSVGGSYVATPQLTLDAGFTYIFAKDATINEPRDASDQTAAAIGGAFTGNVSGNVWLIGVQANYRF

SEQ ID NO: 23521 - DNA, 1287 bp, Vibrio cholerae O1 biovar eltor str. N16961
  CDS (1)..(1287): transl_table=11
atgaacaacatgcgtctgtttaaaaaatctctgcttgccgtgacggtaacgctagccacacaacaagcgtttgcagcaggtttccagctcaacgcacaatctgctaccggcctaggtcgcgcttttgcgggtgatgccgttatcgccgataacgcagccgtaatgtctcgcaacccagcggcgatggcactgtttgatgagatggcgctctctcttggttttgaaaccattaccaccatgattgacgttaaaaatgtctcttatcgaggtgttctcggtaactcagtttctgttcaagacacggatgacgtaggtggtacttccgttgcacctaatattcatttgatcgttccagtcaatgaacagtttgcttggggggttaatgcttattcaaactttggtacaaaaactgagttttctgattcttatccagcctctgaatacggtggcttaacagacgttaaaagctttaacttaggcctagcaggttcttatcgcgtcaacaaagaatggagttttggtgctggtttagacctgatttatgggcaaggcaccatgaaacgtattgccggaaccagtttcccagcaagtacaattgtggtgaacccgacgaccgttatcccagctcgaggcacatcactactcaacgtcgataaagcggatggttgggcagtaggttttaacttgggtacagtttacgaaatggatgagaataaccgctttggtttgtcttaccgctatagcccagaatttaaagctaaagacgattacggacaagagatcacgctaccactaccggatatcgctgagttctctggcttccacaaaattgagaatactcagtttgccgtacactatagcgtacagtggattggctggagtgctttcgacaaaattgagttccgcaaccttgtaacgtctcgctcttctgttggcgctctaaccaaaggcagctacgataagatgtatgagtggcaagatggctggcactactctatcggtggcacatactacttaaatagtgattggacactgcgtgcaggctatatgtacgatactagcgcacaagattcacgtacttctatctctgttcctgattcagatcgccagtggttatcagcaggctttacctataacatcgatgacaaatcaaacgtagactttggatttacttacttaatgggtaaagatgtcgcagtttccgaaaatgatgcgggttctaagctaaccgcaacaacccacgcagacgcaatcctgttgggcttacaatacagccgtacgttttaa

SEQ ID NO: 23522 - protein, 428 aa, Vibrio cholerae O1 biovar eltor str. N16961
MNNMRLFKKSLLAVTVTLATQQAFAAGFQLNAQSATGLGRAFAGDAVIADNAAVMSRNPAAMALFDEMALSLGFETITTMIDVKNVSYRGVLGNSVSVQDTDDVGGTSVAPNIHLIVPVNEQFAWGVNAYSNFGTKTEFSDSYPASEYGGLTDVKSFNLGLAGSYRVNKEWSFGAGLDLIYGQGTMKRIAGTSFPASTIVVNPTTVIPARGTSLLNVDKADGWAVGFNLGTVYEMDENNRFGLSYRYSPEFKAKDDYGQEITLPLPDIAEFSGFHKIENTQFAVHYSVQWIGWSAFDKIEFRNLVTSRSSVGALTKGSYDKMYEWQDGWHYSIGGTYYLNSDWTLRAGYMYDTSAQDSRTSISVPDSDRQWLSAGFTYNIDDKSNVDFGFTYLMGKDVAVSENDAGSKLTATTHADAILLGLQYSRTF

SEQ ID NO: 23523 - DNA, 1332 bp, Pasteurella multocida subsp. multocida str. Pm70
  CDS (1)..(1332): transl_table=11
atgttttattatacaaataacttaaataacaaaggtctcataattatggcgaaaactagcaaatttactcaaactcttcttgcttccgcgttagcggtggtcgcgggtagcgcttctgctgccgctttccaactagcagaagtgtcaacatccggtttagggcgtgcttatgcgggggaagccgcgattgcagataatgcggcagtggttgccacgaacccagcattaatgagcttattgaaacaacctgaaatttctgttggggcaatttatgtggacccaaatattaatttaacctcaccaatgccaggattcgcctataaaaatattgcgccgaatgcgttagttccgacagtgtatggtgtgtatccaattaacgaaaaattcgctgtgggcggtggattgaatgttaactatggtttagccaccgagtttgatgacaaatatgcgggcggctttttaggcggtaaaaccgatttgaccgcaattaactttaacttaagcggtgcctatcgtgttacggagaagttcagcgttggcttaggcttaaacgcagtgcatgcgaaagcgaaacttgagcgttatgcaggtgtggctttgaaattaaaagtaccaaatgtagctcaacttgcagcattaccagcgaataccgtaatttcaaagctacaaggtgataaatggggctttggctggaatgccggtttggtatatgaatttaatgaacgtaaccgcattggtatcgcctatcattcacaagtggatattaactttaaagggcagtattcaaatcacttcccattagccgctgcagctttgctccagaccaagggcattaccgcgacaggtggcaaagaaatcccgggtaccttacatttaccgctaccagcttactgggaaatttctggttatcataaaatgaccgatcgttttgcaatgcactatagctataaatatacgcaatggagcaaatttaaagagttacgtgcaaaaggtacggacggtaagaccttatttagcaaaacagaagagtttcgtgattcttcacgtattgcccttggtgcgagctatgatgtaaccgatgcattaacggtacgtacgggtattgcgtatgatgaaagtgctgcagatgagcataacaccatttctattccagatacggatcgtacttggtttagtgtgggggccacttaccgctttacgccaaatgtatctattgatgccggttttgcacatttaaaaggcaagaagaatacctttaaagaagaaggggttccatttactagcaaagccagtgcgaacctttatggtttaaacgtgaattaccgtttctaa

SEQ ID NO: 23524 - protein, 443 aa, Pasteurella multocida subsp. multocida str. Pm70
MFYYTNNLNNKGLIIMAKTSKFTQTLLASALAVVAGSASAAAFQLAEVSTSGLGRAYAGEAAIADNAAVVATNPALMSLLKQPEISVGAIYVDPNINLTSPMPGFAYKNIAPNALVPTVYGVYPINEKFAVGGGLNVNYGLATEFDDKYAGGFLGGKTDLTAINFNLSGAYRVTEKFSVGLGLNAVHAKAKLERYAGVALKLKVPNVAQLAALPANTVISKLQGDKWGFGWNAGLVYEFNERNRIGIAYHSQVDINFKGQYSNHFPLAAAALLQTKGITATGGKEIPGTLHLPLPAYWEISGYHKMTDRFAMHYSYKYTQWSKFKELRAKGTDGKTLFSKTEEFRDSSRIALGASYDVTDALTVRTGIAYDESAADEHNTISIPDTDRTWFSVGATYRFTPNVSIDAGFAHLKGKKNTFKEEGVPFTSKASANLYGLNVNYRF

SEQ ID NO: 23525 - DNA, 1275 bp, Pseudomonas aeruginosa PAO1
  CDS (1)..(1275): transl_table=11
atgaaaacaatatggtttaaaacctctctcgcactgaccattagcgctgtctccacctacaccctcgccaacggcatcgccatcaacgaacagagcgccagcggcgccggcaccgcctacgccggccgcgcctcgtccgcgctcgatgccagcaccatctacggcaacccggccggcctgtccaagctgaaacgcaccgaagtcagcggcggtctggccatcgtcaaggccaaggacgacatcagccaggcccacagcaccgcccagggcagcaacaagggcgactcggtaccgctggccgccgtaccgttcggctacttctccacgccgatcaacgaagatttcactttcggcctgggcatctacgtgccctacggcatcatcaacgattacgaaaacggcttcatgggcagctcccacggctcctatagcaaggtgcaggtgatcaccgtgcagccgaccatcgcctggaagatcaacgacaaggtttccgtcggcttcggtccgaccttcaaccgcatcgacggccagttgaagaacaccctggccaccaatggcctgctcggcagcaacggcgataccaagatcaacatcaagggcgacgacaccgccatcggctacaacgtcggcgtgatggtcgacctgaccgacgacaccacctggggcctgacctaccactccaaggtcaagtaccacctgggcggcaacaccgaagtgaagaacgctccgggtgccctgggcctgaacggcaagtacgatgccaagctggacatcaccctgccggaatcggtggatacctccatcacccacaagttcgacgacaagtggacgggctacctgggcgccgtctggacccgctggagccgcctggagaagatcgaggtgcgcaacagcggcgtaccggcgctcggccaggccctgggcttcaacaccatcggcgaagacctgaactggcgcgacacctggtccttctcggtaggtacctcctaccaggccaccccggagtgggtgctgcgcaccggctttgcctacgagccgtcgccgacctccaacgaggaccgcaacgtgcgcatcccggtgggcgaccgcaaggtcttcaccgtcggtgccggctggtcgccgaaccaggacctgaccgtcgacgtggcctacgcctacctgtgggaaaccaccgccggcgtcaaccaggaaggcagcgccctgcagccggcctacagcgccaagtacgacaacagcgcgcatggcctgaccgcccaggtcacctatcgcttctga

SEQ ID NO: 23526 - protein, 424 aa, Pseudomonas aeruginosa PAO1
MKTIWFKTSLALTISAVSTYTLANGIAINEQSASGAGTAYAGRASSALDASTIYGNPAGLSKLKRTEVSGGLAIVKAKDDISQAHSTAQGSNKGDSVPLAAVPFGYFSTPINEDFTFGLGIYVPYGIINDYENGFMGSSHGSYSKVQVITVQPTIAWKINDKVSVGFGPTFNRIDGQLKNTLATNGLLGSNGDTKINIKGDDTAIGYNVGVMVDLTDDTTWGLTYHSKVKYHLGGNTEVKNAPGALGLNGKYDAKLDITLPESVDTSITHKFDDKWTGYLGAVWTRWSRLEKIEVRNSGVPALGQALGFNTIGEDLNWRDTWSFSVGTSYQATPEWVLRTGFAYEPSPTSNEDRNVRIPVGDRKVFTVGAGWSPNQDLTVDVAYAYLWETTAGVNQEGSALQPAYSAKYDNSAHGLTAQVTYRF

SEQ ID NO: 23527 - DNA, 1392 bp, Pseudomonas aeruginosa PAO1
  CDS (1)..(1392): transl_table=11
ttgccattgctctgcgccctgatcgtcggcggattgttcggcacgtcccaggcgcaagccggcggcttcatggtgccgaccaccaacacggcgggctggggccgtgcgatggcaggcggctcgctgtttcccaacgatccgagcgccgcgttcaacaacccggcggccatggcgttcatcgacaagcggatcgcccagttgacggtcaactacgccgatatcgacatcaagtacaacggcgatgcctacgactaccagggtaatcccatgaccggcggctaccaggacgggccgggcacccccgagctgggtaccaacgatggtggccaggctggattcggcgcgtggctgccgaccggcttcctggtcgtaccgatcaacgaccgcttcgccttcggtctgagccaggtcgttccgatgggaatgcgcagcacctgggacccgaactggaaaggccgcgatttcgcggtggacaccaagatcgagacgatcggcctgaccggctccctgtcgttcaaggtcaacgacaacttctccctgggcgccggggtgatcatccagcgcacctccggcttcgtcagccagaacctcgatctctatgcctcggccgccaactccccgggcatgggcgggattccgttcccggcctcgaactcgtccgcgctgatgcgggtcaaggtggacaacacctcgcccggcttcttcgccggcgcggtttggaagccgaccgaccgcgacaccctgggcttcgcctaccacgcgaagatccgcaacaagctgaaggggcactacaacctctacgaccacgacggtggactgaccgagggcgccatcgagggcggcaccccgggcctggcctatccgggcctggacctgcgcatgggcgcttccgcctcggcgcgcctggatatccccgcctacgcctcactggattgggtacaccagttcaacgaccgtctgagcctgggcgccagcgccacctggaccgagtggtcgtcgttccaggacctgaccctcaaatcccacggcaacacgatcgtctccattccctacacctaccggaacacctggaccctggcggtgggcggcgactacaaggtgaccgaccagtggaccatgcgcgccggggtcgcctacgaccagacgccgacccacaatgccacccgcgacccgcggattcccgacggcgatcgctacttcgcctccctgggcgccggctatcgcttccagtcgatgccggagttgtcgatcgacgcggcctactcgcggcagttcgtcaaggaggtgccgttgaagacggtcaaccaggatcgcctgggcggcggacgcctggatggcagggcaaccagcaagggacaggtgttcagcctgtccgcgacctacgacttctag

SEQ ID NO: 23528 - protein, 463 aa, Pseudomonas aeruginosa PAO1
MPLLCALIVGGLFGTSQAQAGGFMVPTTNTAGWGRAMAGGSLFPNDPSAAFNNPAAMAFIDKRIAQLTVNYADIDIKYNGDAYDYQGNPMTGGYQDGPGTPELGTNDGGQAGFGAWLPTGFLVVPINDRFAFGLSQVVPMGMRSTWDPNWKGRDFAVDTKIETIGLTGSLSFKVNDNFSLGAGVIIQRTSGFVSQNLDLYASAANSPGMGGIPFPASNSSALMRVKVDNTSPGFFAGAVWKPTDRDTLGFAYHAKIRNKLKGHYNLYDHDGGLTEGAIEGGTPGLAYPGLDLRMGASASARLDIPAYASLDWVHQFNDRLSLGASATWTEWSSFQDLTLKSHGNTIVSIPYTYRNTWTLAVGGDYKVTDQWTMRAGVAYDQTPTHNATRDPRIPDGDRYFASLGAGYRFQSMPELSIDAAYSRQFVKEVPLKTVNQDRLGGGRLDGRATSKGQVFSLSATYDF

SEQ ID NO: 23529 - DNA, 1401 bp, Neisseria meningitidis MC58
  CDS (1)..(1401): transl_table=11
atgaccccttccgcactgaaaaaaaccgtcctgctgctcggcactgcctttgccgccgcatccgtccacgcatccggctaccacttcggcacacagtcggtcaacgcgcaaagcacggcaaatgccgccgccgcagaagccgccgacgcatcgaccatcttctacaaccctgccggcctgaccaaactcgacagcagccagatttccgtcaacgccaacatcgtgctgcccagcattcattatgaggcggattccgccaccgactttaccgggcttcccgtccaaggttcgaaaagcggcaaaatcaccaaaaccacggtcgcgccccacatctacggcgcatacaaagtcaacgacaatctgaccgtgggcttgggcgtgtacgtccccttcggctctgccaccgaatacgaaaaagattccgtgttgcgccacaacatcaacaaactcggtctgaccagcatcgccgtcgaacctgtcgccgcgtggaaactcaacgaccgccattccttcggcgcaggcatcatcgcccaacatacttccgccgaactgcgcaaatatgccgactgggggattaagagtaaagcagagatattgacggcaaaaccgcccaaacctaacggtgtagccgaagctgcaaaaattcaggccgacggacacgccgatgtcaaaggcagcgattggggcttcggctaccaactggcgtggatgtgggacatcaacgaccgtgcgcgcgtgggcgtgaactaccgttccaaagtctcgcacacgctcaaaggcgatgccgaatgggcggcagacggcgcggcggcgaaagcaatgtggagtacgatgcttgcagcaaacggctacacggcgaatgaaaaagcccgcgttaaaatcgttacgcctgagtctttgtccgtacacggtatgtacaaagtgtccgataaagccgacctgttcggcgacgtaacttggacgcgccacagccgcttcgataaggcggaactggtttttgaaaaagaaaaaaccgtcgtcaaaggcaaatccgaccgcaccaccatcacccccaactggcgcaacacctacaaagtcggcttcggcggttcttatcaaatcagcgaaccgctgcaactgcgcgccggcatcgcttttgacaaatcgcccgtccgcaacgccgactaccgcatgaacagcctacccgacggcaaccgcatctggttctccgccggtatgaaataccatatcggtaaaaaccacgtcgtcgatgccgcctacacccacatccacatcaacgacaccagctaccgcacggcgaaggcaagcggcaacgatgtggacagcaaaggcgcgtcttccgcacgtttcaaaaaccacgccgacatcatcggtctgcaatacacctacaaattcaaataa

SEQ ID NO: 23530 - protein, 466 aa, Neisseria meningitidis MC58
MTPSALKKTVLLLGTAFAAASVHASGYHFGTQSVNAQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAELVFEKEKTVVKGKSDRTTITPNWRNTYKVGFGGSYQISEPLQLRAGIAFDKSPVRNADYRMNSLPDGNRIWFSAGMKYHIGKNHVVDAAYTHIHINDTSYRTAKASGNDVDSKGASSARFKNHADIIGLQYTYKFK

SEQ ID NO: 23531 - DNA, 1344 bp, Xylella fastidiosa 9a5c
  CDS (1)..(1344): transl_table=11
atgattagacatgttttcaccttagtcaacgttactgcactaacgctaagcatcactggtgtgctctacatcggtaatgcgcacgctgctgctttccaattaaaggagaacagcgctaaagctctgggtcggtcattcgcaggcgcggcaagcgcccaagacgacgccgccatcattgtcaacaaccctgccggcatgcgccaactcgacggacgacaattccaggccgatctgagcacggtcagattttccgccgaatatcgtgggaatccaggaatttatcgcaatggcaacacaatcggtggcggcaatggtggtgatgccggcatggtggcactgctgcctgactcctatttccacatgcctttgggcgataacaacaacgtgcatttaggggcaacgctcaacgcaccattcggtttcagtacaaaatacgatcgcaactggacaggacgctatcacggcatctatagcaagttacaggcaatcgatctaggcatagccgtttcctatgacgttaacccgtacgtgtcgttcggcggtgcagtgtttgctgaacgcttgaacgtggacctgagtaatgcgatcgacttcgggagcattctaaatgcacgtcacgtaccaaacttctccccgggtagtgccgatggttactcacacatcgaaggtcacgataccagcaggggcttcacactggggggcttgttcagtcccgatgaaaagacccatcttggcttcagctaccggtctcaggttgaacacaacgtcaacaatggaaacgctcactttgctgtgcctgagaacgctgctgcagtgctggcagtggctgcaacggggacattcatcaatacaaaaatcaagtccacgatccgcctacctgccagcgcaacaaccagcttcactcatgccattgatgaccgatggtccataatggctgaagtcactcggactgcctggagcaagttcgacaaaatcaccattcatttcgcatcctctcagcccaacaacgcactgaatttttcctatcgagataccacttttgttgctctcgggaccgaatatcggttcagcgacatgctgacgctgcgtggtggcttgggttatgaccagacaccgaccaccgccgaataccgcagcgtacgggtgcccgacaacaaccgcacctggatctcactcggtatgacttggaaaccatcaaagcaaaccgattacaacatcgggtatgcacatctgtttatcggtcatccaactatcacgcaaatcaacgcaacagctagcaccttggtgggtgattacaacatcaataccgacttacttgcaatttcaatcaaccacaagttctaa

SEQ ID NO: 23532 - protein, 447 aa, Xylella fastidiosa 9a5c
MIRHVFTLVNVTALTLSITGVLYIGNAHAAAFQLKENSAKALGRSFAGAASAQDDAAIIVNNPAGMRQLDGRQFQADLSTVRFSAEYRGNPGIYRNGNTIGGGNGGDAGMVALLPDSYFHMPLGDNNNVHLGATLNAPFGFSTKYDRNWTGRYHGIYSKLQAIDLGIAVSYDVNPYVSFGGAVFAERLNVDLSNAIDFGSILNARHVPNFSPGSADGYSHIEGHDTSRGFTLGGLFSPDEKTHLGFSYRSQVEHNVNNGNAHFAVPENAAAVLAVAATGTFINTKIKSTIRLPASATTSFTHAIDDRWSIMAEVTRTAWSKFDKITIHFASSQPNNALNFSYRDTTFVALGTEYRFSDMLTLRGGLGYDQTPTTAEYRSVRVPDNNRTWISLGMTWKPSKQTDYNIGYAHLFIGHPTITQINATASTLVGDYNINTDLLAISINHKF

SEQ ID NO: 23533 - DNA, 1299 bp, Caulobacter crescentus CB15
  CDS (1)..(1299): transl_table=11
atgtctcttacgcgtacccgcctcgccgtcggcgtggctttcgtggcgctcgtcgccgcctcccaggcctccgcttcggccttctatctgcaggaacaatcggttcgcggcacgggccgcgcctattcgggcgaagtcgccgacaagggcgtcggcagcctgtggtggaacccggcgtcgatcgccggcatcgcccgcagcgaagcccacttcggcctgaaccagatcctggtgaactccgaggtcaccaacaccggctccagcatcacccgcccggtccccccggccggcctgaccactgcggtcggcggcgccgacgccgccttcgacccgatcaacaacggcatcgtgccgaacttcggcgccgcctggaagatcaacgacaagctctcgctgggcctgtcggtcgccgcgccctacaacttcaccaccgagtacaccgccaacagctggacccgctacgacgcgctgaagtcgcagctgcggaccgtcaatgtcgagggcgtggtcgcctatcgcgtcaatgacatgctggacctgggccttggcgtgacggcgatgtacgccgacgccgaactgaccaacgccctgcccaacatctcgccgctgcaagccgatggcctgcaatcgctgaagggtgacggcttcgcctatggctacagcgtcggcgcgcaactgcacccgtccaagagcctgacgatcggcgccagctatcgcagcaaactcgaccacaagctggacggcacggtgaaggtctcgggcctgctggctccgatccccgccgccagcaacttcacggtcgacggccaggccaagatcaccctgccctggatcgccaacctcggcgcgcgctgggcggtgaatgaccagtggaccctgaacggttcggtcagccgcgtgggctggagcgagttcgacgccatccgcgtcagcttcgccggcggcggctcgaccagcccccaggactataaggacgtcaccacctacgcggccggcgtcgactaccaggcctcgcctcgtctgacgctgcgggccggcgtccagtatgacccgaccccgaccccggagatcggccgcaccgcccgcgtgccggacggcgaccgcatgatgtacgccaccggcgcgacctgggctgcgaccgagaccctgcagctcgacgccgcgatcagctacatcgcgttcgacaagagccagatcaatcgcaccgacgtcaccgccaccagctcgaccgtccgcctgcgcggcgatgtcgagggttcggccgtcgtgctcgcggccggcgcgcgcttcagcttctaa

SEQ ID NO: 23534 - protein, 432 aa, Caulobacter crescentus CB15
MSLTRTRLAVGVAFVALVAASQASASAFYLQEQSVRGTGRAYSGEVADKGVGSLWWNPASIAGIARSEAHFGLNQILVNSEVTNTGSSITRPVPPAGLTTAVGGADAAFDPINNGIVPNFGAAWKINDKLSLGLSVAAPYNFTTEYTANSWTRYDALKSQLRTVNVEGVVAYRVNDMLDLGLGVTAMYADAELTNALPNISPLQADGLQSLKGDGFAYGYSVGAQLHPSKSLTIGASYRSKLDHKLDGTVKVSGLLAPIPAASNFTVDGQAKITLPWIANLGARWAVNDQWTLNGSVSRVGWSEFDAIRVSFAGGGSTSPQDYKDVTTYAAGVDYQASPRLTLRAGVQYDPTPTPEIGRTARVPDGDRMMYATGATWAATETLQLDAAISYIAFDKSQINRTDVTATSSTVRLRGDVEGSAVVLAAGARFSF

SEQ ID NO: 23535 - DNA, 1341 bp, Xanthomonas axonopodis pv. citri str. 306
  CDS (1)..(1341): transl_table=11
atgtctaccgcttccactctcagccgcgccaccctcttggccgtcggtatcgctggcgtgctggccgttggtcaggcgcacggcgccgcgttccagctgaaggaaaacagcgccaagggccttggccgcgcattcgcaggttcgggcagcgccccggatgatgcctccatcatcgccaccaacccggccggcatgcgccagctggacggccgcctgttccaggccgacgtcagcgccatcagcttctcggccaagttccagcccgacaccgcggcctacgccaacggcgcgccggtgtccggcggcaacggcggcgacgccggcatgatcgcgccggtcccggcgatgtacttccacgtgccgttcggcgagaacgacaacatgcacctgggcacctcgctgaccgtgccgttcggcttcaagaccgaatacgaccgcgactgggtcggccgctaccacggcaccaagaccgagctgcaggcgatcgacttcaacgtcgcgttctcctatgacgtgaacccgtacgtgtccttcggtgcctcggtgttcgccgagcgtctggatatcgacctggccaacgcggtggatttcggcagcgtgctggctgcgcgccgcgtgccgggcttcgcgccgggcagcgccgatggctactcgcgcatcaagggcgacagcaccgaagtgggcttcaccctgggcggcttgttcagcatcgatgagaacacccacatcggcttcagctaccgctcgcaggtggaacacaagatcaccgacggcaccgccgacttcaccgtgccgggcagtgctgccgccgtgctgagcgtggccgcaccgggtaccttcgtggataccaagggccgcgccaccgtcaagctgccggccagcgccaccgccagcttcacgcataacgtgaacgagcagtggtcgatcatggccgacgtcacccgcaccgcctggagcaagttcgaccaggtgaccgtggacttcgcttccaaccagcccgacagcgtgctggacttctcctaccgcgacaccaccttcgcctcgatcggtgccgactaccgcctgagcgatacggtgaccctgcgcggcggcctggcgtacgaccaaaccccgaccacggccgaacaccgcgacgtgcgcgtgccggacgcgagccgcaagtgggtttcgctgggtatgagctggcgtccgtcggcgcagaccgagtacaacttcggctacacccacctgttcaccagcgacccgaccagcgacacccgcagcgccacgggcgaccgtcttgccggcagctacgacgtgaagggcgacgtgctggccgcgtcgatcaactacaagttctga

SEQ ID NO: 23536 - protein, 446 aa, Xanthomonas axonopodis pv. citri str. 306
MSTASTLSRATLLAVGIAGVLAVGQAHGAAFQLKENSAKGLGRAFAGSGSAPDDASIIATNPAGMRQLDGRLFQADVSAISFSAKFQPDTAAYANGAPVSGGNGGDAGMIAPVPAMYFHVPFGENDNMHLGTSLTVPFGFKTEYDRDWVGRYHGTKTELQAIDFNVAFSYDVNPYVSFGASVFAERLDIDLANAVDFGSVLAARRVPGFAPGSADGYSRIKGDSTEVGFTLGGLFSIDENTHIGFSYRSQVEHKITDGTADFTVPGSAAAVLSVAAPGTFVDTKGRATVKLPASATASFTHNVNEQWSIMADVTRTAWSKFDQVTVDFASNQPDSVLDFSYRDTTFASIGADYRLSDTVTLRGGLAYDQTPTTAEHRDVRVPDASRKWVSLGMSWRPSAQTEYNFGYTHLFTSDPTSDTRSATGDRLAGSYDVKGDVLAASINYKF

SEQ ID NO: 23537 - DNA, 1272 bp, Yersinia pestis KIM
  CDS (1)..(1272): transl_table=11
ttggtcatgaaccagaaaaacctgtttacccgctcagctctggcagcagctatcgctcttatttcatcgaacgtttctgcagccggttttcagttgaatgaatattcagccgccgctctagggcgtgctttctctggtgaaggcgcagtggctgataatgcttccgttggtagccgcaatcctgcagcaatgactttattcgaccgcccttctttctccggtggtgtgatttatattgatccaagtgttgatatcacggggacgtcgccaagtggcaaaagtacggatgccagtaacattgcgccatcagcgtgggttccgaatctccactttattatgccattggatgaacagtgggcaatcggtgcttctgcgacctctaactacggtttagccactgaatttaatgatgattatgtggcaggcatgttaggcggccaaaccgatctgaaaacggctaacctcaacctaagtgccgcgtaccgcctgaatgataacttcagttttggcctggggtttgatgcagtctatgctgatgcgaaaattgtgcgccatctcggtgaagctggcgggggtctattgcctgctaacactgaagccgccaggttggaaggtaccaaatggggttacggctggaatacgggtattttgtatgaaatcgataaagaaaaccgctacagcttcacttatcgttctgaagtcaatatcgattttgacggtgattacagtaaccaactacctgttattttcggtggtctgggtggaaaaacggtccctggttccctaactctgaacctgcccgccgtgtgggaagtctccggctacaataaagtcgcgccacaatgggccattcactacagcatggcttacaccacctggagcagtttcaaggagttaaaagcaaccgcgtctaatggcgatgtgctgtttgataaacatgaaggcttcagagatgcctaccgtattgcgttagggaccacctattactacgatgataactggacattccgcaccggtattgcctttgatgatagcccgatccccgcaggaaaccgttcaatttccatcccggaccaagatcgtttctggctcagtgcaggtaccacctacgccttcaacaaaaatgcctctgttgatgtcggtattgcttatatgaaaagccagaatgtcagtattaccgaaaagaccccggccccatctaacaccacatatgagttcaactcgaaaggttccgcgatgctatacggtgtgaacttcaactacacattctaa

SEQ ID NO: 23538 - protein, 423 aa, Yersinia pestis KIM
MVMNQKNLFTRSALAAAIALISSNVSAAGFQLNEYSAAALGRAFSGEGAVADNASVGSRNPAAMTLFDRPSFSGGVIYIDPSVDITGTSPSGKSTDASNIAPSAWVPNLHFIMPLDEQWAIGASATSNYGLATEFNDDYVAGMLGGQTDLKTANLNLSAAYRLNDNFSFGLGFDAVYADAKIVRHLGEAGGGLLPANTEAARLEGTKWGYGWNTGILYEIDKENRYSFTYRSEVNIDFDGDYSNQLPVIFGGLGGKTVPGSLTLNLPAVWEVSGYNKVAPQWAIHYSMAYTTWSSFKELKATASNGDVLFDKHEGFRDAYRIALGTTYYYDDNWTFRTGIAFDDSPIPAGNRSISIPDQDRFWLSAGTTYAFNKNASVDVGIAYMKSQNVSITEKTPAPSNTTYEFNSKGSAMLYGVNFNYTF

SEQ ID NO: 23539 - DNA, 1227 bp, Vibrio vulnificus CMCP6
  CDS (1)..(1227): transl_table=11
atgactcagaacatgcgtctgtttaaaaagtctctcctagcagtgactgttgcattggcttcaggccaaacaatggcagcaggtttccaacttaatgcacaatctgcaacaggtatcggccgcgcattcgccggtgatgcagtcattgcagataacgccgccgttatggcacgtaacccagccgctatggcgctttttgatgaaaaagccctatcgcttggttttgaaagcatcacttcaatgattgaagtgaaggatgcaaggtaccaaggcttaacagctccagcgggtaaagaatcgaactatgatgacgctggtgatacttctattgcgccaaatattcactttatcatgccagtaaacgataagtttgcttggggtgttaatgcttattcaaactttggtactaaaactgagtttgatgacagtttcgttgcgcgtgaatacggcggcttgacggatgtgaaaagcgccaactttggcttagcaggttcatatcgccttaacgagcaatggagcttcggtgctggtttagacatcatctacggccaaggcacaatgaaacgtgaacatgctctaatcggcactttagtcgacgtagacaaagcagacggctgggctgttggtttcaatgtgggtactgtatttgaactagatgaaaacaaccgttttggtttctcttaccgctacagcccagaaatggaagcggaagatgacaaaggccaaaagatcactctaccactaccagatatggcggagttttcgggttaccacaaaattaccgacaccaagtttgcggttcactactctatccaatacattggctggggcacgtttgataaaattgagttccgtaacttaaaagacaattcaccagcaatcggtgcaagctacgacaaagcttatgaatggcaagatggttggcactacgctattggtggtacttactacctaaacaaagactggacgctacgtgcgggttatatgtatgacactagtgcacaagattcactaacatcagtttcagtgcctgactcagatcgtcaatggctatctactggttttacttaccacattgatactaagtctaacattgactttggttttacctacctgatgggtgacgatgttaaggttaatgaatctactgctggcgtgtcatcactaacggctacaactcacgcagacgctatcttgttcggcttacaatatagccgtactttctaa

SEQ ID NO: 23540 - protein, 408 aa, Vibrio vulnificus CMCP6
MTQNMRLFKKSLLAVTVALASGQTMAAGFQLNAQSATGIGRAFAGDAVIADNAAVMARNPAAMALFDEKALSLGFESITSMIEVKDARYQGLTAPAGKESNYDDAGDTSIAPNIHFIMPVNDKFAWGVNAYSNFGTKTEFDDSFVAREYGGLTDVKSANFGLAGSYRLNEQWSFGAGLDIIYGQGTMKREHALIGTLVDVDKADGWAVGFNVGTVFELDENNRFGFSYRYSPEMEAEDDKGQKITLPLPDMAEFSGYHKITDTKFAVHYSIQYIGWGTFDKIEFRNLKDNSPAIGASYDKAYEWQDGWHYAIGGTYYLNKDWTLRAGYMYDTSAQDSLTSVSVPDSDRQWLSTGFTYHIDTKSNIDFGFTYLMGDDVKVNESTAGVSSLTATTHADAILFGLQYSRTF

SEQ ID NO: 23541 - DNA, 1248 bp, Vibrio vulnificus CMCP6
  CDS (1)..(1248): transl_table=11
atgaacaagaagaactgctctctgctgacgatatcgatattgtttgcctgccatgctaatgccgctggttttcaagttgcggaacattcagcgtctggtcttggtcgagcgttttccggtgaaggggctgttgctgacaacgcttcggtattggcgagaaacccagctgcgatgacactatttgaaaacgcacagttttctggtgccctgtctatcgtagatccagaggtcaatgtttacgacaaaacgaatggcgaacaatctgatgacgttgcgcctttgcaacttgttccagcagcctattacatcagccctattaatgagaagtgggcatggggtattggtatgtttaccaactacggtgtggcgactgactacccagacgacatttcagctggcgacatggctggtgatacggcgttagtttcagtggggatcaaccccaatatcgcctatcgcgttaacgaagcgttgagcgtgggtgcgggtgtgaattttgtttatgcgcacgcagagttgactcgtcacaagggttctctcgcacctctgtttggatcgaccgataaatcagaaaacttgatcggtatgactggcacgacctttggttacggctggaacgttggcgcactatacgaactcagtgaaaagacgcgctttggtttgggttatcgttccaaagtcgatctggatttcgatgatggtgaattcagcagctacgactcaggcatcgccacagcccctaaagtcgatggccgtttacagatcagcctaccttccatcattgaagtctcggcataccatgaatttaacgaacaatgggcgatgcacgccggttggcaacaaaccgaatggagcacattcaccgagctaaaggcaacgtctccacagtgtaacgatggtaccgctggtcaatgcttctataaaccagagcattacgaaaacaacaatcgttattcacttggtgcaacctatcaaatgaacgaaagctggactcttcgcgcaggcttagcatttgatgaacaagccggtgaagcaaccctcagcattcctgacagcgaccgtttctggtacagcgcaggcttaacttacttgatgagcgacaacatgacgatcgacgcgggctttgcactggttaagagccgttctggttcattcaaagaaaccaacgcagcagatgaagtgcttgaattcgaagcagaaggcacggcttacatcagcgcgattcaaatgaactacacctttaagtaa

SEQ ID NO: 23542 - protein, 415 aa, Vibrio vulnificus CMCP6
MNKKNCSLLTISILFACHANAAGFQVAEHSASGLGRAFSGEGAVADNASVLARNPAAMTLFENAQFSGALSIVDPEVNVYDKTNGEQSDDVAPLQLVPAAYYISPINEKWAWGIGMFTNYGVATDYPDDISAGDMAGDTALVSVGINPNIAYRVNEALSVGAGVNFVYAHAELTRHKGSLAPLFGSTDKSENLIGMTGTTFGYGWNVGALYELSEKTRFGLGYRSKVDLDFDDGEFSSYDSGIATAPKVDGRLQISLPSIIEVSAYHEFNEQWAMHAGWQQTEWSTFTELKATSPQCNDGTAGQCFYKPEHYENNNRYSLGATYQMNESWTLRAGLAFDEQAGEATLSIPDSDRFWYSAGLTYLMSDNMTIDAGFALVKSRSGSFKETNAADEVLEFEAEGTAYISAIQMNYTFK

SEQ ID NO: 23543 - DNA, 1224 bp, Vibrio vulnificus CMCP6
  CDS (1)..(1224): transl_table=11
atgccctcgtttgcgtctttgaacaccttttgtctttcttctttgagcctcaaacgaacactattcagcctctctctgttggcctccgctcacgccagtgccagtggtatttttctgcaagaggccgtgattgctaacgcaggaacggtgggagcgggcgatggtgtgtatacacaatcggcggcggcaatgtgggcaaacccagcgacaatgccgtggatgggtgagacgttgacgacagtgaatgccacggcgtttgacttgaaaatggactatcacgatcaatcgggtgtgggccatgggcaagctgcgtctttgatgccttctgttggcctgtttcatgttcgtcaactcaatgaagacgtgcactttggcattgcgttgggtacggtgggcggttccagcctagattacggttctgagtggcaaggtgccgcactgatgaccgacattgcgttggcggcagtgcaaatcaacccggctctgggttttagagtaactgaccagctttcttgggggatcggtgcacaaatcagctgggcttctctggaaatgggcatggcgaatgcgcgacggcttgagcagtcttctgattgggcgtatggctttaatgctggcgtgatgtatcagtttgatgagcaatgggatctgggtgtaagttttcgctccaaagtgaatcatgagttttcaacggagcttagtggtgggcaacgtgcgcttcctgtaggcacggatctggttgtacccgcgattgtggatgtgagtagcagctacgcagtgaatccgaagctcaagttacttgcttctatccaattacaccgctggagtgaatgggatacgacggtgtttgattttggccgtttagattcaaatcctctcggtctgaattcgatagatcgtcagtgggaggatgtgtggaaatttgccgttgcgacggattaccaactcaatgcggattggcgcttaaaagcaggcttctcgtacgaaacgtcgccacaagatgaccctagcaagcaatgggtggatctgcccgttggtcagcaatatcgttactctgttggcgccacgacgcagtgggacagctatgtccttgatgtttactatgagtatgccgacttaggggaagtggacatcgcgacgcggaaaatagcgaatcaggatgtgggcattaatggcacgtttgaagggcgtatccactttgttggtctgagcgtcagcttttaa

SEQ ID NO: 23544 - protein, 407 aa, Vibrio vulnificus CMCP6
MPSFASLNTFCLSSLSLKRTLFSLSLLASAHASASGIFLQEAVIANAGTVGAGDGVYTQSAAAMWANPATMPWMGETLTTVNATAFDLKMDYHDQSGVGHGQAASLMPSVGLFHVRQLNEDVHFGIALGTVGGSSLDYGSEWQGAALMTDIALAAVQINPALGFRVTDQLSWGIGAQISWASLEMGMANARRLEQSSDWAYGFNAGVMYQFDEQWDLGVSFRSKVNHEFSTELSGGQRALPVGTDLVVPAIVDVSSSYAVNPKLKLLASIQLHRWSEWDTTVFDFGRLDSNPLGLNSIDRQWEDVWKFAVATDYQLNADWRLKAGFSYETSPQDDPSKQWVDLPVGQQYRYSVGATTQWDSYVLDVYYEYADLGEVDIATRKIANQDVGINGTFEGRIHFVGLSVSF

SEQ ID NO: 23545 - DNA, 1344 bp, Xylella fastidiosa Temecula1
  CDS (1)..(1344): transl_table=11
atgattagacgtgttttcaccttagtcaacgttactacactaacgctaagcatcactggtgtgctctacatcagtaatgcgcacgctgctgctttccaattaaaggagaacagcgctaaagctctgggtcggtcattcgcaggcgcggcaagcgcccaagacgacgccgccatcattgtcaacaaccctgccggcatgcgccaactcgacggacgacaattccaggccgatctgagcacggtcagattttccgccgaatatcgtgggaatccaggaatttatcgcaatggcaacccaatcggtggcggcaatggtggggatgccggcatggtggcactgctgcctgactcctatttccacatgccttttggcgataacaacaacgtgcatttaggggcaactctcaacgcaccattcggtttcagtacaaaatacgatcgcaactggacaggacgctatcacggcatctatagcaagttacaggcaatcgatctaggcatagccgtttcctatgacgttaacccgtacgtgtcgttcggcggtgcagtgtttgctgaacgcttgaacgtgaacctgagtaatgcgatcgacttcgggagcattctaaatgcgcgtcgcgtaccaagcttctccccgggtagtgccgatggttactcacacatcgaaggtcacgataccagcatgggcttcacactgggggggttgttcagtcccgatgaaaagacccatattggcttcagctaccgatctgaggttaaacacaacgcaaacaatggaaatgctcactttactgtacctgagaacgctgctgcagtgctggcggttgctgcaccgggaacattcatcaatacaaaaattaagtccacgatccgcttacctgccagcgcaacaaccagcttcactcatgccattgatgaccgatggtccataatggctgaagtcactcggactgcctggagcaagttagacaaaatcaccattcatttcgcatcctctcagcccaaaaacgtactgaatttttcctatcgagataccacttttgttgctctcgggaccgaatatcggttcaacgacatgctaacgctgcgtggtggcttggcttatgaccagacgccgaccaccgccgaatatcgcagcgtacgggtgccagacaacagccgcacctggatctcattcggtatgacttggaaaccatcaaagcaaaccgattacaacatcggatatgcacatttgtttatcggtcatccgactatcacacaaatcagcgcaacaggtagcaccttagccggtgcttacaacatcaatgccgacttacttgcaacttcgatcaactacaagttctga

SEQ ID NO: 23546 - protein, 447 aa, Xylella fastidiosa Temecula1
MIRRVFTLVNVTTLTLSITGVLYISNAHAAAFQLKENSAKALGRSFAGAASAQDDAAIIVNNPAGMRQLDGRQFQADLSTVRFSAEYRGNPGIYRNGNPIGGGNGGDAGMVALLPDSYFHMPFGDNNNVHLGATLNAPFGFSTKYDRNWTGRYHGIYSKLQAIDLGIAVSYDVNPYVSFGGAVFAERLNVNLSNAIDFGSILNARRVPSFSPGSADGYSHIEGHDTSMGFTLGGLFSPDEKTHIGFSYRSEVKHNANNGNAHFTVPENAAAVLAVAAPGTFINTKIKSTIRLPASATTSFTHAIDDRWSIMAEVTRTAWSKLDKITIHFASSQPKNVLNFSYRDTTFVALGTEYRFNDMLTLRGGLAYDQTPTTAEYRSVRVPDNSRTWISFGMTWKPSKQTDYNIGYAHLFIGHPTITQISATGSTLAGAYNINADLLATSINYKF

SEQ ID NO: 23547 - DNA, 1269 bp, Pseudomonas syringae pv. tomato str. DC3000
  CDS (1)..(1269): transl_table=11
atgctcaagagaacacttggcctcacggctgcgctggcatcctcccaaattcttgctggcggttttgcgcgcaccgagcagagcatcagcggcatgggcgtcggtcaggccggacgcgcttcaatggcgcaggacgccagcacggtctatggcaacccggcgggtatggcgcgtcttgagggcaggcaaatcacggcaggtgtcacgttcgttgatgcatcgaccgacatcagccatgcagccggtcgttcacgaggcagcaatgacggcgacatggtgccgttcagctcggttccattcgggttttacacccagaaactcgatgagcactgggcgtttggcctgggtatctatgcaccttttggtttgtcgactgactatgaaaatggctttcaggggcgcatgtttgccagcaagagcgacctcaaggtggtgacagtgcagcccacggtcagctacgccttcaacgacaggttgtcgattggcgcaggccccacgttcaatcgaattgccgggacgctggagtcggatatcacgctcaatcccgccatcgccgacacgcgcgtaaaagtcagcggtgatgacacggcggtaggcttcaacatcggcgtgctgttcaatgcgaccgacaccacgcgtgtggggctgacgtaccattccaaagtcgattacaaacttggctgccatacgcaggtctcgaccggtgccgggacgccaccgcagttgctcgccagcaatcgctatgactgtacgttgaaagtggccacgccagagtcatacgatctttccgttactcagaaactgagtgacgcctggacgctttatgccagtgctacccgaaccggctggagcagcatgcaggacctgagccttcgtaatcagcccgtttctgctgcgcagggaggctccctggcatcagcactgacggggtctattcaggaaggcctgaactggcacgacacatgggcttatgccatcggcacggcctaccggctggatcaacagtgggtactgcgtgcaggcgtgctgttcgatcagtcgccgaccagcaacactgatcgatcaccacgcacacccacaggggatcgcgaggtattcagcgtcggggctggctatgaggtcaccccgcaactgactcttgatgtggcttactcttatcttcaggaagaaagtgtcgatgtcagccgcgccaatgcgctaggcagttacagtgcgacgtatcagagccatgcgaatttactcggcgttggcgcgacctatcgtttctga

SEQ ID NO: 23548 - protein, 422 aa, Pseudomonas syringae pv. tomato str. DC3000
MLKRTLGLTAALASSQILAGGFARTEQSISGMGVGQAGRASMAQDASTVYGNPAGMARLEGRQITAGVTFVDASTDISHAAGRSRGSNDGDMVPFSSVPFGFYTQKLDEHWAFGLGIYAPFGLSTDYENGFQGRMFASKSDLKVVTVQPTVSYAFNDRLSIGAGPTFNRIAGTLESDITLNPAIADTRVKVSGDDTAVGFNIGVLFNATDTTRVGLTYHSKVDYKLGCHTQVSTGAGTPPQLLASNRYDCTLKVATPESYDLSVTQKLSDAWTLYASATRTGWSSMQDLSLRNQPVSAAQGGSLASALTGSIQEGLNWHDTWAYAIGTAYRLDQQWVLRAGVLFDQSPTSNTDRSPRTPTGDREVFSVGAGYEVTPQLTLDVAYSYLQEESVDVSRANALGSYSATYQSHANLLGVGATYRF

SEQ ID NO: 23549 - DNA, 1275 bp, Pseudomonas syringae pv. tomato str. DC3000
  CDS (1)..(1275): transl_table=11
atgaaaataatgacaaaagcacttaaccggacaactcttggactcgccctgggtctggcttcttctcaactgctcgctgccggcttcgccctcaacgaacaaagcatcagcggcatgggcaccggctttgcaggtcgctcctcctccgccgacgatgccagcaccgtgttcggcaaccctgccggcatgtcgcgtatcaaacgcgaacaaatcagcgtaggcgccgcagccgtgatcgccaagaccgacatcgacaatggtcgtggcacgttcggcggcagcaacgacggtgacatggttcccgtggttggtgtgccaatgggctactacgtcaaacctatcgatgatcactgggcatttggtctgggcgtgtacgttccgttcggcctggtcactgattacgagaaaggctttgccggccgttactggggtgacaagagccacgtacagatcgtgacctttcagccgaccgtcagctacgcattcaatgacaaggtttctatcggttttggcccgaccatcaaccgtatcgacggtgaattgacatcggctgtccctaaccgagcgtccctcggcaccaacgatggcaaggtgaagatcaagggcgatgacactgcaatcggcttcaatgccggtattctggtgcaggctactgacaccacgcgcctgggtctgacttaccattccaaagtcgattacaagctcgaaggcaagaccaaggtagaaggctctggttttggtcctttcggcggtcagaagtatgacgcctcgctggatatctccacgcctgagtcggtggacttctccatcactcagcagcttgatgaaaactggaccgtttatgcaggcagcacctggactcgctggagccgcctgaaagacatcacggtcgaaaacagcggcgtgcccacagcattggcctcaagcattggcaccattacggaagaacaggactggcacgacacttgggcacacgccatcggtgcttcgtacaaggtcaataaggagtggacgctgcgcactggtttctctgttgatcagtcgccgaccaacaacgttaatcgatcccctcgcatcccgactggcgatcgcaagatcatcagcttcggtgctggctggagcccgaccgacgacctgaccattgacgtggcgtactcgtacctgcgtgaagatgaaaccaagatccgcgacagcagcgcgaccaaaggctcgtacagcgccgattaccgcaatacggcgcatggccttggcacttcagttacctatcgtttctga

SEQ ID NO: 23550 - protein, 424 aa, Pseudomonas syringae pv. tomato str. DC3000
MKIMTKALNRTTLGLALGLASSQLLAAGFALNEQSISGMGTGFAGRSSSADDASTVFGNPAGMSRIKREQISVGAAAVIAKTDIDNGRGTFGGSNDGDMVPVVGVPMGYYVKPIDDHWAFGLGVYVPFGLVTDYEKGFAGRYWGDKSHVQIVTFQPTVSYAFNDKVSIGFGPTINRIDGELTSAVPNRASLGTNDGKVKIKGDDTAIGFNAGILVQATDTTRLGLTYHSKVDYKLEGKTKVEGSGFGPFGGQKYDASLDISTPESVDFSITQQLDENWTVYAGSTWTRWSRLKDITVENSGVPTALASSIGTITEEQDWHDTWAHAIGASYKVNKEWTLRTGFSVDQSPTNNVNRSPRIPTGDRKIISFGAGWSPTDDLTIDVAYSYLREDETKIRDSSATKGSYSADYRNTAHGLGTSVTYRF

SEQ ID NO: 23551 - DNA, 1251 bp, Vibrio parahaemolyticus RIMD 2210633
  CDS (1)..(1251): transl_table=11
atgactcagaatacgcgtctgtttaaaaagactctcctagcagtaacggtagcttttgcctcaggtcaatcgatggcagcaggtttccaaattaacgctcaatcagcaactggtatcggccgtgcgtttgctggtgatgcagtaatcgccgataacgcgtcagtaatggctcgtaacccagcggcaatggctctttttgataaaatggagctgtcacttggttttgaaagcattacttcaatgattgaagtgaaagatgcgaaatacagaaatttcatgggtcagagcgttgatgttgctgacacagatgatgtgggcgacacgtcaatcgcgccaaacattcacctaatcgttccagtaaacgacaagtttgcttggggcgtaaatgcttactcaaacttcggtactaaaactgagttttcagataactacacagcaactgaatacggcggcttaactgacgttaagagcgcaaactttggtcttgctggctcttaccgcttaaatgaacaatggagctttggtgcaggtgttgatttaatctacggtcaaggcacgatgaaacgtacaacaagctcttctattccacttgttggcggcaaaaaaatactagatgtagataaagctgatggttgggctgttggtttcaacgttggtaccgtgtacgaactggatgaaaacaaccgttttggtctagcgtatcgttatagcccagaatttacggcaaaagacgataaaggtcaggaaatcactctacctctaccagatatggctgaattttctggcttccacaaaatccaagataccaagtttgccgtacattacagcatccaatacattggttggaaagatttcgaccaaattgattttgaaaacctaaatcaagggttacttaaaggtggttactcgaaagactatcaatggcaagatggctggcactacgcaattggtggtacttactacctaaacaataactggacacttcgtgctggttacatgtacgacaccagcgctcaagataaggtaacatctatctcggtaccagattcagatcgtcagtggttctcaacaggtttctcttaccatatcgacaacagctcaaacattgattttggcttcacatacttgctaggtgacgatgtaaaagtcaatgagaatactcaattggcccctggtctttctacaggtgtaacagctacaacgcacgcagacgctatcctgtttggcttacaatacagccgtagcttctaa

SEQ ID NO: 23552 - protein, 416 aa, Vibrio parahaemolyticus RIMD 2210633
MTQNTRLFKKTLLAVTVAFASGQSMAAGFQINAQSATGIGRAFAGDAVIADNASVMARNPAAMALFDKMELSLGFESITSMIEVKDAKYRNFMGQSVDVADTDDVGDTSIAPNIHLIVPVNDKFAWGVNAYSNFGTKTEFSDNYTATEYGGLTDVKSANFGLAGSYRLNEQWSFGAGVDLIYGQGTMKRTTSSSIPLVGGKKILDVDKADGWAVGFNVGTVYELDENNRFGLAYRYSPEFTAKDDKGQEITLPLPDMAEFSGFHKIQDTKFAVHYSIQYIGWKDFDQIDFENLNQGLLKGGYSKDYQWQDGWHYAIGGTYYLNNNWTLRAGYMYDTSAQDKVTSISVPDSDRQWFSTGFSYHIDNSSNIDFGFTYLLGDDVKVNENTQLAPGLSTGVTATTHADAILFGLQYSRSF

SEQ ID NO: 23553 - DNA, 1320 bp, Vibrio parahaemolyticus RIMD 2210633
  CDS (1)..(1320): transl_table=11
atgaaaaccaacaagactttcctatcaacagcagtagcacttagcctacttggcacttcaggcatggcaaatgcagcaggcttccaattagctgaatattctgcaacaggtctaggtcgtgcttacgctggtgaagcagcaatggctgacaacgcaagttctcaatggcgtaacccagcaatgcttacttacctagagggcactcaagtgtctgttggtgccatctatgtaaatccaaacattgatatcaatggtcaaaccacacttaagcatccagtaaatcagagtgtaattaactcctcttcaacctcttcagatgacttcgcacatgatgcgatcattccaaacttctacctatcacatcaatacaacgaacaattcgcaatcggcctagcgttcggtacgaactacggtatggaaacggatctaggcaaaggctttgccgcctctcattttggtaacgaagcaagcgtaaccacaatggaagcaaacctaaacgcagcatacaaaattaatgatgcggtaagtattggtggtggtattcgttacatcatcggtgaaggaagttttggcgctacgactcctaaagtaaacgtattacaaaaacctcaaggtacgactcttaagtacatggaaggtgacgatacggcttggggttggcaattgggtacagcgtggcagatcaatgaaaacaaccgcatcggtttcacgtacaaatctgaggttgagctaaagcttgaaggtcatgctgagggccttggttttggcttcggtactcctaagcttccacagctgcgtgacaatggctacatgtacctaaacctaccagcaacggctgaactagcgagcttccaccaagtaacagaccaacttgcgctacacgcaagtttcaactggactgactggagttctttcgagaagctagaagctcacctagaaaccgctggtacacacatggtgaaagtggaaaactgggaagataactaccgctttgcagttggtgcgacttaccaacttcaacctaaggtagccctacgtactggtattgcatacgatacgtctgctgtaagtgataagaaccgcacgatcactattccagaaacagaccgtacttggttaagcatcggtgcaacttatgactggacgaaagacttcagcctagacgctggcttcacttacattatcgcgaaagacgcaccaatcgttgagtctcgtggctacaagtcagacgattcagctgaagtagttggcggtcaattcgttggtgaaacaacgggtaacgtttggctaatcggtgttcaagcgaactaccgtttctaa

SEQ ID NO: 23554 - protein, 439 aa, Vibrio parahaemolyticus RIMD 2210633
MKTNKTFLSTAVALSLLGTSGMANAAGFQLAEYSATGLGRAYAGEAAMADNASSQWRNPAMLTYLEGTQVSVGAIYVNPNIDINGQTTLKHPVNQSVINSSSTSSDDFAHDAIIPNFYLSHQYNEQFAIGLAFGTNYGMETDLGKGFAASHFGNEASVTTMEANLNAAYKINDAVSIGGGIRYIIGEGSFGATTPKVNVLQKPQGTTLKYMEGDDTAWGWQLGTAWQINENNRIGFTYKSEVELKLEGHAEGLGFGFGTPKLPQLRDNGYMYLNLPATAELASFHQVTDQLALHASFNWTDWSSFEKLEAHLETAGTHMVKVENWEDNYRFAVGATYQLQPKVALRTGIAYDTSAVSDKNRTITIPETDRTWLSIGATYDWTKDFSLDAGFTYIIAKDAPIVESRGYKSDDSAEVVGGQFVGETTGNVWLIGVQANYRF

SEQ ID NO: 23555 - DNA, 1362 bp, Vibrio parahaemolyticus RIMD 2210633
  CDS (1)..(1362): transl_table=11
atgagaaaaaacatgcagcgacaattcactctttcaccgatttatttattaatcggtttagcctcatcgacggcgtatgccggtggttttcaaattaacgaacattcggcgacgggtcttggtcgtgcttttgctggtgatgccgtcattggtgataatgcgtctgtagtcagccgcaacgccgcagcgatgacgctgtttaaacaaaatgccttatcgttcggtgtcacttacgtcaaacctgacgttaccgttaaaaatgcacaatatcatcgagctaatattaatgcggatgtcgatgttagcatgggaggtggattgatacccaaccttcaaccaccaagtgtaagtgttaccccatcagagaccgtggccgacattgatgacgtcgatggcgttggtcaaccagccgttgtacccaatttttactttattcaccctatcaacgacgactggtatctaggcttatcgacatactccaacttcggaaccgacatggagtttaaaccaaactatggcgcacctgtttttggcggtgtcaccagcgtagcgagtgtcaaccttggcgcaagcttggcatacaaggtgaacgatcgttttagtatcggtggtggtattgatgtgatttacggctctggtgagctgtaccgcgatatggacgtgggtgtttgcgttggtgggaacatacttggaaacgaactagaacaacgttgcggagccgtaaaaggcaacgcacttgatgtggaagctggcggcattgggcttggtgcgaatattggcatgatgtacgagtttaacgagcgtcatcgcttaggtttaagctacaagcacagccctaacattgatgccaagggtgacatccactttgctggcgaatcgtacgactcacttgcgatgccgctaccggatattgcggagttttccggttatcaccgcgtcttacctaaatttgccctgcactattctgtgcagtggattggttggtcagcatttgacagcttgaaagctgatgatcagttgctaaaagattttcagtggcaagactccgcgcactactccatcggtgcgacttggtacgccaatgaacgttggacacttcgcacgggttacatgttcgacaaaacacctgtcgatgagctgacttcgctttctatcccagattcgaaccgtcactggttatctgcgggggcctcttaccagtggtcatcagataccacggttgacatcggcatgacgtacttgattggtgaagatgtcaacgtagaagagtacgcgtatgaaggtgttcctgcaccgatggtaacgggcgtgacccattcaaatgcgttcctaattggtgcccaactcagccaccgtttctaa

SEQ ID NO: 23556 - protein, 453 aa, Vibrio parahaemolyticus RIMD 2210633
MRKNMQRQFTLSPIYLLIGLASSTAYAGGFQINEHSATGLGRAFAGDAVIGDNASVVSRNAAAMTLFKQNALSFGVTYVKPDVTVKNAQYHRANINADVDVSMGGGLIPNLQPPSVSVTPSETVADIDDVDGVGQPAVVPNFYFIHPINDDWYLGLSTYSNFGTDMEFKPNYGAPVFGGVTSVASVNLGASLAYKVNDRFSIGGGIDVIYGSGELYRDMDVGVCVGGNILGNELEQRCGAVKGNALDVEAGGIGLGANIGMMYEFNERHRLGLSYKHSPNIDAKGDIHFAGESYDSLAMPLPDIAEFSGYHRVLPKFALHYSVQWIGWSAFDSLKADDQLLKDFQWQDSAHYSIGATWYANERWTLRTGYMFDKTPVDELTSLSIPDSNRHWLSAGASYQWSSDTTVDIGMTYLIGEDVNVEEYAYEGVPAPMVTGVTHSNAFLIGAQLSHRF

SEQ ID NO: 23557 - DNA, 1104 bp, Vibrio parahaemolyticus RIMD 2210633
  CDS (1)..(1104): transl_table=11
atgaaaaatctttcaaaaatcgtcgtagcgagctctctactgacgtgtgctgctgcgcaagcgggtgggttatacctttacgaaactacagcatcggatattggtttggcatccgctggtatggcggctcgtgcgcaagatgcctcagtaatggcagcaaacccggctggtctggcgaatgtttctggtaaatctttctctggtaacctgattggcctttacggtgacgcgcaactagacacgatgactggcgatgcgggcaacgtgattggttttgttcctatggcgtcggcattttacagccaacaagtaaacgacaaatggacgctgggtattggtctgtatggcaactacggtcttggcctcgagtacgaaggtcttttgaataatcatttagatattcctacagcaacgacgcaagccttaaccattcaaccttccgcttcttaccgcatcaatgatcactggtctgtgggtgcggcgcttggcattcagtacggtatgtatgaagtggaaacgaagggagccttgaacttcaatgacgaagaccaagatactcagctcaacggccgagtaggtgtactgtatgaggcaacaccaggcacgcgtcttggcctgtcttactcttctgaaaccgaatttgaattcgacaatagtaactccattgctccgcaacaactgatcttcagtgcttaccatgaagtgaatgatgacctagcggtgatgtggaacgtgaactggcaagactggagcgaatacacaaccacgcttaaggctgcagatttggtcgatgtagagacacaagacacttaccaaatcgcattgggtactcagtacaaactgaatgaaaaaatgatgtggaatgcaggttttgcattcgataccagcatgtatgaaagccaatcaaacggtgacattaccgttcctactggcaaggcgtaccgcattggtacaggcattgattacaaattggattcagaaaactcaattggtttcgcgtttgaagcggtcttgatggaatcgtcagaaacgccacgcttacaagctggctttgatgagcctgctctgtacttcatgagcatgagctacaattggaaaaactaa

SEQ ID NO: 23558 - protein, 367 aa, Vibrio parahaemolyticus RIMD 2210633
MKNLSKIVVASSLLTCAAAQAGGLYLYETTASDIGLASAGMAARAQDASVMAANPAGLANVSGKSFSGNLIGLYGDAQLDTMTGDAGNVIGFVPMASAFYSQQVNDKWTLGIGLYGNYGLGLEYEGLLNNHLDIPTATTQALTIQPSASYRINDHWSVGAALGIQYGMYEVETKGALNFNDEDQDTQLNGRVGVLYEATPGTRLGLSYSSETEFEFDNSNSIAPQQLIFSAYHEVNDDLAVMWNVNWQDWSEYTTTLKAADLVDVETQDTYQIALGTQYKLNEKMMWNAGFAFDTSMYESQSNGDITVPTGKAYRIGTGIDYKLDSENSIGFAFEAVLMESSETPRLQAGFDEPALYFMSMSYNWKN

SEQ ID NO: 23559 - DNA, 1242 bp, Vibrio parahaemolyticus RIMD 2210633
  CDS (1)..(1242): transl_table=11
atgaacaagaagcactgctctctgctgacaatttcaatattgtttgcgtgtaatgcccattcagcgggctttcaggttgctgaacactcggcatctggtcttggtcgagcattctcaggtgaaggggctgtagcagacaatgccagcgttcttgcacgtaacccagcagcaatgactcttttcaaagaagctcagttttctggcgcactttctatcgttgatcctgaagtcaacgtttacgatacgcttcataaagagcaatctgatgacgtagcaccactgcaagtggttcctgcgggttattacatcagcccaatcaatgacaactgggcttggggtatcggtatgttcaccacttacggtgttgcaacagattatccagatgatatttctgcgggtgatatggctggcgacacctcgctactttcggtcaacatcaacccaaacattgcttaccgtatcaacgaaaaatttagtgttggtggcggcatcaacttagtttatgcagaagctgaactgacacgtcataaaggtgcgttggcgccgctatttggttctggtagcagtaaatccgataacctaattggcatggaaggtgagactttcgcatggggttggaacgtcggtgccctatttgaacttaacgaaaacaaccgttttggctttggctaccgttctaaagtcgatctagattttgatgatggtgaattcagcagctacgactctggcatcgcaaccgcagcaaaagttgatggtcgcttgaagatttcgcttccttctattatcgaactttctgcattccatcaacttaatgaccaatgggcgattcattacggttggcaacaaactgactggagcacttttaaagagctaaaagcgaccagtaatgaatgtaaaggcggcgtatgtttcttcaaaccagaaaagtatgaagacaacaaccgttactctgtaggtgcaacttacacgctaaacacagagtggacattccgcgcaggcttggcttatgacgagcaagcgggtgaagcaacattgagtatccctgatagtgaccgtatgtggtacagcgcgggtctaacgtatgcaatgaatgaaaacctatcgtttgatgctggttttgcattggtacaaagtgagtcgggctctttcactgagactaacgctgcaggtcaagaaattaagtttgattcagaaggtacggcatacatcagtgcagtacagatgaactacaccttcaaataa

SEQ ID NO: 23560 - protein, 413 aa, Vibrio parahaemolyticus RIMD 2210633
MNKKHCSLLTISILFACNAHSAGFQVAEHSASGLGRAFSGEGAVADNASVLARNPAAMTLFKEAQFSGALSIVDPEVNVYDTLHKEQSDDVAPLQVVPAGYYISPINDNWAWGIGMFTTYGVATDYPDDISAGDMAGDTSLLSVNINPNIAYRINEKFSVGGGINLVYAEAELTRHKGALAPLFGSGSSKSDNLIGMEGETFAWGWNVGALFELNENNRFGFGYRSKVDLDFDDGEFSSYDSGIATAAKVDGRLKISLPSIIELSAFHQLNDQWAIHYGWQQTDWSTFKELKATSNECKGGVCFFKPEKYEDNNRYSVGATYTLNTEWTFRAGLAYDEQAGEATLSIPDSDRMWYSAGLTYAMNENLSFDAGFALVQSESGSFTETNAAGQEIKFDSEGTAYISAVQMNYTFK

SEQ ID NO: 23561 - DNA, 1308 bp, Haemophilus ducreyi 35000HP
  CDS (1)..(1308): transl_table=11
ctgttagcttgtttaattactgttagcggaactagttcgcaagcagcttctttccaattagctgaaatttcaacttctggtttattaggtatggcttatgcgggtaacgctgcagtagcagataatgcttcggtcgttgcaactaaccctgcattaatgacagaattcaaacacccacaaatttcagttgggggtattttagtggacgcaaatgtagatgtgtcaggtaaaatcaatggttcagttgacgcgcctcacaaagatattattccgaatgcaatagtgcctaatatttactttgttacgcctattaattcacaatttagtttaggcggtggtttaaacgttaattacggcttgaaatcacaatataacgataaatttaatgggggaatgttcggtggtagcactaaactaaccgcattaaactttaatttaagcggcgcttataatttaggtaatggcattagcttgggcttaggcttaaatgctatccattcagatgcagaaattaaccgctatttaggtgcgggcaaacaaatccttatagaggcaggcaaacaagcacaaaatatcataccaagcctatctgaaaacactagtattgctcatattaaaggcaaaaaatggagcttaggttggaatgttggtcttgcttatcaactggatgaaaatcaccgttggggtgtagcatatcatgcaccggtcgatgtaaaatttagcggtcagtattctaatcagttaccggaagccttgaatccgcttttacaagcgcactcttccctcaaattaccaattagccaagccactggcggtaaagcaattccagggaatttaacccttaatttacccgcttattgggaattatctggcttccataaactcactgatcaattagcaatgcaatatagctataaatacaccggatggaaacgcttaaaaagtttagatgcttatgctaatgacggtaaattattattccaaaaaattgaaaactttagcaattcttcacgttatgcgatcggtttctcttatgatgtggctcaagatttaaccttgcgcactggttttgcttacgataaaaatgctagtgtaaaacatccttcgatctcaattccagatacaacacgtacttggtattcaatcggtgcaacttatcgctttacaccgaatgtgtcttttgatgttggtttagcacatttacgcggtaaaaagaaccaatttactgaaggcacacttgttaaaggtgcatttgaagttgccgcaagagccaatctttacggcttgagtataagttatggtttttaa

SEQ ID NO: 23562 - protein, 435 aa, Haemophilus ducreyi 35000HP
MLACLITVSGTSSQAASFQLAEISTSGLLGMAYAGNAAVADNASVVATNPALMTEFKHPQISVGGILVDANVDVSGKINGSVDAPHKDIIPNAIVPNIYFVTPINSQFSLGGGLNVNYGLKSQYNDKFNGGMFGGSTKLTALNFNLSGAYNLGNGISLGLGLNAIHSDAEINRYLGAGKQILIEAGKQAQNIIPSLSENTSIAHIKGKKWSLGWNVGLAYQLDENHRWGVAYHAPVDVKFSGQYSNQLPEALNPLLQAHSSLKLPISQATGGKAIPGNLTLNLPAYWELSGFHKLTDQLAMQYSYKYTGWKRLKSLDAYANDGKLLFQKIENFSNSSRYAIGFSYDVAQDLTLRTGFAYDKNASVKHPSISIPDTTRTWYSIGATYRFTPNVSFDVGLAHLRGKKNQFTEGTLVKGAFEVAARANLYGLSISYGF

SEQ ID NO: 23563 - DNA, 1458 bp, Chromobacterium violaceum ATCC 12472
  CDS (1)..(1458): transl_table=11
atgaagctcaagcatctcagcctgtccgtgatgatcatgggcaccgcgctcggtctggcatcgactcaggccgcggcctcgggttatcagttcggctcgcagagcgtctccggccagggcaccgcgcacgcgaacggcgccgaagccaatgatccttccaccatcttcaccaacccggccggcctgtcccggctggacggcacccagctcgtgatcggcggcaccctggtggtgccgcattccgaatacaccgacaacggctccaggaacgtgctgggccagcccaccggcggcggcaacggcggcaccttcgcgcctaaggccgtggccgcgccgactttctacctgtcgcacaagatcaacgacaagatcaccgccggcatcggcatgtacgtgccttacggcgccaagctggactacggcttcgactgggccggccgctacgcactgaagagcgtcaacctgcagtcgctgaacatcaacccgtccatttccttcaagctggatgagcgccactccttcggcttcggcgtgtccgcccagtatatggatgcgacgctggagcagatggcggatgcaacgtctgggttggcattgagtgttgcaaagggcctgcctggcggagttactcccggcaacatcgctactgctatgggcatgctgaaggccgcaggagtaaggggggatggcctcgcgcacgtagagggtaatgattggggctttggctggaatgtcggttatatgttccaactggacgaaaatacccgctttggtttggcttaccgttccagtatcaagcagaagttgacgggtagttcgacttggacttttaacaatgtgaccggcagcatggttccattcggcattccactgtctgccgccgccgctgccaaggcaaagcacccgaatgcatctgcctctgttgatgtgaccaccccggaaaccgtgtccgccaacttcttccatcagttgaacccgaaagtggcgctgatggccgacgccacctgggtgcgcaactcgcagctgcagcagatcgacatcaagcaatacagcacgccggctcagggcgatctgatactgcaccagaactggaaggacacctggcgcctgtcgttcggctccaactaccagctgaacgatgcctggatgctgcgcggcggcgtggcctgggagcagtcgccggtgcagtcggacgaccagcgccatccggctctgccggacagcgaccgcctctggctgtcgttgggcgccaactacaagatcaacaagcagagctcgatcgacctggcctacagcttcatcgacttcaagaacgccaacgtcaactacaccgattcctgcaatccgaccggtcaaaaggctgatggctctctgtgcaccggcaacggcggcacggtcaagggcagctacaagacttatctgcagctgatcggcgtgcaatacaactaccgtttctaa

SEQ ID NO: 23564 - protein, 485 aa, Chromobacterium violaceum ATCC 12472
MKLKHLSLSVMIMGTALGLASTQAAASGYQFGSQSVSGQGTAHANGAEANDPSTIFTNPAGLSRLDGTQLVIGGTLVVPHSEYTDNGSRNVLGQPTGGGNGGTFAPKAVAAPTFYLSHKINDKITAGIGMYVPYGAKLDYGFDWAGRYALKSVNLQSLNINPSISFKLDERHSFGFGVSAQYMDATLEQMADATSGLALSVAKGLPGGVTPGNIATAMGMLKAAGVRGDGLAHVEGNDWGFGWNVGYMFQLDENTRFGLAYRSSIKQKLTGSSTWTFNNVTGSMVPFGIPLSAAAAAKAKHPNASASVDVTTPETVSANFFHQLNPKVALMADATWVRNSQLQQIDIKQYSTPAQGDLILHQNWKDTWRLSFGSNYQLNDAWMLRGGVAWEQSPVQSDDQRHPALPDSDRLWLSLGANYKINKQSSIDLAYSFIDFKNANVNYTDSCNPTGQKADGSLCTGNGGTVKGSYKTYLQLIGVQYNYRF

SEQ ID NO: 23565 - DNA, 1338 bp, Chromobacterium violaceum ATCC 12472
  CDS (1)..(1338): transl_table=11
atgcaagccgcaccccgctccctgagcctgttgtccgtttccctcgccgccctgttcgccgccgcgcccgccgcgcaggccgccggtttccaactgaccgagcaaagcgtcactggcatgggccgcgcctacgccggcgccggcatggccggcgacgacctgtccgccgtgttctacaacccagccggcatgaccctgctgtccggcacccgcgtgcaaggcggcctgacctacgcggaaatcgacgcgccgttcagcggccgcaataccagcgtcagccatctgcctggcacgcctcccgccaccgtgacgacttctgccaacgacaatggccgcggcgcgggcgaagtgattccgaacggttacctgacccaccaggtcaacgaccagctgttcctgggcctgggcgtgaccacgccgttcggcctgggcgcaagctatagcgacaactggggcggccgcgacaacggcatctccagcagcatcatgacggtggacatcaatccgtcgctggcttacaagctgaacgacaagtggagctttggcggcggcgtgtctgcgcaatacgcgaaggcggacctgaagcagggcgcctatctgcccggcgccagcggcgagctcaaggccgacagctggggcttcggctacaacctgggcgtgatgtactcctacagcgccgatacccgcgtcggcctgtcctatcgctccaagatccatcacgacgccaagggcgattacaccaatgccggttttcccgcgccgctgggcggcctgctcaatggcacgtattccggctcggccgaggtgaccacgccggaatggctgatgctgagcggctacagcaagctgaacagcaagttcgcagtcggcgccaccgcgcgctggacgcgctggagccgcttcgaccagctggtggtcaagggcagccccgtggtgcctaagttgccgggcctgacgcccgcgccgatcgacaccaccaccaccatcgacaaccactggaagaacagctggctgttctcggtgggcggcgactacttctacagcgaagcgctgaccctgcgcgcgggcctgggctacgagaccacgccggtgccgaacccgcagcaccgcaacgtgttgattccggacgccgaccgcatgtggctgaccctgggcgccggctaccggatcagcaagcaggcgagcgtggacgtgagctacgcctatctgcgcgcggtgggcgacaccaagatcgacaatacttcgcatagcccgttcggcaccaccagccgtctgcagggcgattactcctcgatcagcggccacctgctgggcgtgcagatgcagtaccgcttctga

SEQ ID NO: 23566 - protein, 445 aa, Chromobacterium violaceum ATCC 12472
MQAAPRSLSLLSVSLAALFAAAPAAQAAGFQLTEQSVTGMGRAYAGAGMAGDDLSAVFYNPAGMTLLSGTRVQGGLTYAEIDAPFSGRNTSVSHLPGTPPATVTTSANDNGRGAGEVIPNGYLTHQVNDQLFLGLGVTTPFGLGASYSDNWGGRDNGISSSIMTVDINPSLAYKLNDKWSFGGGVSAQYAKADLKQGAYLPGASGELKADSWGFGYNLGVMYSYSADTRVGLSYRSKIHHDAKGDYTNAGFPAPLGGLLNGTYSGSAEVTTPEWLMLSGYSKLNSKFAVGATARWTRWSRFDQLVVKGSPVVPKLPGLTPAPIDTTTTIDNHWKNSWLFSVGGDYFYSEALTLRAGLGYETTPVPNPQHRNVLIPDADRMWLTLGAGYRISKQASVDVSYAYLRAVGDTKIDNTSHSPFGTTSRLQGDYSSISGHLLGVQMQYRF

SEQ ID NO: 23567 - DNA, 1185 bp, Wolinella succinogenes DSM 1740
  CDS (1)..(1185): transl_table=11
atggcaaaaaagctctttttaaccctcctctctcttttctctttcgcctgtgcctcaggctacaaaatccccgaacaatctcttgattccacggctctctctggcgctcatgtcgcggggagctatggggcagatgccagttattacaaccctgccaacatggcttttgcctctttagaagctgagatggagagtgcgctcacctatattcatctcacctcggttcactttgagcaaggcgcctacaaagaggattcaaagcgagagaatttccttgttcctaagtttttttaccgaagccctgcgatgggggattggcgtatggggctctcctttaccaccccagcaggactctctaagcgctgggaagagggggttagagggcaaagtaatgccaatgagttcacgctagaggtctttgagctcaacccttctctctcttataaaatttccgattcgctagcgcttggcttgggaatccgtggggtctatagcaaaggaatcgtgaaaaacgatatggtcactttgggctcctatcaagagctcaaaggcgattctttagactttggctggaacgctgctttggcgtttaagcccgtggagagcaccaatttaagcattgcctatcgctctaaagtcaatcttagtattgagggtgatgcgggaattcgcaccccctttggaaatatcaatcctgaggctagagtcacgattcctcttcctgcaactctaagcctagcgcttgccaagcagtgggatgacttcttggtggagtttgtatgggatagggtctattggtcggcctacaaagagcttgattttgactatgaccacgacatgacctccaatccaatcctaagagccctagacgcttccaaggccaaaaattggaaggataccaacacctatcgcctaggactctcttatcagatgaatgaggcgtggaagctcatggcgggctttggaattgataagaatcccatccctgatgacaggctaggttttgagctccccgatagtgacgccaagatctactctcttggagctcgttataagatcaactctcgccatgaggtgggagcagcctttttggtgagcgacaaagaggacaggacgacctctattggcacttttagccatacgcaggcccaccttttaacctttggatacacctatcgctactaa

SEQ ID NO: 23568 - protein, 394 aa, Wolinella succinogenes DSM 1740
MAKKLFLTLLSLFSFACASGYKIPEQSLDSTALSGAHVAGSYGADASYYNPANMAFASLEAEMESALTYIHLTSVHFEQGAYKEDSKRENFLVPKFFYRSPAMGDWRMGLSFTTPAGLSKRWEEGVRGQSNANEFTLEVFELNPSLSYKISDSLALGLGIRGVYSKGIVKNDMVTLGSYQELKGDSLDFGWNAALAFKPVESTNLSIAYRSKVNLSIEGDAGIRTPFGNINPEARVTIPLPATLSLALAKQWDDFLVEFVWDRVYWSAYKELDFDYDHDMTSNPILRALDASKAKNWKDTNTYRLGLSYQMNEAWKLMAGFGIDKNPIPDDRLGFELPDSDAKIYSLGARYKINSRHEVGAAFLVSDKEDRTTSIGTFSHTQAHLLTFGYTYRY

SEQ ID NO: 23569 - DNA, 1344 bp, Photorhabdus luminescens subsp. laumondii TTO1
  CDS (1)..(1344): transl_table=11
ttggttatgaaccagaaaaacctgttcacccgttcagcattagcggttgcagtggcaataatttcatcgaatgctggcgctgctggtttccagttaaatgaattttctacttcggctttgggccgcgctttttccggggaaggcgttgttgctgataacgcagcggtaggaagccgtaacccagcagcaatgacactgtttgatcgcccatcattctctattggcgccgtctatatcaacccagatgttgatattaccggtaaatccccagtaacaggcaaaagtactaacgctaaaaatattgctcctaccgcttggatacctaacatacatttcattatgccaatcgatgatcaatggtttgttggtacctcggtcaccaccaatttcggcctggcaaccgattttagcaataactatgaagcaggccctatcggcggtaaaactgacctgacaacgttgaacttcaatctgagcggagcttatcgcctgaacgatcactttagctttggtttaggactgaacgctgtttatgcggatgcaaaaattgtccgtcatgcgggcgctctgtcatacatgctggatcagcaccccaagatgccaaaaggtctcgtaaaaccaacagatgaggttgctaatctggaaggtaaagattggggctatggctggaacgcaggcattatgtatgaagtggatgaaaataaccgttacagcctgacttaccgctctaaagttaaaattaagtttaaagacggtgactataaaaatgacgtacctgttcagctaggtcaaatgctgcaaaaagcgggagtgaatttacctgctactggaggccaaaccattggcggtagattggatctcaatttgccagatatctgggaggtttccggttacaaccgcgtagcacctaaatgggctattcactatagcttggcatatgcaggctggagtgaatttaatgaactgaaagggaccagaaaaaaagacggtgcagttttgtttagtaaacatgaaggcttcaaagatgcctaccgtattgctttaggtacaacgtattatcacgatgacaattggacattccgtacaggtatcgcctttgacgatagcccgattcctgctgaaaaccgttctatctccattccagatcaagatcgtttctggttgagtgcaggtgcaacctacgcatttaacaaagatgcttccgttgatgtaggcgtttcatatatgcatggtcagaaagtcactgttaaagagaaattgtctgaagcgttacctaacgcatacgaattcgaagctaagggttctgcctggttgtatggtgtgaacttcaactacgcattctaa

SEQ ID NO: 23570 - protein, 447 aa, Photorhabdus luminescens subsp. laumondii TTO1
MVMNQKNLFTRSALAVAVAIISSNAGAAGFQLNEFSTSALGRAFSGEGVVADNAAVGSRNPAAMTLFDRPSFSIGAVYINPDVDITGKSPVTGKSTNAKNIAPTAWIPNIHFIMPIDDQWFVGTSVTTNFGLATDFSNNYEAGPIGGKTDLTTLNFNLSGAYRLNDHFSFGLGLNAVYADAKIVRHAGALSYMLDQHPKMPKGLVKPTDEVANLEGKDWGYGWNAGIMYEVDENNRYSLTYRSKVKIKFKDGDYKNDVPVQLGQMLQKAGVNLPATGGQTIGGRLDLNLPDIWEVSGYNRVAPKWAIHYSLAYAGWSEFNELKGTRKKDGAVLFSKHEGFKDAYRIALGTTYYHDDNWTFRTGIAFDDSPIPAENRSISIPDQDRFWLSAGATYAFNKDASVDVGVSYMHGQKVTVKEKLSEALPNAYEFEAKGSAWLYGVNFNYAF

SEQ ID NO: 23571 - DNA, 1389 bp, Vibrio vulnificus YJ016
  CDS (1)..(1389): transl_table=11
ttggtttttaaagcttttgctctagatctacaattcgtccccacatattcacttattcagcgaacaaacataatgaaaaccaacaagactcttctatcaacagcagtcgcttttggcctactttctagtgcaaatcttgcaaatgcagcaggcttccagctagcagaatactcggcaacaggccttggccgcgcatacgctggtgaagcagcgatggcagacaacgcaagcgcacaatggcgtaacccagcgatgctgacctacctagagggtacacaagtatctgttggcgcgatttatgtaaacccaaatattgatgttaaaggcaccactacgcttcaacacccagcaaccggacaaactgttgcagtcactgattctgcatctgatgacttcgcgcacgacgcagttattccaaacctttacatctcacatcgttacaatgaccaacttgcgattggttttgcactaggcaccaactacggtatggaaactgacctaggcaaagatttcgctgcctctcatttcggcaatgaagccagcgtaatcagtaaagaagcgaacttaaacctagcttaccaactgaatgaacagttcagtattggtggcggtattcgctacattattgctgaaggtagctttggcgctacagcaccaaaaacgaacatcctcaacctaccacaaggcaccacgttaaaatacatggaaggtgacgataccacatggggttggcaagtaggttctgcgtggcagatcaataagaatcaccgtgttggctttacctacaaatctgaagttgaactgaaattagaaggtcatgcagaaggtgttgggtttgggtttggtacgactatccctaaatcacgcgataatggttacatgtaccttactttgccagcaacagcagagctagcaagtttccaccagttgacagaaaaaatcgctatgcatgcaagtttcaactggacagactggagctctttcgagaaattggaagcccatatggaaacagctgggactcagatggtgaaagtagaaaactgggaagacaactaccgctttgctgttggtgcgacataccaattacagcctaagttagcactaagaaccggtattgcttatgacacctcagccgtgagcgataaaaaccgtaccatcaccattccagaaacggatcgtacttggttgagcatcggtgcgacatacgactggacgcaagatttcacactagacgcaggctttacttacatcatagccaaagatgcgccaattaaggaatcacgtggttacgaatcggatgacaaagcacaagctattggcggtcagtttgtcggtgaaaccacgggtaacgtgtggctaattggtgttcaagcgaactaccacttctaa

SEQ ID NO: 23572 - protein, 462 aa, Vibrio vulnificus YJ016
MVFKAFALDLQFVPTYSLIQRTNIMKTNKTLLSTAVAFGLLSSANLANAAGFQLAEYSATGLGRAYAGEAAMADNASAQWRNPAMLTYLEGTQVSVGAIYVNPNIDVKGTTTLQHPATGQTVAVTDSASDDFAHDAVIPNLYISHRYNDQLAIGFALGTNYGMETDLGKDFAASHFGNEASVISKEANLNLAYQLNEQFSIGGGIRYIIAEGSFGATAPKTNILNLPQGTTLKYMEGDDTTWGWQVGSAWQINKNHRVGFTYKSEVELKLEGHAEGVGFGFGTTIPKSRDNGYMYLTLPATAELASFHQLTEKIAMHASFNWTDWSSFEKLEAHMETAGTQMVKVENWEDNYRFAVGATYQLQPKLALRTGIAYDTSAVSDKNRTITIPETDRTWLSIGATYDWTQDFTLDAGFTYIIAKDAPIKESRGYESDDKAQAIGGQFVGETTGNVWLIGVQANYHF

SEQ ID NO: 23573 - DNA, 1215 bp, Desulfovibrio vulgaris subsp. vulgaris str. Hildenborough
  CDS (1)..(1215): transl_table=11
atgcggaaagttcttctcgtgttgtgtctggccttgtgtccgttgcaggcatgggctgccggctacggcgtctatgagtggagtgcacgtggcaacgcgcttggcggtgccatggtcgcccgggacgccgacccctcgtctgtcgcctacaaccctgccgccatcaccgaccttgagggtgcgcagatccagatgggggccacagccatcgcccctacggcgaagatgacctccaatacgcccggcaagcgtgatgccgagttctccgactccatctgggggctgcccaccttctactacacgcagcagctttcggataactactggttcggtttcggcatgttctcgcgtgttggcctcggcaccgactacaaggacaccgatacatggccggggcgctataactgttcatacgccgccatccattcggtgtcgctcaaccccaaccttgccatgaaactcactgatgagctttccgtggcattcggccttgatgcgacctacctgcgattcatgtacgacaccactatttctcctgtcgatgtcatgcagcagatagacgccgacggttgggcctacggcctcaacctcggtgcccgctacaagccctacgactggctggctttcggtgtggcgtggcgtagcgagatgcaactcacggtcaacggcaacgtcgacttcacgcaaaagggcgctgttcccgctcctgccgctcgcgacgtacgcggtacggaacccatacccgaaagcatcacctttggtgtgatggtgaagcctttcgacaagctgagccttgaagtcgacgccgtgtggacgcgctggagtgcctacaacacactcgtcatcaattatgatcccgccctgtacggcaaatcgagtgtttcggcggagaagaactggaagaacacatggcgtttgcagttcggtgccgaatatgccctcaccgacagcatcgacctgcgcgcaggctacgtgtacgaccagacccctgtcgatgacgcgcatgaggattacgccgtgccctgttccgacaggcagattgccaccaccggtatcggctggaagatcaacgaagcatgggtgctcgacgcctcctacagctatctctggatgaccgaccgagagtacgaggcccgttccggtggcatctacgactccacccgcgaggatgcgcatgcgcacatggcggggttgagccttacctacaagttctag

SEQ ID NO: 23574 - protein, 404 aa, Desulfovibrio vulgaris subsp. vulgaris str. Hildenborough
MRKVLLVLCLALCPLQAWAAGYGVYEWSARGNALGGAMVARDADPSSVAYNPAAITDLEGAQIQMGATAIAPTAKMTSNTPGKRDAEFSDSIWGLPTFYYTQQLSDNYWFGFGMFSRVGLGTDYKDTDTWPGRYNCSYAAIHSVSLNPNLAMKLTDELSVAFGLDATYLRFMYDTTISPVDVMQQIDADGWAYGLNLGARYKPYDWLAFGVAWRSEMQLTVNGNVDFTQKGAVPAPAARDVRGTEPIPESITFGVMVKPFDKLSLEVDAVWTRWSAYNTLVINYDPALYGKSSVSAEKNWKNTWRLQFGAEYALTDSIDLRAGYVYDQTPVDDAHEDYAVPCSDRQIATTGIGWKINEAWVLDASYSYLWMTDREYEARSGGIYDSTREDAHAHMAGLSLTYKF

SEQ ID NO: 23575 - DNA, 1206 bp, Desulfovibrio vulgaris subsp. vulgaris str. Hildenborough
  CDS (1)..(1206): transl_table=11
gtgtaccgtttcatcattgccgtggcgctgtgcgccgtctgggcggcatcggcccatgcggcaggtttcgccatgcatgaattcggggcgaggggcaacgcccttggcggtgccatggtggcgcgacccgccaccgacccgtcttctatcgcattcaaccccgccctcgtcacgcatcttgatacgccgcaggtgcttgccggcgtcaccatggtgcagcccgaggtgaccatagacacacccggtgaatcgacgaccaccgaggccaacgtgtgggccatcccccatgcctacgccacgacgcccctcaccgacaccatgtatttcggcgtaggggcgttcccccgcttcggcctcggcaacgagtactcgaagacgtggcccatggcttctgaactcacctacgtgggcatccagtcggtgtcggtgaacccggtgcttggcttcagaccgacgaaggacttcgccttcggcttcggcgtggaggccatgtacttcgacttcgaggaaaagatgcgcccgttgggcatggatgcccgcatcaagggcgacagcaccggttttggcctgaatggtggcatgtggtggcaggcattcgaagatatcgccctcggtgccagcttccgcacaccggtgaagcagcacgtcaaggggcgcgccacgttcgacaacgtccccgccggatacggcccgctgttcagggacaccgacgccgaaggcgacatcacgctgcccggcgaggtgcgtttcggcgtctattggcaggccaccgagcgccttggtgtcgaggtgggggccatgcgcaccttctggagcagttatgacgagttgcgcatcgactacggttcacccgtgggcggaaagcctgcctccatcaagcagacggagtgggaggacgtgtggcgtctgagcgccggtgccgagtaccgtctcaccgacaacgtcgacttgcgcgcgggctatgtctatgacgaggaaccggtcaattcggcgcatctcgacttcatggtccctgccaacgaccgtcacctcatgagccttggcgtgggctaccacgaagggccgtggcgcgttgatctttcgtacacctacctgctcatcaccgaccgtgagggcgaggtgcatacggcgggcggcaacgtgcccgtgcgcttccacgacggctatgcccatctgctgggcatgagcgcggcgtgggagttctga

SEQ ID NO: 23576 - protein, 401 aa, Desulfovibrio vulgaris subsp. vulgaris str. Hildenborough
MYRFIIAVALCAVWAASAHAAGFAMHEFGARGNALGGAMVARPATDPSSIAFNPALVTHLDTPQVLAGVTMVQPEVTIDTPGESTTTEANVWAIPHAYATTPLTDTMYFGVGAFPRFGLGNEYSKTWPMASELTYVGIQSVSVNPVLGFRPTKDFAFGFGVEAMYFDFEEKMRPLGMDARIKGDSTGFGLNGGMWWQAFEDIALGASFRTPVKQHVKGRATFDNVPAGYGPLFRDTDAEGDITLPGEVRFGVYWQATERLGVEVGAMRTFWSSYDELRIDYGSPVGGKPASIKQTEWEDVWRLSAGAEYRLTDNVDLRAGYVYDEEPVNSAHLDFMVPANDRHLMSLGVGYHEGPWRVDLSYTYLLITDREGEVHTAGGNVPVRFHDGYAHLLGMSAAWEF

SEQ ID NO: 23577 - DNA, 1287 bp, Erwinia carotovora subsp. atroseptica SCRI1043
  CDS (1)..(1287)
atggtcatgagccagaaaaacctgttcaaacaatccacaattgctgttgcggtggccctgttttcagcaaatgtgtccgcagctggtttccagcttaatgaatactcatcatcgggtctgggacgcgcgttttctggtgaaggtgccgtagccgacaatgcgacctccggtagccgtaacccggcgaccatgaccatgtttgaccgcccatcgttctctggtggtgtcacctatatcaacccagatattgatatcagtggttcaagttcatctgggcaaaatgctgatgcgaaaaatatcgcaccacatgcctgggtgccgaacctgcattttattatgccgcttaacgaacagtgggcgattggtgcttctgcggtaaccaactatggtctggcgactgagtttaatgacaactatgtagctggctctatcggcggtcaaaccgatctgctgacctcgaacctgaacctgagcgccgcctatcgcctgaaccagcatttcagctttggtttaggtgttaacgccgtctatgccgatgccaagtttgtgcgtcatgcaggggaactgtccgctgcatttcctcctgctctaggggtgaccccccgtacagaaatatcacgtatggaaggtaaagagtggggctacggctggaacgccggcatcctgtacgaagtagatgaaaacaatcgcatcggcctaacctaccgctctaaagtcgatatcgactttaatggtgactacagtaaccaactgcctgcaggagcaggagcgcttaatggcgcaacagtgcctggtaaactgacgctaaatctgccggaaatgtgggaagcatcggcctatcaccgcgtagcgccgaaatgggcggtacactacagcctgacctacaccagttggagccagttccaggaattgaaagcaacgggtagcaatggacaaaccttgttccagaaagaagaaaacttccgtgatgcttaccgtatcgcactcggtaccacctactatcacgacgataactggacgttccgtagtggtatcgcgtttgatgacagcccggtaccggccgacagacgttctatctccatccccgatcaggaccgtttctggttgagcgcaggtactacctatgcgtttaacaaagatgcctctgttgatgttggcgtgtcctacatgcatggtaaaaaagttaccatcaccgaaaaaggcccaactgcaacgtctccaacgtacaacttcagctctgaaggtaaagcctggctgtacggcgtgaacttcaactatgcgttctaa

SEQ ID NO: 23578 - protein, 428 aa, Erwinia carotovora subsp. atroseptica SCRI1043
MVMSQKNLFKQSTIAVAVALFSANVSAAGFQLNEYSSSGLGRAFSGEGAVADNATSGSRNPATMTMFDRPSFSGGVTYINPDIDISGSSSSGQNADAKNIAPHAWVPNLHFIMPLNEQWAIGASAVTNYGLATEFNDNYVAGSIGGQTDLLTSNLNLSAAYRLNQHFSFGLGVNAVYADAKFVRHAGELSAAFPPALGVTPRTEISRMEGKEWGYGWNAGILYEVDENNRIGLTYRSKVDIDFNGDYSNQLPAGAGALNGATVPGKLTLNLPEMWEASAYHRVAPKWAVHYSLTYTSWSQFQELKATGSNGQTLFQKEENFRDAYRIALGTTYYHDDNWTFRSGIAFDDSPVPADRRSISIPDQDRFWLSAGTTYAFNKDASVDVGVSYMHGKKVTITEKGPTATSPTYNFSSEGKAWLYGVNFNYAF

SEQ ID NO: 23579 - DNA, 1191 bp, Desulfotalea psychrophila LSv54
  CDS (1)..(1191): transl_table=11
atgaaaaagaagatttctgcactggccctgataagccttatggtggcggcaaacgcctctgcctcaggttttagaattccagagcaatctgttgattccacggctaaggccggtgccaatatagcctcgtctacccgggccgatgccacctattttaaccctgccaatatgtcatggctggaagatgggaccatgattcagggtaacctgacctatatccatctcaccaagaatgagtaccatggagctgatggatattcgtctaatgcagaggatgaaaattttgtgatgcccaccggttttatcgtctccccgtattttggagattttcgctttggtatctccaatacctctccctatggccttgccaagagatggaagaataatgccggaactggctctgcccgcgagttttccatggagaccttcgagctgaaccccaccctctcctatcgtattaacgataaggtctctctggccggtggagtacggatgatgtacgccaatgccaccataaaaaatgtattgtacgatatggagggggatactatcgagtggggctataatctggccctctctgttcgtcctgtggagagttggaatatctcggccacctatcgttccaagattgatctgaacttttctgagagcgatgtacgctttaatcctacagctagtggtctcttgcccccatcggctataatatcggcgtccactagtgtgccagcacctgcagtcttagccctcagtacctcgtttcaaccccttgaaaatctgaccgtagaactgaccgtagatagaacattttggtcagcatacgatcagcttaatattgtaacaaatccagcaggttattcaaaatcttttctgaaagattgggatgatggcaatgcctaccgtcttggccttagctatgatcttaacgatgccctgaccctgatggctggttttgcctacgatgagtgtccgtcccccaatagcaccgtgggctttgagctcccagacgcacctgcctggctctactccgttggctttcagtatgccatgaccgagaacctcgatgtaggtatggctgtcctctatgactacaaagaagaaagagatgttaatcatccaggcattggcgctgttggtgaatttaccaatggtggtgccttcttggttagcactggcctgaattatcgtttttag

SEQ ID NO: 23580 - protein, 396 aa, Desulfotalea psychrophila LSv54
MKKKISALALISLMVAANASASGFRIPEQSVDSTAKAGANIASSTRADATYFNPANMSWLEDGTMIQGNLTYIHLTKNEYHGADGYSSNAEDENFVMPTGFIVSPYFGDFRFGISNTSPYGLAKRWKNNAGTGSAREFSMETFELNPTLSYRINDKVSLAGGVRMMYANATIKNVLYDMEGDTIEWGYNLALSVRPVESWNISATYRSKIDLNFSESDVRFNPTASGLLPPSAIISASTSVPAPAVLALSTSFQPLENLTVELTVDRTFWSAYDQLNIVTNPAGYSKSFLKDWDDGNAYRLGLSYDLNDALTLMAGFAYDECPSPNSTVGFELPDAPAWLYSVGFQYAMTENLDVGMAVLYDYKEERDVNHPGIGAVGEFTNGGAFLVSTGLNYRF

SEQ ID NO: 23581 - DNA, 1266 bp, Yersinia pseudotuberculosis IP 32953
  CDS (1)..(1266): transl_table=11
atgaaccagaaaaacctgtttacccgctcagctctggcagcagctatcgctcttatttcatcgaacgtttctgcagccggttttcagttgaatgaatattcagccgccgctctagggcgtgctttctctggtgaaggcgcagtggctgataatgcttccgttggtagccgcaatcctgcagcaatgactttattcgaccgcccttctttctccggtggtgtgatttatattgatccaagtgttgatatcacggggacgtcgccaagtggcaaaagtacggatgccagtaacattgcgccatcagcgtgggttccgaatctccactttattatgccattggatgaacagtgggcaatcggtgcttctgcgacctctaactacggtttagccactgaatttaatgatgattatgtggcaggcatgttaggcggccaaaccgatctgaaaacggctaacctcaacctaagtgccgcgtaccgcctgaatgataacttcagttttggcctggggtttgatgcagtctatgctgatgcgaaaattgtgcgccatctcggtgaagctggcgggggtctattgcctgctaacactgaagccgccaggttggaaggtaccaaatggggttacggctggaatgcgggtattttgtatgaaatcgataaagaaaaccgctacagcttcacttatcgttctgaagtcaatatcgattttgacggtgattacagtaaccaactacctgttattttcggtggtctgggtggaaaaacggtccctggttccctaactctgaacctgcccgccgtgtgggaagtctccggctacaataaagtcgcgccacaatgggccattcactacagcatggcttacaccacctggagcagtttcaaggagttaaaagcaaccgcgtctaatggcgatgtgctgtttgataaacatgaaggcttcagagatgcctaccgtattgcgttagggaccacctattactacgatgataactggacattccgcaccggtattgcctttgatgatagcccgatccccgcaggaaaccgttcaatttccatcccggaccaagatcgtttctggctcagtgcaggtaccacctacgccttcaacaaaaatgcctctgttgatgtcggtattgcttatatgaaaggccagaatgtcagtattaccgaaaagaccccggccccatctaacaccacatatgagttcaactcgaaaggttccgcgatgctatacggtgtgaacttcaactacacattctaa

SEQ ID NO: 23582 - protein, 421 aa, Yersinia pseudotuberculosis IP 32953
MNQKNLFTRSALAAAIALISSNVSAAGFQLNEYSAAALGRAFSGEGAVADNASVGSRNPAAMTLFDRPSFSGGVIYIDPSVDITGTSPSGKSTDASNIAPSAWVPNLHFIMPLDEQWAIGASATSNYGLATEFNDDYVAGMLGGQTDLKTANLNLSAAYRLNDNFSFGLGFDAVYADAKIVRHLGEAGGGLLPANTEAARLEGTKWGYGWNAGILYEIDKENRYSFTYRSEVNIDFDGDYSNQLPVIFGGLGGKTVPGSLTLNLPAVWEVSGYNKVAPQWAIHYSMAYTTWSSFKELKATASNGDVLFDKHEGFRDAYRIALGTTYYYDDNWTFRTGIAFDDSPIPAGNRSISIPDQDRFWLSAGTTYAFNKNASVDVGIAYMKGQNVSITEKTPAPSNTTYEFNSKGSAMLYGVNFNYTF

SEQ ID NO: 23583 - DNA, 1404 bp, Mannheimia succiniciproducens MBEL55E
  CDS (1)..(1404): transl_table=11
atgaaaaaggcaataaataaaaccttcctggcaagttgtattttatgcgccgccggtcaggcttctgccgccgcattccaattagctgaaatttcaacttccggtctgggtcgttcttatgcgggcgaagctgcaattgccgacaacgctgccgtaattgcaaccaacccggcattaatgtctcaatttaaaaccaatcaattctctgccggcggcatttatgtggattcccaaatccgcatgaacggtacggtaagcgccaatcttgcggggcaaaccgttgcacaagcgccagcatcaaaaaccagcgttgtgccggggtcattaattccgaatatgtatttcgtctcgccgcttaacgataaatttgccgtcggtgccggcatgaacgtaaatttcggcttaaaaagcgaatatgaagacgactacgcggccggcgtattcggcgggaagaccgagttaaccgcactgaaccttaacctgagcggttcatatcgggtaactgaaaaattaagcgccggtgtgggtttaaatgcactttatgcaaaagccgaagtatcccgtaacgccggtattttagcggatgccgtcggcaatgttgcaagcaatccgcaagcattaagcgctatcgttgcgcaacgacccgatctggcaagcaaaatgggggcgctgagcggtttggcaagcggtctgcaaagagataccctattaacgcatttacaggataaaacggcttgggcgttcggttataatcttggtctggcttatgatctcaacgaaagaaaccgtttcggtatcgcctatcattcaaaaattgatattgattttaaagaccgtaacgcggtcagttatcttccgtacggcacaacgccttacataggtgaaggcggcttggtgctacatttgccaagttattgggaattttccggttatcataaattaaccgataaattcgccatgcattacagctataaatataccgaatggagccgtttgaagaatcttcacgccacttacgcggatagatcactcagaaatgacggtttagccttccataaagatgaagaatacaaagacaattcccgcattgcattaggtgcaacctacgaagtggatgaaaaattaacgctacgcgccggtgtcgcttatgacgagtccgccgcacctcgtactcacgcaagcgcttccattccggatactaaccgtacctggtacagccttggcgcgacctataaatttactccggcactttccgttgatttcggtttcgcccatttacgcggcagaaaacttgacttcagcgaagaacaaagtttagccggcggtttagttactgtgaaagccgattataaatctaaagcgacggctaacctttacggactgaacataaattatagtttctaa

SEQ ID NO: 23584 - protein, 467 aa, Mannheimia succiniciproducens MBEL55E
MKKAINKTFLASCILCAAGQASAAAFQLAEISTSGLGRSYAGEAAIADNAAVIATNPALMSQFKTNQFSAGGIYVDSQIRMNGTVSANLAGQTVAQAPASKTSVVPGSLIPNMYFVSPLNDKFAVGAGMNVNFGLKSEYEDDYAAGVFGGKTELTALNLNLSGSYRVTEKLSAGVGLNALYAKAEVSRNAGILADAVGNVASNPQALSAIVAQRPDLASKMGALSGLASGLQRDTLLTHLQDKTAWAFGYNLGLAYDLNERNRFGIAYHSKIDIDFKDRNAVSYLPYGTTPYIGEGGLVLHLPSYWEFSGYHKLTDKFAMHYSYKYTEWSRLKNLHATYADRSLRNDGLAFHKDEEYKDNSRIALGATYEVDEKLTLRAGVAYDESAAPRTHASASIPDTNRTWYSLGATYKFTPALSVDFGFAHLRGRKLDFSEEQSLAGGLVTVKADYKSKATANLYGLNINYSF

SEQ ID NO: 23585 - DNA, 1437 bp, Legionella pneumophila str. Paris
  CDS (1)..(1437): transl_table=11
gtgaaaattaggcacaaacccttaagaacgctggtgagtactgctgttctcggagttctagctactggtacattaaacgcaggtggattttctttgtataccgaaggagctggatatacaacaggtaacttcgctgccggtgtggctgctgaagcggccgatgcgtctacaggttggtacaacccagcaggtttggtattaatccgcgatcagcaagctgtatttgccggtgtcggggtatttccgactgccaagctaagcgggattagtacttattcaacgattaatccgcctcctgcgccttcttttatttattctgaagttttcaataatatcaacggggctgaggatgcttttgttccttcgtttcattatgccttgccactgggtgaaaatgctacgtttgggttaagtgtagtatcaccatttggattggcaacagattggggtcccgattctccagtgcgctatcaagccacttttactgagttaattaccaccaatatctcacctgaaattgggggtagattaacagagcacgttgctttaggtgctggcttggatttgcaatatgcccgggttaaatacaatcgtatacttggcgcacctaatataatgaatgctttggatcttaatcccatgttagctgattcactgacttacaataaaggacactcttttggagtaggttttcatgtaggcgttctgggtatgtttaacgataatcatactcgtcttggagtaaactatcagtcagagatgagacatgaattctatggctatagccggctgacaggaccattggcaattccgggcaatatatttgcacctacatttccacaactgggcgtatttcaaagcgatgatttattcagtaatgccattgatttacctgatgtagtgactattagtgcttatcatgatgtcaatgacaaatttgcattgttaggctctttggtttataccgcatggagcagctttaaaacggtacaacttactaatgtagctgccccaagattggctgcaaatggaggtgtttcgcaagtcaaggcgataagtgtatcaccacagaattatactgatactttgcgggtggcgattggtgccaattatcatgttaatgacaaattaatgctccgtgtgggtggtggttatgatccaactcctacgaatgatattgacagagacgtacgtttaccggatacagatcgatgggctttatctgctggcgctcattatcaggcaactaataacattggtgtcgatatcggatatacccatttattcacttcaagtgatccagtgattaatagaaccgatgtgttaacggcaacaacaagctataacgttacagcatctggaaccgcaggtgccaatttagtaggtgtgcaagcgacttggacaattgataaagaacctccagcaccgactaaataa

SEQ ID NO: 23586 - protein, 478 aa, Legionella pneumophila str. Paris
MKIRHKPLRTLVSTAVLGVLATGTLNAGGFSLYTEGAGYTTGNFAAGVAAEAADASTGWYNPAGLVLIRDQQAVFAGVGVFPTAKLSGISTYSTINPPPAPSFIYSEVFNNINGAEDAFVPSFHYALPLGENATFGLSVVSPFGLATDWGPDSPVRYQATFTELITTNISPEIGGRLTEHVALGAGLDLQYARVKYNRILGAPNIMNALDLNPMLADSLTYNKGHSFGVGFHVGVLGMFNDNHTRLGVNYQSEMRHEFYGYSRLTGPLAIPGNIFAPTFPQLGVFQSDDLFSNAIDLPDVVTISAYHDVNDKFALLGSLVYTAWSSFKTVQLTNVAAPRLAANGGVSQVKAISVSPQNYTDTLRVAIGANYHVNDKLMLRVGGGYDPTPTNDIDRDVRLPDTDRWALSAGAHYQATNNIGVDIGYTHLFTSSDPVINRTDVLTATTSYNVTASGTAGANLVGVQATWTIDKEPPAPTK

SEQ ID NO: 23587 - DNA, 1443 bp, Legionella pneumophila str. Lens
  CDS (1)..(1443): transl_table=11
gtgaaaattaggcacaaacccttaagaacgttagtgagtactgctgtcctcggagttctggctactggtacattaaacgcaggtggattttctttgtataccgaaggagctggatatacaataggtaacttcgctgccggtgtggctgctgaagcagcggatgcctctacaggttggtataacccagcaggtttggtattaatccgcgatcagcaagctgtatttgcaggtgtcggtgtattcccaactgccaagttaagcggagttagtacttactcaacaattaatccgccccctttcccttcttttgtttattctgaggttttcaataatatcaatggggctgaggatgcttttgtgccctcgtttcattatgccttgccattgggtgaaaatgctacgttcgggttaagtgttgtatcaccatttggattggcaacagattggggcccagattctccagtgcgctatcaagccacttttactgagttaattaccaccaatatatcacccgaaattggtggtagattaacagagcacgttgctttgggggctggtttggatttgcaatatgctagagttaaatacaatcgtatacttggagtacctaacatactgaatgttttgccaccttttaaccccatgttagccgattcactgacttacaataaaggacactcttttggagtaggttttcatgtgggtgttctgggcatgtttaacgataatcatactcgtctcggtgcaaactatcagtcatcaatgcggcatgaattctatggctacagtcgtctaacagggccattggcaagtccaggtaatatattagcgccatttttgttcccggcacctggcatatttcaaagcgatgatttatttagtaactcaattgattttcctgatgtagtgactattagtgcttatcatgatgtcaatgacaaacttgcactgttaggctctttagtttatactgcatggagtagttataaaacagtacaactctataatgcagctgccggaagaccagcggataatggaaatgtttcccaagccaaggcgataagcatatcaccgcagaattataacgatactttgcgggtagcgattggtgccaattatcatgttaatgataaattaatgcttcgtgtgggtggtggttatgatccaacacctaccaatgatattgacagagacgtgcgtttaccggatacagatcgttgggctttatctgctggcgctcattatcaggcaacgaataatatcggtctcgatatcggatatacccatttatttacttcaagtgatccagttattaacaagactgatgcgtttactgcaacaaccagatataacgttacagcatctggaactgcaggtgccaatttagtaggtgtgcaagcaacttggactattgataaagaacctccagcaccgactaaataa

SEQ ID NO: 23588 - protein, 480 aa, Legionella pneumophila str. Lens
MKIRHKPLRTLVSTAVLGVLATGTLNAGGFSLYTEGAGYTIGNFAAGVAAEAADASTGWYNPAGLVLIRDQQAVFAGVGVFPTAKLSGVSTYSTINPPPFPSFVYSEVFNNINGAEDAFVPSFHYALPLGENATFGLSVVSPFGLATDWGPDSPVRYQATFTELITTNISPEIGGRLTEHVALGAGLDLQYARVKYNRILGVPNILNVLPPFNPMLADSLTYNKGHSFGVGFHVGVLGMFNDNHTRLGANYQSSMRHEFYGYSRLTGPLASPGNILAPFLFPAPGIFQSDDLFSNSIDFPDVVTISAYHDVNDKLALLGSLVYTAWSSYKTVQLYNAAAGRPADNGNVSQAKAISISPQNYNDTLRVAIGANYHVNDKLMLRVGGGYDPTPTNDIDRDVRLPDTDRWALSAGAHYQATNNIGLDIGYTHLFTSSDPVINKTDAFTATTRYNVTASGTAGANLVGVQATWTIDKEPPAPTK

SEQ ID NO: 23589 - DNA, 1293 bp, Photobacterium profundum SS9
  CDS (1)..(1293): transl_table=11
atgaataagaataagaataaaataacattatctttagcagcagcgttaatactgggcatgagtgccaatacaatggccgccggttttcaacttgcagaatattcagcaacgggcttaggccgtgcgtttgctggtgaagcggcaatggcagacaatgccggagcacaatttcgaaacccagcaatgctgacttaccttgaaggtacacaagtatcaatgggggctatttatgttgatccaaatattgatgttgaaggttcggtaaacggtacacaaaccaaagccagcgatattgcaaactcagccgttattcctaacttctacctatctcaccaacttaacgacaaggtatttttaggtttagcgttcggtactaactacggcatggaaactgaactagcgggtgattatcttgctacgcaatttggtaaccaagcgaaagtaatgtcgattgaaattaacccaaacattgcttacaaaatcaatgagcagtttagtgttggtggtggtatccgttacgttatgggagagggtcactttggtgcagctgcatcttctgacatgccacttgctccaggagttacagtacctaaaggcgcagacctgaagtacatggaaggtgatgatacagcgtggggttggcaggcgggtgccgcatggcaaatcaatgaaaataaccgcattggtttcaactaccgttctgaagttgagttgaacttaacaggtagtgcttctggggctatttacgacctcgaagcactaaaaaaaggtaaaaagccaagcgcaagttacgcgggtagcatggcattaactttacctgcaacagcagaaattgcgagctttcaccaattaacgaataagattgcggtacacgctagtttcaactggacagattggagcagcttcgacaagttggaagctaaaatcccatcgctatacggtaatgatcctgatctgattaaagaagaaaactgggaagacaactaccgcttagctgtgggtacaacttaccaatacacgaacaagctcgtgctgcgctcaggtattgcttacgatacatcagcagtaagtgatgagcaccgtacacaaacgattccagaaactgaccgcctatggctaagtatgggtgctggctacaactggtcacaaaacctaacacttgatgcaggcttcacgtacatatttgccaaagatgcaccaatgaacgaagtggatccaagccttggacaatttaaaggtgaaaccactggcagcatatggcttgttggtgtacaagcaagctaccgcttctaa

SEQ ID NO: 23590 - protein, 430 aa, Photobacterium profundum SS9
MNKNKNKITLSLAAALILGMSANTMAAGFQLAEYSATGLGRAFAGEAAMADNAGAQFRNPAMLTYLEGTQVSMGAIYVDPNIDVEGSVNGTQTKASDIANSAVIPNFYLSHQLNDKVFLGLAFGTNYGMETELAGDYLATQFGNQAKVMSIEINPNIAYKINEQFSVGGGIRYVMGEGHFGAAASSDMPLAPGVTVPKGADLKYMEGDDTAWGWQAGAAWQINENNRIGFNYRSEVELNLTGSASGAIYDLEALKKGKKPSASYAGSMALTLPATAEIASFHQLTNKIAVHASFNWTDWSSFDKLEAKIPSLYGNDPDLIKEENWEDNYRLAVGTTYQYTNKLVLRSGIAYDTSAVSDEHRTQTIPETDRLWLSMGAGYNWSQNLTLDAGFTYIFAKDAPMNEVDPSLGQFKGETTGSIWLVGVQASYRF

SEQ ID NO: 23591 - DNA, 1251 bp, Photobacterium profundum SS9
  CDS (1)..(1251): transl_table=11
atgaacaagaagcgtctgtttactaaaacgatgattgctgcagcaatcacactaacatctcagcaagctctttctgctggtttccaacttaacgcacaatcagcaactggccttggtcgcgcatttgctggtgacgccgttattgctgataacgcatcagtaatgtcacgtaacgccgcggcaatgtctttattcgatgcgcctgcaatctcgttaggtcttaacgttattgatacggacattaatattaaaaatgcccagtattcaaatccccgctctgcaaattcaggttcactggatgatcagtctgttggtgattcaactttagttccgaatatttattatattcacccaataaatgaccaatgggcagtaggtgctggaatttactctaattttggtacaaaaactgaatttagtgatgactatgctgccaatgaatttggtgggttaactgatgttaagagtgtaaactttgcattaagcgcttcataccgtatcaaccaacaatggagcgttggtggtggattagatattgtctatggttcaggaaaattgaagcgctctgttaaagttggtccaccaacagctgaacagaaaataaatctacttgatgttgatgctgacggtgttggtgtgggttggaacgtaggtacggtatttgagctagatgaccgcaaccgtttcggtctatcataccgctatagcccagagctagaaactgaaggtgacatgtcctttgcaggctcaacaagcggcaacccagatatcagtaacgacaaattaaaaatgccactacctgatatggcagagttctctggtttccacaaattaaacgacaaatttgcagtccactatagcgtacaatggattggttggagcgcatttgacaaactagcaacaactggtggcgataccctcaacacttacgaatggcaagacggctggcactatgcgttaggtggcacttactacctaaataacgattggactttacgtactggttatatgtatgacaccagcgcacaagatcaaaaaacatcgatttctgtaccagattccgatcgtcaatggttctcaggtggctttacttaccacctagatgccaaatctaacattgatttcggtctaacctacctaatgggtaaagacgttgatgtaaatgaagtatcaccagtcggaacaactatttcggcaacgactcgtgcaaacgcattgctatacggtattcagtacagccgttcgttctaa

SEQ ID NO: 23592 - protein, 416 aa, Photobacterium profundum SS9
MNKKRLFTKTMIAAAITLTSQQALSAGFQLNAQSATGLGRAFAGDAVIADNASVMSRNAAAMSLFDAPAISLGLNVIDTDINIKNAQYSNPRSANSGSLDDQSVGDSTLVPNIYYIHPINDQWAVGAGIYSNFGTKTEFSDDYAANEFGGLTDVKSVNFALSASYRINQQWSVGGGLDIVYGSGKLKRSVKVGPPTAEQKINLLDVDADGVGVGWNVGTVFELDDRNRFGLSYRYSPELETEGDMSFAGSTSGNPDISNDKLKMPLPDMAEFSGFHKLNDKFAVHYSVQWIGWSAFDKLATTGGDTLNTYEWQDGWHYALGGTYYLNNDWTLRTGYMYDTSAQDQKTSISVPDSDRQWFSGGFTYHLDAKSNIDFGLTYLMGKDVDVNEVSPVGTTISATTRANALLYGIQYSRSF

SEQ ID NO: 23593 - DNA, 1248 bp, Photobacterium profundum SS9
  CDS (1)..(1248): transl_table=11
atgtccaaaaatataaaattcagtgctattgccgtaacagccgctttcatgtcacttaatgtaaatgcagcgggcttccaagttaatgaacactctgcatctggccttggccgagcattcgcaggtgatgctgctattgccgataacgccgccgtactttcacgtaaccccgccgcaatgacccttttcaaaacagctgaaatttcaggcggattcagtattgttgaccctagtattgatgttgaagataaaagctttggccaaacagctaaagatgtagcgcccgtcgcttttgtaccagcaggttactacattcaaccaatcaatgaccgctttgctgttggcttggcactcttttccaactatggcgtgaccaccgagtatccagccgattttaatgcgggatcttccgccggtgaaacatcactgattaccgttaacttcaacccaaacatcgcttaccgtatcaatgacaatttcagtattgggggtggcgtaagcttggtgtatggcgaggccgaattaaaccgtcaccttggctctctttctgctgcagttcctgactctagccccagtgataaaacaatcaccatgaaaggggatacctttgattggggttggaacattggtgcgttatacgaatacaacgaaaacaaccgtttcggtcttagctaccgttcacaagtcgacctcgactttgaaggtgacttcactgactaccttggtgccatcactggtacacccaataacaccataaccggtaagctgccggtagtattacccgccattgctgagttctcaggcttccaccagttaaacaatcaatgggccgtgcactacagcgttcaatggacgcaatacagcaaatttgaagaattaaaagcaacaagtaacgaatgttcaccaggttacaacggggaatcaggcacttgtttgctaaaagaagaagattacgacgacagtttccgctatgcattaggtgctacatacaccatcaatacaacatgggcagtacgtgctggttttgcgtttgacgaacaagccggtcaagcaaccttaagtattcctgataccgaccgttactggtattcagcaggagctacttacacctacaaccaaaatatgtcatttgatctcggcctgacttatctatacggaaaagaaggcaccttcgaagaagatggcagcactttcacttcatccggtggcgccattattagtgccgcacaaatgaactacacattctag

SEQ ID NO: 23594 - protein, 415 aa, Photobacterium profundum SS9
MSKNIKFSAIAVTAAFMSLNVNAAGFQVNEHSASGLGRAFAGDAAIADNAAVLSRNPAAMTLFKTAEISGGFSIVDPSIDVEDKSFGQTAKDVAPVAFVPAGYYIQPINDRFAVGLALFSNYGVTTEYPADFNAGSSAGETSLITVNFNPNIAYRINDNFSIGGGVSLVYGEAELNRHLGSLSAAVPDSSPSDKTITMKGDTFDWGWNIGALYEYNENNRFGLSYRSQVDLDFEGDFTDYLGAITGTPNNTITGKLPVVLPAIAEFSGFHQLNNQWAVHYSVQWTQYSKFEELKATSNECSPGYNGESGTCLLKEEDYDDSFRYALGATYTINTTWAVRAGFAFDEQAGQATLSIPDTDRYWYSAGATYTYNQNMSFDLGLTYLYGKEGTFEEDGSTFTSSGGAIISAAQMNYTF

SEQ ID NO: 23595 - DNA, 1314 bp, Salmonella enterica subsp. enterica serovar Paratyphi A str. ATCC
  CDS (1)..(1314): transl_table=11
atggtcatgagccagaaaaccctgtttacaaagtctgctctcgcagtcgcagtggcaatcatctccacccaggcctggtctgcaggctttcagttaaacgaattttcttcctctggccttggccgggcctattcgggtgaaggcgcaatcgcagatgatgcgggtaacgttagccgcaacccggcgttaattaccatgtttgaccgcccgacgttttcagcgggcgcagtttatattgatcctgatgttaatattagcgggacatcgccatctcgtcggacgttagatgcggataacatcgcgccgacggcctgggtgccgaacgtccattttgtcgccccgattaacgaccagtttggctggggggcttctattacctctaactatggtctggcgacagagtttaacgacacatacgccggcggctcggttggcggtacgaccgatcttgaaaccatgaacctgaatttaagcggcgcttatcgcttaaatgaggcctggagcttcggcctcggctttgatgcggtatacgcacgtgcgaaaatcgaacgttttgcgggcgatttaggccagttggtcgcggcacagaatccggcgctggcgccggtcgcgggtcggattcccagcgacaccaagattgcccacctgaacggtaatcagtggggctttggctggaatgccggtatcctttatgaactggataaaaataaccgctacgcgctgacctaccgctcggaagtcaaaattgactttaaaggcaactacagtagcgatcttcccatcgctataaaccaatttaatctgcctatcccaacggcaaccggcggcgcgacgcagtcaggctacctgacgctgaatctgccggaaatgtgggaagtgtccggttataaccgtgtggcgccacagtgggccatccactatagcctggcctataccagctggagtcagttccaggaattgaaggcaaaatcgaccgctggcgatacgctctttgagaagcatgaaggctttaaagacgcttatcgcattgcgttaggtaccacctattactacgatgacaactggacgttccgtaccggtatcgccttcgatgacagcccggtaccagcgcaaaaccgttctatctctattccggaccaggaccgtttctggctgagcgccggtacgacttacgcctttaacaaagatgcgtctgtcgacgttggcgtctcttatatgcatggtcagagcgtgaaaattaatgaaggcccttatcagtttgaatctgaagggaaagcctggctgttcggtactaactttaactacgcgttctaa

SEQ ID NO: 23596 - protein, 437 aa, Salmonella enterica subsp. enterica serovar Paratyphi A str. ATCC
MVMSQKTLFTKSALAVAVAIISTQAWSAGFQLNEFSSSGLGRAYSGEGAIADDAGNVSRNPALITMFDRPTFSAGAVYIDPDVNISGTSPSRRTLDADNIAPTAWVPNVHFVAPINDQFGWGASITSNYGLATEFNDTYAGGSVGGTTDLETMNLNLSGAYRLNEAWSFGLGFDAVYARAKIERFAGDLGQLVAAQNPALAPVAGRIPSDTKIAHLNGNQWGFGWNAGILYELDKNNRYALTYRSEVKIDFKGNYSSDLPIAINQFNLPIPTATGGATQSGYLTLNLPEMWEVSGYNRVAPQWAIHYSLAYTSWSQFQELKAKSTAGDTLFEKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 23597 - DNA, 1272 bp, Azoarcus sp. EbN1
  CDS (1)..(1272): transl_table=11
atgcatacgacgatgattgcccgggcagtcccggcggcgctgctgacgatggcgtccggcctggcctcggctgccggtttccagctgatggagcagaacgccagcggactcggcaacgcctacgcgggctccgcggcggtcgccgagaacgccgcgacgatcttcttcaatccggccggcatgacgcagctgcaggcgcgcgaagcgtcgttcggcgtgacggcggtgcggccgagcttcgagttcagcgacaagggctcgcaaagcggtgtgctcaggggcgaaggcgacgacgcgggcgggtgggaggcgttgccgaacgcctacctgtcgtgggcgctgaacaaggacctgtatgtcggtgtcggcctcggtgccccgttcggcctcgtcacggattacgacgagtcgtgggtcggtggcgcccagtcgctgaacttcgagatcaagacttacaacatcaacccgtcgatcgcgtaccgcgtcaatgacaagctttcgctcggtgccggcctgaactggcagcgcgccgaagccgagtacgagcgcatcgccgcggtcgcgcccggcctcgccacgacattcgcgacgctcgacgtcgactccgatgcgtggggctggaacatcggcgtgctgttcacgccgtcgccgtcgatgaaaatcggtgtctcgtaccgatcgagaatcgagcacgagctcgaaggcgacctgaagctcaaggggacgctcgcgggccgggtgccgcagacgagcaacggcaaggcccgcgccgatgtcgatctgcccgacacgctgatcatgagcgtcgcgcagaagatcgacgagcgctgggaaatgctcggcgacctgtcgtggacgggctggagcagcatcaggaaagtcgatatcgaccgccgctcggggccgctgtcgggcgtcacggtgcagacgctcgacaccgattatcgcgacagctggcgcgtcgcgctcggcgcgaactacaagctcaacgacgcatggaagctgaagttcggcgtcgcctacgaccaggcgccggtgaggagccgggaccgccggctcgtcgcgctgccggacaacgatcgcacctggtatgcgctcggcgcgcagtggaaagcgacgaagacgacgacgctcgatgtcggcggcgcttatctctacgtgcgcgacacgaagatcgacaacgaccagagcgcggcaggacgcgggcgcgtgaccggcgaatacgagaccgacgtctggctcttcggcgcgcagtactcgatggcgttctga

SEQ ID NO: 23598 - protein, 423 aa, Azoarcus sp. EbN1
MHTTMIARAVPAALLTMASGLASAAGFQLMEQNASGLGNAYAGSAAVAENAATIFFNPAGMTQLQAREASFGVTAVRPSFEFSDKGSQSGVLRGEGDDAGGWEALPNAYLSWALNKDLYVGVGLGAPFGLVTDYDESWVGGAQSLNFEIKTYNINPSIAYRVNDKLSLGAGLNWQRAEAEYERIAAVAPGLATTFATLDVDSDAWGWNIGVLFTPSPSMKIGVSYRSRIEHELEGDLKLKGTLAGRVPQTSNGKARADVDLPDTLIMSVAQKIDERWEMLGDLSWTGWSSIRKVDIDRRSGPLSGVTVQTLDTDYRDSWRVALGANYKLNDAWKLKFGVAYDQAPVRSRDRRLVALPDNDRTWYALGAQWKATKTTTLDVGGAYLYVRDTKIDNDQSAAGRGRVTGEYETDVWLFGAQYSMAF

SEQ ID NO: 23599 - DNA, 1371 bp, Xanthomonas oryzae pv. oryzae KACC10331
  CDS (1)..(1371): transl_table=11
ttgcagtccttatccggagagctacaacttatgtctaccgcttccattctcagccgcgccaccctgctggccgtcggtatcgccggcgtgctggccgttggtcaggcgcacggcgccgcgttccagctgaaggaaaacagcgccaagggcctcggccgcgccttcgcaggttcgggcagcgccccggacgatgcctccatcatggtcaacaacccggccggtatgcgccagttggacggtcgcctgttccaggccgacgtcagcgccatcagcttctcggccaggttccagcctgagtcggccaactacgccaacggcgccccggtctccggcggtaacggcggcgatgccggcatgatcgcgccggtgccggcgatgtacttccacgtgccgttcggcgagaacgacaacatgcacctgggcacctcgctgaccgtgccgttcggcttcaagaccgaatacgaccgcgactgggtcggccgctaccacggcaccaagaccgagctgcaggcgatcgacttcaacgtcgcgttctcctatgacgtgaacccgtacgtgtccttcggcgcctcggtgttcgccgagcgtctggatatcgacctggccaacgccgtcgattttggcagcgtgctggctgcgcgccgcgtgccgggcttcgcgccgggcagcgccgatggctactcgcgcatcaagggcgacagcactgaagtgggcttcactctgggtggcttgttcagcatcgatgagaacacccatatcggcttcagctaccgctcgcaggtggaacacaagatcaccgatggcactgccgacttcaccgtgccgggcagtgctgccgcggtgctgagcgtggccgcaccgggcaccttcgtcgacaccaagggccgcgctaccgtcaagctgccggccagcgcgaccgccagcttcacgcacaacgtgaacgagcagtggtcgatcatggccgacgtcacccgcaccgcctggagcaagttcgaccaggtgaccgtggacttcgcctccaaccagcccgacagtgtgctggacttctcctaccgcgacaccaccttcgcctcgatcggtgccgattaccgcatgagcgatacggtgaccctgcgcggcggcctggcatacgaccagaccccgaccacggccgaacaccgcgacgtgcgcgtgccggacgcgagccgcaagtgggtttcgctgggtatgagctggcgtccgtcggcgcagaccgaatacaacgtcggttacacccacctgttcaccaacaacccgaccagcgatacccgcagcgccaccggcgaccgtctggctggcagctatgacgtgaagggcgacgtgctggccgcgtcgatcaactacaagttctga

SEQ ID NO: 23600 - protein, 456 aa, Xanthomonas oryzae pv. oryzae KACC10331
MQSLSGELQLMSTASILSRATLLAVGIAGVLAVGQAHGAAFQLKENSAKGLGRAFAGSGSAPDDASIMVNNPAGMRQLDGRLFQADVSAISFSARFQPESANYANGAPVSGGNGGDAGMIAPVPAMYFHVPFGENDNMHLGTSLTVPFGFKTEYDRDWVGRYHGTKTELQAIDFNVAFSYDVNPYVSFGASVFAERLDIDLANAVDFGSVLAARRVPGFAPGSADGYSRIKGDSTEVGFTLGGLFSIDENTHIGFSYRSQVEHKITDGTADFTVPGSAAAVLSVAAPGTFVDTKGRATVKLPASATASFTHNVNEQWSIMADVTRTAWSKFDQVTVDFASNQPDSVLDFSYRDTTFASIGADYRMSDTVTLRGGLAYDQTPTTAEHRDVRVPDASRKWVSLGMSWRPSAQTEYNVGYTHLFTNNPTSDTRSATGDRLAGSYDVKGDVLAASINYKF

SEQ ID NO: 23601 - DNA, 1344 bp, Vibrio fischeri ES114
  CDS (1)..(1344): transl_table=11
atgaatacaacattttcgcgtacgctgcttgcaacaagtactttatttattagtgcgacatctatagctggaggatttcaagtaaacgaacattcagctacaggtttaggtcgagcgtttgcaggtgaggcggttattgcagataacgcttcagtattaagtcgtaatgcggcggcaatgacgatgtttgattcaacatccatttcaatggggttaactatggttaagcctgatgtaagtgtggaaaatgtagaatatcaacaactgaaaattaatgaaaatatggggattccgacaggaataggattcaacagtatgacggtttctaatactgatgggattgcaggaacggagtttgttccaaatttttatgtaattcaccccttaaatgataaatgggcatttggattcgcaagttattctaattttgggacaggcacagaatttgaggataactatgatgcttctatttttggtgggaaaacagaggtaaaaagtgccaatatcggttttagtttggcatataagcttaatgaacaatggagttttggtgctggaattgatgttatttatggtattggtaatttatatcgggatcttgacagtacgatttgtaataagccttttgcgggagcaaaagattgttctattaagaaaactaaagccttggatatatcagctactggtgtaggcattggcgggaatgttggtgttgtatatcaggttaatgagcgcaatcgttttggtttaagttataaatacagtccagaagttgaagcggaaggtgatgttgattatttagagaatcatgtacatggcgtgacaagtgatagtgtgtatttaccgctacctgatattgctgaattttcgggttatcatttactaaccgataaagtggcaatccattatagttatcagtggattggttggtctgcatttgattctgttgatattaatgatgttaattctgatcaacgtatttcggtaaaagaatacaattggaaaaactcatatcatatcgctgtaggtacaacttattacttaaataaaaaatggacattacgtgcaggctatatgtttgataaaacgccagtagatgaaattacgtcaatttcgattcctgattcagatagacaatggttttcaactggtttcacttataactggagtaaccaaaccagcgtagattttggttttacgtatttaattggtgaagatgttgaggtttcagaggttcaagatattccggatatgatgggcattactacgcctaatccatctttaactgcaaccacacacgctaatgctgtgttagccgctattcaattgagtcatagtttctaa

SEQ ID NO: 23602 - protein, 447 aa, Vibrio fischeri ES114
MNTTFSRTLLATSTLFISATSIAGGFQVNEHSATGLGRAFAGEAVIADNASVLSRNAAAMTMFDSTSISMGLTMVKPDVSVENVEYQQLKINENMGIPTGIGFNSMTVSNTDGIAGTEFVPNFYVIHPLNDKWAFGFASYSNFGTGTEFEDNYDASIFGGKTEVKSANIGFSLAYKLNEQWSFGAGIDVIYGIGNLYRDLDSTICNKPFAGAKDCSIKKTKALDISATGVGIGGNVGVVYQVNERNRFGLSYKYSPEVEAEGDVDYLENHVHGVTSDSVYLPLPDIAEFSGYHLLTDKVAIHYSYQWIGWSAFDSVDINDVNSDQRISVKEYNWKNSYHIAVGTTYYLNKKWTLRAGYMFDKTPVDEITSISIPDSDRQWFSTGFTYNWSNQTSVDFGFTYLIGEDVEVSEVQDIPDMMGITTPNPSLTATTHANAVLAAIQLSHSF

SEQ ID NO: 23603 - DNA, 1299 bp, Vibrio fischeri ES114
  CDS (1)..(1299): transl_table=11
atgaacaacaataaaaatcgtctatctatcgcagtggcacttggcctattaggttcagttgcaagctcaaacactatggctgcaggtttccaacttgcagaatattcagctacaggtctaggccgtgcttacgcaggtgaagcagcgatcgctgatggtgctgacgcacaatggcgcaacgttgcaatgctgacatatttagaaggtactcaagtttctgttggtggtatctacgtaaaccctaatattgatgttgaaggccaatcaagtatgagcccaacatcaactaaatcagaagactttgcacacgatgcttttattccaaacttgtatgtttcacaccgtgtgaatcaacaactagccatcggtttcgcagttggcactaactacggtatggaaacagacttaggtactgactttacaggtaccaactttggtaatgaagctagtgttattactaaagaaattaatgtaaatatggcttaccaaattaaccaacaattcagtattggtggtggcgttcgttacgttattgcggaaggtagtttcggggctgtagcaccaacacaaacaccaacatttcatccatcacttcctaaaccaggtacaactctaaaatacatggaaggaacagacgaggcatggggatggcaagtaggtactgcgtggcaaatcaatgatacaaaccgtatcggatttaactataaatcagaagtaaaactagatttaacaggccatgcaaatggtgttggttttgatctgtatgcaaagaacccaagtgatagatactcaggttcaatggaattagctctcccagcaacagctgaacttgcaagctttcaccaactaaatgataagctagcaattcacgcaagctttaactggacagactggagcagctttgaaaaattagaagctaatatcccatcacttaaagttgcgactcaggagattaagcaagaaaattgggaagataactatcgcttagctgttggcggtacttacgctcttgatcaaaaagtaacgttacgtacaggtattgcttacgatacttcagcagtaagcgaagaaaaccgaacggcaacaatccctgaaactgaccgtttatggttaagtatgggtgcaggctacgcttggtctgataacctaactctagatgccggttttacatatatttttgcaaaagatgcaaaaatgcatgaaaaagatccaaaatcagctccattcggcggtacatttgaaggggaaacaactggtaatgtatggctagttggtgttcaagcgaactaccgtttctaa

SEQ ID NO: 23604 - protein, 432 aa, Vibrio fischeri ES114
MNNNKNRLSIAVALGLLGSVASSNTMAAGFQLAEYSATGLGRAYAGEAAIADGADAQWRNVAMLTYLEGTQVSVGGIYVNPNIDVEGQSSMSPTSTKSEDFAHDAFIPNLYVSHRVNQQLAIGFAVGTNYGMETDLGTDFTGTNFGNEASVITKEINVNMAYQINQQFSIGGGVRYVIAEGSFGAVAPTQTPTFHPSLPKPGTTLKYMEGTDEAWGWQVGTAWQINDTNRIGFNYKSEVKLDLTGHANGVGFDLYAKNPSDRYSGSMELALPATAELASFHQLNDKLAIHASFNWTDWSSFEKLEANIPSLKVATQEIKQENWEDNYRLAVGGTYALDQKVTLRTGIAYDTSAVSEENRTATIPETDRLWLSMGAGYAWSDNLTLDAGFTYIFAKDAKMHEKDPKSAPFGGTFEGETTGNVWLVGVQANYRF

SEQ ID NO: 23605 - DNA, 1152 bp, Vibrio fischeri ES114
  CDS (1)..(1152): transl_table=11
atgaaacccttttttagctactctttaactgcctctgctgttttgctcagttttaatgccttttctagcggattatttcttcaggaagcaaccgttgcgaatgctggtacaacaggcgcaggagacggcgtttacactgaatctgcggctgcaatgtggacaaaccctgccaccatgtcctacatgggagagagtaaaacaaccatcaatgccatggcgtttgatttagaaatgaaatttaatgataacaatggttcagaagatggcaaagcacattcaattttaccttcagctggcgcttttcatactcaagcgataacagacaaattacactttggtttagcacttggcgctgttggaggctcaagcttagactatggtagtgactgggctggcagtaaactattagaagatatcagcttgactgcaatgcagttaaatcctgctttaagttatcaagtaaatgaacgattatcattaggggctggtttacaatttagctgggcttcttttgagcaatcaatgtcaggaattactgctgaaaaagattcagattgggcatatggctataatctaggcgttatgtatcaagtttcagaacaagcatccatgggcttaagctaccgttcaaaacttgagcatgaatttaataataacattagcttagataattttaatccaacgctttcgagtggaatgatcatgcctgatattgttgacctcagcaccagttatgcattaagtaaagatgtaaacttattaagtagcatacagttgcaccgttggagccactgggattcgaccattttagacgcaaacctaggtaatggtggtgccgaaataaaacgagattgggatgatgcatggaaattcgccatcggtgctgattatcgtctaaattctgattggcgtttaaaggctggattctcatatgaaacctcacctcaagatgatccttcgatgcaatgggtagatttaccggtaggtgaacaatatcgctactctgttggtgcatccacatcatgggacggtattacaatggatatgttttatgaatacgccgatttaggctctgttgatatggatcgtttaaatgtgaatggtaccttcgacggcagaatccactttgtgggcgtaaactttactttttaa

SEQ ID NO: 23606 - protein, 383 aa, Vibrio fischeri ES114
MKPFFSYSLTASAVLLSFNAFSSGLFLQEATVANAGTTGAGDGVYTESAAAMWTNPATMSYMGESKTTINAMAFDLEMKFNDNNGSEDGKAHSILPSAGAFHTQAITDKLHFGLALGAVGGSSLDYGSDWAGSKLLEDISLTAMQLNPALSYQVNERLSLGAGLQFSWASFEQSMSGITAEKDSDWAYGYNLGVMYQVSEQASMGLSYRSKLEHEFNNNISLDNFNPTLSSGMIMPDIVDLSTSYALSKDVNLLSSIQLHRWSHWDSTILDANLGNGGAEIKRDWDDAWKFAIGADYRLNSDWRLKAGFSYETSPQDDPSMQWVDLPVGEQYRYSVGASTSWDGITMDMFYEYADLGSVDMDRLNVNGTFDGRIHFVGVNFTF

SEQ ID NO: 23607 - DNA, 1284 bp, Pseudomonas syringae pv. syringae B728a
  CDS (1)..(1284)
atgaaaataatgacaaaagcactgaaccggacaacgcttggactcgcactgggtctggcttcttctcaactgctcgctgccggctttgccctcaacgaacaaagcatcagcggcatgggcaccggctttgcaggtcgctcctcgtcagccgatgacgcaagcaccgtattcggcaaccctgccggtatgtcccgcatcaaacgcgaacaaatcagcgtcggtgcagctgccgtgatcgccaagaccgatatcgacaatggtcgtggcacatttggcggcagcaacgacggcgatatggttccggtggtcggcgtacccatgggctattacgtcaaaccaatcgatgatcactgggcatttggtctgggcgtgtacgtaccgttcggcctggtcaccgattacgaaaaaggcttcgctggccgctactggggtgacaagagtcacgtccaggtcgtgaccttccagccgaccgtcagctatgcattcaacgacaaggtgtccatcggtttcggcccgacgatcaaccgtatcgacggtgaactgacctcggcaacattgaacgccgcaacaccgggccgtaacgacggcaaagtgaagatcgaaggcgatgacaccgcaatcggcttcaatgccggtattttggtgcaggctaccgacaccactcgcctgggcctgacttaccactccaaggtcgattacaagctcaagggcaagaccaagatcgaaggttcgggtttcggtcctttcggcggccagaagtatgacgcttcgctggatatctccacacccgagtccgtggacttctccatcacccagcagatcgacgaaaactggacggtctatgccggcagcacctggactcgctggagccgcctgcaagacatcaccgtcaacaacgatggcgtccctgccttactgggcggttctgccggcccaatcggcaccattactgaagagcagaactggcacgacacctgggcgcacgccatcggcgcctcgtacaaggtcaataaagagtggacgctgcgcaccggcttctccgttgatcagtcgccgaccaacaacgtcaaccgctcccctcgcatcccgaccggcgatcgcaagatcatcagcttcggtgcaggctggagcccgaccgacgacctgaccatcgacgtggcgtactcgtacctgcgtgaagacgaaaccaagatccgcgattccagcgcgaccaaaggttcgtacagcgccgactaccgtaacaccgctcacggcctgggcacttcggttacctatcgcttctga

SEQ ID NO: 23608 - protein, 427 aa, Pseudomonas syringae pv. syringae B728a
MKIMTKALNRTTLGLALGLASSQLLAAGFALNEQSISGMGTGFAGRSSSADDASTVFGNPAGMSRIKREQISVGAAAVIAKTDIDNGRGTFGGSNDGDMVPVVGVPMGYYVKPIDDHWAFGLGVYVPFGLVTDYEKGFAGRYWGDKSHVQVVTFQPTVSYAFNDKVSIGFGPTINRIDGELTSATLNAATPGRNDGKVKIEGDDTAIGFNAGILVQATDTTRLGLTYHSKVDYKLKGKTKIEGSGFGPFGGQKYDASLDISTPESVDFSITQQIDENWTVYAGSTWTRWSRLQDITVNNDGVPALLGGSAGPIGTITEEQNWHDTWAHAIGASYKVNKEWTLRTGFSVDQSPTNNVNRSPRIPTGDRKIISFGAGWSPTDDLTIDVAYSYLREDETKIRDSSATKGSYSADYRNTAHGLGTSVTYRF

SEQ ID NO: 23609 - DNA, 1341 bp, Xanthomonas campestris pv. campestris str. 8004
  CDS (1)..(1341): transl_table=11
atgtctaccgcttccactctcagccgcgccaccctgctggccgttggtattgccggcgtgctggccgttggccaggcacacggtgccgccttccagctgaaggaaaacagcgccaagggcctcggccgcgccttcgcaggttcgggcagcgccccggacgacgcatcgatcatcgccaacaacccggccggcatgcgccagctggacggccgcctgttccaggccgacgtcagcgccatcagcttctcggccaagtaccagggcgaaggcggcagctacgccaacggcgccccgatctccggcggtaacggcggcgacgcgggcatgatcgcgccggtcccggcagcgtatttccacgtgccgttcggtgagaacaacaacatgcacctgggtacgtcgctgaccgtgccgttcggcttcaagaccgaatacgaccgcgactggaccggccgctaccacggcaccaagaccgagctgcaggcgatcgacttcaacgtcgcgttctcctacgacgtgaacccctacgtgtcgttcggcgcgtcggtgttcgcggagcgtctggatatcgacctgggcaacgcggtggacttcggcagcatcctggccgcgcgtcgcgcaccgggcttcgcgccgggcagcgccgatggctactcgcgcatcaagggcgacagcaccgaagtgggcttcaccctcggcggcttgttcagcatcgatgagaacacccacatcggcttcagctaccgctcggaagtggagcacaagatcaccgacggcgacgccgacttcaccgtgccgggcaatgccgctgccgcgctgggcttcgccgcaccgggcaccttcatcgataccaagggccgcgccaccgtgaccctgcccgccagcgccaccgccagcttcacccacaacgtgaacgagcagtggtcgatcatggccgacgtcacccgcaccgcctggagcaagttcgaccaggtgaccgtggacttcgcctccaatcagcccaacagcgtgctggacttctcctaccgcgacaccaccttcgcctcgatcggtgccgactaccgcatgagcgagacgctgaccctgcgtggcggtgtggcgtatgaccagaccccgaccaccgccgagcaccgtgacgtgcgcgtgccggacgcgagccgcaagtgggtctcgctgggtctgagctggcgcccgtcgcagcaggccgagtacaacttcggctatacgcacctgttcaccagcgatccgaccagcgacaccaccactgccaccggcaacgcgctggccggcagctacaaggtgcacggcgacgtgctggccgcgtcgatcaactacaagttctga

SEQ ID NO: 23610 - protein, 446 aa, Xanthomonas campestris pv. campestris str. 8004
MSTASTLSRATLLAVGIAGVLAVGQAHGAAFQLKENSAKGLGRAFAGSGSAPDDASIIANNPAGMRQLDGRLFQADVSAISFSAKYQGEGGSYANGAPISGGNGGDAGMIAPVPAAYFHVPFGENNNMHLGTSLTVPFGFKTEYDRDWTGRYHGTKTELQAIDFNVAFSYDVNPYVSFGASVFAERLDIDLGNAVDFGSILAARRAPGFAPGSADGYSRIKGDSTEVGFTLGGLFSIDENTHIGFSYRSEVEHKITDGDADFTVPGNAAAALGFAAPGTFIDTKGRATVTLPASATASFTHNVNEQWSIMADVTRTAWSKFDQVTVDFASNQPNSVLDFSYRDTTFASIGADYRMSETLTLRGGVAYDQTPTTAEHRDVRVPDASRKWVSLGLSWRPSQQAEYNFGYTHLFTSDPTSDTTTATGNALAGSYKVHGDVLAASINYKF

SEQ ID NO: 23611 - DNA, 1281 bp, Pseudomonas fluorescens Pf-5
  CDS (1)..(1281): transl_table=11
atgaaaaaagtaatgctcaaatccaccataagtctcgcggttgcacttgcctctacccaacttttcgccagcggttttgctcttaacgaacaaagcatcagcggcatgggtaccggcttcgcgggtcgttcctcttctgccgaagatgccagcaccgtttacggtaaccctgccggcatgtccctgctgcaacgtgaccaggtaactgtcggcgttgcggcaatcgatgccaagaccaacctgaaaaacgtcaagggcggcccacccggcggcaccagcgacggcgacatggttccgttcaccagcgttcctatggggttcttcgtcaaacaactgggcaacggctgggcattgggtctgggcgcctatgcccccttcggcctggttaccaactatgagtcgacttctgccagccgctattacggcgacaagagcgtagtcaaggtcgtcaccctgcaaccgaccgtcagctatgccttcaatgacatggtgtcgatcggcttcggcccgaccatcaaccgcctgagcggtgaactgacttccgcgactccgtttccaaaccctgcgctcttcggccgcaatgatggcagcgtgaagatcaagggtgacgataccgccatcggctacaacgtcggcatcatcgtccagcctaccgacactactcgcctgggcctgacctaccactccaaggtcaagtacaagctggaaggccacaccaacatcgccggcccgggcttcggtccgttcaatggcggccgttacgatgcctcgctggacatcactactccggaagtcgtcgacttctctgtcacccagaaactggatgaccagtggaccgtctacgcaggtagcacttggactcgctggagccgcctgaaagacatcaccgtgaacaacgaaggtgttcctgccctgcttggcggttccaggggcccgatcggcaccatcaccgagccacagaactggcacgacacctgggcctcggctgttggtgtttcctacaaggtcaacaaagagtgggttctgcgcagcggcctctcggttgaccaggcgccaaccaacaacaccgaccgttctgtacgtatccctaccggtgaccgtaaggccatcagcttcggtgccggctacagcccgactgaagacctgactctggacctggcggtttcctacctgaaggaagaggacgtcaacgtcaacagaaccggcaaaggcaatgcctacagcgctacttaccagaacagcgcatggggctacggcctgggcgccacctacaagttctaa

SEQ ID NO: 23612 - protein, 426 aa, Pseudomonas fluorescens Pf-5
MKKVMLKSTISLAVALASTQLFASGFALNEQSISGMGTGFAGRSSSAEDASTVYGNPAGMSLLQRDQVTVGVAAIDAKTNLKNVKGGPPGGTSDGDMVPFTSVPMGFFVKQLGNGWALGLGAYAPFGLVTNYESTSASRYYGDKSVVKVVTLQPTVSYAFNDMVSIGFGPTINRLSGELTSATPFPNPALFGRNDGSVKIKGDDTAIGYNVGIIVQPTDTTRLGLTYHSKVKYKLEGHTNIAGPGFGPFNGGRYDASLDITTPEVVDFSVTQKLDDQWTVYAGSTWTRWSRLKDITVNNEGVPALLGGSRGPIGTITEPQNWHDTWASAVGVSYKVNKEWVLRSGLSVDQAPTNNTDRSVRIPTGDRKAISFGAGYSPTEDLTLDLAVSYLKEEDVNVNRTGKGNAYSATYQNSAWGYGLGATYKF

SEQ ID NO: 23613 - DNA, 1260 bp, Colwellia psychrerythraea 34H
  CDS (1)..(1260): transl_table=11
atgacattcaataaaacattgttaacactatcgttaacctgttcatcattttacagtgtcggcgccgcctttcagttggctgagcatagtgctgctggtttaggtcgagcgtttgctggtgaagctgcaattgccgatgatgcatctgtaattgcacgcaaccctgcccttatggcgcaatttgatcaaatagagttatcatttactggcacttacgttatacctgatgtcagcttaacgggtattgatgcaccaacgggtattaacccagtagcattgaatgatagtagtattgcgccaagtgccatcattccagcaatatatctagtagtgccgctaaatgacaagtttgctctaggttttggcaccttctctaattttggtttagccactgagtttgatgatgattatgctgcggggcaactcgcgggggaaacgtcaattactacggttaattttaattccagcctctcttataaagtaaatgataactttgccatagctggggggttaaatgttatttatgccgatgcttccttaatacgtaattttggtgacagtccgctgccttcgccacctgaaacggtggccgcaaatttggctggcgatgatatatcctatggttggaacctaggtttatcgtatgattttaacgaaaacaatagactaggttttagttatcgaagtgaagtagaactaacacttgaaggtgattacagtaatggtttaccagctaaccttggtggcttagcgggtgacgtagtcatgggcaccatggatataaccttgccagctattatggagttttcaggttttcatcaattaaatagttccttagctgtgcattactcagccgtgtggactggttggagtagttttgatgagctagcgggatacgctgaaggtgtagaagaccctgtgttttcaaaagaagagaactttgctgattcaatgcgatatgccattggtgccacctatcaattaagtagcaatataaagctcagaacaggtattgcttatgaccaaacacccaccggtgaagaacatcgatcgatctcaattcctgatagtaatcgtatatggataagtggcggcttaaactatagctttgacgaccaatcatcgatagatttaggtgtcagtgtcattcaaggcaatagtgaaacattcactgaaaaagatgacttaggtcaacagtggacattcgaatcacaaggtgatgcttacattgtttctgcacaatataaccatgttttctaa

SEQ ID NO: 23614 - protein, 419 aa, Colwellia psychrerythraea 34H
MTFNKTLLTLSLTCSSFYSVGAAFQLAEHSAAGLGRAFAGEAAIADDASVIARNPALMAQFDQIELSFTGTYVIPDVSLTGIDAPTGINPVALNDSSIAPSAIIPAIYLVVPLNDKFALGFGTFSNFGLATEFDDDYAAGQLAGETSITTVNFNSSLSYKVNDNFAIAGGLNVIYADASLIRNFGDSPLPSPPETVAANLAGDDISYGWNLGLSYDFNENNRLGFSYRSEVELTLEGDYSNGLPANLGGLAGDVVMGTMDITLPAIMEFSGFHQLNSSLAVHYSAVWTGWSSFDELAGYAEGVEDPVFSKEENFADSMRYAIGATYQLSSNIKLRTGIAYDQTPTGEEHRSISIPDSNRIWISGGLNYSFDDQSSIDLGVSVIQGNSETFTEKDDLGQQWTFESQGDAYIVSAQYNHVF

SEQ ID NO: 23615 - DNA, 1284 bp, Pseudomonas syringae pv. phaseolicola 1448A
  CDS (1)..(1284): transl_table=11
atgaaaataatgacaaaaacactgaaccggacaacacttggactcgccctgggtctggcttcttctcaactgcttgcagccggttttgccctaaacgaacaaagcatcagcggcatgggcacaggctttgcaggtcgctcctcgtcagccgatgatgcaagcaccgtattcggcaaccctgccggcatgtcccgaatcaaacgcgaacaaatcagcgtcggcgccgcagccgtgatcgccaagaccgacatcgacaacggtcgcggcacattcggcggcagcaacgacggtgacatggttccggtggtcggcgtgccaatgggctattacgtcaaacctatcgatgatcactgggcatttggtctgggcgtgtacgtcccgttcggcctggtcactgattacgaaaaaggcttcgccggccgctactggggcgacaagagtcacgtccagatcgtgaccttccagccaactgtcagctatgcattcaatgacaaggtttccatcggtttcggcccgaccatcaaccgcatcgacggtgaactgacctcggcaacattgaacgccgcaacaccgggccgtaatgacggcaaggtgaagatcgaaggcgatgacaccgcaatcggcttcaatgccggcattctggtgcaggctaccgacaccactcgtctgggcctgacttaccactccaaggtcgattacaagctcaagggcaagaccaagatcgaaggctcgggcttcggcccgttcggcggccagaagtacgatgcttcgctggacatctccacgcctgagtcggtggacttctctatcacccagcaactcgacgagaactggactgtttacgcaggcagtacctggactcgctggagccgcctgcaggacatcaccgtcaacaacgatggcgtccctgctctgctgggcggttctgccggcccaatcggcaccatcaccgaagaacagaactggcacgacacctgggcgcacgccatcggtgcctcgtacaaggtcaataaagagtggaccctgcgcacaggtttctccgttgatcagtcgccgaccaacaacgtcaaccgctccccacgcatcccgactggcgatcgcaagatcatcagtttcggcgcaggctggagcccgaccgacgacctgaccatcgacgtagcgtactcgtacctgcgtgaagacgaaaccaagatccgcgactccagcgcgaccaaaggttcgtacagcgctgactaccgcaacaccgctcacggcctgggcacttcggttacctatcgcttctga

SEQ ID NO: 23616 - protein, 427 aa, Pseudomonas syringae pv. phaseolicola 1448A
MKIMTKTLNRTTLGLALGLASSQLLAAGFALNEQSISGMGTGFAGRSSSADDASTVFGNPAGMSRIKREQISVGAAAVIAKTDIDNGRGTFGGSNDGDMVPVVGVPMGYYVKPIDDHWAFGLGVYVPFGLVTDYEKGFAGRYWGDKSHVQIVTFQPTVSYAFNDKVSIGFGPTINRIDGELTSATLNAATPGRNDGKVKIEGDDTAIGFNAGILVQATDTTRLGLTYHSKVDYKLKGKTKIEGSGFGPFGGQKYDASLDISTPESVDFSITQQLDENWTVYAGSTWTRWSRLQDITVNNDGVPALLGGSAGPIGTITEEQNWHDTWAHAIGASYKVNKEWTLRTGFSVDQSPTNNVNRSPRIPTGDRKIISFGAGWSPTDDLTIDVAYSYLREDETKIRDSSATKGSYSADYRNTAHGLGTSVTYRF

SEQ ID NO: 23617 - DNA, 1452 bp, Pseudomonas syringae pv. phaseolicola 1448A
  CDS (1)..(1452): transl_table=11
atgcccttgtcaacgttaaggacttacccacgaggtgtgtactatagggatcctatttttgcgttgataaaatcgcaggtttgccagcgcatggaatgcctgaaaacactttgcaggtgtatgcaggcagtttccccttcaaacgggttgaccggaccccctttactgcgagcattgaacaccatgcacaagacgaccctgggcttcacggttgccatgatttccacgcacttgtatgcaggtggctttgcgcttaacgagcaaggtataagcggcatgggcacagcgtttgcgggccgggcctctgccgccgaagatgccggcacggtatacggcaaccctgcaggcatggcgcgtctggccggccagcaggtcaccggtggtgctacctttatcgatgcatcgacggatatcagccaggcgagtggacgttcgagcggcagcaacgatggcgacatggtgccattcaaggccatcccgttcggtttttatactcgcaggctgaatgaacactgggccatcggccttggcgcgtacgtgccgttcggtctggcgacggattacgaacgcggttttcaagggcgcgcctttgccagcaagagcgatgcaaaagttctgaccctgcaaccgacattgagttatgccttcaatgacagggtatcggtgggcttcgggccgaccatcaatcagtttgccggctcgctggagtcggacctgacgcttaacccggccatcgccgacagtaatgtgaaggtgaagggcaaggatgtcgcgctgggcttcaatatcggcgttctggccagcctgactgataccacgcaggctggtttgacctaccactccaaagtgcgctacgacctggattgccacaccgaggttgccacaggtgccggtacgccagcccagttgctgagcagcaatcgctatgactgctcgctacaggtcgatactcctgaatcctacgaattgtcagtcacccagaagctcaccgatgcctggacactttatgcggggacgacctggacgcgctggagccgcatgaaggacctgagtttcagcaccgagaacatcaggcctgcgcgtggagggatacttgctgcgtccttgtctggcgctatcgctggcgggctggactggcacgatacctgggcgtatgcgctcggcacatcgtatcgactggattcacactggtcgttgcgtaccggcattcgtctggatcagtcaccgaccagcaataccaatcgctcgccacgcacaccgaccggcgaccgtacgatcttcagtgtgggggcgggttatgacgtcagcaaagaactgacccttgatgttgcctacgcctatcttaaagaagaaagcgttgatgtcagccgtgccaatgcgctggccagttacagcgcgcgctatcagaaccgcgccagctttttgggcgtgggggcgacttaccgtttctga

SEQ ID NO: 23618 - protein, 483 aa, Pseudomonas syringae pv. phaseolicola 1448A
MPLSTLRTYPRGVYYRDPIFALIKSQVCQRMECLKTLCRCMQAVSPSNGLTGPPLLRALNTMHKTTLGFTVAMISTHLYAGGFALNEQGISGMGTAFAGRASAAEDAGTVYGNPAGMARLAGQQVTGGATFIDASTDISQASGRSSGSNDGDMVPFKAIPFGFYTRRLNEHWAIGLGAYVPFGLATDYERGFQGRAFASKSDAKVLTLQPTLSYAFNDRVSVGFGPTINQFAGSLESDLTLNPAIADSNVKVKGKDVALGFNIGVLASLTDTTQAGLTYHSKVRYDLDCHTEVATGAGTPAQLLSSNRYDCSLQVDTPESYELSVTQKLTDAWTLYAGTTWTRWSRMKDLSFSTENIRPARGGILAASLSGAIAGGLDWHDTWAYALGTSYRLDSHWSLRTGIRLDQSPTSNTNRSPRTPTGDRTIFSVGAGYDVSKELTLDVAYAYLKEESVDVSRANALASYSARYQNRASFLGVGATYRF

SEQ ID NO: 23619 - DNA, 1206 bp, Dechloromonas aromatica RCB
  CDS (1)..(1206): transl_table=11
atgaataagatgaacctgcgtatcgtcccagcactgctgttggctatcttttccggcaccgcctcggctgctgccttccagctttgggagcaaaatgccagcggcctggggaatgcttatgcgggctcggcagcggtggcggataacgccagtacggttttcttcaatccggcggggatgacgcaactgtcaggcttccagttctctgctggggtaaccggggttgggccgagctatgagtttcgtgacaatggctcgaccggagcattcaagggtagcggcaacggcggtgacgcgggcggctggaatgccgttcccaatctctatttgtccgggcatctgaccgataatctttcgatcggctttggcgtttcggccccatttgggctggcgactgaatacgacagcaactgggtcgggcgtgttcaggcgatcaagtcagagatcaagaccgtcaactacaacccgtcgcttgcctatcgcgtcaacgacaaggtttcgctgggttttggcatcaattatcagcaactggatgctgaaattaccagttacaccccggctggtctctaccgggtcaagggtgacgattcgacctggggatggaatgccggtgctttgtttacactttctcccgccatgcgcgttggtgtgtcttaccgctcggcagtgaattacacgctggaaggaacccgttcggtcggggctaattccgttgccgccaaggcggacatcaagctgccagatacttttatcctgtcggtctggcaacaggtttcggatcgttgggaagcgatgggcgatttgtcctacacgcgctggagcaccctggatcgtctggatgttcgcagctccgctggcgttgataccgagatcttcaactatgaaaactcctggcgacttgcctggggtgctgcctacaaggccagtgatgcactcaaggtgaaattcggtattgcctatgaccggacgccggtgcgcgatgaataccgttcggctcgcgtgcccgacaacgatcgtttgtggttgtcgctgggcggacagtggaatgccggtcgctatggcaaggtcgatgtcggctactcctatctttacgtcaaggacccgtctatccagcagtccaaggtggtgggagtagcccacgaattgcgtggcgattacaacgccagtgcccatatcgttggcgcgcaatactcggtgggtttctaa

SEQ ID NO: 23620 - protein, 401 aa, Dechloromonas aromatica RCB
MNKMNLRIVPALLLAIFSGTASAAAFQLWEQNASGLGNAYAGSAAVADNASTVFFNPAGMTQLSGFQFSAGVTGVGPSYEFRDNGSTGAFKGSGNGGDAGGWNAVPNLYLSGHLTDNLSIGFGVSAPFGLATEYDSNWVGRVQAIKSEIKTVNYNPSLAYRVNDKVSLGFGINYQQLDAEITSYTPAGLYRVKGDDSTWGWNAGALFTLSPAMRVGVSYRSAVNYTLEGTRSVGANSVAAKADIKLPDTFILSVWQQVSDRWEAMGDLSYTRWSTLDRLDVRSSAGVDTEIFNYENSWRLAWGAAYKASDALKVKFGIAYDRTPVRDEYRSARVPDNDRLWLSLGGQWNAGRYGKVDVGYSYLYVKDPSIQQSKVVGVAHELRGDYNASAHIVGAQYSVGF

SEQ ID NO: 23621 - DNA, 1329 bp, Dechloromonas aromatica RCB
  CDS (1)..(1329): transl_table=11
atgcacaaaaacctcgcaccgcgtctgatcccggcgctgattgccattgcgttttcaggtggcgcttcagcttctggcttccagttgcttgaacaaaacgctagtggcctgggtaattcctatgccggttccgcagcagttgcagaaaatgccagtacgattttctacaatccggccggcatgacacagttgaagggtttgcaggtttccggtggcttgactgcaatacacaccagctacaagttctccgaccaaggctctagtgttggtgttttgcagaattctggtaacggtggagatggcggtggctggggttatttgcctaatgcgtacatttcttgggaagctaccaaagacttgtatcttggcctgggtatcggtgcgccttttggcttgaagaccgagtacaacaacccatggcaaggtggggcgcagtctctaaaatttgatatcaagacagtcaatatcaatccgagcattgcttggcgggcgaatgagtttgtttcagttggtgctggtatcaactatcagaaattgaccgctgaatacgagcgtcaggtagctgttgcaagtacttctggtcttgctgttgcaacaatgctttctacaacgaaggcaacactgaatctggatgatgatgcatgggggtggaatgttggcgccctgttttccattaacccaactaccaaaatcggtgtttcttatcgttcggctgtgaaatatgatttgacgggagatttcaagtttgatggaacactggctcaatcgagcaatccattgttgggtggggcaactaaagatcgtagtgcaaaagctaccttgaaggtgcctgatacttggattcttagcgccacgcatgctttgaatgatcgtgtcgagttgttgggtgatatctcttggacgggctggagttcaattcccaaagtagatgtttataacgcacaaacaactggtgcgggagcagtttctggccgtatcgcacagactctcgacacagagtttcgcgatacgtggcgtgtcgctgctggtgcgaactaccgatatacggaagctttaaagttcaagtttggtattgcttatgatcaaacgccggtgaagggcgcgtctactcgtcttgtttccttgccagacaacaaccgtatctggctctcgtttggtacccaatggaagccgaccaaggattcggcagtggacctcggtattgctcaccttttcgtcaaggattcaaagattgacaacgatcagtctgcagcaggacgtggtcgtgttaccggtacgtttgccgacagtgcttggatttttggtttgcaatactcagcagcgttctaa

SEQ ID NO: 23622 - protein, 442 aa, Dechloromonas aromatica RCB
MHKNLAPRLIPALIAIAFSGGASASGFQLLEQNASGLGNSYAGSAAVAENASTIFYNPAGMTQLKGLQVSGGLTAIHTSYKFSDQGSSVGVLQNSGNGGDGGGWGYLPNAYISWEATKDLYLGLGIGAPFGLKTEYNNPWQGGAQSLKFDIKTVNINPSIAWRANEFVSVGAGINYQKLTAEYERQVAVASTSGLAVATMLSTTKATLNLDDDAWGWNVGALFSINPTTKIGVSYRSAVKYDLTGDFKFDGTLAQSSNPLLGGATKDRSAKATLKVPDTWILSATHALNDRVELLGDISWTGWSSIPKVDVYNAQTTGAGAVSGRIAQTLDTEFRDTWRVAAGANYRYTEALKFKFGIAYDQTPVKGASTRLVSLPDNNRIWLSFGTQWKPTKDSAVDLGIAHLFVKDSKIDNDQSAAGRGRVTGTFADSAWIFGLQYSAAF

SEQ ID NO: 23623 - DNA, 1371 bp, Ralstonia eutropha JMP134
  CDS (1)..(1371): transl_table=11
gtgagaggcaactacgttcgcgtggccgtggcgctatgcgctgcggcgtgcggaacaccagcgggagcaacggacgtgttcaacctggagggctttggtccagtttcccgcgctatgggcgggaccggagcggccttcgacatcgggccagcggcgatgatggcgaatccggcaacacttggcctgatggccgaggggaatcacctgcatcttgggctcgacatggtgaccaccgacatcaaggccaccaatacggcaacgggcgagacggcccggtccggcaaccacggcaacaacaacgggccttactttgcgcccgaggccgcgttcgtctaccgtcatgacaacatcgcgctaggcgccggaatctttgcggagggcggcctcggtacgcaatacgggggcagcagtttcctgtcgcgcacgtccaatggcgtgcagacgggcctggaccagttctcccggttgctggtgctgcgcattccgtttgcggtggcctatcggccgacggacaagctgacgctcggcgcctcgctggatgcggtctggacgtcgctcaatctcggcacgctgctcgacgtcacgcagatcggcacgcttgccagccagcggcgggtgtctggttcgctggtgcccacgctgctttccgtgcccggcctttccggggggtacctgggcttctcgaacagcgcgcccgtcggtggcggggccgatgcctggggcatcggcggaaaactggggctgacctacgacatcacgcccgatacccgcgtaggactggcctacaacgcgaaaacgcgggtgggcgatcttcgcgggcaggccacgcttgcggctgtcagcaccgtcgcgggcaacattccgctgagcggcgaagtcagggtgcgggacttccagatgccggcgcagttcacggtgggcatcagccaccagttcaacgagcgactgtcggcttcggcggactaccagcgagtgttctggtcgagcgtgatgcgtgacatcaacgtcaccttcacgcgtgggggcgcgaacctcgacctgtcgctaccgcagaactaccgcgataccaacgtgttcggccttggcgtggcgtaccgtttcgattcggcctggacggtgcgcggcgggttccactatgcgcaagaagccataccgaacggcatgctgctagccgttgtgccggccattcccacgaccaccctgagtggcggcgcgacttacgcattcggcaaggacgacgcgatcgattttgccttgtcggtggtgttaccaaagaccgtggggaacgccagccagccgaatactgcggtaccgctcaccgtgcggcattcgcagctcaacgcggttctggcataccgcaagcgcttctag

SEQ ID NO: 23624 - protein, 456 aa, Ralstonia eutropha JMP134
MRGNYVRVAVALCAAACGTPAGATDVFNLEGFGPVSRAMGGTGAAFDIGPAAMMANPATLGLMAEGNHLHLGLDMVTTDIKATNTATGETARSGNHGNNNGPYFAPEAAFVYRHDNIALGAGIFAEGGLGTQYGGSSFLSRTSNGVQTGLDQFSRLLVLRIPFAVAYRPTDKLTLGASLDAVWTSLNLGTLLDVTQIGTLASQRRVSGSLVPTLLSVPGLSGGYLGFSNSAPVGGGADAWGIGGKLGLTYDITPDTRVGLAYNAKTRVGDLRGQATLAAVSTVAGNIPLSGEVRVRDFQMPAQFTVGISHQFNERLSASADYQRVFWSSVMRDINVTFTRGGANLDLSLPQNYRDTNVFGLGVAYRFDSAWTVRGGFHYAQEAIPNGMLLAVVPAIPTTTLSGGATYAFGKDDAIDFALSVVLPKTVGNASQPNTAVPLTVRHSQLNAVLAYRKRF

SEQ ID NO: 23625 - DNA, 1218 bp, Thiobacillus denitrificans ATCC 25259
  CDS (1)..(1218): transl_table=11
atgtcactttgcttcaagcggctcgccgcaagccttgcgcttgcggcggccggcggcgcggcccacgcggccggctacgcgctgatcgaacagaacgcgagcgggctcggcaacgcctacgcgggccaggcggccgcggcgagcgatgccagcacgatctatttcaacccggccggcatgacccggctgcccgaccggcagatcgtcgtcgccgggcatctgatcaagccccgcgccgagttctcggggacgagcagcgccggcgtcacgggcgggcagggcggcgacgccggggactgggccttcgtcccgaatgcctatgtcgcgatgcgcctgacgccggacctgcatctgggcctcggcctcaacagccccttcggcctcaagaccgaatacgaacccgagtggatcggccgttatcaggcgattgagtcggagctcaagacgatcaacctgaatccgtccgtcgcctacaagctcagcgagacgttttcggtgggcgctgggcttaatatccagtggatcgaagcgacgctgacccaccgacagccgcttgggccaccccctttcccggctccgttgctcaagatcaagggcgacgattacggctggggctacaacctcggcgcgctctggcaggcgacgcctgcgacgcgcatcggcgtgtcctaccgttccgaagtcgactacacgctcgagggcacgtcgagcacttccgaccccgttgtgaaccccctcaatggcccggtgaccgcggaggtcacgctgccggacagcgcgtcgctgagtcttttccacacgctctccccgcagtgggacctgttggccgacgtgagctggacgggctggagcgatttcgacgacctgccgatccgcggcacagtcgacagcacgacgatcgaaaactggagcgacagcctgcgctattcgctcggcgcaacctggcacgcgaacgaaaaatggagtctgcgcggcggcatcgcctacgatgaagcgccggtgtcggaccgctatcgcaccccgcgcatcccggacggcgcgcgcacctgggtcgcgctcggcggccagtaccgcgtgtcgaagcgcagcgcactcgacttcggctacgcgcacctgttcgtcaacgacccgggtctgcagccgtcgacgacgacgctcgacggcgaatacgacagcgcggtcgacatcgtgtccgcccagttcacgctgaatttctga

SEQ ID NO: 23626 - protein, 405 aa, Thiobacillus denitrificans ATCC 25259
MSLCFKRLAASLALAAAGGAAHAAGYALIEQNASGLGNAYAGQAAAASDASTIYFNPAGMTRLPDRQIVVAGHLIKPRAEFSGTSSAGVTGGQGGDAGDWAFVPNAYVAMRLTPDLHLGLGLNSPFGLKTEYEPEWIGRYQAIESELKTINLNPSVAYKLSETFSVGAGLNIQWIEATLTHRQPLGPPPFPAPLLKIKGDDYGWGYNLGALWQATPATRIGVSYRSEVDYTLEGTSSTSDPVVNPLNGPVTAEVTLPDSASLSLFHTLSPQWDLLADVSWTGWSDFDDLPIRGTVDSTTIENWSDSLRYSLGATWHANEKWSLRGGIAYDEAPVSDRYRTPRIPDGARTWVALGGQYRVSKRSALDFGYAHLFVNDPGLQPSTTTLDGEYDSAVDIVSAQFTLNF

SEQ ID NO: 23627 - DNA, 1275 bp, Pseudomonas syringae pv. syringae B728a
  CDS (1)..(1275)
atgacaaaagcactgaaccggacaacgcttggactcgcactgggtctggcttcttctcaactgctcgctgccggctttgccctcaacgaacaaagcatcagcggcatgggcaccggctttgcaggtcgctcctcgtcagccgatgacgcaagcaccgtattcggcaaccctgccggtatgtcccgcatcaaacgcgaacaaatcagcgtcggtgcagctgccgtgatcgccaagaccgatatcgacaatggtcgtggcacatttggcggcagcaacgacggcgatatggttccggtggtcggcgtacccatgggctattacgtcaaaccaatcgatgatcactgggcatttggtctgggcgtgtacgtaccgttcggcctggtcaccgattacgaaaaaggcttcgctggccgctactggggtgacaagagtcacgtccaggtcgtgaccttccagccgaccgtcagctatgcattcaacgacaaggtgtccatcggtttcggcccgacgatcaaccgtatcgacggtgaactgacctcggcaacattgaacgccgcaacaccgggccgtaacgacggcaaagtgaagatcgaaggcgatgacaccgcaatcggcttcaatgccggtattttggtgcaggctaccgacaccactcgcctgggcctgacttaccactccaaggtcgattacaagctcaagggcaagaccaagatcgaaggttcgggtttcggtcctttcggcggccagaagtatgacgcttcgctggatatctccacacccgagtccgtggacttctccatcacccagcagatcgacgaaaactggacggtctatgccggcagcacctggactcgctggagccgcctgcaagacatcaccgtcaacaacgatggcgtccctgccttactgggcggttctgccggcccaatcggcaccattactgaagagcagaactggcacgacacctgggcgcacgccatcggcgcctcgtacaaggtcaataaagagtggacgctgcgcaccggcttctccgttgatcagtcgccgaccaacaacgtcaaccgctcccctcgcatcccgaccggcgatcgcaagatcatcagcttcggtgcaggctggagcccgaccgacgacctgaccatcgacgtggcgtactcgtacctgcgtgaagacgaaaccaagatccgcgattccagcgcgaccaaaggttcgtacagcgccgactaccgtaacaccgctcacggcctgggcacttcggttacctatcgcttctga

SEQ ID NO: 23628 - protein, 424 aa, Pseudomonas syringae pv. syringae B728a
MTKALNRTTLGLALGLASSQLLAAGFALNEQSISGMGTGFAGRSSSADDASTVFGNPAGMSRIKREQISVGAAAVIAKTDIDNGRGTFGGSNDGDMVPVVGVPMGYYVKPIDDHWAFGLGVYVPFGLVTDYEKGFAGRYWGDKSHVQVVTFQPTVSYAFNDKVSIGFGPTINRIDGELTSATLNAATPGRNDGKVKIEGDDTAIGFNAGILVQATDTTRLGLTYHSKVDYKLKGKTKIEGSGFGPFGGQKYDASLDISTPESVDFSITQQIDENWTVYAGSTWTRWSRLQDITVNNDGVPALLGGSAGPIGTITEEQNWHDTWAHAIGASYKVNKEWTLRTGFSVDQSPTNNVNRSPRIPTGDRKIISFGAGWSPTDDLTIDVAYSYLREDETKIRDSSATKGSYSADYRNTAHGLGTSVTYRF

SEQ ID NO: 23629 - DNA, 1188 bp, Desulfovibrio desulfuricans G20
  CDS (1)..(1188)
atgtttctcagccttccgcacacggcccgggccgcaggatttgccatgtacgaattcagcgcccgcggcaatgctctgggcggcgccatggttgcgcgcaaggccagtccttcttccattgcgttcaaccctgcgctgattacgcagcttaagggtactcagatggctgcgggcatgacgctggtagaccccagcgccactgtggaagtgaaagggcaggaaactgtctccgccaaaaagaattactgggccattcctcatgcctacgccacgcggcaggtcaacgatgcgctgtactacggtgtcggcgtgttttcccgtttcggtctgggtaatgaatattccaaagactggttcggtaaagaccagctgtattatgtgggcatacagtccctgtcggtgaaccccgtcatggggcttaaacttaccgacaagctttcggtcgcctttggcattgaggccatgtggtttgactatgagcagaaaaacatagtggaagccggtgccggcggcaggctggacggccgtgtgaacggcgaaagcataggctacggcattaatctgggcattcactatcagcctgtggaatggcttgcgctgggcgccagctggcgttccggcatcaagcagaacctgaagggcacgggctatttcagcggttccggcccccttttcagcaactggggcgataccgatgcgcgcggcagcgtgaacctgcccgacatgctttttctgggggtatgtgtgatgcccaccgacaggctgagcattgaagcgggtgcggtacgtaccggctggacaagctatgacaagctggtcatcgattataacaaccccagtgtggcaacgacggacaaaaccaccgagtggaaggatgtctggcggtttaacgtgggggttgaatatgcccttaacgagatgctggacctgcgtgccggctatgtttatgacaattcgccgctcaacgaaaactatcttgattttctggtgcctgccaacgacaggcatcttttcagcggcggtgtgggcatacatcaggggccgtggacgctggacctcagctacacctacctgcttatcaaggaacgcacaggcagtgtgaccaccacaatgggcggtgaaaacagagtgcgcttcaaagacggagacgctcaccttgtgggcatgacgctgggataccgcttttag

SEQ ID NO: 23630 - protein, 395 aa, Desulfovibrio desulfuricans G20
MFLSLPHTARAAGFAMYEFSARGNALGGAMVARKASPSSIAFNPALITQLKGTQMAAGMTLVDPSATVEVKGQETVSAKKNYWAIPHAYATRQVNDALYYGVGVFSRFGLGNEYSKDWFGKDQLYYVGIQSLSVNPVMGLKLTDKLSVAFGIEAMWFDYEQKNIVEAGAGGRLDGRVNGESIGYGINLGIHYQPVEWLALGASWRSGIKQNLKGTGYFSGSGPLFSNWGDTDARGSVNLPDMLFLGVCVMPTDRLSIEAGAVRTGWTSYDKLVIDYNNPSVATTDKTTEWKDVWRFNVGVEYALNEMLDLRAGYVYDNSPLNENYLDFLVPANDRHLFSGGVGIHQGPWTLDLSYTYLLIKERTGSVTTTMGGENRVRFKDGDAHLVGMTLGYRF

SEQ ID NO: 23631 - DNA, 1161 bp, Haemophilus somnus 2336
  CDS (1)..(1161)
atgagtgtttctgccggaaaagctttacaaggtcagggagcaagcggacaaccaataaccgaagaagccacacaaaagaatattgttcccggtgctttgattcctaatatgtattttgttgcacccattaatgataaatttgctgtcggtgcggcgatgaatgtgaactttggattaaaaagccaatataaaagcaattacgaagccggtgtttttggcggaactaccgagctaaattccattaatttaaatttaagcggttcatatcgtatcagcaaaggcttaagcattggtgtgggattaaatgcggtttatgccaaagcgaaaattgagcgtcgtgccggtattttagataagggagttaataaacttgcttctcttcctaaactgaaaaagattttctcaccactagcctctatggttgatgcaaattcccctatagtgcaattacaagataacaatgcatggggattgggttggaatatcggtgcagtttatgaatttaatcagggtaaccgtatcggtattgcctatcattccaaggtagatattaattttaaagatagcgatgcattacgttatagacttgctggatctggaagtattgaaccttatagaaatagaggtaaattaacgttacatttaccggactatcttgaaatttccggtttccaccaattaacggaaaaattcgctatgcactatagctataaatatactaaatggagccgtttacaaagtttgcatgccgtttatgataacggtcaggtcgcttttcataaagatgaaaactttgatgacagttctcgtgtagctctaggggcgacttataatgtcaatgataaattaaccttgcgtgcgggtattgcttatgatgaatccgccgaacatccgagtgcttcaatccccgataccgaccgcacttggtatagcttgggggcaacctatcatttcacgccaaatctttcggttgacgtaggttttgctcatttacgtggtaaaaaacggcaatttaaagagggatatgaaattggaaatactgtatcttatccgggtaatagaggtcaggttacaaatgtacagttagccgtagtaagtgcggactaccaatcaacggcacgtgccaatttgtacggtttaaatcttagctaccgtttctaa

SEQ ID NO: 23632 - protein, 386 aa, Haemophilus somnus 2336
MSVSAGKALQGQGASGQPITEEATQKNIVPGALIPNMYFVAPINDKFAVGAAMNVNFGLKSQYKSNYEAGVFGGTTELNSINLNLSGSYRISKGLSIGVGLNAVYAKAKIERRAGILDKGVNKLASLPKLKKIFSPLASMVDANSPIVQLQDNNAWGLGWNIGAVYEFNQGNRIGIAYHSKVDINFKDSDALRYRLAGSGSIEPYRNRGKLTLHLPDYLEISGFHQLTEKFAMHYSYKYTKWSRLQSLHAVYDNGQVAFHKDENFDDSSRVALGATYNVNDKLTLRAGIAYDESAEHPSASIPDTDRTWYSLGATYHFTPNLSVDVGFAHLRGKKRQFKEGYEIGNTVSYPGNRGQVTNVQLAVVSADYQSTARANLYGLNLSYRF

SEQ ID NO: 23633 - DNA, 1413 bp, Haemophilus somnus 2336
  CDS (1)..(1413)
atgaatagcaataaacaatcactttttactaaatctttcattgcttcagcattggcattatcggcaagttacgttaatgcggcggcgttccaaattgctgaggtgtccagttccggtttaggacgagcttatgcgggtgaagcggcaattgctgataatgccgcagttgtggcaaccaacccagcgttaatgagtttgtttaaaacgaaacaattctcaatggggggggtatacgttcaatctagaattaatataaatggtgaggttaaggttaatgcggggttatttcacggaattgaaactggaaaaggggatcagaaaaacattgtgccaagtgcagttattcccaatatgtacttcgtcgcacctattaatgataaatttgctgtcggtgcgggcatgaatgtgaactttgggttacaaagtaaatataaaaaggattatgatgccggtgttttgggtggaaccaccgcactgaattccattaacttaaatttaagcggttcataccgtatcagcaaaggattaagcatcggtgctgggttgaatgcggtttatgccaaagcgaaaattgagcgtcatgcaggtattttgaaagaagcacttggtactgttaagcaaatatcaacaccaggaggacaaccagggggttttataatcagattggatccgtcatcacaacaactgcttgctgcattagctcaaataaaagttaattcggatactagcataatacaattacaagataataatgcatggggatttggttggaatatcggggcagtctatgaatttaatcaaggtaaccgtatcggtattgcctatcattctaaagtagatattaattttaaagatgatgatgcgttgagttatcaacttaaaccaagaagaattagtcctgttaaagagaaaggtgggttaacgctacatttgccggattatttcgaaatttccggtttccaccaattaacggaaaaattcgccatgcactacagctataaatatactaaatggagccgtttacaaagtttacatgccacttatgataacggcaaggtcgctttccataaagatgaaaaatttcatgacagttcacgtgtagctctaggggcgacttataatgtgaatgataaattaaccctgcgtgcaggtattgcttatgatgagtcagccgaccacccaagtgcttcaatccccgataccgaccgcacttggtatagcttgggggcaacctataacttcacgccaaatctttctgttgacgtaggttttgctcatttacgaggtaaaaaacagcaatttagcgaaacacaaaatattggaaaagagattaaactcgttaatataagtgcggattatcaatcaacggcacgtgccaatttgtacggcttaaatcttaactaccgtttctaa

SEQ ID NO: 23634 - protein, 470 aa, Haemophilus somnus 2336
MNSNKQSLFTKSFIASALALSASYVNAAAFQIAEVSSSGLGRAYAGEAAIADNAAVVATNPALMSLFKTKQFSMGGVYVQSRININGEVKVNAGLFHGIETGKGDQKNIVPSAVIPNMYFVAPINDKFAVGAGMNVNFGLQSKYKKDYDAGVLGGTTALNSINLNLSGSYRISKGLSIGAGLNAVYAKAKIERHAGILKEALGTVKQISTPGGQPGGFIIRLDPSSQQLLAALAQIKVNSDTSIIQLQDNNAWGFGWNIGAVYEFNQGNRIGIAYHSKVDINFKDDDALSYQLKPRRISPVKEKGGLTLHLPDYFEISGFHQLTEKFAMHYSYKYTKWSRLQSLHATYDNGKVAFHKDEKFHDSSRVALGATYNVNDKLTLRAGIAYDESADHPSASIPDTDRTWYSLGATYNFTPNLSVDVGFAHLRGKKQQFSETQNIGKEIKLVNISADYQSTARANLYGLNLNYRF

SEQ ID NO: 23635 - DNA, 1356 bp, Haemophilus somnus 2336
  CDS (1)..(1356)
ttgtcgttatctgccgcttatgccaatgcggcagctttccaactcgccgaggtatccagttccggtttgggacgtgcttatgcaggtgaagcggcgattgctgataatgccgccgttgtagcgactaaccctgccttaatgagtttgtttaaagcaaatcaattttctataggtggggtttatgttcaatctagaattaatataaatggtgaagtaaatgttaatgtagggaagggagttgtacaagttgcagaggaaaaagcagatcagaaaaaagttgtacccggtgcattagttcccaatttgtattttgttgcacctattaatgacaaatttgctatcggtgcgggtatgaatgtcaactttggattacaaagcaaatataaaaaggattatgatgccggtgtttttggcggaactactgagctgaattccattaatttaaatttaagcggttcatatcgtatcagcaaaggattaagcattggagccggattaaatgcggtttatgctaaagcaaaaattgagcgtcatgcgggtgttctagataaggcaattgatactattgccgattataatggaatggttgggggtatcaaaattccttcattgcaagtgttagtcccaattttctccaagttaaaaaatggagtgaatacggatactctcttaacacaattacaagataataatgcatggggattcggttggaatatcggggcggtttatgaatttaatcaaggtaaccgtatcggtattgcctaccactctaaagtagatattaattttaaagatgatgatgccttgagttatcaatttgaagcagtaaatattatccctgttaaagagaaaggtgggttaacgctacatttgccggattatttcgaaatttccggtttccatcaattaacggcaaaattcgccatgcactacagctataaatatactaaatggagccgtttacaaagtttacatgccacttatgataacggtaaggttgctttccataaagatgaaaaatttcatgacagttcacgtgtagctctaggggcgacttataatgtgaatgataaattaaccctgcgtgcaggtattgcttatgatgagtctgccgaccatccgagtgcttcaatccccgataccgaccgcacttggtatagcttgggtgcaacctataactttacgcctaatctttctgttgatgtaggttttgctcatttacgtggtaaaaaacagcaatttaaggaaaagcataagattggaagtacaggtgttgagttcggcagtatagatgcaaactataaatcaacagcacgtgccaatttgtacggcttaaatcttaactaccgtttctaa

SEQ ID NO: 23636 - protein, 451 aa, Haemophilus somnus 2336
MSLSAAYANAAAFQLAEVSSSGLGRAYAGEAAIADNAAVVATNPALMSLFKANQFSIGGVYVQSRININGEVNVNVGKGVVQVAEEKADQKKVVPGALVPNLYFVAPINDKFAIGAGMNVNFGLQSKYKKDYDAGVFGGTTELNSINLNLSGSYRISKGLSIGAGLNAVYAKAKIERHAGVLDKAIDTIADYNGMVGGIKIPSLQVLVPIFSKLKNGVNTDTLLTQLQDNNAWGFGWNIGAVYEFNQGNRIGIAYHSKVDINFKDDDALSYQFEAVNIIPVKEKGGLTLHLPDYFEISGFHQLTAKFAMHYSYKYTKWSRLQSLHATYDNGKVAFHKDEKFHDSSRVALGATYNVNDKLTLRAGIAYDESADHPSASIPDTDRTWYSLGATYNFTPNLSVDVGFAHLRGKKQQFKEKHKIGSTGVEFGSIDANYKSTARANLYGLNLNYRF

SEQ ID NO: 23637 - DNA, 993 bp, Haemophilus somnus 2336
  CDS (1)..(993)
atgaatatgaactttagtttgagaagtaaatataaagatgattatgttggcggtgttttgggtggaacaagcgagatggattctattaatttgaatttaagcggttcatatcgtgtcagcaaaggattaagcgttggtgcaggattaaatgccatttatgccaaagcgaaatttgaacgccgtgcagggattttaaagaaaactattgatagtttacgtagtgatgacaatgagctgcttattttactctctccatcaatagtatcatcggcatatagcctaacatttcatgaaaacagtactgtagcacgcttacaagataacaatgcatggggattgggttggaatatcggtgcggtttatgaatttaatcaagataatcgtatcggtattgcctaccattctaaagtagatattgattttaaagataatgatacattgggttatatacttggcaaagaagagattaagcttcatcgtgcaaaaggtaagttaactttacatttaccgagctatttcgaaatttccggtttccaccaattaacagcaaaatttgctatgcactacagctataaatatacgcaatggagccgtttacaaagtttgcatgccgcttattccaatggtgaagtcgcttttcataaagatgaaaactttcatgacagttctcgtgtagctttaggggcaacttatgatgtgaatgataaattaactttacgtgcaggtattgcttatgatgaatccgccgaccacccaactgcttccattccggataccgaccgcacttggtacagcttaggggcaacctatcatttcacaccaaatctttctgtcgacatgggctttgctcatttacgcggtaaaaaacagaaatttaaagagaaccactcatttacaagcaaagataattatgaagtaggtagaatagatgcagattatcaatcaacagcacgagccaatctgtatggcttaaatcttaactaccgtttctaa

SEQ ID NO: 23638 - protein, 330 aa, Haemophilus somnus 2336
MNMNFSLRSKYKDDYVGGVLGGTSEMDSINLNLSGSYRVSKGLSVGAGLNAIYAKAKFERRAGILKKTIDSLRSDDNELLILLSPSIVSSAYSLTFHENSTVARLQDNNAWGLGWNIGAVYEFNQDNRIGIAYHSKVDIDFKDNDTLGYILGKEEIKLHRAKGKLTLHLPSYFEISGFHQLTAKFAMHYSYKYTQWSRLQSLHAAYSNGEVAFHKDENFHDSSRVALGATYDVNDKLTLRAGIAYDESADHPTASIPDTDRTWYSLGATYHFTPNLSVDMGFAHLRGKKQKFKENHSFTSKDNYEVGRIDADYQSTARANLYGLNLNYRF

SEQ ID NO: 23639 - DNA, 1392 bp, Actinobacillus pleuropneumoniae serovar 1 str. 4074
  CDS (1)..(1392)
atgaatcacacatttaataaaactcttattgcttcactcttaactttatctgccggcggtgtatcggcttctttattccaacttgcggaagtttcaacgtcaggactcggtatggcgtacgcaggtaatgcggcggttgcggacaatgcgtccgtagtagcaaataacccggcgttaatgactaaattcaaacgccctgaaatttcagccggtggcgtgctcgttgatacagatttgaccgttcgcggaatcacttcaaacggtaatcaagcatatgcaggtaatgtcgtaccaaccgcaccgattcctaatatgtatttcgtattaccggtgaatgatgatttctcattcggtttaggttataacgtaaattacggtttaaaaacaaaatatccgaccgattttgcagcaggttcattaggcggtaataccgaattacaagcgcataacttcaacctaagcggcgcttataaattaggttacggttttagcattggtgcaggtttaaatgttgtttactctaaagcggaatttattcgtcatttaggtgataatgtcgaagcaggtgcagctcgagctaaggcaggggcagcacaagcaagagcggcggctgcaaaagcaaacgcagcgggtttaaccgctcaagcgcaagcattaaccgccacagcaaacaaatatcaagctttaggtaatttattatcctcttataaacgttcaacagaagtagctcgtgtcagtggcgatgaatggtcattaggttggaatgccggtttagtttacgagttgaatgaaaatcaccgctggggtttagcataccactctcctgtagatgtgaaatttaaaggtcattacagtaacagtatttctgctgcaacaggaagttctatcgttgcattcccaacagccggtcaagagtttccgggtaaattaacacttaatttaccggcattctgggaattatcgggtttccataaattaaccgaccgcttagcggttcaatatagctggaaacgtaccgaatggagccgtttaaaaacgttagatgcttacggcactaaaggcgaacattacttacacaaaaaagaagatttctcggatgcgagtcgttatgcactaggcgtatcttatgatgtatccgagccattaacattacgtgcgggtatcgcttatgatgaaaacgcaagcaccaatcatccgtcaatttcgattccggatacaaaccgtatgtggtattcggtgggtgcaacctatcgtgtaacccctgcgctttcggtggatgccggttatgcgttcctacgcggtacggcaaacagctttgacgaaaaaggtacggcatttaaaattaaagctcgcgggaatctctacggcttaaatcttaactacaaattttaa

SEQ ID NO: 23640 - protein, 463 aa, Actinobacillus pleuropneumoniae serovar 1 str. 4074
MNHTFNKTLIASLLTLSAGGVSASLFQLAEVSTSGLGMAYAGNAAVADNASVVANNPALMTKFKRPEISAGGVLVDTDLTVRGITSNGNQAYAGNVVPTAPIPNMYFVLPVNDDFSFGLGYNVNYGLKTKYPTDFAAGSLGGNTELQAHNFNLSGAYKLGYGFSIGAGLNVVYSKAEFIRHLGDNVEAGAARAKAGAAQARAAAAKANAAGLTAQAQALTATANKYQALGNLLSSYKRSTEVARVSGDEWSLGWNAGLVYELNENHRWGLAYHSPVDVKFKGHYSNSISAATGSSIVAFPTAGQEFPGKLTLNLPAFWELSGFHKLTDRLAVQYSWKRTEWSRLKTLDAYGTKGEHYLHKKEDFSDASRYALGVSYDVSEPLTLRAGIAYDENASTNHPSISIPDTNRMWYSVGATYRVTPALSVDAGYAFLRGTANSFDEKGTAFKIKARGNLYGLNLNYKF

SEQ ID NO: 23641 - DNA, 1275 bp, Pseudomonas aeruginosa UCBPP-PA14
  CDS (1)..(1275)
atgaaaacaatatggtttaaaacctctctcgcactgaccattagcgctgtctccacctacaccctcgccaacggcatcgccatcaacgaacagagcgccagcggcgccggcaccgcctacgccggccgcgcctcgtccgcgctcgatgccagcaccatctacggcaacccggccggcctgtccaagctgaaacgcaccgaagtcagcggcggtctggccatcgtcaaggccaaggacgacatcagccaggcccacagcaccgcccagggcagcaacaagggcgactcggtaccgctggccgccgtaccgttcggctacttctccacgccgatcaacgaagatttcactttcggcctgggcatctacgtgccctacggcatcatcaacgattacgaaaacggcttcatgggcagctcccacggctcctatagcaaggtgcaggtgatcaccgtgcagccgaccatcgcctggaagatcaacgacaaggtttccgtcggcttcggtccgaccttcaaccgcatcgacggccagttgaagaacaccctggccaccaatggcctgctcggcagcaacggcgataccaagatcaacatcaagggcgacgacactgccatcggctacaacgtcggcgtgatggtcgacctgaccgacgacaccacctggggcctgacctaccactccaaggtcaagtaccacctgggcggcaacaccgaagtgaagaacgctccgggtgccctgggcctgaacggcaagtacgacgccaagctggacatcaccctgccggaatcggtggatacctccatcacccacaagttcgacgacaagtggacgggctacctgggcgccgtctggacccgctggagccgcctggagaagatcgaagtgcgcaacagcggcgtaccggcgctcggccaggccctgggcttcaacaccatcggcgaagacctgaactggcgcgacacctggtccttctcggtaggtacctcctaccaggccaccccggagtgggtgctgcgtaccggctttgcctacgagccctcgccgaccaccaacgaggaccgcaacgtgcgcatcccggtgggcgaccgcaaggtcttcaccgtcggtgccggctggtcgccgaaccaggacctgaccgtcgacgtggcctacgcctacctgtgggaaaccactgccggcgtcaaccaggaaggcagcgccctgcagccggcctacagcgccaagtacgacaacagcgcgcatggcctgaccgcccaggtcacctatcgcttctga

SEQ ID NO: 23642 - protein, 424 aa, Pseudomonas aeruginosa UCBPP-PA14
MKTIWFKTSLALTISAVSTYTLANGIAINEQSASGAGTAYAGRASSALDASTIYGNPAGLSKLKRTEVSGGLAIVKAKDDISQAHSTAQGSNKGDSVPLAAVPFGYFSTPINEDFTFGLGIYVPYGIINDYENGFMGSSHGSYSKVQVITVQPTIAWKINDKVSVGFGPTFNRIDGQLKNTLATNGLLGSNGDTKINIKGDDTAIGYNVGVMVDLTDDTTWGLTYHSKVKYHLGGNTEVKNAPGALGLNGKYDAKLDITLPESVDTSITHKFDDKWTGYLGAVWTRWSRLEKIEVRNSGVPALGQALGFNTIGEDLNWRDTWSFSVGTSYQATPEWVLRTGFAYEPSPTTNEDRNVRIPVGDRKVFTVGAGWSPNQDLTVDVAYAYLWETTAGVNQEGSALQPAYSAKYDNSAHGLTAQVTYRF

SEQ ID NO: 23643 - DNA, 1197 bp, Dechloromonas aromatica RCB
  CDS (1)..(1197)
atgaacctgcgtatcgtcccagcactgctgttggctatcttttccggcaccgcctcggctgctgccttccagctttgggagcaaaatgccagcggcctggggaatgcttatgcgggctcggcagcggtggcggataacgccagtacggttttcttcaatccggcggggatgacgcaactgtcaggcttccagttctctgctggggtaaccggggttgggccgagctatgagtttcgtgacaatggctcgaccggagcattcaagggtagcggcaacggcggtgacgcgggcggctggaatgccgttcccaatctctatttgtccgggcatctgaccgataatctttcgatcggctttggcgtttcggccccatttgggctggcgactgaatacgacagcaactgggtcgggcgtgttcaggcgatcaagtcagagatcaagaccgtcaactacaacccgtcgcttgcctatcgcgtcaacgacaaggtttcgctgggttttggcatcaattatcagcaactggatgctgaaattaccagttacaccccggctggtctctaccgggtcaagggtgacgattcgacctggggatggaatgccggtgctttgtttacactttctcccgccatgcgcgttggtgtgtcttaccgctcggcagtgaattacacgctggaaggaacccgttcggtcggggctaattccgttgccgccaaggcggacatcaagctgccagatacttttatcctgtcggtctggcaacaggtttcggatcgttgggaagcgatgggcgatttgtcctacacgcgctggagcaccctggatcgtctggatgttcgcagctccgctggcgttgataccgagatcttcaactatgaaaactcctggcgacttgcctggggtgctgcctacaaggccagtgatgcactcaaggtgaaattcggtattgcctatgaccggacgccggtgcgcgatgaataccgttcggctcgcgtgcccgacaacgatcgtttgtggttgtcgctgggcggacagtggaatgccggtcgctatggcaaggtcgatgtcggctactcctatctttacgtcaaggacccgtctatccagcagtccaaggtggtgggagtagcccacgaattgcgtggcgattacaacgccagtgcccatatcgttggcgcgcaatactcggtgggtttctaa

SEQ ID NO: 23644 - protein, 398 aa, Dechloromonas aromatica RCB
MNLRIVPALLLAIFSGTASAAAFQLWEQNASGLGNAYAGSAAVADNASTVFFNPAGMTQLSGFQFSAGVTGVGPSYEFRDNGSTGAFKGSGNGGDAGGWNAVPNLYLSGHLTDNLSIGFGVSAPFGLATEYDSNWVGRVQAIKSEIKTVNYNPSLAYRVNDKVSLGFGINYQQLDAEITSYTPAGLYRVKGDDSTWGWNAGALFTLSPAMRVGVSYRSAVNYTLEGTRSVGANSVAAKADIKLPDTFILSVWQQVSDRWEAMGDLSYTRWSTLDRLDVRSSAGVDTEIFNYENSWRLAWGAAYKASDALKVKFGIAYDRTPVRDEYRSARVPDNDRLWLSLGGQWNAGRYGKVDVGYSYLYVKDPSIQQSKVVGVAHELRGDYNASAHIVGAQYSVGF

SEQ ID NO: 23645 - DNA, 1356 bp, Haemophilus influenzae R2846
  CDS (1)..(1356)
atgaaaaaatttaatcaatctatattagcaactgcaatgttgttggctgcaggtggtgcaaatgcggcggcgtttcaattggcggaagtttctacttctgggcttggtcgtgcctatgcgggtgaagcggcgattgcagataatgcttctgtggtggcaactaacccagctttgatgagtttatttaaaacggcacagttttccacaggtggcgtttatattgattctagaattaatatgaatggtgatgtaaattcttatctaaacagtggttcaatggcattaacaaagtacggctcagcttcacagcgtaatgttgttcccggtgcttttgtgccaaatctttatttcgttgcgccagtaaatgataaattcgcgctgggtgcaggaatgaatgtcaatttcggtctaaaaagtgaatatgacgatagctatgatgctggtgtatttggtggaaaaactgacttgaatgctatcaacttaaatttaagtggtgcttatcgagtaatagaaggcttgagcctaggtttaggggtaaatgcggtttatgctaacgcccaagttgaacgaaatgcgggtattattgcggatagtcttcaggattcacaagtaaaaggagcactcaaaatagtagattctacaaataaagctcctgaccgtttgacctctaaagacaaatctgttgtgtcattacaagatagagcagcttggggctttggctggaatgcaggtgtaatgtatcaatttaatgaagctaatcgaattggtttagcctatcattctaaagtggacattgattttgctgaccgcactgccactagtttcggaaaaaaggatatcgtggcggggaaaacaggtaatttaacctttacattgccagattacttagaactttctggtttccatcaattaactgacaaatttgctgtgcattatagttataaatatacccattggagtcgtttaacaaaattacatgctagctatgaaaatggtgaaaaagcttttgataaagaattgcaatacagtaataactctcgtgttgcattaggggcaagttataatcttgatgaaaaattgaccttacgtgcgggtattgcttacgatcaagcggcatctcgtcatcagcgtagtgctgcaattccagataccgatcgcacttggtatagtttagggggaacctataaattcacccctaatttatctgttgatcttggctatgcttacttaaaaggcaaaaaagttcactttaaagaagtacaaaaagctgcaggtggccacataacaacaaccgcaaattacacttctcaagcacatgcaaatctttacggtttgaatttaaattatagtttctaa

SEQ ID NO: 23646 - protein, 451 aa, Haemophilus influenzae R2846
MKKFNQSILATAMLLAAGGANAAAFQLAEVSTSGLGRAYAGEAAIADNASVVATNPALMSLFKTAQFSTGGVYIDSRINMNGDVNSYLNSGSMALTKYGSASQRNVVPGAFVPNLYFVAPVNDKFALGAGMNVNFGLKSEYDDSYDAGVFGGKTDLNAINLNLSGAYRVIEGLSLGLGVNAVYANAQVERNAGIIADSLQDSQVKGALKIVDSTNKAPDRLTSKDKSVVSLQDRAAWGFGWNAGVMYQFNEANRIGLAYHSKVDIDFADRTATSFGKKDIVAGKTGNLTFTLPDYLELSGFHQLTDKFAVHYSYKYTHWSRLTKLHASYENGEKAFDKELQYSNNSRVALGASYNLDEKLTLRAGIAYDQAASRHQRSAAIPDTDRTWYSLGGTYKFTPNLSVDLGYAYLKGKKVHFKEVQKAAGGHITTTANYTSQAHANLYGLNLNYSF

SEQ ID NO: 23647 - DNA, 1356 bp, Haemophilus influenzae R2866
  CDS (1)..(1356)
atgaaaaaatttaatcaatctctattagcaactgcaatgttgttggctgcaggtggtgcaaatgcggcagcgtttcaattggcggaagtttctacttctgggcttggtcgtgcctatgcaggtgaagcggcgattgcagataatgcttcagtggtggcaactaacccagctttgatgagtttatttaaaacggcacagttttccacaggtggcgtttatgttgattctagaattaatatgagtggtgatgtaactgcttctataacaggttctgtaatgacagcagcaaaggacggctcagcttcacagcgtaatgttgttcctggtgcttttgtgccaaatctttatttcgttgcgccagtaaatgataaattcgcgctgggtgcaggaatgaatgtcaatttcggtctaaaaagtgaatatgatgatagttatgatgctggtgtatttggtggaaaaactgacttgagtgctatcaacttaaatttaagtggtgcttatcgagtaacagaaggcttgagcctaggtttaggggtaaatgcggtttatgctaacgcccaagttgaacgaaatgcgggtgttattgcggatagtgttcaggatggacaagcaaaaacggcactcagagcagtagttccaggaacaaaaattcctgacatattgacctctaaagacaaatctgttgtgtcattacaagatagagccgcttggggctttggctggaatgcaggtgtaatgtatcaatttaatgaagctaatcgaattggtttagcctatcattctaaagtggacattgattttactgaccgcactgccactagtttaggaaaaacggatatcgtggcggggaaaacaggtaatttaacctttacattgccagattacttagaactttctggtttccatcaattaactgacaaacttgctgtgcattatagttataaatatacccattggagtcgtttaacaaaattaaacgctagctatgaaaatggtgaaaaagcttttgataaagaattacaatacagtaataactctcgtgttgcattaggggcaagttataatcttgctgaaaaattaaccttacgtgcgggtattgcttacgatcaagcggcatctcgtcatcaccgtagtgctgcaattccagataccgatcgcacttggtatagtttaggggcaacctataaattcacgccgaacttatctgttgatcttggctatgcttacttaaaaggcaaaaaagttcactttaaagaagtacaaaaagttgcaaatggcttcctaacaacaaccgcaaattatacctctcaagcacacgcaaatctttacggcttaaacttaaattatagtttctaa

SEQ ID NO: 23648 - protein, 451 aa, Haemophilus influenzae R2866
MKKFNQSLLATAMLLAAGGANAAAFQLAEVSTSGLGRAYAGEAAIADNASVVATNPALMSLFKTAQFSTGGVYVDSRINMSGDVTASITGSVMTAAKDGSASQRNVVPGAFVPNLYFVAPVNDKFALGAGMNVNFGLKSEYDDSYDAGVFGGKTDLSAINLNLSGAYRVTEGLSLGLGVNAVYANAQVERNAGVIADSVQDGQAKTALRAVVPGTKIPDILTSKDKSVVSLQDRAAWGFGWNAGVMYQFNEANRIGLAYHSKVDIDFTDRTATSLGKTDIVAGKTGNLTFTLPDYLELSGFHQLTDKLAVHYSYKYTHWSRLTKLNASYENGEKAFDKELQYSNNSRVALGASYNLAEKLTLRAGIAYDQAASRHHRSAAIPDTDRTWYSLGATYKFTPNLSVDLGYAYLKGKKVHFKEVQKVANGFLTTTANYTSQAHANLYGLNLNYSF

SEQ ID NO: 23649 - DNA, 1260 bp, Pseudomonas fluorescens PfO-1
  CDS (1)..(1260)
atgctcaagaatcccgtcggcctggcggtcgcgctggtgtcctccaatgtgttggccggtggttttgccctcaacgaacaaagcatcagcgggatggggtccgggtttgcgggacgatcttcatccgccgaagacgccagtacgatctacggcaacccggcaggcatggcgcggcttaaacgagagcaggtgagcgtgggggcggcgacgctgttcgccaaatcggacatcagccagacacgcagtacgtttggggggaaggaagacggcgacatggtgcccgccaccacagtaccgatggggtattacgtgaaaccgatcgatgagcattgggcattcggcgtcgggttttatgtgcctttcgggctgatcaccgactacggcagtggttttgccggccgctattacgccaacaagagtgaagtcaccacgctgacctttcagccgaccatcagctacgcctttaacgaaaaggtgtcgatcggattcgggccgaccatcaatcgtatcggcggagagatatcgggcatggtgcccaatccactcagccccgggcgcaacgacggcaaactcaaaagcaccggcgatgacaccgcactgggcttcaatgctggcgtgctggtgcaggcgaccgatcagacccgcctgggcctgacgtatcactccaaagtcagttaccacctggacgccaaaaccaaggtcaccgatggcatcttcagcgtgctgggcgtcagcggccgtagctatgacgcatcgctggatgtggacacgccggagtcggtggacttttcgctgacgcatcaattcaacgacgactggacgctctatgtgggcagcacctggacacgctggagccgcttcaaggaactgaccattgagaacagcggcttgccgccgttgctgagcgggcaattggggacgatcagcgaagaacagaactggcatgacacctgggctcacgcgatcggtgcggcctatcgattgaataaccaatgggtgctgcgtggcgggttttcggtcgatcagtcacccgccaacaacaccaatcgggggccgcgcattccgacgggcgaccgtaaggttgtcagcttcggcgccggctggacacccgtggacaatgtcacgatcgatctcgcgtattcctatctttgggaggaaagcgtcgaggtcaacgacacctcggcatcgaggggggcctaccgtgccaggtacaagaacagtgccagcgggttcggtacgtcggtcagttatcgcttctag

SEQ ID NO: 23650 - protein, 419 aa, Pseudomonas fluorescens PfO-1
MLKNPVGLAVALVSSNVLAGGFALNEQSISGMGSGFAGRSSSAEDASTIYGNPAGMARLKREQVSVGAATLFAKSDISQTRSTFGGKEDGDMVPATTVPMGYYVKPIDEHWAFGVGFYVPFGLITDYGSGFAGRYYANKSEVTTLTFQPTISYAFNEKVSIGFGPTINRIGGEISGMVPNPLSPGRNDGKLKSTGDDTALGFNAGVLVQATDQTRLGLTYHSKVSYHLDAKTKVTDGIFSVLGVSGRSYDASLDVDTPESVDFSLTHQFNDDWTLYVGSTWTRWSRFKELTIENSGLPPLLSGQLGTISEEQNWHDTWAHAIGAAYRLNNQWVLRGGFSVDQSPANNTNRGPRIPTGDRKVVSFGAGWTPVDNVTIDLAYSYLWEESVEVNDTSASRGAYRARYKNSASGFGTSVSYRF

SEQ ID NO: 23651 - DNA, 1272 bp, Pseudomonas fluorescens PfO-1
  CDS (1)..(1272)
atgaaaaaagtcatgctcaaaaccacccttagccttgccgtaaccgtggcatccacccagatcttcgcggctggctttgccatcaacgaacacagcatcagcgggatggggactgggtacgccgggcgatcttcttctgccgacgacgcaagcactgtttacggcaaccctgccggcatgtcgcgcatcacgcgcgaacaagtcaccggtggcgttgcattcctcgatgcaaaaaccgatatcagcgacgccagctccagcccgaacggcggcagcaacaaaggcgacatggtgcccttcacctccgtacctatgggttactacgtcaagccgatcgacgagcattgggcattcggtctgggtgtgtacgtacccttcggcctgatcaccgactatgaaaacggcttcgccggccgttacttcggcagcaagtccgaagtcaagatcattaccttccagccaaccgtcagctacaagttcaacgacgtcgtgtcgatcggtttcggcccgaccatcaaccgtatcgacggctcgcttgaatctaacctgtcgatcactcaggctgcgccggacggcaaggtcaagatcaagggtgacgacaccgcactgggctacaacatcggggtgctggtacaggctaccgacagcactcgcctgggtctgacctaccactcgaaagtcgactacaagctcgaaggcaacaccaaggtcaactacggtgtgctgggcgcgatcggcctgggtgcgaaccagaagtacgacgcttcgctgaagatcaccacgcctgaatccgtggacctctcggtcacccaggcgatcaacgatcgctggaacgtctacgccggtaccacctggacccgctggagccagctggaaaagatcaccgtcaagaactccggcgttcagccactgctggctggccagttcggcgagatcaccgaagaacagaactggcatgacacctgggcgtacgccatcggtacgtcctaccaactgaacaaggaatgggtactgcgtaccggtctgacgttcgaccagtcgccgaccaacaacgtcgaccgttcgccacgcataccgaccggcgaccggaccatcttcagtatcggtgccggctggagcccgaccgaagacctgaccatcgacgttgcctactcgtacctgaaggaagagaaggtcaacattcgcaacacaaacgatcgtggccagagctacaactcgcagtatgaaaactcggcaaacggcttcggtgtcggcgcaacctaccgcttctga

SEQ ID NO: 23652 - protein, 423 aa, Pseudomonas fluorescens PfO-1
MKKVMLKTTLSLAVTVASTQIFAAGFAINEHSISGMGTGYAGRSSSADDASTVYGNPAGMSRITREQVTGGVAFLDAKTDISDASSSPNGGSNKGDMVPFTSVPMGYYVKPIDEHWAFGLGVYVPFGLITDYENGFAGRYFGSKSEVKIITFQPTVSYKFNDVVSIGFGPTINRIDGSLESNLSITQAAPDGKVKIKGDDTALGYNIGVLVQATDSTRLGLTYHSKVDYKLEGNTKVNYGVLGAIGLGANQKYDASLKITTPESVDLSVTQAINDRWNVYAGTTWTRWSQLEKITVKNSGVQPLLAGQFGEITEEQNWHDTWAYAIGTSYQLNKEWVLRTGLTFDQSPTNNVDRSPRIPTGDRTIFSIGAGWSPTEDLTIDVAYSYLKEEKVNIRNTNDRGQSYNSQYENSANGFGVGATYRF

SEQ ID NO: 23653 - DNA, 1290 bp, Rhodospirillum rubrum
  CDS (1)..(1290)
atgaccattattcgtacatccggggccgtcgccggtctgtgtggactggccgtggccctgagcggcggctcggcctgggcttcgggtttccagttgaaggaacagagcgccgagggcctgggcaacgccttcgccggcgccaccgccaaggcttatgacccgagcaccgccttttataaccccgccggcctcacccgcctcaagggcacccaagccgacagcgttttgacctatatcatgccaaaggcccatttcagcggctcgggcaccaacgccctgggcggttcgacgggcagcatcgaaggcggcgacgccgtggccgacgcggccgtgccgtcattctatggcgtatacagctataacgacgacctgaagttcggcatcgccgccaatgtgcccttcggcctgcgcaccgattacgacaagaactgggccgggcgctatcaggcgatcgaatccgatctgcagatcgtcaccctgacgccttcggtggcctatcgggtggttggcgattcgtcgtttggcgatttctcgatcggcggtggcccggttgtgcagttcgcctcggtcaagctgaccaacgccgtcaacaacttcggtctggtggccggtgacggtcgcgccaaggtctcgggctcggatatcggctacggcttcaatatcggcgctttgtgggagccgaccgaaaccacccgcatcggcgtcaactaccgctcgcgcgtcgagcacaatttcgatggcgacgccaaatacaccaatgtcgcccggcctttggccatctcgcgcggcctcgtcaacagcggcgcctcggccgatttgacgaccccggatgtggtcagcatcggcgcctatcacgaattcgatccgcaatgggcggtcacggccgatgtcgcctggaccaactggtcgctgtttgacgaattgaagatcgagaacgacaagggcggggtgatcacccgcgtcgatgaaagctgggaagacaccatgttcgtcgcccttggcggcatctacaagccggtcgaggacgtcgccctgcggatcggcgtggcctatgaccaggcccccgtcggcaagaagcaccgcaccgcccgcatccccgataccaaccgctattggctggccgccggcgtgagctacgcggtgaccgacagcttcagtctcgacgcctcctacgcccacatcttcgccgatcgggtcagcatcaacgaaaccaccgcccagggcaatctgacgggcacctacgacagctcgatcgacatcctgtcggccagcgcgacgttgcgtttctaa

SEQ ID NO: 23654 - protein, 429 aa, Rhodospirillum rubrum
MTIIRTSGAVAGLCGLAVALSGGSAWASGFQLKEQSAEGLGNAFAGATAKAYDPSTAFYNPAGLTRLKGTQADSVLTYIMPKAHFSGSGTNALGGSTGSIEGGDAVADAAVPSFYGVYSYNDDLKFGIAANVPFGLRTDYDKNWAGRYQAIESDLQIVTLTPSVAYRVVGDSSFGDFSIGGGPVVQFASVKLTNAVNNFGLVAGDGRAKVSGSDIGYGFNIGALWEPTETTRIGVNYRSRVEHNFDGDAKYTNVARPLAISRGLVNSGASADLTTPDVVSIGAYHEFDPQWAVTADVAWTNWSLFDELKIENDKGGVITRVDESWEDTMFVALGGIYKPVEDVALRIGVAYDQAPVGKKHRTARIPDTNRYWLAAGVSYAVTDSFSLDASYAHIFADRVSINETTAQGNLTGTYDSSIDILSASATLRF

SEQ ID NO: 23655 - DNA, 1128 bp, Cytophaga hutchinsonii
  CDS (1)..(1128)
atgggtggagcaggcgttgcaacaaacttagatgccgccagtgttttcttcaaccccggcagtgttgcgcacttagagcaaaacagtgtgagtgcaggggtgagtttaaccgctgaaagtaccgccttccgcgacgggaacagccagcaggagtttaatacaaattctccggtcagcacaccatttacgggctatggcgtttggggaccgaaagaaagcaaatttaaatttggtatgggtgtatatacaccattcggaagtaccattacatacgaagatggctggtccggacgatttagcttaacacaaatgaaattgctttccgtattttttcagccgacagtaagttataaaatcaacgacaagtttggcataggtgcaggttttgtatatggctatggaaatatagatttaagcagagacctgccgattagcaattcaaacggagattatgctacagctaacttaaaaggtacagccggcggcatgggttataatcttggtatctattacaaacccagtgacaaactttcgtttggtctgagttaccgctcggaagtaaagatgaaagtaaacaagggcacggcaacgtttaatgtacctccatcccttgccagcagctttccatcaggtaatttcagtgcgtcccttccacttcctcaagtgttaacattagggatcggctacaatgcgagcgaacggttattacttacttttgatgtgaactacatcggctggggaagttacaaatcactggcgtttgattacgaacagaatacttcttcgttaaaagacacagagtcgccccgtaattataaaaacacgtatgcattgcgtttaggtgcacaatataaagtgagtgaaaagtttttagtgcgtgcaggtacaaactatgaaaaaacaccaatcaaagatggatatgtaacaccggaagttccggatgcagacaggttgaattttacaggaggtatcgggtacaagcccagcgaccgttttgtaatagatgcttcattcagttatatcaactttatgaaacgtacggacaccaacatagaaacacacatgtccggtacatacaaaacacgcattttagtgccaggtatttcattaacctataacttcaactag

SEQ ID NO: 23656 - protein, 375 aa, Cytophaga hutchinsonii
MGGAGVATNLDAASVFFNPGSVAHLEQNSVSAGVSLTAESTAFRDGNSQQEFNTNSPVSTPFTGYGVWGPKESKFKFGMGVYTPFGSTITYEDGWSGRFSLTQMKLLSVFFQPTVSYKINDKFGIGAGFVYGYGNIDLSRDLPISNSNGDYATANLKGTAGGMGYNLGIYYKPSDKLSFGLSYRSEVKMKVNKGTATFNVPPSLASSFPSGNFSASLPLPQVLTLGIGYNASERLLLTFDVNYIGWGSYKSLAFDYEQNTSSLKDTESPRNYKNTYALRLGAQYKVSEKFLVRAGTNYEKTPIKDGYVTPEVPDADRLNFTGGIGYKPSDRFVIDASFSYINFMKRTDTNIETHMSGTYKTRILVPGISLTYNFN

SEQ ID NO: 23657 - DNA, 1035 bp, Azotobacter vinelandii AvOP
  CDS (1)..(1035): transl_table=11
atgccaacccgtcaggttctgttcgggctcgccctgctcggtgccgctggcaccgcttgggcggatgattccagattctccgtcgctgccggtcgcagcgctccggtcgcctccggttccggcgcggccgttccgccggcggccaatcccgtcatggccgccggaatgggaatggccgtggcgaacggcagcgggcagggtgccggccgcctggtcgccgaacccggactgcgcggactgaccctgcagccgactttcgcctaccggctcaacgatgcgctttccatcggtatcggcgcgcgcctcgtccagggcgctgtgatccgtcccggcggcgctccggccgatgcgcctccggcctacctggatagcgacaccggcgctggcctcaatctgggcctgctgtaccgggtgagcgacagcacctggctggggctggcctacgccagcggctacgaactgaatctcgacgagcgtgccggcgtcgccgatcccgtggcgaacgtcgcccgcggacgtccggaaaccaaccggacgatcgccgaggcgcgggcgccggacagcgtcaccgcgagcatttcccaccggctggacagtggctggatgctgtcggccagcctcggctggatgggctggagcgccctgcaacggtccgagggcgaggcgccgagcccggctgccgcgagcgtcggtggcgcacaccagtaccgcgacacctggcgcctcgccctgggcgcggaacagcaactcggcgagcatctgcactggagcatggggctgagctacgactcgtcgcccttgcccggcgaccagcgcaatctggacgacccgttgccggaaaacctgcgcctggccgccgggctgagctaccggatggatcagggggtggagttgcagctcggctacagcctgatctggctgggcgaagcggagtcgcggcagaacggccggacgcgcaacgacggcatcctgtccgccgagccgcccagcagtaccctgcacgtcatcggcgggggcatggtctggcgtttctga

SEQ ID NO: 23658 - protein, 344 aa, Azotobacter vinelandii AvOP
MPTRQVLFGLALLGAAGTAWADDSRFSVAAGRSAPVASGSGAAVPPAANPVMAAGMGMAVANGSGQGAGRLVAEPGLRGLTLQPTFAYRLNDALSIGIGARLVQGAVIRPGGAPADAPPAYLDSDTGAGLNLGLLYRVSDSTWLGLAYASGYELNLDERAGVADPVANVARGRPETNRTIAEARAPDSVTASISHRLDSGWMLSASLGWMGWSALQRSEGEAPSPAAASVGGAHQYRDTWRLALGAEQQLGEHLHWSMGLSYDSSPLPGDQRNLDDPLPENLRLAAGLSYRMDQGVELQLGYSLIWLGEAESRQNGRTRNDGILSAEPPSSTLHVIGGGMVWRF

SEQ ID NO: 23659 - DNA, 1353 bp, Chromohalobacter salexigens DSM 3043
  CDS (1)..(1353): transl_table=11
atgcataacaacatcaacaagctcacactcgccgtgacgctggcctctaccgtgatcgcctccggccatgccgctgcgtctggcttccaggtccgcgaacagagcgccaaggcactcggcaacgccatggccggggcggcggccggtgccgaggacgtcagctacatgacctacaacccggcggccatcggtaacgtcgagggcactcaggtggccggcggcatttcctacatcgatgccagcttcgaattgaccgacgcctcggcgagctccgtcaccggggccagttacatgggaaatggcaataacgaagggggcgaggaggcctgggtacccagttttgccttcaagacccgtctcgacgagcgcttcgatcttggcctggcgatctccgcgccgtacggtctctcgacgaagtatgacaaggaatggatcgggcgttatcacgccatcgaaaccgagctcaagaccatcgacatccaaccaacgctgaattaccgcgccaccgaccgcctcgaccttgctgtggggctgcgtgctcagtatgccgatgccacgctctccaacgccatcgatctgggcgcggtgggagccggcgcaggtcagttgccgccctcggcgatcggcaatgccgatggcatggccgaggtgaccggtgacgactggggctacggctacaccctgggggcgctgttccaggccaccgagcggacccgtctgggcatcagctaccgctcggaggtcgagctgacgctggacggtgacgtcgattacagctccgacaacgccgcggggcaggcagtattggccggggcgcaggccaccggtcagctgcaggacggcggcggcaaggcggagatcaccacgccggccaacctcaacctggggatctaccatcaattgactgatcggctcgccttgatggccaatgccgaatggacggagtggagcagcttcgaggagctgaccgtcgagttcgataatggagggcagagcaccacgaccgaaaactgggacgatacctgggctttctcggtgggggcgaactatcaactcaaccggcagtggctgctgcgcgccggcctgggggtcgacgaatcgccggtgccggacagcgaacaccgcacgccgcgtgtgcccgatgccgaccgccgctgggcgacgctcggggccacctggatgccgacttcgaacctgggcgtgacggcgggctacatgcacgtgttcggtgacgatggcgatatcgatcagaacgccacgccgaccaacgagaatgccagccgcggcaacctgtccgggacctatgaagtcgaggccgatgtgttcgcactgtcgatggattatcgcttctga

SEQ ID NO: 23660 - protein, 450 aa, Chromohalobacter salexigens DSM 3043
MHNNINKLTLAVTLASTVIASGHAAASGFQVREQSAKALGNAMAGAAAGAEDVSYMTYNPAAIGNVEGTQVAGGISYIDASFELTDASASSVTGASYMGNGNNEGGEEAWVPSFAFKTRLDERFDLGLAISAPYGLSTKYDKEWIGRYHAIETELKTIDIQPTLNYRATDRLDLAVGLRAQYADATLSNAIDLGAVGAGAGQLPPSAIGNADGMAEVTGDDWGYGYTLGALFQATERTRLGISYRSEVELTLDGDVDYSSDNAAGQAVLAGAQATGQLQDGGGKAEITTPANLNLGIYHQLTDRLALMANAEWTEWSSFEELTVEFDNGGQSTTTENWDDTWAFSVGANYQLNRQWLLRAGLGVDESPVPDSEHRTPRVPDADRRWATLGATWMPTSNLGVTAGYMHVFGDDGDIDQNATPTNENASRGNLSGTYEVEADVFALSMDYRF

SEQ ID NO: 23661 - DNA, 1320 bp, Desulfuromonas acetoxidans DSM 684
  CDS (1)..(1320): transl_table=11
ttgaaattactggttactgctgttgccctggcactgatgctgccgggttgggtgagtgcggcgggttttcatatccgcgaacaggggagcaaggcgatgggcatggccaatgcctttgctgcccaggctgatgatccgtcggctattttttacaatcccgccgggattgtttttcaaaccggaacccaggtcagtcttggtgtgaccgtcatcaacgtaccggaaacggaatttcgcgggaccaccaagttgggtgatgtggcaagtggccttggtgtggaacaacaggtggataccgaagcgcgtgatgacatcttttttccgcccaatttctatatgaccacccgtaaagaaggttctccctgggcgtttggtattggtattggatcactttatccacttgccaagcgctgggataccaccagcccgtttcgtgatgagattaaagaaattgccatcaagccgattaacgtcaatccgacagtggcctatctgtttgagtcgatcaaccttggtgttgcagttggtattgactatacctacgcggatgtgtggcttgaaaagtcagcgtgtgtcgatgcctatgccctgggagccgtgcctgtaccgggattgactgccgttcaattgggtgagttggagctcgaagccgatggcgatggttggggatataactttggtttgttgtggcagccgttggaaaccttgtcgtttggcgttgcctatcgcagtgaaattgaactggattttgatggtgatgctgattaccagatcaccagtgcgggccagagtgtttatggtgctccaccactttcctacacagattctatttacagtacaggcgctgaaacggaaattacgttgccggacacttggagcttcgctgttgcctggaagccgacgcgtaagctgaccgtagagttcgatgcggaccgctttggttggagctcctatgacagtttggacatcctgtttgatgaaaataccgtgctgtcggattctctgaatcgtaaagattggaacgatgtctgggcttatcggtttggtgcccagtatgcggtgacggaaactcttgatctacgtgttggttatgcccgtgacaacaccccggtacccaatgataccattggtcctgagcttcctgatgccgatcgtaacaactacacctttggtttcggttaccatacggatcgggcggtgtttgattttgcctacatgtgggttgatttcgatgatcgtaaagtcgacaacgagactcaaaccggtacatacaaaagtgacgcttatctgtttgccgctaatctgacctattttttctaa

SEQ ID NO: 23662 - protein, 439 aa, Desulfuromonas acetoxidans DSM 684
MKLLVTAVALALMLPGWVSAAGFHIREQGSKAMGMANAFAAQADDPSAIFYNPAGIVFQTGTQVSLGVTVINVPETEFRGTTKLGDVASGLGVEQQVDTEARDDIFFPPNFYMTTRKEGSPWAFGIGIGSLYPLAKRWDTTSPFRDEIKEIAIKPINVNPTVAYLFESINLGVAVGIDYTYADVWLEKSACVDAYALGAVPVPGLTAVQLGELELEADGDGWGYNFGLLWQPLETLSFGVAYRSEIELDFDGDADYQITSAGQSVYGAPPLSYTDSIYSTGAETEITLPDTWSFAVAWKPTRKLTVEFDADRFGWSSYDSLDILFDENTVLSDSLNRKDWNDVWAYRFGAQYAVTETLDLRVGYARDNTPVPNDTIGPELPDADRNNYTFGFGYHTDRAVFDFAYMWVDFDDRKVDNETQTGTYKSDAYLFAANLTYFF

SEQ ID NO: 23663 - DNA, 1353 bp, Methylobacillus flagellatus KT
  CDS (1)..(1353): transl_table=11
atggaaatcaaaatgatcaaacgcttttgcttcttatcgatcttgggaatcagcagcagcgcagccacgacgggacatgcggcaggcttcgccctgatcgagcaaagcgcatccgggtttggcaatgcctatgccggcatggctgcgcgcgccgatgacgccagtgtgcagttcttcaatccggccagcctttcctggctgccaccaggcaggcagatcatcgtgggtggcagtgccatcctgcccagcgccaagctcaggaatgtcaacagcacccaccgcagcactggtacccccattcccggtaacgatgggggagatgccgcctcactggagttggtgcccaacttttactttgcaaatgacctgggggacaacctcaagtttggcttgggcgtcaccgtcccgtacggactgacctcggactatgacagtggctggaaagggcgctaccaggcgctgaaatccgaggtaatgaccctagacatcaacccggctttctctttcaaggccaacgagaaactctccatcggtggcggtatcagcgtgcaatatattcgggcagaactgaccaatgcgctcgattccagtgcattgtgccaagccaacccggcattgccagcgggcacgtgtaacgcactcggactgggccaaataggcaatccggcagtagacagctatagcaagatgcaaggggacgatatcagttgggggttcaacctgggtgtgatctttaaaccttgggacggaacgacattgggggccagctatcgctcgcatatcaagcacaagctggaaggaaaggcaaaattcagacctgttgccccgctggccgccacattacgcaactccgatatctccaccagtctctctctgccagaaaccgcctcgttcagtattgcccagcgattgaatgaccgtgttgaactgttggctgatgtgacatggaccaattggagccgcttccaggaattacgcatccattttgataatggcctgggtgacaatgtcaccaccacaaaatggaatgacagctaccgtttctcccttggtgggaactatcgttacagcgaccgcctgacgttgcgcgccggggtggcttacgaccaaacgcctgtgcccgatgccgctcaccgcacgccgcgcatcccggatgctgaccgcacctggtttgctgtgggtgcaagctggaaactggatgcagccaacaccctggattttggttacgcgtatttgcgcctgaaagacaccagcaccaggcacgtcagcgaaggagctgtcagccatgtgctggaaggcgattttacgtcgaaagtgaatatactcagcgcacagtgggtatatagcttttga

SEQ ID NO: 23664 - protein, 450 aa, Methylobacillus flagellatus KT
MEIKMIKRFCFLSILGISSSAATTGHAAGFALIEQSASGFGNAYAGMAARADDASVQFFNPASLSWLPPGRQIIVGGSAILPSAKLRNVNSTHRSTGTPIPGNDGGDAASLELVPNFYFANDLGDNLKFGLGVTVPYGLTSDYDSGWKGRYQALKSEVMTLDINPAFSFKANEKLSIGGGISVQYIRAELTNALDSSALCQANPALPAGTCNALGLGQIGNPAVDSYSKMQGDDISWGFNLGVIFKPWDGTTLGASYRSHIKHKLEGKAKFRPVAPLAATLRNSDISTSLSLPETASFSIAQRLNDRVELLADVTWTNWSRFQELRIHFDNGLGDNVTTTKWNDSYRFSLGGNYRYSDRLTLRAGVAYDQTPVPDAAHRTPRIPDADRTWFAVGASWKLDAANTLDFGYAYLRLKDTSTRHVSEGAVSHVLEGDFTSKVNILSAQWVYSF

SEQ ID NO: 23665 - DNA, 1350 bp, Shewanella baltica OS155
  CDS (1)..(1350): transl_table=11
atgcaaaaacgtcttctgactttggctgtcactgcagccttgttaagttcaacgactcaactccatgccgcaggttttcaattagccgaatattctgccacaggcttaggccgcgcctttgcgggtgaagcggctatggcggataacgcttcggctcaagcacgtaatccagccatgttgacttatctcgaaggtcgtcagttatcgacgggtggtatttatgtcatgccaaacgtcgatgtgactggcgatgtcagcattagctcgccgttgcttggcccagatcctgttgttatgaaaggtggcgatgcactggatgtggccgatgacgcactggtgccaaatttttactactcaaatcagttaaatgatcaatggacttggggcctagcggtaaattctaactatggtctagccactgaattacctgcgactcacgccgcggctatttttggtaacaagacttcggttacaaccgttgagtttaatccaaacatcgcttatcgcatcaatgatgccgttagcgtcggtgctggtgtacgtatcgtttatggtgaaggcgaaattggtgcgtcattaccaggttgggtcgatggtatcaaacctgctctgcctgctcccgtgcaggctgtgttacctcctggtggcactgagctgaaaagcatgaagggtgatgatgtgggttacggctggcagttaggtgcaagctggcagatcaatccggctcaccgtttaggttttgcgtatcacagcggcgtgcaattggacttagatggtcatgcttctggcgtcttgtataccggcggtcaagacgtgtctattgaagggtatttaccgcttgaattacccgcctttgcagaaattgcttcccaccaccaattgaccgataactgggccatgcacgcgagcgtgaactggaccgattggagtgtatttgatcagctggtggcttatttccctggtgacgttaaacctaagggcgatttagagtctgatttagttaaagaagaacactttgaagataactggcgtttcgcgctgggaaccacttatcaagtgaataatgactggttagtgcgtgccggtgttgctttagacaaaacggcagcaaatgacgagtggcgcacaactacaattccagactctgaccgtctgtggttctctgtcggtgccggttatcaggcgactaagaatctgaatgttgattttgcggtgacgtatatcaaagcaacaggcgatgcgccaatcaacgaacagcaaaatctactgggcttagcggccgttaactttaacggtgaagcgagcggcgatgtgtggcttgcgggtatccagatgagctataagatgtaa

SEQ ID NO: 23666 - protein, 449 aa, Shewanella baltica OS155
MQKRLLTLAVTAALLSSTTQLHAAGFQLAEYSATGLGRAFAGEAAMADNASAQARNPAMLTYLEGRQLSTGGIYVMPNVDVTGDVSISSPLLGPDPVVMKGGDALDVADDALVPNFYYSNQLNDQWTWGLAVNSNYGLATELPATHAAAIFGNKTSVTTVEFNPNIAYRINDAVSVGAGVRIVYGEGEIGASLPGWVDGIKPALPAPVQAVLPPGGTELKSMKGDDVGYGWQLGASWQINPAHRLGFAYHSGVQLDLDGHASGVLYTGGQDVSIEGYLPLELPAFAEIASHHQLTDNWAMHASVNWTDWSVFDQLVAYFPGDVKPKGDLESDLVKEEHFEDNWRFALGTTYQVNNDWLVRAGVALDKTAANDEWRTTTIPDSDRLWFSVGAGYQATKNLNVDFAVTYIKATGDAPINEQQNLLGLAAVNFNGEASGDVWLAGIQMSYKM

SEQ ID NO: 23667 - DNA, 1323 bp, Shewanella amazonensis SB2B
  CDS (1)..(1323): transl_table=11
atgacaacaagagaagagacgatgaagtacttcaacaagacactgcttgcagccgccattggtttggcaagcacccaaaccctggctgccggttttcaactcaacagtcactctgccaccggtgttggccgcgccatttccggtgatgccgttattgccgacaacgcctccgtgttgtcccgtaacccagctgccatggcgctgtttgacaacacagccctgtctctgggcgtgacctatgccgacatcgatgtgagtgtaaaagatgtctgtaaagccggtacccctatttgtttcggtagcgacaccgatgctgcggaagataaaatcatccccaatttctattacatcaaccccattaacgataaatgggcctttggtgtagccgccttctccaacttcggcacaggtaccgatcctggcgctctggccaacaatgcagtcactctgcctggccttggtaccattcctgcgccagttgacctgctgggtaacacagaagttatcaccatgaacctgaatgccagcctgtcatatcgtgtaaacgaacagctgagcctgggcgccggtgtggatgtgatttacggccagggcaccctgacccgtaaaggcaacctgccttttggcccgaacggtgaaatggtgccggtaagtctggtgaacgtggatgccgacggttgggcactgggcgggatcctgggcgcggtgtatgaatttaatgcagaccaccgtttaggggtgagctacagattcagccccgagtttaaagccagcggcgatgtgcagacgttggtgccacaggctcaggcgtatgccaactttgatgagattgttattccgctgccggacattttccaggtggccggtttccaccagctgaccgaaaagtttgccctgcactatacggcgcaactgacttcctggggcgatttcaaagagatcaccctcgaaaatggcactctgggccagaccagcattccgtcttctcagctcaagcactatgcctgggatgactcttggctgttcagcatcggtggtacttatcagctgtctgatgcctggacactgcgtgctggctacatgcacgatcagggtgtagtggatgagatcagctcgatttctatccctgattcagatcgcaactggtacacccttggcgcaagctatgcactgtctgccaatgccaccctggatctgggggtagcactggtacgcggtgaagacacccaggtgctggagcaaagcgccattatcggtgacgtgattgcccacacccgctccaacgccgtgtactattcactgcagtacaactacaagtactga

SEQ ID NO: 23668 - protein, 440 aa, Shewanella amazonensis SB2B
MTTREETMKYFNKTLLAAAIGLASTQTLAAGFQLNSHSATGVGRAISGDAVIADNASVLSRNPAAMALFDNTALSLGVTYADIDVSVKDVCKAGTPICFGSDTDAAEDKIIPNFYYINPINDKWAFGVAAFSNFGTGTDPGALANNAVTLPGLGTIPAPVDLLGNTEVITMNLNASLSYRVNEQLSLGAGVDVIYGQGTLTRKGNLPFGPNGEMVPVSLVNVDADGWALGGILGAVYEFNADHRLGVSYRFSPEFKASGDVQTLVPQAQAYANFDEIVIPLPDIFQVAGFHQLTEKFALHYTAQLTSWGDFKEITLENGTLGQTSIPSSQLKHYAWDDSWLFSIGGTYQLSDAWTLRAGYMHDQGVVDEISSISIPDSDRNWYTLGASYALSANATLDLGVALVRGEDTQVLEQSAIIGDVIAHTRSNAVYYSLQYNYKY

SEQ ID NO: 23669 - DNA, 1359 bp, Shewanella amazonensis SB2B
  CDS (1)..(1359): transl_table=11
atgataatgaaaaagagtgtactgacttttgccgtatcagcggctcttatggggattacgactcaggttaacgctgctggcttccagctggctgaatactctgccactggtcttggccgtgcttttgccggtgaagcggccatggccgacaacgccgcggctcaagcgcgtaacccagccatgctggcatacctgagcggtcgtcaggtatccggcggcggtatctacgtcgctaccgaagtggacgtgaccggcgatgtgcacattgcgtctccagtgcttggtccgcagggtgtgacgctgaatgccgacgcctatgacgttgccgacagtgcacttatcccaaacttctattactcaagccaaatcaatgacaactggacctggggtctggctgttaactccaactacggcctggccaccgagctgcctgccactcacgcggcctccttgtttggccatcacaccgaaatcaccacagttgagttcaaccccaacatcgcatatcgcctgaacgatgcggtgactttgggtgccggtgtgcgcattgtttacggtgacggtagcattggtgcagctacaccttactgggtgggcgccatcaaggccaatccaaacctgccagcacaaattgccgcccgtctgcctgagcctggcactgtgctcaaaaccatggaaggcgatgatgtaagctacggctggcaagtgggcggtagctggcagccttctgaaaaccacagattcggcttggcttatcacagcggtgtagagctggagctgtccgggagcgctgctggtcttgtctacactggtggccagaacctggatattgaaggttatctgccactggagctgccagcttttgccgagttgtcttctttccatcagctgagtgatgatgtggcgctgcacgccagcgttaactggacccagtggagtgtgttcgaccgtctggtggcttacttccccggtgaaaccaagccagtgggtggcatcgagtccgatctggtgaaagaagagaacttcaaggacagctggcgcgttgccgtaggttctacctggaacgtaaacaaagactggaccgtacgcagcggctttgcggttgaccgcactgcagtggatgatgagttccgtaccaccaccatccccgactctgaccgcctgtggttcagtctgggtgccggttaccgcgccagcgaaaacctgaccgtggatatggccatcacctatattcgtgcccacggtttcgcgcctatcgatgagcatcaggatctggccggtctggctcaggtcagctttaacggtgaagccggtggcagcgtgtggctggccggtgtgcagttaagctataagatgtaa

SEQ ID NO: 23670 - protein, 452 aa, Shewanella amazonensis SB2B
MIMKKSVLTFAVSAALMGITTQVNAAGFQLAEYSATGLGRAFAGEAAMADNAAAQARNPAMLAYLSGRQVSGGGIYVATEVDVTGDVHIASPVLGPQGVTLNADAYDVADSALIPNFYYSSQINDNWTWGLAVNSNYGLATELPATHAASLFGHHTEITTVEFNPNIAYRLNDAVTLGAGVRIVYGDGSIGAATPYWVGAIKANPNLPAQIAARLPEPGTVLKTMEGDDVSYGWQVGGSWQPSENHRFGLAYHSGVELELSGSAAGLVYTGGQNLDIEGYLPLELPAFAELSSFHQLSDDVALHASVNWTQWSVFDRLVAYFPGETKPVGGIESDLVKEENFKDSWRVAVGSTWNVNKDWTVRSGFAVDRTAVDDEFRTTTIPDSDRLWFSLGAGYRASENLTVDMAITYIRAHGFAPIDEHQDLAGLAQVSFNGEAGGSVWLAGVQLSYKM

SEQ ID NO: 23671 - DNA, 999 bp, Shewanella denitrificans OS-217
  CDS (1)..(999): transl_table=11
atgaaaaaaaccgtgttaaccttggccatcagtgccttagtcgtaggttcaactgcgccagtgaatgccgcaggtttccagctggctgaatactctgccacaggtcaaggccgagcctttgctggcgaagccgctatggctgacaatgcctcaactcaagcgcgtaaccctgccatgttaagttaccttgaaggccagcaagtctccttgggtggtatttacgtgatgacgaatgttgacgtagatggtgatgtctccctacgctcacccttatttggttcggctgaagtggtgatccctgccgatggaaaagacgttgccgccagtgcgttagttcctaatttttactacgctaatccactaaatgaagattggactctgggccttggggtgaattccaactatggattagccacagaagtgcccgcggatcacgcggccgccatctttggtagtcacacttcggtgaaaacagtcgaattcaatcccaatcttgcttaccgcgtaaatgatgcgttcactttaggtgcaggcgcgcgcttggtgtatggcgaaggtgaaatatcagcaagcacccctgcttggattagcgctataggcagtcatcccaatgtccctgctagcattgcagcacgtctgccgtcagcaggtactcagcttaagtctatgcaaggtgatgacataggttatggctggacgttaggttcaagctggcagattaacccaagtcacagactcggcttggcttatcacagcggagtggagcttgagcttgcaggttctgcggcagggttaagctatactggtggccaagatgtggctatagaaggttatttaccccttgaactgcccgcttttgcagaacttgcctcttaccatgagctgacagagaagcttgccattcataccagtgtgaactggactcagtggagtgtatttgagcgtttagtggcacatttcccaggtgatgtgaagcctgtgggcaaccttgagacatag

SEQ ID NO: 23672 - protein, 332 aa, Shewanella denitrificans OS-217
MKKTVLTLAISALVVGSTAPVNAAGFQLAEYSATGQGRAFAGEAAMADNASTQARNPAMLSYLEGQQVSLGGIYVMTNVDVDGDVSLRSPLFGSAEVVIPADGKDVAASALVPNFYYANPLNEDWTLGLGVNSNYGLATEVPADHAAAIFGSHTSVKTVEFNPNLAYRVNDAFTLGAGARLVYGEGEISASTPAWISAIGSHPNVPASIAARLPSAGTQLKSMQGDDIGYGWTLGSSWQINPSHRLGLAYHSGVELELAGSAAGLSYTGGQDVAIEGYLPLELPAFAELASYHELTEKLAIHTSVNWTQWSVFERLVAHFPGDVKPVGNLET

SEQ ID NO: 23673 - DNA, 1353 bp, Shewanella frigidimarina NCIMB 400
  CDS (1)..(1353): transl_table=11
atgaaaaaaacagtgttaacactggcgattagcgccattgtatttggggcaacaactcaagtgaacgcggcaggtttccaacttgcagaatactcagcgacaggtttgggccgtgcatttgctggtgaagcagctattgcagacaatgcgtcaactcaagcgcgtaatccagccatgctagcttatctagaaggccgccaagtatcagcgggtggcatttatgttatgccaaatgttgatgtggttggtgatgtcggtatttcttcaccgttattaggctcagagccattagtgattggtgctgacgcatacgatgttgctgacaatgcatttgtgccaaacttttattattcaaaccagttgaatgatcaatggacttggggtctagcggttaattcaaattatggtttagcaactgatattccggtagcggatgcagcggctatttttggcagtaaaacctcaattaccactgtcgagtttaatcccaatgttgctttccgtgttgatgactcattcactgtaggtgcaggcttacgtgttgtgtacggtgaaggtgaagttagtgcaaccgctccaggttggattgatgcgattaaagctaatcctaacttacctgcaagcattaatgcacgtttaccttcaggtggtaccaatctaaagtcaatggaaggtgatgatgttggctatggttggaaagcgggcgcgagctggcaaattaactcagcaaaccgcatcggtttggcttatcacagtagtgtcgatcttaaattagacggtcatgtgtctggcgtggcttataacggtggtcaaaatattgaaattgagggctacttacctattgagttacctgcatttgcggaactggcttcttaccatcagttaactgaaaactgggcaatgcatgcaagtgttaattggacagaatggagtgtgtttgaacaactagtggcgtacttccctggtgatgttaagcctgtcggtggcctagagtcagacgtggtaaaagaagagaactttaaagataactggcgttatgcgcttggtaccacctatacacttaatgaccagtggacattacgtgctggtatggcgctagataaaaccgcggttgatgaccaacaccgcaccaccaccattccagattctgaccgtttatggttcagtgtgggtaccggttatcaagtctctaaaaatctgaatgttgatgttggtgtgacttacattcgcactcatggtgatgcacccattacagagactcagagcctgcaaaatattgcatcggttagcttcactggtgaagcaacgggtgacgtatggttaacaggcgtacagttaagttataagatgtaa

SEQ ID NO: 23674 - protein, 450 aa, Shewanella frigidimarina NCIMB 400
MKKTVLTLAISAIVFGATTQVNAAGFQLAEYSATGLGRAFAGEAAIADNASTQARNPAMLAYLEGRQVSAGGIYVMPNVDVVGDVGISSPLLGSEPLVIGADAYDVADNAFVPNFYYSNQLNDQWTWGLAVNSNYGLATDIPVADAAAIFGSKTSITTVEFNPNVAFRVDDSFTVGAGLRVVYGEGEVSATAPGWIDAIKANPNLPASINARLPSGGTNLKSMEGDDVGYGWKAGASWQINSANRIGLAYHSSVDLKLDGHVSGVAYNGGQNIEIEGYLPIELPAFAELASYHQLTENWAMHASVNWTEWSVFEQLVAYFPGDVKPVGGLESDVVKEENFKDNWRYALGTTYTLNDQWTLRAGMALDKTAVDDQHRTTTIPDSDRLWFSVGTGYQVSKNLNVDVGVTYIRTHGDAPITETQSLQNIASVSFTGEATGDVWLTGVQLSYKM

SEQ ID NO: 23675 - DNA, 1242 bp, Thiomicrospira denitrificans ATCC 33889
  CDS (1)..(1242): transl_table=11
atgagaaatgcgtttgtttttttactacttggctctgctcttgtagcaggtggatataaaattcctgagacttcactaaactctgttgctcttggtgccgcaaatgtcgcacatgcaaatggtgctgatgcagcgtattacaacccagcaaatatggcttttatgaaagatgaagcagttattgagggaaacctaatttatattgggcttagtgatgtaaactttcaaggttcgtacacaagtagtttgggaacaactagcggatataacatagactcaaaaagagaaaattttattatcccctcacttcactatgtctcacaagatataagcggagttcgtcttggagttagtttagtctctccagcagggctctcaaaaagatggcaagatgctccagctgtgtatagctcggaggagtttacgctaaaaactgttgaactaaatccaagtgttgcgtttaaagtaagtgagaacattggtgtagctttaggtctaagagctatctacacagatggtattgtaaagagtacttcaccaatcgcttctcgtgatatgagcggtgatagcatagattttggatataacttagcgctctcatataagccaacatcagagttagaatttgcgctgacatatcgctcaaaagtagatttaacctcaaaaggctctgctactcttttttatcgtgatattgcaaatagttttggaggcggcgtgggagcgacttacagctcttctagctctgcttcagttagtgtacctgttccagctcttttaaatatagcagcagcatatacgtttctttcaaaaacaacactagagtttgtgtatgagagaaactactggagtgcatataaagagcttgattttaactatggaagtggcgtaaatccagtgactaacattgtttttggcacgtcaattgcaaaaaactttaaagattgcgatgtctttcgctttggtgtaacgcaagagttaaatgcgctaaaacttatgggtggtctagtgatagataaatccccagtaccaaactcaacaataagttttgagcttccagatagcgattcactctcgttctcaatgggtgcaaggtatcaaataaacgacaaattaaacataggattagcggctctttactcagtgcgagaaaacagaagagtctcaaacgcatcaatagatggcgaattttcagatgcaaacgtacttatagtttcatctgcaatagagtataaattttaa

SEQ ID NO: 23676 - protein, 413 aa, Thiomicrospira denitrificans ATCC 33889
MRNAFVFLLLGSALVAGGYKIPETSLNSVALGAANVAHANGADAAYYNPANMAFMKDEAVIEGNLIYIGLSDVNFQGSYTSSLGTTSGYNIDSKRENFIIPSLHYVSQDISGVRLGVSLVSPAGLSKRWQDAPAVYSSEEFTLKTVELNPSVAFKVSENIGVALGLRAIYTDGIVKSTSPIASRDMSGDSIDFGYNLALSYKPTSELEFALTYRSKVDLTSKGSATLFYRDIANSFGGGVGATYSSSSSASVSVPVPALLNIAAAYTFLSKTTLEFVYERNYWSAYKELDFNYGSGVNPVTNIVFGTSIAKNFKDCDVFRFGVTQELNALKLMGGLVIDKSPVPNSTISFELPDSDSLSFSMGARYQINDKLNIGLAALYSVRENRRVSNASIDGEFSDANVLIVSSAIEYKF

SEQ ID NO: 23677 - DNA, 1401 bp, Syntrophobacter fumaroxidans MPOB
  CDS (1)..(1401): transl_table=11
atggatcgaggaacatccggtctccatccggcaagccgacggcaacgagtcgaaggccgcggacggcccccctggccgaaggggatcgccaacgaacaaggaggttggagtatgctgtgtctgcgtatcgccggttccatgctgttgatcgtgctggccagtttcgccctgatcggcgcttctcccgctttcggttcgggctttgccatctacacacagggagccgcatccctcgggcaggccgcagccaccatcgcccacggggaagatccctcggtcattttcttcaaccccgccctgatgagcaaattcgaaggcactcaggtcgaagtcgggaccacgttgctcattcccctgcgcgatttcaagagcgggctcaccggaaattccaccagtgccgaaaaggatgttttctttccttccactttttttgtcactcaccggttcacggacaagatcagcctgggactcggagtgttcaatcccttcggactcgccacggaatgggcggacaactgggaaggaagatatatcgcgaccaagtccgaattgacgacttacgacatcaaccccgtgatttcctggcaggtcacgccgtggctggccatcggcggcggtcccgatttcctgatcctggacaccaccttggagaaaaagctctatttcgcgcccttggggctcgccgacggaggacagaggttcaaaggggacggtcacggcgtgggatggagtttcggggcgctgtttgaaccccatccggatgtatccatcggggcatcgtatcggagcatggtcagagtgaacgtcgacggcaaggctgagttcaccctgcccaacggcgcaccggcttatttctcactgctgtttcccgacaccgacggcgacgcccaactcaatctcccccagcgcgttcacttcggtgtgtgctacaagggcttctatcccctcaccctggaagtcgccgcgcgatgggaagggtggtcttccttcgaacagttgatcatccggctcgacaagccggtcgcaggcagcatggtgtccgtcaacaacaggaactggcacgacgtatggaccggaagcatcggggccaaataccagttgaacgaccggttcgcgcttgtggccggatacctctaccagggcaatcccgttccggattccaccttcgacccgtccatcccggacgccgacgcccacctgatcaccatcgggacggatttcaggtatggagcgctgcgcgccgggttgtcctacggcttccagaaaatggtgagccgcaccaaaaacaacacggtggacgacaatcccaacgacggcttcttcaatcccttgactgcggccaacggggagtacaacacggacatccatctcatcgggctgaccctgagctacatgttctga

SEQ ID NO: 23678 - protein, 466 aa, Syntrophobacter fumaroxidans MPOB
MDRGTSGLHPASRRQRVEGRGRPPWPKGIANEQGGWSMLCLRIAGSMLLIVLASFALIGASPAFGSGFAIYTQGAASLGQAAATIAHGEDPSVIFFNPALMSKFEGTQVEVGTTLLIPLRDFKSGLTGNSTSAEKDVFFPSTFFVTHRFTDKISLGLGVFNPFGLATEWADNWEGRYIATKSELTTYDINPVISWQVTPWLAIGGGPDFLILDTTLEKKLYFAPLGLADGGQRFKGDGHGVGWSFGALFEPHPDVSIGASYRSMVRVNVDGKAEFTLPNGAPAYFSLLFPDTDGDAQLNLPQRVHFGVCYKGFYPLTLEVAARWEGWSSFEQLIIRLDKPVAGSMVSVNNRNWHDVWTGSIGAKYQLNDRFALVAGYLYQGNPVPDSTFDPSIPDADAHLITIGTDFRYGALRAGLSYGFQKMVSRTKNNTVDDNPNDGFFNPLTAANGEYNTDIHLIGLTLSYMF

SEQ ID NO: 23679 - DNA, 1029 bp, Syntrophobacter fumaroxidans MPOB
  CDS (1)..(1029): transl_table=11
atggccatcataccgagcaccgatgtaaagttcgtgggcgcctcctatggaaccaaggacaacgtgtggcttgcgccgcatttttatgccacgtaccagttttccgaccggctctggttcggcgtggggttgttctcacccttcgggctgggcacggaattcgacagcgactggccgggcaggttcagcaactacaacgcggtgatccagaccctgaacttcaatcccaatgtcgccctcaagctgaacgaccagttttccatcgcggcgggatttgacatcatgtggttcgacctgaagctcgagcagagcgttgcggacttgagcggctacggtctgggaatcatcgaccaggacctgagcggcagttccttcgggtatgggttcaacctcgccatgcattaccgggcttgcgattggttgcgcctggggatttcctatcgcagccaggtcaagcagcatgtggacggcaatgtggagttttcgccgaacgtgtcgttctatcccttcaattttgtcaacatggacggcagcgggaccatcacgctgccggatgagctcttttttggcgccacgttttatcccatgccgaacctcagcttcgaggtcggagccgtctggacccggtggagcacgtacaatgcgttgaccatccagtacgaggagccgatcgtcggccccacatccacggtcacgagggaaaagcaatgggaagacgtctggaggatccagttcggggttgaatacaaagtgtgcgaatggctggacctgagagcgggatacgtgttcgaccaggaacccagtgtcgacaagtacgtcgactatctcgtgccggccaacgacaggcacctgttcaacttcggcccgggttttcactgggggaactggaccaccgacctgtcctacacgtatctactcatcgaggatcgggacgtcagtgactccgaggcctccggcttcatcaggccgtcgcagttcaggaacgggcatgcccatctgatcgggatcagcgtcggctacaagttttga

SEQ ID NO: 23680 - protein, 342 aa, Syntrophobacter fumaroxidans MPOB
MAIIPSTDVKFVGASYGTKDNVWLAPHFYATYQFSDRLWFGVGLFSPFGLGTEFDSDWPGRFSNYNAVIQTLNFNPNVALKLNDQFSIAAGFDIMWFDLKLEQSVADLSGYGLGIIDQDLSGSSFGYGFNLAMHYRACDWLRLGISYRSQVKQHVDGNVEFSPNVSFYPFNFVNMDGSGTITLPDELFFGATFYPMPNLSFEVGAVWTRWSTYNALTIQYEEPIVGPTSTVTREKQWEDVWRIQFGVEYKVCEWLDLRAGYVFDQEPSVDKYVDYLVPANDRHLFNFGPGFHWGNWTTDLSYTYLLIEDRDVSDSEASGFIRPSQFRNGHAHLIGISVGYKF

SEQ ID NO: 23681 - DNA, 1344 bp, Xylella fastidiosa Ann-1
  CDS (1)..(1344): transl_table=11
atgattagacgtgctttcaccttagtcaacgttactgcactaacgctaagcatcactggtgtgctctacatcggtaatgcgcacgctgctgctttccaattaaaggagaacagcgctaaagctctgggtcggtcattcgcaggcgcggcaagcgcccaagacgacgccgccatcattgtcaacaaccctgccggcatgcgccaactcgacggacgacaattccaggccgatctgagcacggtcagattttccgccgaatatcgtgggagtccaggaatttatcgcaatggcaacccaatcggtggcggcaatggtggggatgccggcatggtggcactgctgcctgactcctatttccacatgccttttggcgataacaacaacgtgcatttaggggcaacgctcaacgcaccattcggtttcagtacaaaatacgatcgcaactggacaggacgctatcacggcatctatagcaagttacaggcaatcgatctaggcatagccgtttcctatgacgttaacccgtacgtgtcgttcggcggtgcagtgtttgctgaacgcttgaacgtggacctgagtaatgcgatcgacttcgggagcattctaaatgcgcgtcgcataccaagcttctccccgggtagtgccgatggttactcacacatcgaaggtcacgataccagcatgggcttcacactgggggggttgttcagtcccgatgaaaagacccatattggcttcagctaccgatctgaggttgaacacaacgcaaacaatggaaacgctcactttactgtgcctgagaacgctgctgcagtgctggcggttgctgcaccgggaacattcatcaatacaaaaattaagtccacaatccgcctacctgccagcgcaacaaccagcttcactcatgccattgatgaccgatggtccataatggctgaagtcactcggactgcctggagcaagttagacaaaatcaccattcatttcgcatcctctcagcccaacaacgtactgaatttttcctatcaagataccacttttgttgctctcgggaccgaatatcggttcaacgacatgctaacgctgcgtggtggcttggcttatgaccagacgccgaccaccgccgaatatcgcagcgtacgggtgccagacaacagccgcacctggatctcattcggtatgacttggaaaccatcaaagcaaaccgattacaacatcggatatgcacatttgtttatcggtcatccgactatcacacaaatcagcgcaacaggtagcaccttagccggtgcttacaacatcaatgccgacttacttgctacttcgatcaactacaagttctga

SEQ ID NO: 23682 - protein, 447 aa, Xylella fastidiosa Ann-1
MIRRAFTLVNVTALTLSITGVLYIGNAHAAAFQLKENSAKALGRSFAGAASAQDDAAIIVNNPAGMRQLDGRQFQADLSTVRFSAEYRGSPGIYRNGNPIGGGNGGDAGMVALLPDSYFHMPFGDNNNVHLGATLNAPFGFSTKYDRNWTGRYHGIYSKLQAIDLGIAVSYDVNPYVSFGGAVFAERLNVDLSNAIDFGSILNARRIPSFSPGSADGYSHIEGHDTSMGFTLGGLFSPDEKTHIGFSYRSEVEHNANNGNAHFTVPENAAAVLAVAAPGTFINTKIKSTIRLPASATTSFTHAIDDRWSIMAEVTRTAWSKLDKITIHFASSQPNNVLNFSYQDTTFVALGTEYRFNDMLTLRGGLAYDQTPTTAEYRSVRVPDNSRTWISFGMTWKPSKQTDYNIGYAHLFIGHPTITQISATGSTLAGAYNINADLLATSINYKF

SEQ ID NO: 23683 - DNA, 1203 bp, Rhodoferax ferrireducens DSM 15236
  CDS (1)..(1203): transl_table=11
atgaaattcaaacaaacaatggtaagtctgtcagtggctggtgcgttgttggtgatgtccggaagcgccgcagcatccgggttcgcattgatcgaacaaagcgccagcggaatgggcaatgcttttgcgggcggagcggcgatcgccgatgatgcctcgacggtgttcttcaatcctgctgggatgtcgcgtttgagtggcaagcaaattgcgatcactgcgcatgcgatcacaccctcggctaaatatacttctgctgcgggcgttcccagcgggggcgatgcgggcggcaccgcgatcgtcccgaatggctattttgtgatggaagtgaaccccgccctgagattcggcctgggtgtcaacgcaccgttcgggttgcagaccgaatatgacgcgaactgggtcggcaaacagcaggcgatcaagtcaaagctcgaaaccgtgaacgtgaatccgtcactgtcttaccaggttaatgacaagctgagcattggtggaggactggattaccagcacatcaagggcgaattgtcccaagatcaagggggcgctatcggcgttgcggtcatcaatggctccgacagtacctggggttacaacctgggcgcgttgtatcaggtggattccaccacacgcatcggagtggcctatcgttccacgatgagctataccttgagcggctctgtggccacttcgctgcccttcgcaaacgggccggtgtcgctaaatataaaactgcctgacagcttgtcaatcagcggcttccatcaatacagtgataaatgggatgtcatggccgatgtcacgtttacgggatggagttcgttcaagcaggtgaagattgtggacgggacgggtgtgaccatctcgaacacgcctgaaaactggaaagacaccgtacgggtagcggttggcgcaacgtatcattacaaccagcactggttggcccgtgccggcctggcttatgaccaagcacctgtttcggatgaatttcgaaccgcgcgaattccggacaacagccgcacttggctgtcatttggcggacagtacaagccgtcggtgaccagcgcgattgatgtcgggtattcacatttattcctgagagattcctcgatcaactcgccaacgcctgcccctgctctggttggaacatacaagaacgcggtcgatatcctcagtgtgcaatatacctatagcttttaa

SEQ ID NO: 23684 - protein, 400 aa, Rhodoferax ferrireducens DSM 15236
MKFKQTMVSLSVAGALLVMSGSAAASGFALIEQSASGMGNAFAGGAAIADDASTVFFNPAGMSRLSGKQIAITAHAITPSAKYTSAAGVPSGGDAGGTAIVPNGYFVMEVNPALRFGLGVNAPFGLQTEYDANWVGKQQAIKSKLETVNVNPSLSYQVNDKLSIGGGLDYQHIKGELSQDQGGAIGVAVINGSDSTWGYNLGALYQVDSTTRIGVAYRSTMSYTLSGSVATSLPFANGPVSLNIKLPDSLSISGFHQYSDKWDVMADVTFTGWSSFKQVKIVDGTGVTISNTPENWKDTVRVAVGATYHYNQHWLARAGLAYDQAPVSDEFRTARIPDNSRTWLSFGGQYKPSVTSAIDVGYSHLFLRDSSINSPTPAPALVGTYKNAVDILSVQYTYSF

SEQ ID NO: 23685 - DNA, 1383 bp, Pseudomonas putida
  CDS (1)..(1383): transl_table=11
atgaaaaaaacaatatacagcttaagtgcctgcggcattttgacgtgcttgtactgtggtattgcgtctgcaacagatgctttcaacctcgtcggggttggaccggtttcccaaggtatgggggggattggtgcagccttcaatatcggggcacaaggtatgatgctgaacccggcaacgcttactcagatgcaagaaggtatgcatctggggctgggaatggacatcattactgcggaattggaagtcaagaataccgctaccggcgaaaaagccgactcccatagtcgtgggcgcaacaacgggccttacgtggcgcctgagctttctttggtgtggcgtggtgagcgatatgcgctgggagtcggtgcttttgcttccgatggggttggaacccagtttggagacaccagctttctctcgcgtaccacgaccaataatcttaatacagggctggaaaactactcccgtctgatagttttgcggataccgttctctgcggcttaccaggtgaacgagaagttgtccgtcggggcatcgttggatgctgtgtggacgtcggtgaacttgggactcctactggataccacacagattggtacattggttggacaaggccaggtgtccggctcattgatgccagcgttgctgagcgtgccggagctgtcggcaggttatctatccgcggacaatcaccgtgccagcggtggtggcgtggactcctggggcataggtggccggcttggtctgacctatcagttgaccccaaaaacacgggtggggattgtatacaacttcaagacccatgttggagacctgtctggcaatgccgatttgacggcagtaagcgctgtcgcgggtaatatccctctctcgggtgaactcaagctacataacttcgagatgccagcatctctcgttgcgggcatcagtcacgaattcagtgatcagtttgctgttgcgttcgactacaagcgtgtctactggagcgatgtcatggatgacatagaagtcaacttcaagcagaaagccacgggcgacactatcaatctgaaactgcctttcaattatcgggacaccaacgtgtattcgttgggagcgcaataccgctacggtgcgaactgggtgtttcgagcgggcgtgcactatgcccaactggccaacccttcaagtggtacaatgccaatcattccttcgacaccgactaccagtctctcgggaggcttttcatatgccttcagccctgaggatgtagtcgatttttctctggcctacggattcaagaagaaagtatccaatgacagcctgccgatcaccgacaagcccatcgaagtatcgcattcgcagatagttacatcgatttcctataccaagagtttctag

SEQ ID NO: 23686 - protein, 460 aa, Pseudomonas putida
MKKTIYSLSACGILTCLYCGIASATDAFNLVGVGPVSQGMGGIGAAFNIGAQGMMLNPATLTQMQEGMHLGLGMDIITAELEVKNTATGEKADSHSRGRNNGPYVAPELSLVWRGERYALGVGAFASDGVGTQFGDTSFLSRTTTNNLNTGLENYSRLIVLRIPFSAAYQVNEKLSVGASLDAVWTSVNLGLLLDTTQIGTLVGQGQVSGSLMPALLSVPELSAGYLSADNHRASGGGVDSWGIGGRLGLTYQLTPKTRVGIVYNFKTHVGDLSGNADLTAVSAVAGNIPLSGELKLHNFEMPASLVAGISHEFSDQFAVAFDYKRVYWSDVMDDIEVNFKQKATGDTINLKLPFNYRDTNVYSLGAQYRYGANWVFRAGVHYAQLANPSSGTMPIIPSTPTTSLSGGFSYAFSPEDVVDFSLAYGFKKKVSNDSLPITDKPIEVSHSQIVTSISYTKSF

SEQ ID NO: 23687 - DNA, 1416 bp, Alcaligenes eutrophus
  CDS (1)..(1416): transl_table=11
atgccgcgcgcttcgctatcccccgaaaatgacaaggagacactcgtgagaggcaactacgttcgcgtggccgtggcgctatgcgctgcggcgtgcggaacaccagcgggagcaacggacgtgttcaacctggagggctttggtccagtttcccgcgctatgggcgggaccggagcggccttcgacatcgggccagcggcgatgatggcgaatccggcaacacttggcctgatggccgaggggaatcacctgcatcttgggctcgacatggtgaccaccgacatcaaggccaccaatacggcaacgggcgagacggcccggtccggcaaccacggcaacaacaacgggccttactttgcgcccgaggccgcgttcgtctaccgtcatgacaacatcgcgctaggcgccggaatctttgcggaggcgggcctcggtacgcaatacgggggcagcagtttcctgtcgcgcacgtccaatggcgtgcagacgggcctggaccagttctcccggttgctggtgctgcgcattccgtttgcggtggcctatcggccgacggacaagctgacgctcggcgcctcgctggatgcggtctggacgtcgctcaatctcggcacgctgctcgacgtcacgcagatcggcacgcttgccagccagcggcgggtgtctggttcgctggtgcccacgctgctttccgtgcccggcctttccggggggtacctgggcttctcgaacagcgcgcccgtcggtggcggggccgatgcctggggcatcggcggaaaactggggctgacctacgacatcacgcccgatacccgcgtaggactggcctacaacgcgaaaacgcgggtgggcgatcttcgcgggcaggccacgcttgcggctgtcagcaccgtcgcgggcaacattccgctgagcggcgaagtcagggtgcgggacttccagatgccggcgcagttcacggtgggcatcagccaccagttcaacgagcgactgtcggcttcggcggactaccagcgagtgttctggtcgagcgtgatgcgtgacatcaacgtcaccttcacgcgtgggggcgcgaacctcgacctgtcgctaccgcagaactaccgcgataccaacgtgttcggccttggcgtggcgtaccgtttcgattcggcctggacggtgcgcggcgggttccactatgcgcaagaagccataccgaacggcatgctgctagccgttgtgccggccattcccacgaccaccctgagtggcggcgcgacttacgcattcggcaaggacgacgcgatcgattttgccttgtcggtggtgttaccaaagaccgtggggaacgccagccagccgaatactgcggtaccgctcaccgtgcggcattcgcagctcaacgcggttctggcataccgcaagcgcttctag

SEQ ID NO: 23688 - protein, 471 aa, Alcaligenes eutrophus
MPRASLSPENDKETLVRGNYVRVAVALCAAACGTPAGATDVFNLEGFGPVSRAMGGTGAAFDIGPAAMMANPATLGLMAEGNHLHLGLDMVTTDIKATNTATGETARSGNHGNNNGPYFAPEAAFVYRHDNIALGAGIFAEAGLGTQYGGSSFLSRTSNGVQTGLDQFSRLLVLRIPFAVAYRPTDKLTLGASLDAVWTSLNLGTLLDVTQIGTLASQRRVSGSLVPTLLSVPGLSGGYLGFSNSAPVGGGADAWGIGGKLGLTYDITPDTRVGLAYNAKTRVGDLRGQATLAAVSTVAGNIPLSGEVRVRDFQMPAQFTVGISHQFNERLSASADYQRVFWSSVMRDINVTFTRGGANLDLSLPQNYRDTNVFGLGVAYRFDSAWTVRGGFHYAQEAIPNGMLLAVVPAIPTTTLSGGATYAFGKDDAIDFALSVVLPKTVGNASQPNTAVPLTVRHSQLNAVLAYRKRF

SEQ ID NO: 23689 - DNA, 1194 bp, Myxococcus xanthus
  CDS (1)..(1194): transl_table=11
atgaagaagacactctccctcatcacgttgctcgccgccgggacgacccaggccgcgggcttccaggtcaacacccagagcgcacgctcctcgggcatggccaacgcggcggcggcgtggctggatgactcgtccgccatctactccaacgcggccaacatcctgggcgtggagaagctggacgtcaccgcgggcgtcaccggcatcctccccagcctgcagttcacccccacgggtggctccgtgcaggggcagaagacgacgctgtctccgccgccgcacgtgttcgccgtgtacaaaatcacggactcgctggcggccggcgtgggcttctacacgccgttcggcgcgagcagccggtggaaagacgacttcgtgggccgcttccgcgcccaggagtccgggctgtccatctacaacatcaaccccacggtggcgtaccaggtgcacgaccgcttccgcgtgggcgcgggcctgaacatcacccgcggcacgctggagattaagcgcgcgctgggattcgtcaccagcgaaggccaggtgcacctgggcggcgcgggctggggcctcggcttcaacgccggtgtccaggccgtggtggtccccaagctcgtgacgttgggcgtgcagtaccgcagccccatcagcatgacgttcaagggcgacgcggacttccgggacgtgccgccggccttccagggccgtctgccggacacccgcgtggagggtgacgtcaagctgccgcagtcggtggtggcgggcatcgccgtcacgccgctggaccgcctgacgcttgcgttcgacgccaactgggtgggctggtccagcttcccggagctcgccatcgagttcccggacaacccggccatcaacaacccgctgccgaagaactggcgctcgacgtggaacttccacctgggcggtgagtacggcatcaccgacgcgctgcaggtgcgcgccggcgtgctgtgggacccggcgcccagcccggatgagacgctgacgccggacctgccggacgcgaaccgcttcggcgtgtcggcgggcgtgggctacagcttcggcgcggtgcgcgtcgacgccgcctaccagttcgtcaacctgttcgacaaggacagcacggcgccgggcatgacgggcgtctacaacggcacggcccaggtgttcggcctgacgctcggctactccatgtag

SEQ ID NO: 23690 - protein, 397 aa, Myxococcus xanthus
MKKTLSLITLLAAGTTQAAGFQVNTQSARSSGMANAAAAWLDDSSAIYSNAANILGVEKLDVTAGVTGILPSLQFTPTGGSVQGQKTTLSPPPHVFAVYKITDSLAAGVGFYTPFGASSRWKDDFVGRFRAQESGLSIYNINPTVAYQVHDRFRVGAGLNITRGTLEIKRALGFVTSEGQVHLGGAGWGLGFNAGVQAVVVPKLVTLGVQYRSPISMTFKGDADFRDVPPAFQGRLPDTRVEGDVKLPQSVVAGIAVTPLDRLTLAFDANWVGWSSFPELAIEFPDNPAINNPLPKNWRSTWNFHLGGEYGITDALQVRAGVLWDPAPSPDETLTPDLPDANRFGVSAGVGYSFGAVRVDAAYQFVNLFDKDSTAPGMTGVYNGTAQVFGLTLGYSM

SEQ ID NO: 23691 - DNA, 1329 bp, Enterobacter cloacae
  CDS (1)..(1329): transl_table=11
atggtcatgagccagaaaaccctgttcaacaagactgcgctggcagtcgcagtggcactcgtctccacttccgcctggtcagcgggctttcagttaaacgaattttcttcctctggccttggccgtgcgtattccggggaaggcgctatcgctgatgatgcgggtaacgcgagtcgtaaccccgcgttgatcatgatgttcgatcgtccgactttctctgccggtgcaatttttgtcgatccaggtgttgatatctcgggccgttctccgacaggtgccgatctgaaatctgataatatcgccccaacggcatgggttccaaacatgcacttcgtggcgccgattaacgaccagttcggctggggcgcatccgtaacctctaaytacggtttagcaaccgagttcaataacgactatgcagctggggcgtttggcggtaaaaccgacctggaaactctgaacctgaacctgagcggtgcttaccgtctggataatcactggagtttcggtgttggctttgacgctgtgtatgctaaagcgaagatcgaacgttacgcgggcgacctgggcaaagtcgtcgctggctcaggcgcacttccaccagccctggcacagcgtgtggctggtatcccagcagatactcagatcgcttatctgaagggcgatgagtggggctttggctggaacgccggtatcctttatgaactcgataaaaacaaccgttacggctttacctaccgttcagaagtaaaaatcgattttgatggagattacaaaagcagcctcccttctgcttataaccagatcctcggcaacttcggtctgccaatgggaaccaatggccaaaccactggcggctctctgagcctgcacttaccagaaatgtgggaattgtcaggttataacaaagtggcgccacagtgggcagttcactatagtctgacctacaccagctggagccagttccaggagctgaaggcgaccaatagcaaaggcgacacgctcttctataaagatgagagcttccgtgatgcttaccgcatcgcgctggggacaacctactatatggatgacaactggacattccgcaccggtattgccttcgatgatagtccggtaccagcagacaaacgctctatctcgattccggatcaggaccgcttctggctgagcgctggtgcgacctatgcattcaacaaggatgcttctattgatgcgggcatatcttatatgcacggtcaaaaagttaactttaaggaaggtccgtatgagttctcttccgaaggtaaagcctggctgtacggcatgaacttcaactacgcgttctaa

SEQ ID NO: 23692 - protein, 442 aa, Enterobacter cloacae
MVMSQKTLFNKTALAVAVALVSTSAWSAGFQLNEFSSSGLGRAYSGEGAIADDAGNASRNPALIMMFDRPTFSAGAIFVDPGVDISGRSPTGADLKSDNIAPTAWVPNMHFVAPINDQFGWGASVTSNYGLATEFNNDYAAGAFGGKTDLETLNLNLSGAYRLDNHWSFGVGFDAVYAKAKIERYAGDLGKVVAGSGALPPALAQRVAGIPADTQIAYLKGDEWGFGWNAGILYELDKNNRYGFTYRSEVKIDFDGDYKSSLPSAYNQILGNFGLPMGTNGQTTGGSLSLHLPEMWELSGYNKVAPQWAVHYSLTYTSWSQFQELKATNSKGDTLFYKDESFRDAYRIALGTTYYMDDNWTFRTGIAFDDSPVPADKRSISIPDQDRFWLSAGATYAFNKDASIDAGISYMHGQKVNFKEGPYEFSSEGKAWLYGMNFNYAF

SEQ ID NO: 23693 - DNA, 1356 bp, Haemophilus influenzae
  CDS (1)..(1356): transl_table=11
atgaaaaaatttaatcaatctatattagcaacagcaatgttgttggctgcaggtggtgcaaatgcggcagctttccaattggcggaagtttctacttctgggcttggtcgtgcctatgcgggtgaagcggcgattgcagataatgcttctgtcgtggcaactaacccagctttgatgagtttatttaaaacggcacagttttccacgggtggcgtttatgttgattctagaattaatatgaatggtgatgtagctgcttctataacaggttcttcaataaaagtaacaaatgacgacgtagcttcagagcgtaatgttgttcctggtgcttttgtgcccaatctttatttcgttgcgccagtgaatgataaattagcggtgggtgcaggaatgaatgtaaatttcggtctaaaaagtgaatatgacgatagttatgatgctggtgtatttggtggaaaaactgacttgactgctatcaacttaaatttaagtggtgcttatcgagtaacagaaggcttgagcctaggtttaggggtaaatgcggtttatgctaaagcccaagttgaacggaatgcgggtattattgcggatagtgttaaggatccacaagcaaaaagggcactcgaaacagtagttccaggaacaaaaattcctgactatttgacctctaaagacaaatctgttgtgtcattacaagatagagccgcttggggstttggctggaatgcaggtgtaatgtatcaatttaatgaagctaaccgaattggtttagcctatcattctaaagtggacattgattttactgaccgcactgccactagtttaggaaaaaagggtatcgaggcggggaaaacaggtaatttaacctttacattgccagattacttagaactttctggtttccatcaattaactgacaaatttgctgtgcattatagttataaatatacccattggagtcgtttaacaaaattacatgctagctatgaagatggtaaaaaagcttttgataaagaattacaatacagtaataattctcgtgttgcattaggggcaagttataatcttgatgaaaaattaaccttacgtgcgggtattgcttacgatcaagctgcatcgcgtcatcaccgtagtgctgcaattccagataccgatcgcacttggtatagtttaggggcaacctataaattcacgccgaatttatctgttgatcttggctatgcttacttaaaaggcaaaaaagttcactttaaagaagtacaaaaagttgcagatgacttcataacagcaaacgcaaattacacttctcaagcacacgcaaatctttacggtttaaacttaaattatagtttctaa

SEQ ID NO: 23694 - protein, 451 aa, Haemophilus influenzae
MKKFNQSILATAMLLAAGGANAAAFQLAEVSTSGLGRAYAGEAAIADNASVVATNPALMSLFKTAQFSTGGVYVDSRINMNGDVAASITGSSIKVTNDDVASERNVVPGAFVPNLYFVAPVNDKLAVGAGMNVNFGLKSEYDDSYDAGVFGGKTDLTAINLNLSGAYRVTEGLSLGLGVNAVYAKAQVERNAGIIADSVKDPQAKRALETVVPGTKIPDYLTSKDKSVVSLQDRAAWGFGWNAGVMYQFNEANRIGLAYHSKVDIDFTDRTATSLGKKGIEAGKTGNLTFTLPDYLELSGFHQLTDKFAVHYSYKYTHWSRLTKLHASYEDGKKAFDKELQYSNNSRVALGASYNLDEKLTLRAGIAYDQAASRHHRSAAIPDTDRTWYSLGATYKFTPNLSVDLGYAYLKGKKVHFKEVQKVADDFITANANYTSQAHANLYGLNLNYSF

SEQ ID NO: 23695 - DNA, 1356 bp, Haemophilus influenzae
  CDS (1)..(1356): transl_table=11
atgaaaaaatttaatcaatctctattagcaactgcaatgttgttggctgcaggtggtgcaaatgcggcggcgtttcaattggcggaagtttctacttctgggcttggtcgtgcctatgcaggtgaagcggcgattgcagataatgcttctgtcgtggcaactaacccagctttgatgagtttatttaaaacggcacagttttccacaggtggcgtttatgttgattctagaattaatatgaatggtgatgtaaagtcttctacaaaaaatttacaaatgctagcagcaaagtacggctcagcttcacagcgtaatgttgttcctggtgcttttgtgccaaatctttatttcgttgcgccagtaaatgataaattcgcgctgggtgcaggaatgaatgtcaatttcggtctaaaaagtgaatatgacgatagttatgatgctggtgtatttggtggaaaaactgacttgagtgctatcaacttaaatttaagtggtgcttatcgagtaacagaaggcttgagcctaggtttaggagtaaatgcggtttatgctaaagcccaagttgaacgaaatgctggtattattaaggagagtgttgagcttgcaaaaacagcattcacagtagcgcaagatgacgaaaaagcaattcctacatatttgacctctaaaaacacatctgttgtgtcattacaagatagagcagcttggggctttggctggaatgcaggtgtaatgtatcaatttaatgaagctaatcgaattggtttagcctatcattctaaagtggacattgattttgttgaccgcactgccactagtttagaagcaggggttatcggggcggggaaaaaaggtgatttaacccttacattgccagattacttagaactttctggtttccatcaattaactgacaaacttgccgtgcattatagttataaatatacccattggagtcgtttaacaaaattaaacgccagcttcgaagatggtaagaaagcgtttgataaggaattacaatacagtaataactctcgtgttgcattaggggcaagttacgatctttatgaaaaattaaccttacgtgcaggtattgcttacgatcaagctgcatctcgtcatcagcgtagtgctgcaattccagataccgatcgcacttggtatagtttaggggcaacctataaattcacgccgaatttatctgttgatcttggctatgcttacttaaaaggcaaaaaagttcactttaaagaagtaaaaacaacaggtaaaacagtaatattgaatgcaactgcagattatacttctcaagcacatgcaaatctttacggcttaaacttaaattatagtttctaa

SEQ ID NO: 23696 - protein, 451 aa, Haemophilus influenzae
MKKFNQSLLATAMLLAAGGANAAAFQLAEVSTSGLGRAYAGEAAIADNASVVATNPALMSLFKTAQFSTGGVYVDSRINMNGDVKSSTKNLQMLAAKYGSASQRNVVPGAFVPNLYFVAPVNDKFALGAGMNVNFGLKSEYDDSYDAGVFGGKTDLSAINLNLSGAYRVTEGLSLGLGVNAVYAKAQVERNAGIIKESVELAKTAFTVAQDDEKAIPTYLTSKNTSVVSLQDRAAWGFGWNAGVMYQFNEANRIGLAYHSKVDIDFVDRTATSLEAGVIGAGKKGDLTLTLPDYLELSGFHQLTDKLAVHYSYKYTHWSRLTKLNASFEDGKKAFDKELQYSNNSRVALGASYDLYEKLTLRAGIAYDQAASRHQRSAAIPDTDRTWYSLGATYKFTPNLSVDLGYAYLKGKKVHFKEVKTTGKTVILNATADYTSQAHANLYGLNLNYSF

SEQ ID NO: 23697 - DNA, 1356 bp, Haemophilus influenzae
  CDS (1)..(1356): transl_table=11
atgaaaaaatttaatcaatctctattagcaactgcaatgttgttggctgcaggtggtgcaaatgcggcggctttccaattggcggaagtttctacttctgggcttggtcgtgcctatgcaggtgaagcggcgattgcagataatgcttctgtggtggcaactaacccagctttgatgagtttatttaaaactgcacagttttccacaggtggcgtttatgttgattctagaattaatatgaatggtgatgtagaggcttttatagcaactttaaaaatgaaaacaacaaagaacggctcagcttcagagcgtaatgttgttcctggtgcttttgtgccaaatctttatttcgttgcgccagtgaatgataaattcgcgctgggcgcaggaatgaatgtcaatttcggtctaaaaagtgaatatgacgatagttatgatgctggtgtatttggtggaaaaactgacttgactgctatcaacttaaatttaagtggtgcttatcgagtaacagaaggcttgagcctaggtttaggggtaaatgcggtttatgctaaagcccaagttgaacgaaatgcgggtattattgcggatactgttaagatttcacaaggtgcattcacagtagggtcacaggaagacaaagcaattcctaaatatttgacctctaaagacaaatctgttgtgtcattacaagatagagcagcttgggggtttggctggaatgcaggtgtaatgtatcaatttaatgaagctaaccgaattggtttagcttatcattctaaagtggacattgattttactgaccgcactgccactagtttagaagcaggggctatcggggcggggaaaaaaggtgatttaacccttacattgccagattacttagaactttctggtttccatcaattaactgacaaatttgcagtgcattatagttataaatatacccattggagtcgtttaacaagattatacgctagctctgaaaatggtaaaaaagcgtttgataaagaattgcaatacagtaataactctcgtattgcattaggggcaagttataatctttatgaaaaattgaccttacgtgcgggtattgcttacgatcaagcggcatctcgtcatcaccgtagtgctgcaattccagataccgatcgcacttggtatagtttaggggcaacctataaattcacgccgaatttatctgttgatcttggctatgcttacttaaaaggcaaaaaagttcactttaaagaagtagcaacaataggtaaaagcgtaatattgaatacaactgcaaattatacttctcaagcacatgcaaatctttacggcttaaacttaaattatagtttctaa

SEQ ID NO: 23698 - protein, 451 aa, Haemophilus influenzae
MKKFNQSLLATAMLLAAGGANAAAFQLAEVSTSGLGRAYAGEAAIADNASVVATNPALMSLFKTAQFSTGGVYVDSRINMNGDVEAFIATLKMKTTKNGSASERNVVPGAFVPNLYFVAPVNDKFALGAGMNVNFGLKSEYDDSYDAGVFGGKTDLTAINLNLSGAYRVTEGLSLGLGVNAVYAKAQVERNAGIIADTVKISQGAFTVGSQEDKAIPKYLTSKDKSVVSLQDRAAWGFGWNAGVMYQFNEANRIGLAYHSKVDIDFTDRTATSLEAGAIGAGKKGDLTLTLPDYLELSGFHQLTDKFAVHYSYKYTHWSRLTRLYASSENGKKAFDKELQYSNNSRIALGASYNLYEKLTLRAGIAYDQAASRHHRSAAIPDTDRTWYSLGATYKFTPNLSVDLGYAYLKGKKVHFKEVATIGKSVILNTTANYTSQAHANLYGLNLNYSF

SEQ ID NO: 23699 - DNA, 1374 bp, Haemophilus influenzae
  CDS (1)..(1374): transl_table=11
atgaaaaaatttaatcaatctctattagcaacggcaatgttgttggctgcaggtggtgcaaatgcggctgcgtttcaattggcggaagtttctacttctgggcttggtcgtgcctatgcaggtgaagcggcgattgcagataatgcttctgtggtggcaactaacccagctttgatgagtttatctaaaacggcacagttttccacaggtggcgtttatattgattctagaattaatatgaatggtgatgtaacttcttctgctacaccagcaaatagtgtaatgacagcaataaggtacggctcagcttcagcgcgtaatgttgttcccggtgcttttgtgccaaatctttatttcgttgcgccagtgaatgataaattcgcgctgggtgcaggaatgaatgtcaatttcggtctaaaaagtgaatatgacgatagttataatgctggtatatttggtggaaaaactgacttgagtgctatcaacttaaatttaagtggtgcttatcgagtaacagaaggcttgagcctaggtttaggggtaaatgcggtttatgctaaagcccaagttgaacggaatgctggtattattgagggtactgttaatgatgaccaaataaaaagagcactcacaacacagccaaaaccatacaaagactttcctcagcatttgtcctctaaagacaaatctgttgtgtcattacaagatagcgcagcttggggccatggctggaatgcaggtgtaatgtatcaatttaatgaagctaacagaattggtttagcctatcattctaaagtggacattgattttactgaccgcactgccactagtttagaagcaggggttatcggggcggggaaaaaaggtgatttaacccttacattgccagattacttagaactttctggtttccatcaattaactgacaaacttgcggtgcattatagttataaatatacccattggagtcgtttaacaaaattaaacgctaacttcgaagatggtaaaaaagcgtttgataaagaattgcaatacagtaataactctcgtgttgcattaggggcaagttataatctttatgaaaaattaaccttacgtgcgggtattgcttacgatcaagcggcatctcgtcatcagcgtagtgctgcaattccagataccgatcgcacttggtatagtttaggggcaacctataaattcacgccgaacttatctgttgatcttggctatgcttacttaaaaggcaaaaaagttcactttaaagaagtaaaagcaataggtgaaaaacgttcattgacattcgatacaactgcaaattacacttctcaagcacacgcaaatctttacggcttaaacttaaattatagtttctaa

SEQ ID NO: 23700 - protein, 457 aa, Haemophilus influenzae
MKKFNQSLLATAMLLAAGGANAAAFQLAEVSTSGLGRAYAGEAAIADNASVVATNPALMSLSKTAQFSTGGVYIDSRINMNGDVTSSATPANSVMTAIRYGSASARNVVPGAFVPNLYFVAPVNDKFALGAGMNVNFGLKSEYDDSYNAGIFGGKTDLSAINLNLSGAYRVTEGLSLGLGVNAVYAKAQVERNAGIIEGTVNDDQIKRALTTQPKPYKDFPQHLSSKDKSVVSLQDSAAWGHGWNAGVMYQFNEANRIGLAYHSKVDIDFTDRTATSLEAGVIGAGKKGDLTLTLPDYLELSGFHQLTDKLAVHYSYKYTHWSRLTKLNANFEDGKKAFDKELQYSNNSRVALGASYNLYEKLTLRAGIAYDQAASRHQRSAAIPDTDRTWYSLGATYKFTPNLSVDLGYAYLKGKKVHFKEVKAIGEKRSLTFDTTANYTSQAHANLYGLNLNYSF

SEQ ID NO: 23701 - DNA, 1368 bp, Haemophilus influenzae
  CDS (1)..(1368): transl_table=11
atgaaaaaatttaatcaatctatattagcaacggcaatgttgttggctgcaggtggtgcaaatgcggcagcgtttcaattggcggaagtttctacttcaggtcttggtcgtgcctatgcaggtgaagcggcgattgcagataatgcttcagtggtggcaactaacccagctttgatgagtttatttaaaacggcacagttttccacaggtggcgtttatgttgattctagaattaatatgaatggtgatgtaactgcttctatagcaactactaaaatgaactcagcaaagtacggctcagcttcagagcgtaatgttgttcctggtgcttttgtgccaaatctttatttcgttgctccagtaaatgataaattcgcgctgggcgcaggaatgaatgtaaatttcggtctaaaaagtgaatatgacgatagttatgatgctggtatatttggtggaaaaacggacttgactgctatccacttaaatttaagtggtgcttatcgagtaacagaaggcttgagcctaggtttaggggtaaatgcggtttatgctaaagcccaagttgaacggaatgctggtattattgcgaatagtgttaatgatacacaagtaaaaactgcactctcagtactggcaccaccactcaaagggcttgatcagaatttgccctctaaagacaaatctgttgtgtcattacaagatagagcagcttgggggtttggctggaatgcaggtgtaatgtatcaatttaatgaagctaaccgaattggtttagcttatcattctaaagtggacattgattttactgaccgcactgccactagtgtagaagcaaatgtcatcaaagaaggtaaaaaaggtaatttaacccttacattgccagattacttagaactttctgggttccatcaattaactgacaaatttgcagtgcattatagttataaatatacccattggagtcgtttaacaaaattacacgctagcttcgaagatggtaagaaagcttttgataaagaattacaatacagtaataactctcgtgttgcattaggggcaagttataatcttgatgaaaaattaaccttacgtgcgggtattgcttacgatcaagctgcatctcgtcatcaccgtagtgctgcaattccagataccgatcgcacttggtatagtttaggtgcaacctataaattcacgccgaatttatctgttgatcttggctatgcttacttagaaggcaaaaaagttcactttaaagaagtaaaaacaataggtgacaagcgtacattgacattgaatacaactgcaaattatacttctcaagcacacgcaaatctttacggtttgaatttaaattatagtttctaa

SEQ ID NO: 23702 - protein, 455 aa, Haemophilus influenzae
MKKFNQSILATAMLLAAGGANAAAFQLAEVSTSGLGRAYAGEAAIADNASVVATNPALMSLFKTAQFSTGGVYVDSRINMNGDVTASIATTKMNSAKYGSASERNVVPGAFVPNLYFVAPVNDKFALGAGMNVNFGLKSEYDDSYDAGIFGGKTDLTAIHLNLSGAYRVTEGLSLGLGVNAVYAKAQVERNAGIIANSVNDTQVKTALSVLAPPLKGLDQNLPSKDKSVVSLQDRAAWGFGWNAGVMYQFNEANRIGLAYHSKVDIDFTDRTATSVEANVIKEGKKGNLTLTLPDYLELSGFHQLTDKFAVHYSYKYTHWSRLTKLHASFEDGKKAFDKELQYSNNSRVALGASYNLDEKLTLRAGIAYDQAASRHHRSAAIPDTDRTWYSLGATYKFTPNLSVDLGYAYLEGKKVHFKEVKTIGDKRTLTLNTTANYTSQAHANLYGLNLNYSF

SEQ ID NO: 23703 - DNA, 1371 bp, Haemophilus influenzae
  CDS (1)..(1371): transl_table=11
atgaaaaaatttaatcaatctctattagcaactgcaatgttgttggctgcaggtggtgcaaatgcggcggctttccaattggcggaagtttctacttctgggcttggtcgtgcctatgcgggtgaagcggcgattgcagataatgcttctgtcgtggcaactaacccagctttgatgagtttatttaaaacgaatcaattttctgttgggggtgtttatgttgattctagaattaatatgaatggtgatgtagattcttatgctataataagtgattcgataaaagtaacaaatgacggctcagcttcagcgcgtaatgttgttcctggtgcttttgtgccaaatctttatttcgttgcaccagtgaatgataaatttgcgctgggcgcaggaatgaatgtcaatttcggtctaaaaagtgaatatgacgatagttatgatgctggtgtatttggtggaaaaactgacttgactgctatcaacttaaatttaagtggtgcttatcgagtaacagaaggcttgagcctaggtttaggggtaaatgcggtttatgctaaagcccaagttgaacggaatgctggtcttattgcggatactgttaaggataaccaagtaaaaaatacactcacagtacagcaagaaccactcaaatatattaataagtatttgccctctaaagacacatctgttgtgtcattacaagatagagcagcttggggctttggctggaatgcaggtgtaatgtatcaatttaatgaagctaacagaattggtttagcctatcattctaaagtagatattgattttactgaccgcactgccactagtttagaagcaaatgttatcaacgcaagtaaaacaggtgatttaacccttacattgccagattacttagaactttctggtttccatcaattaactgacaaacttgcagtgcattatagttataaatatacccattggagtcgtttaacaaaattaaacgctagcttcgaagatggtaagaaagcgtttgataaagaattacaatacagtaataactctcgtgttgcattaggggcaagttataaccttgatgaaaaattgaccttacgtgcgggtattgcttacgatcaagcggcatctcgtcatcagcgtagtgctgcaattccagataccgatcgcacttggtatagtttaggggcaacctataaattcacccctaatttatctgttgatcttggctatgcttacttaaaaggcaaaaaagttcactttaaagaagtaaaaacaataggtgacaaacgttcacttgcattgagtacaactgcaaattatacttctcaagcacacgcaaatctttacggcttaaacttaaattatagtttctaa

SEQ ID NO: 23704 - protein, 456 aa, Haemophilus influenzae
MKKFNQSLLATAMLLAAGGANAAAFQLAEVSTSGLGRAYAGEAAIADNASVVATNPALMSLFKTNQFSVGGVYVDSRINMNGDVDSYAIISDSIKVTNDGSASARNVVPGAFVPNLYFVAPVNDKFALGAGMNVNFGLKSEYDDSYDAGVFGGKTDLTAINLNLSGAYRVTEGLSLGLGVNAVYAKAQVERNAGLIADTVKDNQVKNTLTVQQEPLKYINKYLPSKDTSVVSLQDRAAWGFGWNAGVMYQFNEANRIGLAYHSKVDIDFTDRTATSLEANVINASKTGDLTLTLPDYLELSGFHQLTDKLAVHYSYKYTHWSRLTKLNASFEDGKKAFDKELQYSNNSRVALGASYNLDEKLTLRAGIAYDQAASRHQRSAAIPDTDRTWYSLGATYKFTPNLSVDLGYAYLKGKKVHFKEVKTIGDKRSLALSTTANYTSQAHANLYGLNLNYSF

SEQ ID NO: 23705 - DNA, 1377 bp, Burkholderia pickettii
  CDS (1)..(1377): transl_table=11
gtgaaaggcaactacgttcgcgcggccacggccatctgcgttgcgatctgtggaacccacgccagggcgaccgacgtgttcaatctggagggctttggtccggtctcgcgcgccatgggcggaacgggcgcggccttcgatatcgggccggcagccatgatggagaatcccgcgacacttggcctgatgggcgagggccgccacttcagcctcggcctcgatgttgtgtcgaccgacatcaaggtcacgaacacggcaaccggcgagaccgcgagttcgggcaatcatggcaacaacaacggcccgtactttgcaccgcagaccgcattcgtctaccggcagggacgttacgcctttggcgccggcatcttcgcggaaggcgggctggggacgcaatacggtggcagcagctttctttcgcgcacatccaatggcgtggacaccggcctggatcagttctccaggctgttggtgctgcgcgtgccgttctcggccgcgtaccacgtcaccgacaagctgacggtgggcgcttcggttgacgcagtctggacctcgctcaacctggggacgctgctcgatgtctcgcagatcggcacgctggccggccagggacgcgtgtctgggacgcttgtcccgaccttgctgggcgtgcccgggctctcaggcggctatatcgacttctcgcgcaatgcgcccgttggaggcggcgtgcaggcctggggtatcggcggccggctgggtctgacgtatcaggtgacgcccgatacccgcatcggggcggcgtatcaggcgaagacgcacgtgggtgacctcacgggtcaggccacgctttccgccgtcagttcggtcgccggcaacatcccgctcaagggcgacgtgacggttcgaaacttccagatgcccgcgcagctgacggtcggcatcagtcatcaattcaacgatcaactgtcggtgtcagctgactaccagcgcgtgttctggtccagcgtgatgaaggacatgaacgtcggattcgtgcagtcgggctcggcggccaatctggatctgtcgctgccgcagaactaccgcgacatcagcgtgttcgggatcggcgccgagtatcgctataacgcaaagtggacgttccgtggcgggttccattacgcgcaggaggcgatccccggcaacatgcttttggccgtggtgcccgccacgcccacgacgagcctgaccggcggcgtttcctatgcaatcggcaagaacgatgtgatcgactttgcgctgtcggtggcgctgcgcaagacgttggacaatgcaagccagcccaatacggcggtgccaatcagcgtgacgcactcgcaagtgaacgccgtgatcgcctatcagaagcgcttctag

SEQ ID NO: 23706 - protein, 458 aa, Burkholderia pickettii
MKGNYVRAATAICVAICGTHARATDVFNLEGFGPVSRAMGGTGAAFDIGPAAMMENPATLGLMGEGRHFSLGLDVVSTDIKVTNTATGETASSGNHGNNNGPYFAPQTAFVYRQGRYAFGAGIFAEGGLGTQYGGSSFLSRTSNGVDTGLDQFSRLLVLRVPFSAAYHVTDKLTVGASVDAVWTSLNLGTLLDVSQIGTLAGQGRVSGTLVPTLLGVPGLSGGYIDFSRNAPVGGGVQAWGIGGRLGLTYQVTPDTRIGAAYQAKTHVGDLTGQATLSAVSSVAGNIPLKGDVTVRNFQMPAQLTVGISHQFNDQLSVSADYQRVFWSSVMKDMNVGFVQSGSAANLDLSLPQNYRDISVFGIGAEYRYNAKWTFRGGFHYAQEAIPGNMLLAVVPATPTTSLTGGVSYAIGKNDVIDFALSVALRKTLDNASQPNTAVPISVTHSQVNAVIAYQKRF

SEQ ID NO: 23707 - DNA, 1347 bp, Escherichia coli O6
  CDS (1)..(1347): transl_table=11
atggtcatgagccagaaaaccctgtttacaaagtctgctctcgcagtcgcagtggcacttatctccacccaggcctggtcggcaggctttcagttaaacgaattttcttcctctggcctgggccgggcttattcaggggaaggtgcaattgccgatgatgcaggtaacgttagccgtaaccccgcattgattaccatgtttgaccgcccgacattttctgcgggtgcggtttatattgatccggatgtagatattaccggacattctgatttaaccggtcagagtgcaaatgctaaaaatatcgcaccgacagcatgggtacctaacctgcactttgttgcgcctattaacgatcagtttggttggggagcgtcaataacttccaactatggcctggctacggaatttaccgacaactacgctgctggtatctatggcggtaaaaccgatctgcaaacaatcaaccttaaccttagcggggcttatcgccttaacaatagctggagttttggtcttggttttgatgcagtttatgccaaggcaaaaattgagcgttacgccggttcgctggggccattgttgtctcaacagttgattgcccagggtgtacccgcttcattaaccaatggtattaatactccggactctcaaattgctcatttgaaaggtgacgaatggggctttggctggaacgcgggtattctttatgaactggataaagataaccgttgggggctgacatatcgttcagaagttaaaatcgacttcgatggggattacaaaagctccattaacccaaatctgaacaatattttgggtaacatgggcttaccgtatggcacgatgggggcaacccaaaatggatccttaacgctgaacctgcctgagatgtgggagatttctggttataaccgtgttgcgccgcagtgggcaattcactacagcatggcctataccagttggagccagttccaggaattgaaagcgaaaggcgatagtggtcagactctgttctataaagatgaaggattccgggacgcgtatcgtatcgcgttgggtacaacctactattatgataaaaactggaccttccgtaccggtatcgcttatgacgacagcccggttccggcagataaacgttctatttccattcctgaccaggatcgtttgtggttaagtgctgggttaacctacgcatttaatgaagatgcatccattgatgttggcgcatcttatatgcatggtcagaaagtgaaattcaccgaaggtgaaggagcggcagcttattccttcgagtctgaaggtaaagcctggctgttcggtactaactttaactacgcgttctga

SEQ ID NO: 23708 - protein, 448 aa, Escherichia coli O6
MVMSQKTLFTKSALAVAVALISTQAWSAGFQLNEFSSSGLGRAYSGEGAIADDAGNVSRNPALITMFDRPTFSAGAVYIDPDVDITGHSDLTGQSANAKNIAPTAWVPNLHFVAPINDQFGWGASITSNYGLATEFTDNYAAGIYGGKTDLQTINLNLSGAYRLNNSWSFGLGFDAVYAKAKIERYAGSLGPLLSQQLIAQGVPASLTNGINTPDSQIAHLKGDEWGFGWNAGILYELDKDNRWGLTYRSEVKIDFDGDYKSSINPNLNNILGNMGLPYGTMGATQNGSLTLNLPEMWEISGYNRVAPQWAIHYSMAYTSWSQFQELKAKGDSGQTLFYKDEGFRDAYRIALGTTYYYDKNWTFRTGIAYDDSPVPADKRSISIPDQDRLWLSAGLTYAFNEDASIDVGASYMHGQKVKFTEGEGAAAYSFESEGKAWLFGTNFNYAF

SEQ ID NO: 23709 - DNA, 1314 bp, Salmonella typhimurium
  CDS (1)..(1314): transl_table=11
atggtcatgagccagaaaaccctgtttacaaagtctgctctcgcagtcgcagtggcaatcatctccacccaggcctggtctgcaggctttcagttaaacgaattttcttcctctggccttggccgggcctattcgggtgaaggcgcaatcgcagatgatgcgggtaacgttagccgcaacccggcgttaattaccatgtttgaccgcccgacgttttcagcgggcgcggtttatattgatcctgatgttaatattagcgggacatcgccatctcgtcggacgttagatgcggataacatcgcgccgacggcctgggtgccgaacgtccattttgtcgccccgattaacgaccagtttggctggggggcttctattacctctaactatggtctggcgacagagtttaacgacacatacgccggcggctcggttggcggtacgaccgatcttgaaaccatgaacctgaatttaagcggcgcttatcgcttaaatgaggcctggagcttcggcctcggctttgatgcggtatacgcgcgtgcaaaaatcgaacgttttgcgggcgatttaggccagttggtcgcggcacagaatccggcgctggcgccggtcgcgggtcagattcccagcgacaccaagattgcccacctgaacggtaatcagtggggctttggctggaatgccggtatcctttatgaactggataaaaataaccgctacgcgctgacctaccgctcggaagtcaaaattgactttaaaggcaactacagtagcgatcttcccatcgctataaaccgatttaacctgcctatcccaacggcaaccggcggcgcaacgcagtcaggctacctgacgctgaatctgccggaaatgtgggaagtgtccggttataaccgtgtggcgccacagtgggccatccactatagcctggcctataccagctggagccagttccaggaattgaaggcaaaatcgaccgccggcgatacgctctttgagaagcatgaaggctttaaagacgcttatcgcattgcgttgggtaccacctattactacgatgacaactggacgttccgtaccggtatcgccttcgatgacagcccggtaccagcgcaaaaccgttctatctctattccggaccaggaccgtttctggctgagcgccggtacgacttacgcctttaacaaagatgcgtctgtcgacgttggcgtctcttatatgcatggtcagagcgtgaaaattaatgaaggcccttatcagtttgaatctgaagggaaagcctggctgttcggtactaactttaactacgcgttctaa

SEQ ID NO: 23710 - protein, 437 aa, Salmonella typhimurium
MVMSQKTLFTKSALAVAVAIISTQAWSAGFQLNEFSSSGLGRAYSGEGAIADDAGNVSRNPALITMFDRPTFSAGAVYIDPDVNISGTSPSRRTLDADNIAPTAWVPNVHFVAPINDQFGWGASITSNYGLATEFNDTYAGGSVGGTTDLETMNLNLSGAYRLNEAWSFGLGFDAVYARAKIERFAGDLGQLVAAQNPALAPVAGQIPSDTKIAHLNGNQWGFGWNAGILYELDKNNRYALTYRSEVKIDFKGNYSSDLPIAINRFNLPIPTATGGATQSGYLTLNLPEMWEVSGYNRVAPQWAIHYSLAYTSWSQFQELKAKSTAGDTLFEKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 23711 - DNA, 1287 bp, Pasteurella multocida
  CDS (1)..(1287)
atggcgaaaactagcaaatttactcaaactcttcttgcttccgcgttagcggtggtcgcgggtagcgcttctgctgccgctttccaactagcagaagtgtcaacatccggtttagggcgtgcttatgcgggggaagccgcgattgcagataatgcggcagtggttgccacgaacccagcattaatgagcttattgaaacaacctgaaatttctgttggggcaatttatgtggacccaaatattaatttaacctcaccaatgccaggattcgcctataaaaatattgcgccgaatgcgttagttccgacagtgtatggtgtgtatccaattaacgaaaaattcgctgtgggcggtggattgaatgttaactatggtttagccaccgagtttgatgacaaatatgcgggcggctttttaggcggtaaaaccgatttgaccgcaattaactttaacttaagcggtgcctatcgtgttacggagaagttcagcgttggcttaggcttaaacgcagtgcatgcgaaagcgaaacttgagcgttatgcaggtgtggctttgaaattaaaagtaccaaatgtagctcaacttgcagcattaccagcgaataccgtaatttcaaagctacaaggtgataaatggggctttggctggaatgccggtttggtatatgaatttaatgaacgtaaccgcattggtatcgcctatcattcacaagtggatattaactttaaagggcagtattcaaatcacttcccattagccgctgcagctttgctccagaccaagggcattaccgcgacaggtggcaaagaaatcccgggtaccttacatttaccgctaccagcttactgggaaatttctggttatcataaaatgaccgatcgttttgcaatgcactatagctataaatatacgcaatggagcaaatttaaagagttacgtgcaaaaggtacggacggtaagaccttatttagcaaaacagaagagtttcgtgattcttcacgtattgcccttggtgcgagctatgatgtaaccgatgcattaacggtacgtacgggtattgcgtatgatgaaagtgctgcagatgagcataacaccatttctattccagatacggatcgtacttggtttagtgtgggggccacttaccgctttacgccaaatgtatctattgatgccggttttgcacatttaaaaggcaagaagaatacctttaaagaagaaggggttccatttactagcaaagccagtgcgaacctttatggtttaaacgtgaattaccgtttctaa

SEQ ID NO: 23712 - protein, 428 aa, Pasteurella multocida
MAKTSKFTQTLLASALAVVAGSASAAAFQLAEVSTSGLGRAYAGEAAIADNAAVVATNPALMSLLKQPEISVGAIYVDPNINLTSPMPGFAYKNIAPNALVPTVYGVYPINEKFAVGGGLNVNYGLATEFDDKYAGGFLGGKTDLTAINFNLSGAYRVTEKFSVGLGLNAVHAKAKLERYAGVALKLKVPNVAQLAALPANTVISKLQGDKWGFGWNAGLVYEFNERNRIGIAYHSQVDINFKGQYSNHFPLAAAALLQTKGITATGGKEIPGTLHLPLPAYWEISGYHKMTDRFAMHYSYKYTQWSKFKELRAKGTDGKTLFSKTEEFRDSSRIALGASYDVTDALTVRTGIAYDESAADEHNTISIPDTDRTWFSVGATYRFTPNVSIDAGFAHLKGKKNTFKEEGVPFTSKASANLYGLNVNYRF

SEQ ID NO: 23713 - DNA, 23 bp, Artificial sequence
  (1)..(23): primer
atggtcatgagccagaaaaccct

SEQ ID NO: 23714 - DNA, 27 bp, Artificial sequence
  (1)..(27): primer
ttagaacgcgtagttaaagttagtacc

SEQ ID NO: 23715 - protein, 549 aa, Artificial sequence
  Variant (2)..(2): xaa in position 2 is any amino acid
  Variant (5)..(5): xaa in position 5 is any amino acid
  Variant (7)..(7): xaa in position 7 is any amino acid
  Variant (9)..(12): xaa in position 9 to 12 is any amino acid
  Variant (14)..(15): xaa in position 14 to 15 is any or no amino acid
  Variant (17)..(18): xaa in position 17 to 18 is any amino acid
  Variant (19)..(19): xaa in position 19 is any or no amino acid
  Variant (22)..(23): xaa in position 22 to 23 is any or no amino acid
  Variant (25)..(27): xaa in position 25 to 27 is any amino acid
  Variant (28)..(28): xaa in position 28 is any or no amino acid
  Variant (31)..(34): xaa in position 31 to 34 is any amino acid
  Variant (38)..(38): xaa in position 38 is any amino acid
  Variant (40)..(43): xaa in position 40 to 43 is any amino acid
  Variant (44)..(54): xaa in position 44 to 54 is any or no amino acid
  Variant (56)..(114): xaa in position 56 to 114 is any or no amino acid
  Variant (117)..(117): xaa in position 117 is any amino acid
  Variant (118)..(132): xaa in position 118 to 132 is any or no amino acid
  Variant (134)..(139): xaa in position 134 to 139 is any amino acid
  Variant (142)..(143): xaa in position 142 to 143 is any or no amino acid
  Variant (145)..(145): xaa in position 145 is any amino acid
  Variant (147)..(151): xaa in position 147 to 151 is any amino acid
  Variant (153)..(156): xaa in position 153 to 156 is any amino acid
  Variant (157)..(173): xaa in position 157 to 173 is any or no amino acid
  Variant (175)..(176): xaa in position 175 to 176 is any amino acid
  Variant (178)..(183): xaa in position 178 to 183 is any amino acid
  Variant (186)..(186): xaa in position 186 is any amino acid
  Variant (188)..(191): xaa in position 188 to 191 is any amino acid
  Variant (192)..(196): xaa in position 192 to 196 is any or no amino acid
  Variant (198)..(198): xaa in position 198 is any amino acid
  Variant (200)..(200): xaa in position 200 is any amino acid
  Variant (202)..(210): xaa in position 202 to 210 is any amino acid
  Variant (212)..(225): xaa in position 212 to 225 is any amino acid
  Variant (226)..(285): xaa in position 226 to 285 is any or no amino acid
  Variant (288)..(289): xaa in position 288 to 289 is any amino acid
  Variant (291)..(292): xaa in position 291 to 292 is any amino acid
  Variant (294)..(301): xaa in position 294 to 301 is any amino acid
  Variant (302)..(302): xaa in position 302 is any or no amino acid
  Variant (304)..(305): xaa in position 304 to 305 is any amino acid
  Variant (307)..(307): xaa in position 307 is any amino acid
  Variant (309)..(309): xaa in position 309 is any amino acid
  Variant (311)..(319): xaa in position 311 to 319 is any amino acid
  Variant (320)..(355): xaa in position 320 to 355 is any or no amino acid
  Variant (357)..(357): xaa in position 357 is any amino acid
  Variant (360)..(364): xaa in position 360 to 364 is any amino acid
  Variant (366)..(374): xaa in position 366 to 374 is any amino acid
  Variant (375)..(376): xaa in position 375 to 376 is any or no amino acid
  Variant (378)..(385): xaa in position 378 to 385 is any amino acid
  Variant (388)..(391): xaa in position 388 to 391 is any amino acid
  Variant (393)..(402): xaa in position 393 to 402 is any amino acid
  Variant (403)..(420): xaa in position 403 to 420 is any or no amino acid
  Variant (422)..(427): xaa in position 422 to 427 is any amino acid
  Variant (431)..(432): xaa in position 431 to 432 is any amino acid
  Variant (434)..(439): xaa in position 434 to 439 is any amino acid
  Variant (440)..(440): xaa in position 440 is any or no amino acid
  Variant (443)..(443): xaa in position 443 is any amino acid
  Variant (445)..(446): xaa in position 445 to 446 is any amino acid
  Variant (449)..(457): xaa in position 449 to 457 is any amino acid
  Variant (458)..(461): xaa in position 458 to 461 is any or no amino acid
  Variant (464)..(466): xaa in position 464 to 466 is any amino acid
  Variant (467)..(467): xaa in position 467 is any or no amino acid
  Variant (469)..(471): xaa in position 469 to 471 is any amino acid
  Variant (473)..(473): xaa in position 473 is any amino acid
  Variant (475)..(476): xaa in position 475 to 476 is any amino acid
  Variant (478)..(482): xaa in position 478 to 482 is any amino acid
  Variant (483)..(486): xaa in position 483 to 486 is any or no amino acid
  Variant (489)..(489): xaa in position 489 is any amino acid
  Variant (491)..(492): xaa in position 491 to 492 is any amino acid
  Variant (495)..(514): xaa in position 495 to 514 is any amino acid
  Variant (515)..(539): xaa in position 515 to 539 is any or no amino acid
  Variant (541)..(541): xaa in position 541 is any amino acid
  Variant (543)..(548): xaa in position 543 to 548 is any amino acid
AXGFXLXEXXXXGXXGXXXAGXXAXXXXASXXXXNPAXMXXXXXXXXXXXXXXXVXXXXXXXXXXXXXXXXXXXXXXXXXXXXXXXXXXXXXXXXXXXXXXXXXXXXXXXXXXXVPXXXXXXXXXXXXXXXXGXXXXXXFGXXTXYXXXXXGXXXXXXXXXXXXXXXXXXXXXLXXIXXXXXXAYXVXXXXXXXXXSXGXGXXXXXXXXXLXXXXXXXXXXXXXXXXXXXXXXXXXXXXXXXXXXXXXXXXXXXXXXXXXXXXXXXXXXXXXXXXXXXXXXXXXXGWXXGXXYXXXXXXXXXGXXYXSXVXXXXXXXXXXXXXXXXXXXXXXXXXXXXXXXXXXXXXXXXXXXXXLXLPXXXXXSXXXXXXXXXXXVXXXXXXXXWSXXXXLXXXXXXXXXXXXXXXXXXXXXXXXXXXXWXXXXXXALGXXYXXXXXXXLRXGXXYDXXXXXXXXXXXXXIPXXXXRXXXSXGXXYXXXXXXXXXVDXGXXYLXXXXXXXXXXXXXXXXXXXXXXXXXXXXXXXXXXXXXXXXXXXXXLXGXXXXXXF

SEQ ID NO: 23716 - protein, 17 aa, Artificial sequence
  Variant (2)..(2): xaa in position 2 is any amino acid
  Variant (3)..(3): xaa in position 3 is Ala, Gly or Ser
  Variant (4)..(7): xaa in position 4 to 7 is any amino acid
  Variant (8)..(8): xaa in position 8 is Ala, Asp, Gly, Asn, Pro or Ser
  Variant (10)..(11): xaa in position 10 to 11 is any amino acid
  Variant (12)..(14): xaa in position 12 to 14 is any or no amino acid
  Variant (16)..(16): xaa in position 16 is any or no amino acid
GXXXXXXXAXXXXXNXA

SEQ ID NO: 23717 - protein, 23 aa, Artificial sequence
  Variant (2)..(2): xaa in position 2 is Phe, Trp or Tyr
  Variant (3)..(3): xaa in position 3 is Asn, Gln, Ser or Thr
  Variant (4)..(4): xaa in position 4 is any amino acid
  Variant (5)..(5): xaa in position 5 is Ala or Gly
  Variant (6)..(16): xaa in position 6 to 16 is any amino acid
  Variant (17)..(17): xaa in position 17 is Ala, Gly or Ser
  Variant (18)..(18): xaa in position 18 is any amino acid
  Variant (19)..(19): xaa in position 19 is Ala, Gly, Asn, Ser or Thr
  Variant (21)..(21): xaa in position 21 is any amino acid
  Variant (22)..(22): xaa in position 22 is any or no amino acid
GXXXXXXXXXXXXXXXXXXYXXS

SEQ ID NO: 23718 - protein, 28 aa, Artificial sequence
  Variant (2)..(2): xaa in position 2 is Ala, Asp, Glu or Ser
  Variant (3)..(6): xaa in position 3 to 6 is any amino acid
  Variant (7)..(7): xaa in position 7 is Ala, Gly or Ser
  Variant (8)..(16): xaa in position 8 to 16 is any amino acid
  Variant (17)..(17): xaa in position 17 is Ala, Asp, Glu, Asn, Ser or Thr
  Variant (18)..(26): xaa in position 18 to 26 is any amino acid
PXXXXXXXXXXXXXXXXXXXXXXXXXWS

SEQ ID NO: 23719 - protein, 46 aa, Artificial sequence
  Variant (2)..(2): xaa in position 2 is Ala, Gly, Ser, Thr or Val
  Variant (3)..(3): xaa in position 3 is any amino acid
  Variant (4)..(4): xaa in position 4 is Trp or Tyr
  Variant (5)..(12): xaa in position 5 to 12 is any amino acid
  Variant (13)..(13): xaa in position 13 is Lys or Arg
  Variant (14)..(14): xaa in position 14 is any amino acid
  Variant (16)..(18): xaa in position 16 to 18 is any amino acid
  Variant (19)..(19): xaa in position 19 is any or no amino acid
  Variant (21)..(33): xaa in position 21 to 33 is any amino acid
  Variant (34)..(36): xaa in position 34 to 36 is any or no amino acid
  Variant (38)..(43): xaa in position 38 to 43 is any amino acid
  Variant (44)..(44): xaa in position 44 is Ala, Gly, Ser or Thr
  Variant (45)..(45): xaa in position 45 is any amino acid
  Variant (46)..(46): xaa in position 46 is Gly, Ser or Thr
GXXXXXXXXXXXXXGXXXXDXXXXXXXXXXXXXXXXDXXXXXXXXX

SEQ ID NO: 23720 - DNA, 1347 bp, Escherichia coli; identical to SEQ ID NO: 23515
  CDS (1)..(1347)

SEQ ID NO: 23721 - protein, 448 aa, Escherichia coli; identical to SEQ ID NO: 23516

SEQ ID NO: 23722 - DNA, 1212 bp, Aquifex aeolicus VF5; identical to SEQ ID NO: 23517
  CDS (1)..(1212): transl_table=11

SEQ ID NO: 23723 - protein, 403 aa, Aquifex aeolicus VF5; identical to SEQ ID NO: 23518

SEQ ID NO: 23724 - DNA, 1299 bp, Vibrio cholerae O1 biovar eltor str. N16961; identical to SEQ ID NO: 23519
  CDS (1)..(1299): transl_table=11

SEQ ID NO: 23725 - protein, 432 aa, Vibrio cholerae O1 biovar eltor str. N16961; identical to SEQ ID NO: 23520

SEQ ID NO: 23726 - DNA, 1287 bp, Vibrio cholerae O1 biovar eltor str. N16961; identical to SEQ ID NO: 23521
  CDS (1)..(1287): transl_table=11

SEQ ID NO: 23727 - protein, 428 aa, Vibrio cholerae O1 biovar eltor str. N16961; identical to SEQ ID NO: 23522

SEQ ID NO: 23728 - DNA, 1332 bp, Pasteurella multocida subsp. multocida str. Pm70; identical to SEQ ID NO: 23523
  CDS (1)..(1332): transl_table=11

SEQ ID NO: 23729 - protein, 443 aa, Pasteurella multocida subsp. multocida str. Pm70; identical to SEQ ID NO: 23524

SEQ ID NO: 23730 - DNA, 1275 bp, Pseudomonas aeruginosa PAO1; identical to SEQ ID NO: 23525
  CDS (1)..(1275): transl_table=11

SEQ ID NO: 23731 - protein, 424 aa, Pseudomonas aeruginosa PAO1; identical to SEQ ID NO: 23526

SEQ ID NO: 23732 - DNA, 1392 bp, Pseudomonas aeruginosa PAO1; identical to SEQ ID NO: 23527
  CDS (1)..(1392): transl_table=11

SEQ ID NO: 23733 - protein, 463 aa, Pseudomonas aeruginosa PAO1; identical to SEQ ID NO: 23528

SEQ ID NO: 23734 - DNA, 1401 bp, Neisseria meningitidis MC58; identical to SEQ ID NO: 23529
  CDS (1)..(1401): transl_table=11

SEQ ID NO: 23735 - protein, 466 aa, Neisseria meningitidis MC58; identical to SEQ ID NO: 23530

SEQ ID NO: 23736 - DNA, 1344 bp, Xylella fastidiosa 9a5c; identical to SEQ ID NO: 23531
  CDS (1)..(1344): transl_table=11

SEQ ID NO: 23737 - protein, 447 aa, Xylella fastidiosa 9a5c; identical to SEQ ID NO: 23532

SEQ ID NO: 23738 - DNA, 1299 bp, Caulobacter crescentus CB15; identical to SEQ ID NO: 23533
  CDS (1)..(1299): transl_table=11

SEQ ID NO: 23739 - protein, 432 aa, Caulobacter crescentus CB15; identical to SEQ ID NO: 23534

SEQ ID NO: 23740 - DNA, 1341 bp, Xanthomonas axonopodis pv. citri str. 306; identical to SEQ ID NO: 23535
  CDS (1)..(1341): transl_table=11

SEQ ID NO: 23741 - protein, 446 aa, Xanthomonas axonopodis pv. citri str. 306; identical to SEQ ID NO: 23536

SEQ ID NO: 23742 - DNA, 1272 bp, Yersinia pestis KIM; identical to SEQ ID NO: 23537
  CDS (1)..(1272): transl_table=11

SEQ ID NO: 23743 - protein, 423 aa, Yersinia pestis KIM; identical to SEQ ID NO: 23538

SEQ ID NO: 23744 - DNA, 1227 bp, Vibrio vulnificus CMCP6; identical to SEQ ID NO: 23539
  CDS (1)..(1227): transl_table=11

SEQ ID NO: 23745 - protein, 408 aa, Vibrio vulnificus CMCP6; identical to SEQ ID NO: 23540

SEQ ID NO: 23746 - DNA, 1248 bp, Vibrio vulnificus CMCP6; identical to SEQ ID NO: 23541
  CDS (1)..(1248): transl_table=11

SEQ ID NO: 23747 - protein, 415 aa, Vibrio vulnificus CMCP6; identical to SEQ ID NO: 23542

SEQ ID NO: 23748 - DNA, 1224 bp, Vibrio vulnificus CMCP6; identical to SEQ ID NO: 23543
  CDS (1)..(1224): transl_table=11

SEQ ID NO: 23749 - protein, 407 aa, Vibrio vulnificus CMCP6; identical to SEQ ID NO: 23544

SEQ ID NO: 23750 - DNA, 1344 bp, Xylella fastidiosa Temecula1; identical to SEQ ID NO: 23545
  CDS (1)..(1344): transl_table=11

SEQ ID NO: 23751 - protein, 447 aa, Xylella fastidiosa Temecula1; identical to SEQ ID NO: 23546

SEQ ID NO: 23752 - DNA, 1269 bp, Pseudomonas syringae pv. tomato str. DC3000; identical to SEQ ID NO: 23547
  CDS (1)..(1269): transl_table=11

SEQ ID NO: 23753 - protein, 422 aa, Pseudomonas syringae pv. tomato str. DC3000; identical to SEQ ID NO: 23548

SEQ ID NO: 23754 - DNA, 1275 bp, Pseudomonas syringae pv. tomato str. DC3000; identical to SEQ ID NO: 23549
  CDS (1)..(1275): transl_table=11

SEQ ID NO: 23755 - protein, 424 aa, Pseudomonas syringae pv. tomato str. DC3000; identical to SEQ ID NO: 23550

SEQ ID NO: 23756 - DNA, 1251 bp, Vibrio parahaemolyticus RIMD 2210633; identical to SEQ ID NO: 23551
  CDS (1)..(1251): transl_table=11

SEQ ID NO: 23757 - protein, 416 aa, Vibrio parahaemolyticus RIMD 2210633; identical to SEQ ID NO: 23552

SEQ ID NO: 23758 - DNA, 1320 bp, Vibrio parahaemolyticus RIMD 2210633; identical to SEQ ID NO: 23553
  CDS (1)..(1320): transl_table=11

SEQ ID NO: 23759 - protein, 439 aa, Vibrio parahaemolyticus RIMD 2210633; identical to SEQ ID NO: 23554

SEQ ID NO: 23760 - DNA, 1362 bp, Vibrio parahaemolyticus RIMD 2210633; identical to SEQ ID NO: 23555
  CDS (1)..(1362): transl_table=11

SEQ ID NO: 23761 - protein, 453 aa, Vibrio parahaemolyticus RIMD 2210633; identical to SEQ ID NO: 23556

SEQ ID NO: 23762 - DNA, 1104 bp, Vibrio parahaemolyticus RIMD 2210633; identical to SEQ ID NO: 23557
  CDS (1)..(1104): transl_table=11

SEQ ID NO: 23763 - protein, 367 aa, Vibrio parahaemolyticus RIMD 2210633; identical to SEQ ID NO: 23558

SEQ ID NO: 23764 - DNA, 1242 bp, Vibrio parahaemolyticus RIMD 2210633; identical to SEQ ID NO: 23559
  CDS (1)..(1242): transl_table=11

SEQ ID NO: 23765 - protein, 413 aa, Vibrio parahaemolyticus RIMD 2210633; identical to SEQ ID NO: 23560

SEQ ID NO: 23766 - DNA, 1308 bp, Haemophilus ducreyi 35000HP; identical to SEQ ID NO: 23561
  CDS (1)..(1308): transl_table=11

SEQ ID NO: 23767 - protein, 435 aa, Haemophilus ducreyi 35000HP; identical to SEQ ID NO: 23562

SEQ ID NO: 23768 - DNA, 1458 bp, Chromobacterium violaceum ATCC 12472; identical to SEQ ID NO: 23563
  CDS (1)..(1458): transl_table=11

SEQ ID NO: 23769 - protein, 485 aa, Chromobacterium violaceum ATCC 12472; identical to SEQ ID NO: 23564

SEQ ID NO: 23770 - DNA, 1338 bp, Chromobacterium violaceum ATCC 12472; identical to SEQ ID NO: 23565
  CDS (1)..(1338): transl_table=11

SEQ ID NO: 23771 - protein, 445 aa, Chromobacterium violaceum ATCC 12472; identical to SEQ ID NO: 23566

SEQ ID NO: 23772 - DNA, 1185 bp, Wolinella succinogenes DSM 1740; identical to SEQ ID NO: 23567
  CDS (1)..(1185): transl_table=11

SEQ ID NO: 23773 - protein, 394 aa, Wolinella succinogenes DSM 1740; identical to SEQ ID NO: 23568

SEQ ID NO: 23774 - DNA, 1344 bp, Photorhabdus luminescens subsp. laumondii TTO1; identical to SEQ ID NO: 23569
  CDS (1)..(1344): transl_table=11

SEQ ID NO: 23775 - protein, 447 aa, Photorhabdus luminescens subsp. laumondii TTO1; identical to SEQ ID NO: 23570

SEQ ID NO: 23776 - DNA, 1389 bp, Vibrio vulnificus YJ016; identical to SEQ ID NO: 23571
  CDS (1)..(1389): transl_table=11

SEQ ID NO: 23777 - protein, 462 aa, Vibrio vulnificus YJ016; identical to SEQ ID NO: 23572

SEQ ID NO: 23778 - DNA, 1215 bp, Desulfovibrio vulgaris subsp. vulgaris str. Hildenborough; identical to SEQ ID NO: 23573
  CDS (1)..(1215): transl_table=11

SEQ ID NO: 23779 - protein, 404 aa, Desulfovibrio vulgaris subsp. vulgaris str. Hildenborough; identical to SEQ ID NO: 23574

SEQ ID NO: 23780 - DNA, 1206 bp, Desulfovibrio vulgaris subsp. vulgaris str. Hildenborough; identical to SEQ ID NO: 23575
  CDS (1)..(1206): transl_table=11

SEQ ID NO: 23781 - protein, 401 aa, Desulfovibrio vulgaris subsp. vulgaris str. Hildenborough; identical to SEQ ID NO: 23576

SEQ ID NO: 23782 - DNA, 1287 bp, Erwinia carotovora subsp. atroseptica SCRI1043; identical to SEQ ID NO: 23577
  CDS (1)..(1287)

SEQ ID NO: 23783 - protein, 428 aa, Erwinia carotovora subsp. atroseptica SCRI1043; identical to SEQ ID NO: 23578

SEQ ID NO: 23784 - DNA, 1191 bp, Desulfotalea psychrophila LSv54; identical to SEQ ID NO: 23579
  CDS (1)..(1191): transl_table=11

SEQ ID NO: 23785 - protein, 396 aa, Desulfotalea psychrophila LSv54; identical to SEQ ID NO: 23580

SEQ ID NO: 23786 - DNA, 1266 bp, Yersinia pseudotuberculosis IP 32953; identical to SEQ ID NO: 23581
  CDS (1)..(1266): transl_table=11

SEQ ID NO: 23787 - protein, 421 aa, Yersinia pseudotuberculosis IP 32953; identical to SEQ ID NO: 23582

SEQ ID NO: 23788 - DNA, 1404 bp, Mannheimia succiniciproducens MBEL55E; identical to SEQ ID NO: 23583
  CDS (1)..(1404): transl_table=11

SEQ ID NO: 23789 - protein, 467 aa, Mannheimia succiniciproducens MBEL55E; identical to SEQ ID NO: 23584

SEQ ID NO: 23790 - DNA, 1437 bp, Legionella pneumophila str. Paris; identical to SEQ ID NO: 23585
  CDS (1)..(1437): transl_table=11

SEQ ID NO: 23791 - protein, 478 aa, Legionella pneumophila str. Paris; identical to SEQ ID NO: 23586

SEQ ID NO: 23792 - DNA, 1443 bp, Legionella pneumophila str. Lens; identical to SEQ ID NO: 23587
  CDS (1)..(1443): transl_table=11

SEQ ID NO: 23793 - protein, 480 aa, Legionella pneumophila str. Lens; identical to SEQ ID NO: 23588

SEQ ID NO: 23794 - DNA, 1293 bp, Photobacterium profundum SS9; identical to SEQ ID NO: 23589
  CDS (1)..(1293): transl_table=11

SEQ ID NO: 23795 - protein, 430 aa, Photobacterium profundum SS9; identical to SEQ ID NO: 23590

SEQ ID NO: 23796 - DNA, 1251 bp, Photobacterium profundum SS9; identical to SEQ ID NO: 23591
  CDS (1)..(1251): transl_table=11

SEQ ID NO: 23797 - protein, 416 aa, Photobacterium profundum SS9; identical to SEQ ID NO: 23592

SEQ ID NO: 23798 - DNA, 1248 bp, Photobacterium profundum SS9; identical to SEQ ID NO: 23593
  CDS (1)..(1248): transl_table=11

SEQ ID NO: 23799 - protein, 415 aa, Photobacterium profundum SS9; identical to SEQ ID NO: 23594

SEQ ID NO: 23800 - DNA, 1314 bp, Salmonella enterica subsp. enterica serovar Paratyphi A str. ATCC; identical to SEQ ID NO: 23595
  CDS (1)..(1314): transl_table=11

SEQ ID NO: 23801 - protein, 437 aa, Salmonella enterica subsp. enterica serovar Paratyphi A str. ATCC; identical to SEQ ID NO: 23596

SEQ ID NO: 23802 - DNA, 1272 bp, Azoarcus sp. EbN1; identical to SEQ ID NO: 23597
  CDS (1)..(1272): transl_table=11

SEQ ID NO: 23803 - protein, 423 aa, Azoarcus sp. EbN1; identical to SEQ ID NO: 23598

SEQ ID NO: 23804 - DNA, 1371 bp, Xanthomonas oryzae pv. oryzae KACC10331; identical to SEQ ID NO: 23599
  CDS (1)..(1371): transl_table=11

SEQ ID NO: 23805 - protein, 456 aa, Xanthomonas oryzae pv. oryzae KACC10331; identical to SEQ ID NO: 23600

SEQ ID NO: 23806 - DNA, 1344 bp, Vibrio fischeri ES114; identical to SEQ ID NO: 23601
  CDS (1)..(1344): transl_table=11

SEQ ID NO: 23807 - protein, 447 aa, Vibrio fischeri ES114; identical to SEQ ID NO: 23602

SEQ ID NO: 23808 - DNA, 1299 bp, Vibrio fischeri ES114; identical to SEQ ID NO: 23603
  CDS (1)..(1299): transl_table=11

SEQ ID NO: 23809 - protein, 432 aa, Vibrio fischeri ES114; identical to SEQ ID NO: 23604

SEQ ID NO: 23810 - DNA, 1152 bp, Vibrio fischeri ES114; identical to SEQ ID NO: 23605
  CDS (1)..(1152): transl_table=11

SEQ ID NO: 23811 - protein, 383 aa, Vibrio fischeri ES114; identical to SEQ ID NO: 23606

SEQ ID NO: 23812 - DNA, 1284 bp, Pseudomonas syringae pv. syringae B728a; identical to SEQ ID NO: 23607
  CDS (1)..(1284)

SEQ ID NO: 23813 - protein, 427 aa, Pseudomonas syringae pv. syringae B728a; identical to SEQ ID NO: 23608

SEQ ID NO: 23814 - DNA, 1341 bp, Xanthomonas campestris pv. campestris str. 8004; identical to SEQ ID NO: 23609
  CDS (1)..(1341): transl_table=11

SEQ ID NO: 23815 - protein, 446 aa, Xanthomonas campestris pv. campestris str. 8004; identical to SEQ ID NO: 23610

SEQ ID NO: 23816 - DNA, 1281 bp, Pseudomonas fluorescens Pf-5; identical to SEQ ID NO: 23611
  CDS (1)..(1281): transl_table=11

SEQ ID NO: 23817 - protein, 426 aa, Pseudomonas fluorescens Pf-5; identical to SEQ ID NO: 23612

SEQ ID NO: 23818 - DNA, 1260 bp, Colwellia psychrerythraea 34H; identical to SEQ ID NO: 23613
  CDS (1)..(1260): transl_table=11

SEQ ID NO: 23819 - protein, 419 aa, Colwellia psychrerythraea 34H; identical to SEQ ID NO: 23614

SEQ ID NO: 23820 - DNA, 1284 bp, Pseudomonas syringae pv. phaseolicola 1448A; identical to SEQ ID NO: 23615
  CDS (1)..(1284): transl_table=11

SEQ ID NO: 23821 - protein, 427 aa, Pseudomonas syringae pv. phaseolicola 1448A; identical to SEQ ID NO: 23616

SEQ ID NO: 23822 - DNA, 1452 bp, Pseudomonas syringae pv. phaseolicola 1448A; identical to SEQ ID NO: 23617
  CDS (1)..(1452): transl_table=11

SEQ ID NO: 23823 - protein, 483 aa, Pseudomonas syringae pv. phaseolicola 1448A; identical to SEQ ID NO: 23618

SEQ ID NO: 23824 - DNA, 1206 bp, Dechloromonas aromatica RCB; identical to SEQ ID NO: 23619
  CDS (1)..(1206): transl_table=11

SEQ ID NO: 23825 - protein, 401 aa, Dechloromonas aromatica RCB; identical to SEQ ID NO: 23620

SEQ ID NO: 23826 - DNA, 1329 bp, Dechloromonas aromatica RCB; identical to SEQ ID NO: 23621
  CDS (1)..(1329): transl_table=11

SEQ ID NO: 23827 - protein, 442 aa, Dechloromonas aromatica RCB; identical to SEQ ID NO: 23622

SEQ ID NO: 23828 - DNA, 1371 bp, Ralstonia eutropha JMP134; identical to SEQ ID NO: 23623
  CDS (1)..(1371): transl_table=11

SEQ ID NO: 23829 - protein, 456 aa, Ralstonia eutropha JMP134; identical to SEQ ID NO: 23624

SEQ ID NO: 23830 - DNA, 1218 bp, Thiobacillus denitrificans ATCC 25259; identical to SEQ ID NO: 23625
  CDS (1)..(1218): transl_table=11

SEQ ID NO: 23831 - protein, 405 aa, Thiobacillus denitrificans ATCC 25259; identical to SEQ ID NO: 23626

SEQ ID NO: 23832 - DNA, 1275 bp, Pseudomonas syringae pv. syringae B728a; identical to SEQ ID NO: 23627
  CDS (1)..(1275)

SEQ ID NO: 23833 - protein, 424 aa, Pseudomonas syringae pv. syringae B728a; identical to SEQ ID NO: 23628

SEQ ID NO: 23834 - DNA, 1188 bp, Desulfovibrio desulfuricans G20; identical to SEQ ID NO: 23629
  CDS (1)..(1188)

SEQ ID NO: 23835 - protein, 395 aa, Desulfovibrio desulfuricans G20; identical to SEQ ID NO: 23630

SEQ ID NO: 23836 - DNA, 1161 bp, Haemophilus somnus 2336; identical to SEQ ID NO: 23631
  CDS (1)..(1161)

SEQ ID NO: 23837 - protein, 386 aa, Haemophilus somnus 2336; identical to SEQ ID NO: 23632

SEQ ID NO: 23838 - DNA, 1413 bp, Haemophilus somnus 2336; identical to SEQ ID NO: 23633
  CDS (1)..(1413)

SEQ ID NO: 23839 - protein, 470 aa, Haemophilus somnus 2336; identical to SEQ ID NO: 23634

SEQ ID NO: 23840 - DNA, 1356 bp, Haemophilus somnus 2336; identical to SEQ ID NO: 23635
  CDS (1)..(1356)

SEQ ID NO: 23841 - protein, 451 aa, Haemophilus somnus 2336; identical to SEQ ID NO: 23636

SEQ ID NO: 23842 - DNA, 993 bp, Haemophilus somnus 2336; identical to SEQ ID NO: 23637
  CDS (1)..(993)

SEQ ID NO: 23843 - protein, 330 aa, Haemophilus somnus 2336; identical to SEQ ID NO: 23638

SEQ ID NO: 23844 - DNA, 1392 bp, Actinobacillus pleuropneumoniae serovar 1 str. 4074; identical to SEQ ID NO: 23639
  CDS (1)..(1392)

SEQ ID NO: 23845 - protein, 463 aa, Actinobacillus pleuropneumoniae serovar 1 str. 4074; identical to SEQ ID NO: 23640

SEQ ID NO: 23846 - DNA, 1275 bp, Pseudomonas aeruginosa UCBPP-PA14; identical to SEQ ID NO: 23641
  CDS (1)..(1275)

SEQ ID NO: 23847 - protein, 424 aa, Pseudomonas aeruginosa UCBPP-PA14; identical to SEQ ID NO: 23642

SEQ ID NO: 23848 - DNA, 1197 bp, Dechloromonas aromatica RCB; identical to SEQ ID NO: 23643
  CDS (1)..(1197)

SEQ ID NO: 23849 - protein, 398 aa, Dechloromonas aromatica RCB; identical to SEQ ID NO: 23644

SEQ ID NO: 23850 - DNA, 1356 bp, Haemophilus influenzae R2846; identical to SEQ ID NO: 23645
  CDS (1)..(1356)

SEQ ID NO: 23851 - protein, 451 aa, Haemophilus influenzae R2846; identical to SEQ ID NO: 23646

SEQ ID NO: 23852 - DNA, 1356 bp, Haemophilus influenzae R2866; identical to SEQ ID NO: 23647
  CDS (1)..(1356)

SEQ ID NO: 23853 - protein, 451 aa, Haemophilus influenzae R2866; identical to SEQ ID NO: 23648

SEQ ID NO: 23854 - DNA, 1260 bp, Pseudomonas fluorescens PfO-1; identical to SEQ ID NO: 23649
  CDS (1)..(1260)

SEQ ID NO: 23855 - protein, 419 aa, Pseudomonas fluorescens PfO-1; identical to SEQ ID NO: 23650

SEQ ID NO: 23856 - DNA, 1272 bp, Pseudomonas fluorescens PfO-1; identical to SEQ ID NO: 23651
  CDS (1)..(1272)

SEQ ID NO: 23857 - protein, 423 aa, Pseudomonas fluorescens PfO-1; identical to SEQ ID NO: 23652

SEQ ID NO: 23858 - DNA, 1290 bp, Rhodospirillum rubrum; identical to SEQ ID NO: 23653
  CDS (1)..(1290)

SEQ ID NO: 23859 - protein, 429 aa, Rhodospirillum rubrum; identical to SEQ ID NO: 23654

SEQ ID NO: 23860 - DNA, 1128 bp, Cytophaga hutchinsonii; identical to SEQ ID NO: 23655
  CDS (1)..(1128)

SEQ ID NO: 23861 - protein, 375 aa, Cytophaga hutchinsonii; identical to SEQ ID NO: 23656

SEQ ID NO: 23862 - DNA, 1035 bp, Azotobacter vinelandii AvOP; identical to SEQ ID NO: 23657
  CDS (1)..(1035): transl_table=11

SEQ ID NO: 23863 - protein, 344 aa, Azotobacter vinelandii AvOP; identical to SEQ ID NO: 23658

SEQ ID NO: 23864 - DNA, 1353 bp, Chromohalobacter salexigens DSM 3043; identical to SEQ ID NO: 23659
  CDS (1)..(1353): transl_table=11

SEQ ID NO: 23865 - protein, 450 aa, Chromohalobacter salexigens DSM 3043; identical to SEQ ID NO: 23660

SEQ ID NO: 23866 - DNA, 1320 bp, Desulfuromonas acetoxidans DSM 684; identical to SEQ ID NO: 23661
  CDS (1)..(1320): transl_table=11

SEQ ID NO: 23867 - protein, 439 aa, Desulfuromonas acetoxidans DSM 684; identical to SEQ ID NO: 23662

SEQ ID NO: 23868 - DNA, 1353 bp, Methylobacillus flagellatus KT; identical to SEQ ID NO: 23663
  CDS (1)..(1353): transl_table=11

SEQ ID NO: 23869 - protein, 450 aa, Methylobacillus flagellatus KT; identical to SEQ ID NO: 23664

SEQ ID NO: 23870 - DNA, 1350 bp, Shewanella baltica OS155; identical to SEQ ID NO: 23665
  CDS (1)..(1350): transl_table=11

SEQ ID NO: 23871 - protein, 449 aa, Shewanella baltica OS155; identical to SEQ ID NO: 23666

SEQ ID NO: 23872 - DNA, 1323 bp, Shewanella amazonensis SB2B; identical to SEQ ID NO: 23667
  CDS (1)..(1323): transl_table=11

SEQ ID NO: 23873 - protein, 440 aa, Shewanella amazonensis SB2B; identical to SEQ ID NO: 23668

SEQ ID NO: 23874 - DNA, 1359 bp, Shewanella amazonensis SB2B; identical to SEQ ID NO: 23669
  CDS (1)..(1359): transl_table=11

SEQ ID NO: 23875 - protein, 452 aa, Shewanella amazonensis SB2B; identical to SEQ ID NO: 23670

SEQ ID NO: 23876 - DNA, 999 bp, Shewanella denitrificans OS-217; identical to SEQ ID NO: 23671
  CDS (1)..(999): transl_table=11

SEQ ID NO: 23877 - protein, 332 aa, Shewanella denitrificans OS-217; identical to SEQ ID NO: 23672

SEQ ID NO: 23878 - DNA, 1353 bp, Shewanella frigidimarina NCIMB 400; identical to SEQ ID NO: 23673
  CDS (1)..(1353): transl_table=11

SEQ ID NO: 23879 - protein, 450 aa, Shewanella frigidimarina NCIMB 400; identical to SEQ ID NO: 23674

SEQ ID NO: 23880 - DNA, 1242 bp, Thiomicrospira denitrificans ATCC 33889; identical to SEQ ID NO: 23675
  CDS (1)..(1242): transl_table=11

SEQ ID NO: 23881 - protein, 413 aa, Thiomicrospira denitrificans ATCC 33889; identical to SEQ ID NO: 23676

SEQ ID NO: 23882 - DNA, 1401 bp, Syntrophobacter fumaroxidans MPOB; identical to SEQ ID NO: 23677
  CDS (1)..(1401): transl_table=11

SEQ ID NO: 23883 - protein, 466 aa, Syntrophobacter fumaroxidans MPOB; identical to SEQ ID NO: 23678

SEQ ID NO: 23884 - DNA, 1029 bp, Syntrophobacter fumaroxidans MPOB; identical to SEQ ID NO: 23679
  CDS (1)..(1029): transl_table=11

SEQ ID NO: 23885 - protein, 342 aa, Syntrophobacter fumaroxidans MPOB; identical to SEQ ID NO: 23680

SEQ ID NO: 23886 - DNA, 1344 bp, Xylella fastidiosa Ann-1; identical to SEQ ID NO: 23681
  CDS (1)..(1344): transl_table=11

SEQ ID NO: 23887 - protein, 447 aa, Xylella fastidiosa Ann-1; identical to SEQ ID NO: 23682

SEQ ID NO: 23888 - DNA, 1203 bp, Rhodoferax ferrireducens DSM 15236; identical to SEQ ID NO: 23683
  CDS (1)..(1203): transl_table=11

SEQ ID NO: 23889 - protein, 400 aa, Rhodoferax ferrireducens DSM 15236; identical to SEQ ID NO: 23684

SEQ ID NO: 23890 - DNA, 1383 bp, Pseudomonas putida; identical to SEQ ID NO: 23685
  CDS (1)..(1383): transl_table=11

SEQ ID NO: 23891 - protein, 460 aa, Pseudomonas putida; identical to SEQ ID NO: 23686

SEQ ID NO: 23892 - DNA, 1416 bp, Alcaligenes eutrophus; identical to SEQ ID NO: 23687
  CDS (1)..(1416): transl_table=11

SEQ ID NO: 23893 - protein, 471 aa, Alcaligenes eutrophus; identical to SEQ ID NO: 23688

SEQ ID NO: 23894 - DNA, 1194 bp, Myxococcus xanthus; identical to SEQ ID NO: 23689
  CDS (1)..(1194): transl_table=11

SEQ ID NO: 23895 - protein, 397 aa, Myxococcus xanthus; identical to SEQ ID NO: 23690

SEQ ID NO: 23896 - DNA, 1329 bp, Enterobacter cloacae; identical to SEQ ID NO: 23691
  CDS (1)..(1329): transl_table=11

SEQ ID NO: 23897 - protein, 442 aa, Enterobacter cloacae; identical to SEQ ID NO: 23692

SEQ ID NO: 23898 - DNA, 1356 bp, Haemophilus influenzae; identical to SEQ ID NO: 23693
  CDS (1)..(1356): transl_table=11

SEQ ID NO: 23899 - protein, 451 aa, Haemophilus influenzae; identical to SEQ ID NO: 23694

SEQ ID NO: 23900 - DNA, 1356 bp, Haemophilus influenzae; identical to SEQ ID NO: 23695
  CDS (1)..(1356): transl_table=11

SEQ ID NO: 23901 - protein, 451 aa, Haemophilus influenzae; identical to SEQ ID NO: 23696

SEQ ID NO: 23902 - DNA, 1356 bp, Haemophilus influenzae; identical to SEQ ID NO: 23697
  CDS (1)..(1356): transl_table=11

SEQ ID NO: 23903 - protein, 451 aa, Haemophilus influenzae; identical to SEQ ID NO: 23698

SEQ ID NO: 23904 - DNA, 1374 bp, Haemophilus influenzae; identical to SEQ ID NO: 23699
  CDS (1)..(1374): transl_table=11

SEQ ID NO: 23905 - protein, 457 aa, Haemophilus influenzae; identical to SEQ ID NO: 23700

SEQ ID NO: 23906 - DNA, 1368 bp, Haemophilus influenzae; identical to SEQ ID NO: 23701
  CDS (1)..(1368): transl_table=11

SEQ ID NO: 23907 - protein, 455 aa, Haemophilus influenzae; identical to SEQ ID NO: 23702

SEQ ID NO: 23908 - DNA, 1371 bp, Haemophilus influenzae; identical to SEQ ID NO: 23703
  CDS (1)..(1371): transl_table=11

SEQ ID NO: 23909 - protein, 456 aa, Haemophilus influenzae; identical to SEQ ID NO: 23704

SEQ ID NO: 23910 - DNA, 1377 bp, Burkholderia pickettii; identical to SEQ ID NO: 23705
  CDS (1)..(1377): transl_table=11

SEQ ID NO: 23911 - protein, 458 aa, Burkholderia pickettii; identical to SEQ ID NO: 23706

SEQ ID NO: 23912 - DNA, 1347 bp, Escherichia coli O6; identical to SEQ ID NO: 23707
  CDS (1)..(1347): transl_table=11

SEQ ID NO: 23913 - protein, 448 aa, Escherichia coli O6; identical to SEQ ID NO: 23708

SEQ ID NO: 23914 - DNA, 1314 bp, Salmonella typhimurium; identical to SEQ ID NO: 23709
  CDS (1)..(1314): transl_table=11

SEQ ID NO: 23915 - protein, 437 aa, Salmonella typhimurium; identical to SEQ ID NO: 23710

SEQ ID NO: 23916 - DNA, 1287 bp, Pasteurella multocida; identical to SEQ ID NO: 23711
  CDS (1)..(1287)

SEQ ID NO: 23917 - protein, 428 aa, Pasteurella multocida; identical to SEQ ID NO: 23712

SEQ ID NO: 23918 - DNA, 23 bp, Artificial sequence
  (1)..(23): primer
atggtcatgagccagaaaaccct

SEQ ID NO: 23919 - DNA, 27 bp, Artificial sequence
  (1)..(27): primer
ttagaacgcgtagttaaagttagtacc

SEQ ID NO: 23920 - protein, 549 aa, Artificial sequence; identical to SEQ ID NO: 23715
  Variant (2)..(2): xaa in position 2 is any amino acid
  Variant (5)..(5): xaa in position 5 is any amino acid
  Variant (7)..(7): xaa in position 7 is any amino acid
  Variant (9)..(12): xaa in position 9 to 12 is any amino acid
  Variant (14)..(15): xaa in position 14 to 15 is any or no amino acid
  Variant (17)..(18): xaa in position 17 to 18 is any amino acid
  Variant (19)..(19): xaa in position 19 is any or no amino acid
  Variant (22)..(23): xaa in position 22 to 23 is any or no amino acid
  Variant (25)..(27): xaa in position 25 to 27 is any amino acid
  Variant (28)..(28): xaa in position 28 is any or no amino acid
  Variant (31)..(34): xaa in position 31 to 34 is any amino acid
  Variant (38)..(38): xaa in position 38 is any amino acid
  Variant (40)..(43): xaa in position 40 to 43 is any amino acid
  Variant (44)..(54): xaa in position 44 to 54 is any or no amino acid
  Variant (56)..(114): xaa in position 56 to 114 is any or no amino acid
  Variant (117)..(117): xaa in position 117 is any amino acid
  Variant (118)..(132): xaa in position 118 to 132 is any or no amino acid
  Variant (134)..(139): xaa in position 134 to 139 is any amino acid
  Variant (142)..(143): xaa in position 142 to 143 is any or no amino acid
  Variant (145)..(145): xaa in position 145 is any amino acid
  Variant (147)..(151): xaa in position 147 to 151 is any amino acid
  Variant (153)..(156): xaa in position 153 to 156 is any amino acid
  Variant (157)..(173): xaa in position 157 to 173 is any or no amino acid
  Variant (175)..(176): xaa in position 175 to 176 is any amino acid
  Variant (178)..(183): xaa in position 178 to 183 is any amino acid
  Variant (186)..(186): xaa in position 186 is any amino acid
  Variant (188)..(191): xaa in position 188 to 191 is any amino acid
  Variant (192)..(196): xaa in position 192 to 196 is any or no amino acid
  Variant (198)..(198): xaa in position 198 is any amino acid
  Variant (200)..(200): xaa in position 200 is any amino acid
  Variant (202)..(210): xaa in position 202 to 210 is any amino acid
  Variant (212)..(225): xaa in position 212 to 225 is any amino acid
  Variant (226)..(285): xaa in position 226 to 285 is any or no amino acid
  Variant (288)..(289): xaa in position 288 to 289 is any amino acid
  Variant (291)..(292): xaa in position 291 to 292 is any amino acid
  Variant (294)..(301): xaa in position 294 to 301 is any amino acid
  Variant (302)..(302): xaa in position 302 is any or no amino acid
  Variant (304)..(305): xaa in position 304 to 305 is any amino acid
  Variant (307)..(307): xaa in position 307 is any amino acid
  Variant (309)..(309): xaa in position 309 is any amino acid
  Variant (311)..(319): xaa in position 311 to 319 is any amino acid
  Variant (320)..(355): xaa in position 320 to 355 is any or no amino acid
  Variant (357)..(357): xaa in position 357 is any amino acid
  Variant (360)..(364): xaa in position 360 to 364 is any amino acid
  Variant (366)..(374): xaa in position 366 to 374 is any amino acid
  Variant (375)..(376): xaa in position 375 to 376 is any or no amino acid
  Variant (378)..(385): xaa in position 378 to 385 is any amino acid
  Variant (388)..(391): xaa in position 388 to 391 is any amino acid
  Variant (393)..(402): xaa in position 393 to 402 is any amino acid
  Variant (403)..(420): xaa in position 403 to 420 is any or no amino acid
  Variant (422)..(427): xaa in position 422 to 427 is any amino acid
  Variant (431)..(432): xaa in position 431 to 432 is any amino acid
  Variant (434)..(439): xaa in position 434 to 439 is any amino acid
  Variant (440)..(440): xaa in position 440 is any or no amino acid
  Variant (443)..(443): xaa in position 443 is any amino acid
  Variant (445)..(446): xaa in position 445 to 446 is any amino acid
  Variant (449)..(457): xaa in position 449 to 457 is any amino acid
  Variant (458)..(461): xaa in position 458 to 461 is any or no amino acid
  Variant (464)..(466): xaa in position 464 to 466 is any amino acid
  Variant (467)..(467): xaa in position 467 is any or no amino acid
  Variant (469)..(471): xaa in position 469 to 471 is any amino acid
  Variant (473)..(473): xaa in position 473 is any amino acid
  Variant (475)..(476): xaa in position 475 to 476 is any amino acid
  Variant (478)..(482): xaa in position 478 to 482 is any amino acid
  Variant (483)..(486): xaa in position 483 to 486 is any or no amino acid
  Variant (489)..(489): xaa in position 489 is any amino acid
  Variant (491)..(492): xaa in position 491 to 492 is any amino acid
  Variant (495)..(514): xaa in position 495 to 514 is any amino acid
  Variant (515)..(539): xaa in position 515 to 539 is any or no amino acid
  Variant (541)..(541): xaa in position 541 is any amino acid
  Variant (543)..(548): xaa in position 543 to 548 is any amino acid

SEQ ID NO: 23921 - protein, 17 aa, Artificial sequence
  Variant (2)..(2): xaa in position 2 is any amino acid
  Variant (3)..(3): xaa in position 3 is Ala, Gly or Ser
  Variant (4)..(7): xaa in position 4 to 7 is any amino acid
  Variant (8)..(8): xaa in position 8 is Ala, Asp, Gly, Asn, Pro or Ser
  Variant (10)..(11): xaa in position 10 to 11 is any amino acid
  Variant (12)..(14): xaa in position 12 to 14 is any or no amino acid
  Variant (16)..(16): xaa in position 16 is any or no amino acid
GXXXXXXXAXXXXXNXA

SEQ ID NO: 23922 - protein, 23 aa, Artificial sequence
  Variant (2)..(2): xaa in position 2 is Phe, Trp or Tyr
  Variant (3)..(3): xaa in position 3 is Asn, Gln, Ser or Thr
  Variant (4)..(4): xaa in position 4 is any amino acid
  Variant (5)..(5): xaa in position 5 is Ala or Gly
  Variant (6)..(16): xaa in position 6 to 16 is any amino acid
  Variant (17)..(17): xaa in position 17 is Ala, Gly or Ser
  Variant (18)..(18): xaa in position 18 is any amino acid
  Variant (19)..(19): xaa in position 19 is Ala, Gly, Asn, Ser or Thr
  Variant (21)..(21): xaa in position 21 is any amino acid
  Variant (22)..(22): xaa in position 22 is any or no amino acid
GXXXXXXXXXXXXXXXXXXYXXS

SEQ ID NO: 23923 - protein, 28 aa, Artificial sequence
  Variant (2)..(2): xaa in position 2 is Ala, Asp, Glu or Ser
  Variant (3)..(6): xaa in position 3 to 6 is any amino acid
  Variant (7)..(7): xaa in position 7 is Ala, Gly or Ser
  Variant (8)..(16): xaa in position 8 to 16 is any amino acid
  Variant (17)..(17): xaa in position 17 is Ala, Asp, Glu, Asn, Ser or Thr
  Variant (18)..(26): xaa in position 18 to 26 is any amino acid
PXXXXXXXXXXXXXXXXXXXXXXXXXWS

SEQ ID NO: 23924 - protein, 46 aa, Artificial sequence; identical to SEQ ID NO: 23719
  Variant (2)..(2): xaa in position 2 is Ala, Gly, Ser, Thr or Val
  Variant (3)..(3): xaa in position 3 is any amino acid
  Variant (4)..(4): xaa in position 4 is Trp or Tyr
  Variant (5)..(12): xaa in position 5 to 12 is any amino acid
  Variant (13)..(13): xaa in position 13 is Lys or Arg
  Variant (14)..(14): xaa in position 14 is any amino acid
  Variant (16)..(18): xaa in position 16 to 18 is any amino acid
  Variant (19)..(19): xaa in position 19 is any or no amino acid
  Variant (21)..(33): xaa in position 21 to 33 is any amino acid
  Variant (34)..(36): xaa in position 34 to 36 is any or no amino acid
  Variant (38)..(43): xaa in position 38 to 43 is any amino acid
  Variant (44)..(44): xaa in position 44 is Ala, Gly, Ser or Thr
  Variant (45)..(45): xaa in position 45 is any amino acid
  Variant (46)..(46): xaa in position 46 is Gly, Ser or Thr

SEQ ID NO: 23925 - DNA, 1203 bp, Escherichia coli; identical to SEQ ID NO: 13945
  CDS (1)..(1203)

SEQ ID NO: 23926 - protein, 400 aa, Escherichia coli; identical to SEQ ID NO: 13946

SEQ ID NO: 23927 - DNA, 1281 bp, Aquifex aeolicus VF5; identical to SEQ ID NO: 13947
  CDS (1)..(1281): transl_table=11

SEQ ID NO: 23928 - protein, 426 aa, Aquifex aeolicus VF5; identical to SEQ ID NO: 13948

SEQ ID NO: 23929 - DNA, 1260 bp, Neisseria meningitidis Z2491; identical to SEQ ID NO: 13949
  CDS (1)..(1260): transl_table=11

SEQ ID NO: 23930 - protein, 419 aa, Neisseria meningitidis Z2491; identical to SEQ ID NO: 13950

SEQ ID NO: 23931 - DNA, 1425 bp, Deinococcus radiodurans R1; identical to SEQ ID NO: 13951
  CDS (1)..(1425): transl_table=11

SEQ ID NO: 23932 - protein, 474 aa, Deinococcus radiodurans R1; identical to SEQ ID NO: 13952

SEQ ID NO: 23933 - DNA, 1392 bp, Mycobacterium tuberculosis CDC1551; identical to SEQ ID NO: 13953
  CDS (1)..(1392): transl_table=11

SEQ ID NO: 23934 - protein, 463 aa, Mycobacterium tuberculosis CDC1551; identical to SEQ ID NO: 13954

SEQ ID NO: 23935 - DNA, 1203 bp, Salmonella typhimurium LT2; identical to SEQ ID NO: 13955
  CDS (1)..(1203): transl_table=11

SEQ ID NO: 23936 - protein, 400 aa, Salmonella typhimurium LT2; identical to SEQ ID NO: 13956

SEQ ID NO: 23937 - DNA, 1320 bp, Agrobacterium tumefaciens str. C58; identical to SEQ ID NO: 13957
  CDS (1)..(1320): transl_table=11

SEQ ID NO: 23938 - protein, 439 aa, Agrobacterium tumefaciens str. C58; identical to SEQ ID NO: 13958

SEQ ID NO: 23939 - DNA, 1251 bp, Yersinia pestis KIM; identical to SEQ ID NO: 13959
  CDS (1)..(1251): transl_table=11

SEQ ID NO: 23940 - protein, 416 aa, Yersinia pestis KIM; identical to SEQ ID NO: 13960

SEQ ID NO: 23941 - DNA, 1314 bp, Thermosynechococcus elongatus BP-1; identical to SEQ ID NO: 13961
  CDS (1)..(1314): transl_table=11

SEQ ID NO: 23942 - protein, 437 aa, Thermosynechococcus elongatus BP-1; identical to SEQ ID NO: 13962

SEQ ID NO: 23943 - DNA, 1464 bp, Oceanobacillus iheyensis HTE831; identical to SEQ ID NO: 13963
  CDS (1)..(1464): transl_table=11

SEQ ID NO: 23944 - protein, 487 aa, Oceanobacillus iheyensis HTE831; identical to SEQ ID NO: 13964

SEQ ID NO: 23945 - DNA, 1209 bp, Pseudomonas putida KT2440; identical to SEQ ID NO: 13965
  CDS (1)..(1209): transl_table=11

SEQ ID NO: 23946 - protein, 402 aa, Pseudomonas putida KT2440; identical to SEQ ID NO: 13966

SEQ ID NO: 23947 - DNA, 1305 bp, Bradyrhizobium japonicum USDA 110; identical to SEQ ID NO: 13967
  CDS (1)..(1305)

SEQ ID NO: 23948 - protein, 434 aa, Bradyrhizobium japonicum USDA 110; identical to SEQ ID NO: 13968

SEQ ID NO: 23949 - DNA, 1434 bp, Lactobacillus plantarum WCFS1; identical to SEQ ID NO: 13969
  CDS (1)..(1434): transl_table=11

SEQ ID NO: 23950 - protein, 477 aa, Lactobacillus plantarum WCFS1; identical to SEQ ID NO: 13970

SEQ ID NO: 23951 - DNA, 1203 bp, Salmonella enterica subsp. enterica serovar Typhi Ty2; identical to SEQ ID NO: 13971
  CDS (1)..(1203): transl_table=11

SEQ ID NO: 23952 - protein, 400 aa, Salmonella enterica subsp. enterica serovar Typhi Ty2; identical to SEQ ID NO: 13972

SEQ ID NO: 23953 - DNA, 1170 bp, Bacteroides thetaiotaomicron VPI-5482; identical to SEQ ID NO: 13973
  CDS (1)..(1170): transl_table=11

SEQ ID NO: 23954 - protein, 389 aa, Bacteroides thetaiotaomicron VPI-5482; identical to SEQ ID NO: 13974

SEQ ID NO: 23955 - DNA, 1407 bp, Coxiella burnetii RSA 493; identical to SEQ ID NO: 13975
  CDS (1)..(1407): transl_table=11

SEQ ID NO: 23956 - protein, 468 aa, Coxiella burnetii RSA 493; identical to SEQ ID NO: 13976

SEQ ID NO: 23957 - DNA, 1185 bp, Porphyromonas gingivalis W83; identical to SEQ ID NO: 13977
  CDS (1)..(1185): transl_table=11

SEQ ID NO: 23958 - protein, 394 aa, Porphyromonas gingivalis W83; identical to SEQ ID NO: 13978

SEQ ID NO: 23959 - DNA, 1608 bp, Oryza sativa (japonica cultivar-group); identical to SEQ ID NO: 13979
  CDS (1)..(1608)

SEQ ID NO: 23960 - protein, 535 aa, Oryza sativa (japonica cultivar-group); identical to SEQ ID NO: 13980

SEQ ID NO: 23961 - DNA, 1446 bp, Geobacter sulfurreducens PCA; identical to SEQ ID NO: 13981
  CDS (1)..(1446): transl_table=11

SEQ ID NO: 23962 - protein, 481 aa, Geobacter sulfurreducens PCA; identical to SEQ ID NO: 13982

SEQ ID NO: 23963 - DNA, 1437 bp, Treponema denticola ATCC 35405; identical to SEQ ID NO: 13983
  CDS (1)..(1437): transl_table=11

SEQ ID NO: 23964 - protein, 478 aa, Treponema denticola ATCC 35405; identical to SEQ ID NO: 13984

SEQ ID NO: 23965 - DNA, 1293 bp, Eremothecium gossypii; identical to SEQ ID NO: 13985
  CDS (1)..(1293)

SEQ ID NO: 23966 - protein, 430 aa, Eremothecium gossypii; identical to SEQ ID NO: 13986

SEQ ID NO: 23967 - DNA, 1434 bp, Neurospora crassa; identical to SEQ ID NO: 13987
  CDS (1)..(1434)

SEQ ID NO: 23968 - protein, 477 aa, Neurospora crassa; identical to SEQ ID NO: 13988

SEQ ID NO: 23969 - DNA, 5916 bp, Magnaporthe grisea 70-15; identical to SEQ ID NO: 13989
  CDS (1)..(5916)

SEQ ID NO: 23970 - protein, 1971 aa, Magnaporthe grisea 70-15; identical to SEQ ID NO: 13990

SEQ ID NO: 23971 - DNA, 1380 bp, Gibberella zeae PH-1; identical to SEQ ID NO: 13991
  CDS (1)..(1380)

SEQ ID NO: 23972 - protein, 459 aa, Gibberella zeae PH-1; identical to SEQ ID NO: 13992

SEQ ID NO: 23973 - DNA, 1839 bp, Ustilago maydis 521; identical to SEQ ID NO: 13993
  CDS (1)..(1839)

SEQ ID NO: 23974 - protein, 612 aa, Ustilago maydis 521; identical to SEQ ID NO: 13994

SEQ ID NO: 23975 - DNA, 1464 bp, Aspergillus nidulans FGSC A4; identical to SEQ ID NO: 13995
  CDS (1)..(1464)

SEQ ID NO: 23976 - protein, 487 aa, Aspergillus nidulans FGSC A4; identical to SEQ ID NO: 13996

SEQ ID NO: 23977 - DNA, 1296 bp, Candida glabrata CBS138; identical to SEQ ID NO: 13997
  CDS (1)..(1296)

SEQ ID NO: 23978 - protein, 431 aa, Candida glabrata CBS138; identical to SEQ ID NO: 13998

SEQ ID NO: 23979 - DNA, 1284 bp, Kluyveromyces lactis NRRL Y-1140; identical to SEQ ID NO: 13999
  CDS (1)..(1284)

SEQ ID NO: 23980 - protein, 427 aa, Kluyveromyces lactis NRRL Y-1140; identical to SEQ ID NO: 14000

SEQ ID NO: 23981 - DNA, 1269 bp, Debaryomyces hansenii CBS767; identical to SEQ ID NO: 14001
  CDS (1)..(1269)

SEQ ID NO: 23982 - protein, 422 aa, Debaryomyces hansenii CBS767; identical to SEQ ID NO: 14002

SEQ ID NO: 23983 - DNA, 1245 bp, Yarrowia lipolytica CLIB99; identical to SEQ ID NO: 14003
  CDS (1)..(1245)

SEQ ID NO: 23984 - protein, 414 aa, Yarrowia lipolytica CLIB99; identical to SEQ ID NO: 14004

SEQ ID NO: 23985 - DNA, 1362 bp, Cryptococcus neoformans var. neoformans JEC21; identical to SEQ ID NO: 14005
  CDS (1)..(1362)

SEQ ID NO: 23986 - protein, 453 aa, Cryptococcus neoformans var. neoformans JEC21; identical to SEQ ID NO: 14006

SEQ ID NO: 23987 - DNA, 1173 bp, Entamoeba histolytica HM-1:IMSS; identical to SEQ ID NO: 14007
  CDS (1)..(1173)

SEQ ID NO: 23988 - protein, 390 aa, Entamoeba histolytica HM-1:IMSS; identical to SEQ ID NO: 14008

SEQ ID NO: 23989 - DNA, 1266 bp, Candida albicans SC5314; identical to SEQ ID NO: 14009
  CDS (1)..(1266): transl_table=12

SEQ ID NO: 23990 - protein, 421 aa, Candida albicans SC5314; identical to SEQ ID NO: 14010

SEQ ID NO: 23991 - DNA, 1305 bp, Bartonella quintana str. Toulouse; identical to SEQ ID NO: 14011
  CDS (1)..(1305): transl_table=11

SEQ ID NO: 23992 - protein, 434 aa, Bartonella quintana str. Toulouse; identical to SEQ ID NO: 14012

SEQ ID NO: 23993 - DNA, 1305 bp, Bartonella henselae str. Houston-1; identical to SEQ ID NO: 14013
  CDS (1)..(1305): transl_table=11

SEQ ID NO: 23994 - protein, 434 aa, Bartonella henselae str. Houston-1; identical to SEQ ID NO: 14014

SEQ ID NO: 23995 - DNA, 1470 bp, Bacillus licheniformis ATCC 14580; identical to SEQ ID NO: 14015
  CDS (1)..(1470): transl_table=11

SEQ ID NO: 23996 - protein, 489 aa, Bacillus licheniformis ATCC 14580; identical to SEQ ID NO: 14016

SEQ ID NO: 23997 - DNA, 1167 bp, Bacteroides fragilis YCH46; identical to SEQ ID NO: 14017
  CDS (1)..(1167): transl_table=11

SEQ ID NO: 23998 - protein, 388 aa, Bacteroides fragilis YCH46; identical to SEQ ID NO: 14018

SEQ ID NO: 23999 - DNA, 1350 bp, Methylococcus capsulatus str. Bath; identical to SEQ ID NO: 14019
  CDS (1)..(1350): transl_table=11

SEQ ID NO: 24000 - protein, 449 aa, Methylococcus capsulatus str. Bath; identical to SEQ ID NO: 14020

SEQ ID NO: 24001 - DNA, 1317 bp, Nocardia farcinica IFM 10152; identical to SEQ ID NO: 14021
  CDS (1)..(1317): transl_table=11

SEQ ID NO: 24002 - protein, 438 aa, Nocardia farcinica IFM 10152; identical to SEQ ID NO: 14022

SEQ ID NO: 24003 - DNA, 1404 bp, Legionella pneumophila str. Paris; identical to SEQ ID NO: 14023
  CDS (1)..(1404): transl_table=11

SEQ ID NO: 24004 - protein, 467 aa, Legionella pneumophila str. Paris; identical to SEQ ID NO: 14024

SEQ ID NO: 24005 - DNA, 1404 bp, Legionella pneumophila str. Lens; identical to SEQ ID NO: 14025
  CDS (1)..(1404): transl_table=11

SEQ ID NO: 24006 - protein, 467 aa, Legionella pneumophila str. Lens; identical to SEQ ID NO: 14026

SEQ ID NO: 24007 - DNA, 1473 bp, Geobacillus kaustophilus HTA426; identical to SEQ ID NO: 14027
  CDS (1)..(1473): transl_table=11

SEQ ID NO: 24008 - protein, 490 aa, Geobacillus kaustophilus HTA426; identical to SEQ ID NO: 14028

SEQ ID NO: 24009 - DNA, 1347 bp, Idiomarina loihiensis L2TR; identical to SEQ ID NO: 14029
  CDS (1)..(1347): transl_table=11

SEQ ID NO: 24010 - protein, 448 aa, Idiomarina loihiensis L2TR; identical to SEQ ID NO: 14030

SEQ ID NO: 24011 - DNA, 1344 bp, Silicibacter pomeroyi DSS-3; identical to SEQ ID NO: 14031
  CDS (1)..(1344): transl_table=11

SEQ ID NO: 24012 - protein, 447 aa, Silicibacter pomeroyi DSS-3; identical to SEQ ID NO: 14032

SEQ ID NO: 24013 - DNA, 1260 bp, Neisseria gonorrhoeae FA 1090; identical to SEQ ID NO: 14033
  CDS (1)..(1260): transl_table=11

SEQ ID NO: 24014 - protein, 419 aa, Neisseria gonorrhoeae FA 1090; identical to SEQ ID NO: 14034

SEQ ID NO: 24015 - DNA, 1167 bp, Bacteroides fragilis NCTC 9343; identical to SEQ ID NO: 14035
  CDS (1)..(1167): transl_table=11

SEQ ID NO: 24016 - protein, 388 aa, Bacteroides fragilis NCTC 9343; identical to SEQ ID NO: 14036

SEQ ID NO: 24017 - DNA, 1251 bp, Salmonella enterica subsp. enterica serovar Choleraesuis str; identical to SEQ ID NO: 14037
  CDS (1)..(1251): transl_table=11

SEQ ID NO: 24018 - protein, 416 aa, Salmonella enterica subsp. enterica serovar Choleraesuis str; identical to SEQ ID NO: 14038

SEQ ID NO: 24019 - DNA, 1224 bp, Pseudomonas syringae pv. syringae B728a; identical to SEQ ID NO: 14039
  CDS (1)..(1224)

SEQ ID NO: 24020 - protein, 407 aa, Pseudomonas syringae pv. syringae B728a; identical to SEQ ID NO: 14040

SEQ ID NO: 24021 - DNA, 1326 bp, Corynebacterium jeikeium K411; identical to SEQ ID NO: 14041
  CDS (1)..(1326): transl_table=11

SEQ ID NO: 24022 - protein, 441 aa, Corynebacterium jeikeium K411; identical to SEQ ID NO: 14042

SEQ ID NO: 24023 - DNA, 1293 bp, Rhodobacter sphaeroides 2.4.1; identical to SEQ ID NO: 14043
  CDS (1)..(1293)

SEQ ID NO: 24024 - protein, 430 aa, Rhodobacter sphaeroides 2.4.1; identical to SEQ ID NO: 14044

SEQ ID NO: 24025 - DNA, 1134 bp, Xylella fastidiosa Ann-1; identical to SEQ ID NO: 14045
  CDS (1)..(1134)

SEQ ID NO: 24026 - protein, 377 aa, Xylella fastidiosa Ann-1; identical to SEQ ID NO: 14046

SEQ ID NO: 24027 - DNA, 1464 bp, Leuconostoc mesenteroides subsp. mesenteroides ATCC 8293; identical to SEQ ID NO: 14047
  CDS (1)..(1464)

SEQ ID NO: 24028 - protein, 487 aa, Leuconostoc mesenteroides subsp. mesenteroides ATCC 8293; identical to SEQ ID NO: 14048

SEQ ID NO: 24029 - DNA, 1242 bp, Psychrobacter sp. 273-4; identical to SEQ ID NO: 14049
  CDS (1)..(1242)

SEQ ID NO: 24030 - protein, 413 aa, Psychrobacter sp. 273-4; identical to SEQ ID NO: 14050

SEQ ID NO: 24031 - DNA, 1179 bp, Ralstonia eutropha JMP134; identical to SEQ ID NO: 14051
  CDS (1)..(1179)

SEQ ID NO: 24032 - protein, 392 aa, Ralstonia eutropha JMP134; identical to SEQ ID NO: 14052

SEQ ID NO: 24033 - DNA, 1200 bp, Burkholderia cepacia R18194; identical to SEQ ID NO: 14053
  CDS (1)..(1200)

SEQ ID NO: 24034 - protein, 399 aa, Burkholderia cepacia R18194; identical to SEQ ID NO: 14054

SEQ ID NO: 24035 - DNA, 1224 bp, Pseudomonas fluorescens PfO-1; identical to SEQ ID NO: 14055
  CDS (1)..(1224)

SEQ ID NO: 24036 - protein, 407 aa, Pseudomonas fluorescens PfO-1; identical to SEQ ID NO: 14056

SEQ ID NO: 24037 - DNA, 1197 bp, Burkholderia fungorum LB400; identical to SEQ ID NO: 14057
  CDS (1)..(1197)

SEQ ID NO: 24038 - protein, 398 aa, Burkholderia fungorum LB400; identical to SEQ ID NO: 14058

SEQ ID NO: 24039 - DNA, 1428 bp, Oenococcus oeni PSU-1; identical to SEQ ID NO: 14059
  CDS (1)..(1428)

SEQ ID NO: 24040 - protein, 475 aa, Oenococcus oeni PSU-1; identical to SEQ ID NO: 14060

SEQ ID NO: 24041 - DNA, 1380 bp, Trichodesmium erythraeum IMS101; identical to SEQ ID NO: 14061
  CDS (1)..(1380)

SEQ ID NO: 24042 - protein, 459 aa, Trichodesmium erythraeum IMS101; identical to SEQ ID NO: 14062

SEQ ID NO: 24043 - DNA, 1434 bp, Campylobacter upsaliensis RM3195; identical to SEQ ID NO: 14063
  CDS (1)..(1434): transl_table=11

SEQ ID NO: 24044 - protein, 477 aa, Campylobacter upsaliensis RM3195; identical to SEQ ID NO: 14064

SEQ ID NO: 24045 - DNA, 1488 bp, Lactococcus lactis subsp. cremoris SK11; identical to SEQ ID NO: 14065
  CDS (1)..(1488)

SEQ ID NO: 24046 - protein, 495 aa, Lactococcus lactis subsp. cremoris SK11; identical to SEQ ID NO: 14066

SEQ ID NO: 24047 - DNA, 1461 bp, Deinococcus geothermalis DSM 11300; identical to SEQ ID NO: 14067
  CDS (1)..(1461): transl_table=11

SEQ ID NO: 24048 - protein, 486 aa, Deinococcus geothermalis DSM 11300; identical to SEQ ID NO: 14068

SEQ ID NO: 24049 - DNA, 1359 bp, Azotobacter vinelandii AvOP; identical to SEQ ID NO: 14069
  CDS (1)..(1359): transl_table=11

SEQ ID NO: 24050 - protein, 452 aa, Azotobacter vinelandii AvOP; identical to SEQ ID NO: 14070

SEQ ID NO: 24051 - DNA, 1356 bp, Burkholderia vietnamiensis G4; identical to SEQ ID NO: 14071
  CDS (1)..(1356): transl_table=11

SEQ ID NO: 24052 - protein, 451 aa, Burkholderia vietnamiensis G4; identical to SEQ ID NO: 14072

SEQ ID NO: 24053 - DNA, 1200 bp, Burkholderia mallei 10229; identical to SEQ ID NO: 14073
  CDS (1)..(1200)

SEQ ID NO: 24054 - protein, 399 aa, Burkholderia mallei 10229; identical to SEQ ID NO: 14074

SEQ ID NO: 24055 - DNA, 1200 bp, Burkholderia cenocepacia AU 1054; identical to SEQ ID NO: 14075
  CDS (1)..(1200): transl_table=11

SEQ ID NO: 24056 - protein, 399 aa, Burkholderia cenocepacia AU 1054; identical to SEQ ID NO: 14076

SEQ ID NO: 24057 - DNA, 1356 bp, Burkholderia pseudomallei 1655; identical to SEQ ID NO: 14077
  CDS (1)..(1356)

SEQ ID NO: 24058 - protein, 451 aa, Burkholderia pseudomallei 1655; identical to SEQ ID NO: 14078

SEQ ID NO: 24059 - DNA, 1173 bp, Chromohalobacter salexigens DSM 3043; identical to SEQ ID NO: 14079
  CDS (1)..(1173): transl_table=11

SEQ ID NO: 24060 - protein, 390 aa, Chromohalobacter salexigens DSM 3043; identical to SEQ ID NO: 14080

SEQ ID NO: 24061 - DNA, 1356 bp, Burkholderia pseudomallei 668; identical to SEQ ID NO: 14081
  CDS (1)..(1356)

SEQ ID NO: 24062 - protein, 451 aa, Burkholderia pseudomallei 668; identical to SEQ ID NO: 14082

SEQ ID NO: 24063 - DNA, 1269 bp, Polaromonas sp. JS666; identical to SEQ ID NO: 14083
  CDS (1)..(1269): transl_table=11

SEQ ID NO: 24064 - protein, 422 aa, Polaromonas sp. JS666; identical to SEQ ID NO: 14084

SEQ ID NO: 24065 - DNA, 1341 bp, Crocosphaera watsonii WH 8501; identical to SEQ ID NO: 14085
  CDS (1)..(1341): transl_table=11

SEQ ID NO: 24066 - protein, 446 aa, Crocosphaera watsonii WH 8501; identical to SEQ ID NO: 14086

SEQ ID NO: 24067 - DNA, 1431 bp, Geobacter metallireducens GS-15; identical to SEQ ID NO: 14087
  CDS (1)..(1431): transl_table=11

SEQ ID NO: 24068 - protein, 476 aa, Geobacter metallireducens GS-15; identical to SEQ ID NO: 14088

SEQ ID NO: 24069 - DNA, 1206 bp, Methanosarcina barkeri str. fusaro; identical to SEQ ID NO: 14089
  CDS (1)..(1206): transl_table=11

SEQ ID NO: 24070 - protein, 401 aa, Methanosarcina barkeri str. fusaro; identical to SEQ ID NO: 14090

SEQ ID NO: 24071 - DNA, 1206 bp, Desulfuromonas acetoxidans DSM 684; identical to SEQ ID NO: 14091
  CDS (1)..(1206): transl_table=11

SEQ ID NO: 24072 - protein, 401 aa, Desulfuromonas acetoxidans DSM 684; identical to SEQ ID NO: 14092

SEQ ID NO: 24073 - DNA, 1293 bp, Jannaschia sp. CCS1; identical to SEQ ID NO: 14093
  CDS (1)..(1293): transl_table=11

SEQ ID NO: 24074 - protein, 430 aa, Jannaschia sp. CCS1; identical to SEQ ID NO: 14094

SEQ ID NO: 24075 - DNA, 1458 bp, Desulfitobacterium hafniense DCB-2; identical to SEQ ID NO: 14095
  CDS (1)..(1458): transl_table=11

SEQ ID NO: 24076 - protein, 485 aa, Desulfitobacterium hafniense DCB-2; identical to SEQ ID NO: 14096

SEQ ID NO: 24077 - DNA, 1218 bp, Methanococcoides burtonii DSM 6242; identical to SEQ ID NO: 14097
  CDS (1)..(1218): transl_table=11

SEQ ID NO: 24078 - protein, 405 aa, Methanococcoides burtonii DSM 6242; identical to SEQ ID NO: 14098

SEQ ID NO: 24079 - DNA, 1575 bp, Frankia sp. EAN1pec; identical to SEQ ID NO: 14099
  CDS (1)..(1575): transl_table=11

SEQ ID NO: 24080 - protein, 524 aa, Frankia sp. EAN1pec; identical to SEQ ID NO: 14100

SEQ ID NO: 24081 - DNA, 1200 bp, Ralstonia metallidurans CH34; identical to SEQ ID NO: 14101
  CDS (1)..(1200): transl_table=11

SEQ ID NO: 24082 - protein, 399 aa, Ralstonia metallidurans CH34; identical to SEQ ID NO: 14102

SEQ ID NO: 24083 - DNA, 1341 bp, Magnetococcus sp. MC-1; identical to SEQ ID NO: 14103
  CDS (1)..(1341): transl_table=11

SEQ ID NO: 24084 - protein, 446 aa, Magnetococcus sp. MC-1; identical to SEQ ID NO: 14104

SEQ ID NO: 24085 - DNA, 1305 bp, Mesorhizobium sp. BNC1; identical to SEQ ID NO: 14105
  CDS (1)..(1305): transl_table=11

SEQ ID NO: 24086 - protein, 434 aa, Mesorhizobium sp. BNC1; identical to SEQ ID NO: 14106

SEQ ID NO: 24087 - DNA, 1290 bp, Silicibacter sp. TM1040; identical to SEQ ID NO: 14107
  CDS (1)..(1290): transl_table=11

SEQ ID NO: 24088 - protein, 429 aa, Silicibacter sp. TM1040; identical to SEQ ID NO: 14108

SEQ ID NO: 24089 - DNA, 1305 bp, Nitrobacter hamburgensis X14; identical to SEQ ID NO: 14109
  CDS (1)..(1305): transl_table=11

SEQ ID NO: 24090 - protein, 434 aa, Nitrobacter hamburgensis X14; identical to SEQ ID NO: 14110

SEQ ID NO: 24091 - DNA, 1308 bp, Paracoccus denitrificans PD1222; identical to SEQ ID NO: 14111
  CDS (1)..(1308): transl_table=11

SEQ ID NO: 24092 - protein, 435 aa, Paracoccus denitrificans PD1222; identical to SEQ ID NO: 14112

SEQ ID NO: 24093 - DNA, 1230 bp, Pseudomonas fluorescens; identical to SEQ ID NO: 14113
  CDS (1)..(1230): transl_table=11

SEQ ID NO: 24094 - protein, 409 aa, Pseudomonas fluorescens; identical to SEQ ID NO: 14114

SEQ ID NO: 24095 - DNA, 1215 bp, Pseudomonas fluorescens; identical to SEQ ID NO: 14115
  CDS (1)..(1215): transl_table=11

SEQ ID NO: 24096 - protein, 404 aa, Pseudomonas fluorescens; identical to SEQ ID NO: 14116

SEQ ID NO: 24097 - DNA, 1443 bp, Staphylococcus haemolyticus; identical to SEQ ID NO: 14117
  CDS (1)..(1443): transl_table=11

SEQ ID NO: 24098 - protein, 480 aa, Staphylococcus haemolyticus; identical to SEQ ID NO: 14118

SEQ ID NO: 24099 - DNA, 1245 bp, Leishmania major; identical to SEQ ID NO: 14119
  CDS (1)..(1245)

SEQ ID NO: 24100 - protein, 414 aa, Leishmania major; identical to SEQ ID NO: 14120

SEQ ID NO: 24101 - DNA, 1380 bp, Gibberella moniliformis; identical to SEQ ID NO: 14121
  CDS (1)..(1380)

SEQ ID NO: 24102 - protein, 459 aa, Gibberella moniliformis; identical to SEQ ID NO: 14122

SEQ ID NO: 24103 - DNA, 1233 bp, Schizosaccharomyces pombe; identical to SEQ ID NO: 14123
  CDS (1)..(1233)

SEQ ID NO: 24104 - protein, 410 aa, Schizosaccharomyces pombe; identical to SEQ ID NO: 14124

SEQ ID NO: 24105 - DNA, 1290 bp, Saccharomyces cerevisiae; identical to SEQ ID NO: 14125
  CDS (1)..(1290)

SEQ ID NO: 24106 - protein, 429 aa, Saccharomyces cerevisiae; identical to SEQ ID NO: 14126

SEQ ID NO: 24107 - DNA, 1200 bp, Pseudomonas aeruginosa; identical to SEQ ID NO: 14127
  CDS (1)..(1200): transl_table=11

SEQ ID NO: 24108 - protein, 399 aa, Pseudomonas aeruginosa; identical to SEQ ID NO: 14128

SEQ ID NO: 24109 - DNA, 1197 bp, Pseudomonas aeruginosa; identical to SEQ ID NO: 14129
  CDS (1)..(1197): transl_table=11

SEQ ID NO: 24110 - protein, 398 aa, Pseudomonas aeruginosa; identical to SEQ ID NO: 14130

SEQ ID NO: 24111 - DNA, 1224 bp, Acinetobacter sp; identical to SEQ ID NO: 14131
  CDS (1)..(1224): transl_table=11

SEQ ID NO: 24112 - protein, 407 aa, Acinetobacter sp; identical to SEQ ID NO: 14132

SEQ ID NO: 24113 - DNA, 1218 bp, Bordetella pertussis; identical to SEQ ID NO: 14133
  CDS (1)..(1218): transl_table=11

SEQ ID NO: 24114 - protein, 405 aa, Bordetella pertussis; identical to SEQ ID NO: 14134

SEQ ID NO: 24115 - DNA, 1305 bp, Brucella melitensis; identical to SEQ ID NO: 14135
  CDS (1)..(1305): transl_table=11

SEQ ID NO: 24116 - protein, 434 aa, Brucella melitensis; identical to SEQ ID NO: 14136

SEQ ID NO: 24117 - DNA, 1305 bp, Brucella suis; identical to SEQ ID NO: 14137
  CDS (1)..(1305)

SEQ ID NO: 24118 - protein, 434 aa, Brucella suis; identical to SEQ ID NO: 14138

SEQ ID NO: 24119 - DNA, 1200 bp, Buchnera aphidicola; identical to SEQ ID NO: 14139
  CDS (1)..(1200): transl_table=11

SEQ ID NO: 24120 - protein, 399 aa, Buchnera aphidicola; identical to SEQ ID NO: 14140

SEQ ID NO: 24121 - DNA, 1197 bp, Buchnera aphidicola; identical to SEQ ID NO: 14141
  CDS (1)..(1197): transl_table=11

SEQ ID NO: 24122 - protein, 398 aa, Buchnera aphidicola; identical to SEQ ID NO: 14142

SEQ ID NO: 24123 - DNA, 1200 bp, Burkholderia mallei; identical to SEQ ID NO: 14143
  CDS (1)..(1200): transl_table=11

SEQ ID NO: 24124 - protein, 399 aa, Burkholderia mallei; identical to SEQ ID NO: 14144

SEQ ID NO: 24125 - DNA, 1209 bp, Chromobacterium violaceum; identical to SEQ ID NO: 14145
  CDS (1)..(1209): transl_table=11

SEQ ID NO: 24126 - protein, 402 aa, Chromobacterium violaceum; identical to SEQ ID NO: 14146

SEQ ID NO: 24127 - DNA, 1206 bp, Erwinia carotovora; identical to SEQ ID NO: 14147
  CDS (1)..(1206): transl_table=11

SEQ ID NO: 24128 - protein, 401 aa, Erwinia carotovora; identical to SEQ ID NO: 14148

SEQ ID NO: 24129 - DNA, 1215 bp, Methanosarcina acetivorans; identical to SEQ ID NO: 14149
  CDS (1)..(1215): transl_table=11

SEQ ID NO: 24130 - protein, 404 aa, Methanosarcina acetivorans; identical to SEQ ID NO: 14150

SEQ ID NO: 24131 - DNA, 1209 bp, Neisseria gonorrhoeae; identical to SEQ ID NO: 14151
  CDS (1)..(1209)

SEQ ID NO: 24132 - protein, 402 aa, Neisseria gonorrhoeae; identical to SEQ ID NO: 14152

SEQ ID NO: 24133 - DNA, 1209 bp, Neisseria meningitidis; identical to SEQ ID NO: 14153
  CDS (1)..(1209)

SEQ ID NO: 24134 - protein, 402 aa, Neisseria meningitidis; identical to SEQ ID NO: 14154

SEQ ID NO: 24135 - DNA, 1209 bp, Neisseria meningitidis; identical to SEQ ID NO: 14155
  CDS (1)..(1209): transl_table=11

SEQ ID NO: 24136 - protein, 402 aa, Neisseria meningitidis; identical to SEQ ID NO: 14156

SEQ ID NO: 24137 - DNA, 1215 bp, Photorhabdus luminescens; identical to SEQ ID NO: 14157
  CDS (1)..(1215): transl_table=11

SEQ ID NO: 24138 - protein, 404 aa, Photorhabdus luminescens; identical to SEQ ID NO: 14158

SEQ ID NO: 24139 - DNA, 1218 bp, Photobacterium profundum; identical to SEQ ID NO: 14159
  CDS (1)..(1218): transl_table=11

SEQ ID NO: 24140 - protein, 405 aa, Photobacterium profundum; identical to SEQ ID NO: 14160

SEQ ID NO: 24141 - DNA, 1170 bp, Ralstonia solanacearum; identical to SEQ ID NO: 14161
  CDS (1)..(1170)

SEQ ID NO: 24142 - protein, 389 aa, Ralstonia solanacearum; identical to SEQ ID NO: 14162

SEQ ID NO: 24143 - DNA, 1305 bp, Rhizobium loti; identical to SEQ ID NO: 14163
  CDS (1)..(1305): transl_table=11

SEQ ID NO: 24144 - protein, 434 aa, Rhizobium loti; identical to SEQ ID NO: 14164

SEQ ID NO: 24145 - DNA, 1305 bp, Rhizobium meliloti; identical to SEQ ID NO: 14165
  CDS (1)..(1305): transl_table=11

SEQ ID NO: 24146 - protein, 434 aa, Rhizobium meliloti; identical to SEQ ID NO: 14166

SEQ ID NO: 24147 - DNA, 1203 bp, Salmonella choleraesuis; identical to SEQ ID NO: 14167
  CDS (1)..(1203)

SEQ ID NO: 24148 - protein, 400 aa, Salmonella choleraesuis; identical to SEQ ID NO: 14168

SEQ ID NO: 24149 - DNA, 1203 bp, Salmonella paratyphi; identical to SEQ ID NO: 14169
  CDS (1)..(1203): transl_table=11

SEQ ID NO: 24150 - protein, 400 aa, Salmonella paratyphi; identical to SEQ ID NO: 14170

SEQ ID NO: 24151 - DNA, 1308 bp, Vibrio cholerae; identical to SEQ ID NO: 14171
  CDS (1)..(1308): transl_table=11

SEQ ID NO: 24152 - protein, 435 aa, Vibrio cholerae; identical to SEQ ID NO: 14172

SEQ ID NO: 24153 - DNA, 1311 bp, Vibrio parahaemolyticus; identical to SEQ ID NO: 14173
  CDS (1)..(1311): transl_table=11

SEQ ID NO: 24154 - protein, 436 aa, Vibrio parahaemolyticus; identical to SEQ ID NO: 14174

SEQ ID NO: 24155 - DNA, 1314 bp, Vibrio vulnificus; identical to SEQ ID NO: 14175
  CDS (1)..(1314): transl_table=11

SEQ ID NO: 24156 - protein, 437 aa, Vibrio vulnificus; identical to SEQ ID NO: 14176

SEQ ID NO: 24157 - DNA, 1314 bp, Vibrio vulnificus; identical to SEQ ID NO: 14177
  CDS (1)..(1314): transl_table=11

SEQ ID NO: 24158 - protein, 437 aa, Vibrio vulnificus; identical to SEQ ID NO: 14178

SEQ ID NO: 24159 - DNA, 1179 bp, Xanthomonas axonopodis; identical to SEQ ID NO: 14179
  CDS (1)..(1179): transl_table=11

SEQ ID NO: 24160 - protein, 392 aa, Xanthomonas axonopodis; identical to SEQ ID NO: 14180

SEQ ID NO: 24161 - DNA, 1197 bp, Xanthomonas campestris; identical to SEQ ID NO: 14181
  CDS (1)..(1197): transl_table=11

SEQ ID NO: 24162 - protein, 398 aa, Xanthomonas campestris; identical to SEQ ID NO: 14182

SEQ ID NO: 24163 - DNA, 1185 bp, Xylella fastidiosa; identical to SEQ ID NO: 14183
  CDS (1)..(1185): transl_table=11

SEQ ID NO: 24164 - protein, 394 aa, Xylella fastidiosa; identical to SEQ ID NO: 14184

SEQ ID NO: 24165 - DNA, 1185 bp, Xylella fastidiosa; identical to SEQ ID NO: 14185
  CDS (1)..(1185): transl_table=11

SEQ ID NO: 24166 - protein, 394 aa, Xylella fastidiosa; identical to SEQ ID NO: 14186

SEQ ID NO: 24167 - DNA, 24 bp, Artificial sequence
  (1)..(24): primer
atgacacaattcgcttctcctgtt

SEQ ID NO: 24168 - DNA, 26 bp, Artificial sequence
  (1)..(26): primer
ttaactggcttttttaatatgcggaa

SEQ ID NO: 24169 - protein, 581 aa, Artificial sequence; identical to SEQ ID NO: 14189
  Variant (3)..(3): xaa in position 3 is any amino acid
  Variant (20)..(22): xaa in position 20 to 22 is any amino acid
  Variant (23)..(24): xaa in position 23 to 24 is any or no amino acid
  Variant (27)..(29): xaa in position 27 to 29 is any amino acid
  Variant (31)..(31): xaa in position 31 is any amino acid
  Variant (33)..(33): xaa in position 33 is any amino acid
  Variant (35)..(36): xaa in position 35 to 36 is any amino acid
  Variant (38)..(42): xaa in position 38 to 42 is any amino acid
  Variant (43)..(53): xaa in position 43 to 53 is any or no amino acid
  Variant (56)..(57): xaa in position 56 to 57 is any amino acid
  Variant (60)..(60): xaa in position 60 is any amino acid
  Variant (62)..(63): xaa in position 62 to 63 is any amino acid
  Variant (68)..(68): xaa in position 68 is any amino acid
  Variant (72)..(72): xaa in position 72 is any amino acid
  Variant (75)..(76): xaa in position 75 to 76 is any amino acid
  Variant (78)..(78): xaa in position 78 is any amino acid
  Variant (80)..(88): xaa in position 80 to 88 is any or no amino acid
  Variant (95)..(96): xaa in position 95 to 96 is any amino acid
  Variant (100)..(103): xaa in position 100 to 103 is any amino acid
  Variant (105)..(105): xaa in position 105 is any amino acid
  Variant (107)..(109): xaa in position 107 to 109 is any amino acid
  Variant (110)..(126): xaa in position 110 to 126 is any or no amino acid
  Variant (128)..(128): xaa in position 128 is any or no amino acid
  Variant (130)..(130): xaa in position 130 is any or no amino acid
  Variant (132)..(132): xaa in position 132 is any or no amino acid
  Variant (134)..(134): xaa in position 134 is any or no amino acid
  Variant (136)..(137): xaa in position 136 to 137 is any amino acid
  Variant (138)..(138): xaa in position 138 is any or no amino acid
  Variant (153)..(154): xaa in position 153 to 154 is any amino acid
  Variant (156)..(156): xaa in position 156 is any amino acid
  Variant (158)..(161): xaa in position 158 to 161 is any amino acid
  Variant (162)..(162): xaa in position 162 is any or no amino acid
  Variant (164)..(172): xaa in position 164 to 172 is any amino acid
  Variant (174)..(176): xaa in position 174 to 176 is any amino acid
  Variant (178)..(183): xaa in position 178 to 183 is any amino acid
  Variant (184)..(198): xaa in position 184 to 198 is any or no amino acid
  Variant (208)..(208): xaa in position 208 is any amino acid
  Variant (210)..(212): xaa in position 210 to 212 is any amino acid
  Variant (214)..(215): xaa in position 214 to 215 is any amino acid
  Variant (218)..(218): xaa in position 218 is any amino acid
  Variant (221)..(222): xaa in position 221 to 222 is any amino acid
  Variant (224)..(224): xaa in position 224 is any amino acid
  Variant (225)..(236): xaa in position 225 to 236 is any or no amino acid
  Variant (238)..(238): xaa in position 238 is any or no amino acid
  Variant (244)..(245): xaa in position 244 to 245 is any amino acid
  Variant (250)..(250): xaa in position 250 is any amino acid
  Variant (252)..(252): xaa in position 252 is any amino acid
  Variant (263)..(263): xaa in position 263 is any amino acid
  Variant (265)..(266): xaa in position 265 to 266 is any amino acid
  Variant (269)..(270): xaa in position 269 to 270 is any amino acid
  Variant (271)..(288): xaa in position 271 to 288 is any or no amino acid
  Variant (290)..(291): xaa in position 290 to 291 is any amino acid
  Variant (294)..(295): xaa in position 294 to 295 is any amino acid
  Variant (298)..(299): xaa in position 298 to 299 is any amino acid
  Variant (302)..(303): xaa in position 302 to 303 is any amino acid
  Variant (305)..(305): xaa in position 305 is any amino acid
  Variant (306)..(316): xaa in position 306 to 316 is any or no amino acid
  Variant (318)..(318): xaa in position 318 is any amino acid
  Variant (326)..(329): xaa in position 326 to 329 is any amino acid
  Variant (334)..(334): xaa in position 334 is any amino acid
  Variant (337)..(337): xaa in position 337 is any amino acid
  Variant (338)..(391): xaa in position 338 to 391 is any or no amino acid
  Variant (394)..(394): xaa in position 394 is any amino acid
  Variant (397)..(397): xaa in position 397 is any amino acid
  Variant (401)..(401): xaa in position 401 is any amino acid
  Variant (407)..(408): xaa in position 407 to 408 is any amino acid
  Variant (416)..(416): xaa in position 416 is any amino acid
  Variant (418)..(418): xaa in position 418 is any amino acid
  Variant (419)..(427): xaa in position 419 to 427 is any or no amino acid
  Variant (430)..(430): xaa in position 430 is any amino acid
  Variant (433)..(442): xaa in position 433 to 442 is any or no amino acid
  Variant (453)..(453): xaa in position 453 is any amino acid
  Variant (455)..(455): xaa in position 455 is any amino acid
  Variant (457)..(457): xaa in position 457 is any amino acid
  Variant (459)..(459): xaa in position 459 is any amino acid
  Variant (461)..(466): xaa in position 461 to 466 is any amino acid
  Variant (468)..(474): xaa in position 468 to 474 is any or no amino acid
  Variant (484)..(484): xaa in position 484 is any amino acid
  Variant (489)..(491): xaa in position 489 to 491 is any amino acid
  Variant (492)..(531): xaa in position 492 to 531 is any or no amino acid
  Variant (541)..(542): xaa in position 541 to 542 is any amino acid
  Variant (545)..(545): xaa in position 545 is any amino acid
  Variant (553)..(553): xaa in position 553 is any amino acid
  Variant (557)..(557): xaa in position 557 is any amino acid
  Variant (559)..(560): xaa in position 559 to 560 is any amino acid
  Variant (561)..(575): xaa in position 561 to 575 is any or no amino acid
  Variant (578)..(579): xaa in position 578 to 579 is any amino acid

SEQ ID NO: 24170 - protein, 10 aa, Artificial sequence
  Variant (2)..(2): xaa in position 2 is any amino acid
  Variant (3)..(3): xaa in position 3 is Asn or Thr
  Variant (5)..(5): xaa in position 5 is any amino acid
  Variant (7)..(7): xaa in position 7 is any amino acid
  Variant (8)..(8): xaa in position 8 is Phe, Ile, Leu or Val
  Variant (9)..(9): xaa in position 9 is any amino acid
LXXDXYXXXM

SEQ ID NO: 24171 - protein, 25 aa, Artificial sequence
  Variant (2)..(4): xaa in position 2 to 4 is any or no amino acid
  Variant (8)..(10): xaa in position 8 to 10 is any amino acid
  Variant (11)..(11): xaa in position 11 is Ala or Gly
  Variant (12)..(14): xaa in position 12 to 14 is any amino acid
  Variant (15)..(15): xaa in position 15 is Ala, Asp, Glu, Gly, Asn, Gln or Ser
  Variant (16)..(19): xaa in position 16 to 19 is any amino acid
  Variant (22)..(22): xaa in position 22 is any amino acid
  Variant (25)..(25): xaa in position 25 is Ala, Glu, Gln or Ser
GXXXTSNXXXXXXXXXXXXGTXAHX

SEQ ID NO: 24172 - DNA, 1758 bp, Escherichia coli K12; identical to SEQ ID NO: 20139
  CDS (1)..(1758): transl_table=11

SEQ ID NO: 24173 - protein, 585 aa, Escherichia coli K12; identical to SEQ ID NO: 20140

SEQ ID NO: 24174 - DNA, 1761 bp, Pseudomonas aeruginosa PAO1; identical to SEQ ID NO: 20141
  CDS (1)..(1761): transl_table=11

SEQ ID NO: 24175 - protein, 586 aa, Pseudomonas aeruginosa PAO1; identical to SEQ ID NO: 20142

SEQ ID NO: 24176 - DNA, 1764 bp, Yersinia pestis CO92; identical to SEQ ID NO: 20143
  CDS (1)..(1764): transl_table=11

SEQ ID NO: 24177 - protein, 587 aa, Yersinia pestis CO92; identical to SEQ ID NO: 20144

SEQ ID NO: 24178 - DNA, 1701 bp, Fusobacterium nucleatum subsp. nucleatum ATCC 25586; identical to SEQ ID NO: 20145
  CDS (1)..(1701): transl_table=11

SEQ ID NO: 24179 - protein, 566 aa, Fusobacterium nucleatum subsp. nucleatum ATCC 25586; identical to SEQ ID NO: 20146

SEQ ID NO: 24180 - DNA, 1761 bp, Xanthomonas axonopodis pv. citri str. 306; identical to SEQ ID NO: 20147
  CDS (1)..(1761): transl_table=11

SEQ ID NO: 24181 - protein, 586 aa, Xanthomonas axonopodis pv. citri str. 306; identical to SEQ ID NO: 20148

SEQ ID NO: 24182 - DNA, 1764 bp, Yersinia pestis KIM; identical to SEQ ID NO: 20149
  CDS (1)..(1764): transl_table=11

SEQ ID NO: 24183 - protein, 587 aa, Yersinia pestis KIM; identical to SEQ ID NO: 20150

SEQ ID NO: 24184 - DNA, 1758 bp, Escherichia coli CFT073; identical to SEQ ID NO: 20151
  CDS (1)..(1758): transl_table=11

SEQ ID NO: 24185 - protein, 585 aa, Escherichia coli CFT073; identical to SEQ ID NO: 20152

SEQ ID NO: 24186 - DNA, 1758 bp, Pseudomonas syringae pv. tomato str. DC3000; identical to SEQ ID NO: 20153
  CDS (1)..(1758): transl_table=11

SEQ ID NO: 24187 - protein, 585 aa, Pseudomonas syringae pv. tomato str. DC3000; identical to SEQ ID NO: 20154

SEQ ID NO: 24188 - DNA, 1764 bp, Yersinia pseudotuberculosis IP 32953; identical to SEQ ID NO: 20155
  CDS (1)..(1764): transl_table=11

SEQ ID NO: 24189 - protein, 587 aa, Yersinia pseudotuberculosis IP 32953; identical to SEQ ID NO: 20156

SEQ ID NO: 24190 - DNA, 1764 bp, Xanthomonas campestris pv. campestris str. 8004; identical to SEQ ID NO: 20157
  CDS (1)..(1764): transl_table=11

SEQ ID NO: 24191 - protein, 587 aa, Xanthomonas campestris pv. campestris str. 8004; identical to SEQ ID NO: 20158

SEQ ID NO: 24192 - DNA, 1758 bp, Pseudomonas fluorescens Pf-5; identical to SEQ ID NO: 20159
  CDS (1)..(1758): transl_table=11

SEQ ID NO: 24193 - protein, 585 aa, Pseudomonas fluorescens Pf-5; identical to SEQ ID NO: 20160

SEQ ID NO: 24194 - DNA, 1776 bp, Ralstonia eutropha JMP134; identical to SEQ ID NO: 20161
  CDS (1)..(1776): transl_table=11

SEQ ID NO: 24195 - protein, 591 aa, Ralstonia eutropha JMP134; identical to SEQ ID NO: 20162

SEQ ID NO: 24196 - DNA, 1713 bp, Fusobacterium nucleatum subsp. vincentii ATCC 49256; identical to SEQ ID NO: 20163
  CDS (1)..(1713): transl_table=11

SEQ ID NO: 24197 - protein, 570 aa, Fusobacterium nucleatum subsp. vincentii ATCC 49256; identical to SEQ ID NO: 20164

SEQ ID NO: 24198 - DNA, 1791 bp, Ralstonia eutropha JMP134; identical to SEQ ID NO: 20165
  CDS (1)..(1791)

SEQ ID NO: 24199 - protein, 596 aa, Ralstonia eutropha JMP134; identical to SEQ ID NO: 20166

SEQ ID NO: 24200 - DNA, 1761 bp, Pseudomonas aeruginosa UCBPP-PA14; identical to SEQ ID NO: 20167
  CDS (1)..(1761)

SEQ ID NO: 24201 - protein, 586 aa, Pseudomonas aeruginosa UCBPP-PA14; identical to SEQ ID NO: 20168

SEQ ID NO: 24202 - DNA, 1758 bp, Burkholderia cepacia R18194; identical to SEQ ID NO: 20169
  CDS (1)..(1758)

SEQ ID NO: 24203 - protein, 585 aa, Burkholderia cepacia R18194; identical to SEQ ID NO: 20170

SEQ ID NO: 24204 - DNA, 1770 bp, Burkholderia vietnamiensis G4; identical to SEQ ID NO: 20171
  CDS (1)..(1770): transl_table=11

SEQ ID NO: 24205 - protein, 589 aa, Burkholderia vietnamiensis G4; identical to SEQ ID NO: 20172

SEQ ID NO: 24206 - DNA, 1770 bp, Burkholderia cenocepacia AU 1054; identical to SEQ ID NO: 20173
  CDS (1)..(1770): transl_table=11

SEQ ID NO: 24207 - protein, 589 aa, Burkholderia cenocepacia AU 1054; identical to SEQ ID NO: 20174

SEQ ID NO: 24208 - DNA, 1800 bp, Burkholderia ambifaria AMMD; identical to SEQ ID NO: 20175
  CDS (1)..(1800): transl_table=11

SEQ ID NO: 24209 - protein, 599 aa, Burkholderia ambifaria AMMD; identical to SEQ ID NO: 20176

SEQ ID NO: 24210 - DNA, 23 bp, Artificial sequence
  (1)..(23): primer
atggaaaattcacgcatccctgg

SEQ ID NO: 24211 - DNA, 24 bp, Artificial sequence
  (1)..(24): primer
ttagttatcacgacgcaccgccat

SEQ ID NO: 24212 - protein, 589 aa, Artificial sequence; identical to SEQ ID NO: 20179
  Variant (2)..(4): xaa in position 2 to 4 is any amino acid
  Variant (6)..(7): xaa in position 6 to 7 is any amino acid
  Variant (9)..(11): xaa in position 9 to 11 is any amino acid
  Variant (13)..(15): xaa in position 13 to 15 is any amino acid
  Variant (22)..(29): xaa in position 22 to 29 is any amino acid
  Variant (30)..(35): xaa in position 30 to 35 is any or no amino acid
  Variant (39)..(39): xaa in position 39 is any amino acid
  Variant (50)..(50): xaa in position 50 is any amino acid
  Variant (53)..(53): xaa in position 53 is any amino acid
  Variant (57)..(57): xaa in position 57 is any amino acid
  Variant (60)..(62): xaa in position 60 to 62 is any amino acid
  Variant (73)..(73): xaa in position 73 is any amino acid
  Variant (75)..(75): xaa in position 75 is any amino acid
  Variant (77)..(77): xaa in position 77 is any amino acid
  Variant (80)..(80): xaa in position 80 is any or no amino acid
  Variant (83)..(87): xaa in position 83 to 87 is any amino acid
  Variant (89)..(89): xaa in position 89 is any amino acid
  Variant (92)..(93): xaa in position 92 to 93 is any amino acid
  Variant (96)..(97): xaa in position 96 to 97 is any amino acid
  Variant (99)..(103): xaa in position 99 to 103 is any amino acid
  Variant (105)..(106): xaa in position 105 to 106 is any amino acid
  Variant (108)..(108): xaa in position 108 is any amino acid
  Variant (110)..(110): xaa in position 110 is any amino acid
  Variant (121)..(121): xaa in position 121 is any amino acid
  Variant (125)..(125): xaa in position 125 is any amino acid
  Variant (131)..(131): xaa in position 131 is any amino acid
  Variant (134)..(134): xaa in position 134 is any amino acid
  Variant (143)..(143): xaa in position 143 is any amino acid
  Variant (153)..(153): xaa in position 153 is any amino acid
  Variant (156)..(156): xaa in position 156 is any amino acid
  Variant (159)..(161): xaa in position 159 to 161 is any amino acid
  Variant (164)..(164): xaa in position 164 is any amino acid
  Variant (173)..(173): xaa in position 173 is any amino acid
  Variant (180)..(181): xaa in position 180 to 181 is any amino acid
  Variant (184)..(184): xaa in position 184 is any amino acid
  Variant (187)..(188): xaa in position 187 to 188 is any amino acid
  Variant (190)..(190): xaa in position 190 is any amino acid
  Variant (193)..(193): xaa in position 193 is any amino acid
  Variant (195)..(195): xaa in position 195 is any amino acid
  Variant (199)..(199): xaa in position 199 is any amino acid
  Variant (203)..(203): xaa in position 203 is any amino acid
  Variant (206)..(207): xaa in position 206 to 207 is any amino acid
  Variant (209)..(209): xaa in position 209 is any amino acid
  Variant (213)..(213): xaa in position 213 is any amino acid
  Variant (216)..(216): xaa in position 216 is any amino acid
  Variant (219)..(219): xaa in position 219 is any amino acid
  Variant (229)..(229): xaa in position 229 is any amino acid
  Variant (235)..(236): xaa in position 235 to 236 is any amino acid
  Variant (239)..(240): xaa in position 239 to 240 is any amino acid
  Variant (243)..(244): xaa in position 243 to 244 is any amino acid
  Variant (246)..(246): xaa in position 246 is any amino acid
  Variant (248)..(249): xaa in position 248 to 249 is any amino acid
  Variant (252)..(254): xaa in position 252 to 254 is any amino acid
  Variant (256)..(256): xaa in position 256 is any amino acid
  Variant (269)..(270): xaa in position 269 to 270 is any amino acid
  Variant (272)..(277): xaa in position 272 to 277 is any amino acid
  Variant (280)..(282): xaa in position 280 to 282 is any amino acid
  Variant (284)..(295): xaa in position 284 to 295 is any amino acid
  Variant (298)..(307): xaa in position 298 to 307 is any amino acid
  Variant (309)..(310): xaa in position 309 to 310 is any amino acid
  Variant (312)..(317): xaa in position 312 to 317 is any amino acid
  Variant (318)..(321): xaa in position 318 to 321 is any or no amino acid
  Variant (323)..(328): xaa in position 323 to 328 is any amino acid
  Variant (331)..(335): xaa in position 331 to 335 is any amino acid
  Variant (337)..(337): xaa in position 337 is any amino acid
  Variant (340)..(340): xaa in position 340 is any amino acid
  Variant (343)..(345): xaa in position 343 to 345 is any amino acid
  Variant (360)..(362): xaa in position 360 to 362 is any amino acid
  Variant (364)..(366): xaa in position 364 to 366 is any amino acid
  Variant (369)..(370): xaa in position 369 to 370 is any amino acid
  Variant (373)..(374): xaa in position 373 to 374 is any amino acid
  Variant (377)..(377): xaa in position 377 is any amino acid
  Variant (379)..(379): xaa in position 379 is any amino acid
  Variant (382)..(382): xaa in position 382 is any amino acid
  Variant (386)..(386): xaa in position 386 is any amino acid
  Variant (389)..(390): xaa in position 389 to 390 is any amino acid
  Variant (392)..(393): xaa in position 392 to 393 is any amino acid
  Variant (396)..(397): xaa in position 396 to 397 is any amino acid
  Variant (400)..(401): xaa in position 400 to 401 is any amino acid
  Variant (403)..(406): xaa in position 403 to 406 is any amino acid
  Variant (407)..(408): xaa in position 407 to 408 is any or no amino acid
  Variant (427)..(433): xaa in position 427 to 433 is any amino acid
  Variant (434)..(440): xaa in position 434 to 440 is any or no amino acid
  Variant (448)..(449): xaa in position 448 to 449 is any amino acid
  Variant (452)..(453): xaa in position 452 to 453 is any amino acid
  Variant (455)..(456): xaa in position 455 to 456 is any amino acid
  Variant (459)..(461): xaa in position 459 to 461 is any amino acid
  Variant (463)..(465): xaa in position 463 to 465 is any amino acid
  Variant (468)..(468): xaa in position 468 is any or no amino acid
  Variant (470)..(471): xaa in position 470 to 471 is any amino acid
  Variant (473)..(473): xaa in position 473 is any amino acid
  Variant (477)..(479): xaa in position 477 to 479 is any amino acid
  Variant (482)..(482): xaa in position 482 is any amino acid
  Variant (484)..(484): xaa in position 484 is any amino acid
  Variant (486)..(486): xaa in position 486 is any amino acid
  Variant (500)..(500): xaa in position 500 is any amino acid
  Variant (503)..(504): xaa in position 503 to 504 is any amino acid
  Variant (506)..(507): xaa in position 506 to 507 is any amino acid
  Variant (510)..(510): xaa in position 510 is any amino acid
  Variant (514)..(514): xaa in position 514 is any amino acid
  Variant (517)..(518): xaa in position 517 to 518 is any amino acid
  Variant (521)..(521): xaa in position 521 is any amino acid
  Variant (534)..(535): xaa in position 534 to 535 is any amino acid
  Variant (538)..(539): xaa in position 538 to 539 is any amino acid
  Variant (541)..(542): xaa in position 541 to 542 is any amino acid
  Variant (545)..(548): xaa in position 545 to 548 is any amino acid
  Variant (549)..(549): xaa in position 549 is any or no amino acid
  Variant (554)..(554): xaa in position 554 is any amino acid
  Variant (558)..(558): xaa in position 558 is any amino acid
  Variant (562)..(562): xaa in position 562 is any amino acid
  Variant (565)..(566): xaa in position 565 to 566 is any amino acid
  Variant (570)..(570): xaa in position 570 is any amino acid
  Variant (572)..(573): xaa in position 572 to 573 is any amino acid
  Variant (575)..(575): xaa in position 575 is any amino acid
  Variant (578)..(579): xaa in position 578 to 579 is any amino acid
  Variant (588)..(588): xaa in position 588 is any amino acid

SEQ ID NO: 24213 - protein, 9 aa, Artificial sequence
  Variant (8)..(8): xaa in position 8 is Ala or Gly
HRGHEHSXR

SEQ ID NO: 24214 - protein, 96 aa, Artificial sequence; identical to SEQ ID NO: 20181
  Variant (5)..(5): xaa in position 5 is any amino acid
  Variant (6)..(6): xaa in position 6 is Ile, Leu or Val
  Variant (8)..(8): xaa in position 8 is Ala, Cys, Gly or Ser
  Variant (9)..(9): xaa in position 9 is Leu or Met
  Variant (11)..(11): xaa in position 11 is Leu or Val
  Variant (17)..(17): xaa in position 17 is any amino acid
  Variant (18)..(18): xaa in position 18 is Ile or Val
  Variant (24)..(24): xaa in position 24 is Phe or Leu
  Variant (27)..(27): xaa in position 27 is any amino acid
  Variant (30)..(30): xaa in position 30 is any amino acid
  Variant (32)..(35): xaa in position 32 to 35 is any amino acid
  Variant (36)..(36): xaa in position 36 is Lys or Arg
  Variant (38)..(38): xaa in position 38 is any amino acid
  Variant (40)..(40): xaa in position 40 is Phe or Tyr
  Variant (41)..(41): xaa in position 41 is Ile or Val
  Variant (42)..(42): xaa in position 42 is Asn or Thr
  Variant (47)..(47): xaa in position 47 is Ala, Gly or Pro
  Variant (48)..(48): xaa in position 48 is any amino acid
  Variant (49)..(49): xaa in position 49 is Phe, Trp or Tyr
  Variant (51)..(51): xaa in position 51 is Ser or Thr
  Variant (54)..(54): xaa in position 54 is any amino acid
  Variant (55)..(55): xaa in position 55 is Ala, Glu or Gln
  Variant (57)..(57): xaa in position 57 is Ile or Val
  Variant (58)..(58): xaa in position 58 is any amino acid
  Variant (60)..(60): xaa in position 60 is Phe or Tyr
  Variant (61)..(61): xaa in position 61 is any amino acid
  Variant (62)..(62): xaa in position 62 is Ala, Asn, Gln, Ser or Thr
  Variant (64)..(64): xaa in position 64 is any amino acid
  Variant (66)..(66): xaa in position 66 is Ile or Val
  Variant (67)..(67): xaa in position 67 is Ala or Thr
  Variant (68)..(68): xaa in position 68 is Lys or Arg
  Variant (69)..(69): xaa in position 69 is any amino acid
  Variant (71)..(71): xaa in position 71 is Ala or Ser
  Variant (73)..(73): xaa in position 73 is Asn or Arg
  Variant (74)..(74): xaa in position 74 is Ile, Met or Val
  Variant (77)..(77): xaa in position 77 is Asp or Gly
  Variant (79)..(79): xaa in position 79 is His or Tyr
  Variant (80)..(80): xaa in position 80 is any amino acid
  Variant (81)..(81): xaa in position 81 is Ala or Thr
  Variant (82)..(82): xaa in position 82 is Ala, Gly or Ser
  Variant (83)..(83): xaa in position 83 is any amino acid
  Variant (85)..(85): xaa in position 85 is Ile or Val
  Variant (87)..(87): xaa in position 87 is Ala, Asp or Ser
  Variant (89)..(89): xaa in position 89 is Ala or Ser
  Variant (90)..(90): xaa in position 90 is Ala, Gln or Thr
  Variant (93)..(93): xaa in position 93 is Gln or Thr
  Variant (94)..(94): xaa in position 94 is Ile, Leu or Val

SEQ ID NO: 24215 - protein, 53 aa, Artificial sequence; identical to SEQ ID NO: 20182
  Variant (2)..(2): xaa in position 2 is any amino acid
  Variant (4)..(4): xaa in position 4 is any amino acid
  Variant (5)..(5): xaa in position 5 is any or no amino acid
  Variant (7)..(7): xaa in position 7 is any or no amino acid
  Variant (9)..(9): xaa in position 9 is any amino acid
  Variant (10)..(10): xaa in position 10 is Asp, Glu, Gln, Arg or Ser
  Variant (11)..(11): xaa in position 11 is any amino acid
  Variant (18)..(18): xaa in position 18 is Ser or Thr
  Variant (22)..(22): xaa in position 22 is Ile or Val
  Variant (24)..(24): xaa in position 24 is Gln or Arg
  Variant (26)..(26): xaa in position 26 is any amino acid
  Variant (27)..(27): xaa in position 27 is Ala or Pro
  Variant (28)..(28): xaa in position 28 is any amino acid
  Variant (30)..(31): xaa in position 30 to 31 is any amino acid
  Variant (32)..(32): xaa in position 32 is Ala, Gly, Ile or Pro
  Variant (33)..(33): xaa in position 33 is Phe, Ile, Leu or Val
  Variant (35)..(36): xaa in position 35 to 36 is any amino acid
  Variant (37)..(37): xaa in position 37 is Ile or Val
  Variant (39)..(39): xaa in position 39 is His, Lys or Arg
  Variant (40)..(40): xaa in position 40 is any amino acid
  Variant (43)..(43): xaa in position 43 is Asp, Asn or Gln
  Variant (44)..(44): xaa in position 44 is Ala or Ser
  Variant (45)..(45): xaa in position 45 is Ile, Pro or Val
  Variant (48)..(48): xaa in position 48 is any amino acid
  Variant (52)..(52): xaa in position 52 is any amino acid

SEQ ID NO: 24216 - protein, 93 aa, Artificial sequence; identical to SEQ ID NO: 20183
  Variant (7)..(7): xaa in position 7 is Ala, Gly, Pro or Ser
  Variant (8)..(8): xaa in position 8 is Asp, Glu or Ser
  Variant (10)..(11): xaa in position 10 to 11 is any amino acid
  Variant (12)..(12): xaa in position 12 is Ile or Val
  Variant (13)..(14): xaa in position 13 to 14 is any amino acid
  Variant (17)..(17): xaa in position 17 is any amino acid
  Variant (20)..(20): xaa in position 20 is Ala or Gly
  Variant (21)..(21): xaa in position 21 is Ala, Glu, Asn, Gln or Ser
  Variant (23)..(23): xaa in position 23 is Ile, Leu or Val
  Variant (24)..(24): xaa in position 24 is any amino acid
  Variant (25)..(25): xaa in position 25 is Glu or Pro
  Variant (27)..(27): xaa in position 27 is Ala or Gly
  Variant (28)..(28): xaa in position 28 is any amino acid
  Variant (30)..(30): xaa in position 30 is Ile, Leu or Val
  Variant (41)..(41): xaa in position 41 is Glu or Lys
  Variant (42)..(42): xaa in position 42 is any amino acid
  Variant (45)..(45): xaa in position 45 is any amino acid
  Variant (46)..(46): xaa in position 46 is Ala, Thr or Val
  Variant (48)..(48): xaa in position 48 is Asn or Thr
  Variant (49)..(49): xaa in position 49 is Asn or Ser
  Variant (51)..(51): xaa in position 51 is any amino acid
  Variant (52)..(52): xaa in position 52 is Ala, Asp, Glu, Gly, Asn or Gln
  Variant (53)..(53): xaa in position 53 is Asp, Glu or Gly
  Variant (54)..(54): xaa in position 54 is any amino acid
  Variant (55)..(55): xaa in position 55 is Ala, Pro or Thr
  Variant (57)..(57): xaa in position 57 is Met or Val
  Variant (60)..(60): xaa in position 60 is any amino acid
  Variant (62)..(62): xaa in position 62 is Ser or Thr
  Variant (64)..(64): xaa in position 64 is any amino acid
  Variant (68)..(68): xaa in position 68 is Glu, Gly, Gln, Ser or Thr
  Variant (71)..(72): xaa in position 71 to 72 is any amino acid
  Variant (76)..(76): xaa in position 76 is Asp, Glu or Arg
  Variant (78)..(81): xaa in position 78 to 81 is any amino acid
  Variant (82)..(82): xaa in position 82 is Ile or Val
  Variant (84)..(85): xaa in position 84 to 85 is any amino acid
  Variant (89)..(89): xaa in position 89 is Ser or Thr
  Variant (92)..(92): xaa in position 92 is Leu or Met

SEQ ID NO: 24217 - DNA, 291 bp, Escherichia coli K12; identical to SEQ ID NO: 18608
  CDS (1)..(291): transl_table=11

SEQ ID NO: 24218 - protein, 96 aa, Escherichia coli K12; identical to SEQ ID NO: 18609

SEQ ID NO: 24219 - DNA, 216 bp, Bacteriophage 933W; identical to SEQ ID NO: 18610
  CDS (1)..(216): transl_table=11

SEQ ID NO: 24220 - protein, 71 aa, Bacteriophage 933W; identical to SEQ ID NO: 18611

SEQ ID NO: 24221 - DNA, 291 bp, Bacteriophage VT2-Sa; identical to SEQ ID NO: 18612
  CDS (1)..(291): transl_table=11

SEQ ID NO: 24222 - protein, 96 aa, Bacteriophage VT2-Sa; identical to SEQ ID NO: 18613

SEQ ID NO: 24223 - DNA, 315 bp, Escherichia coli O157:H7 EDL933; identical to SEQ ID NO: 18614
  CDS (1)..(315): transl_table=11

SEQ ID NO: 24224 - protein, 104 aa, Escherichia coli O157:H7 EDL933; identical to SEQ ID NO: 18615

SEQ ID NO: 24225 - DNA, 315 bp, Escherichia coli O157:H7 EDL933; identical to SEQ ID NO: 18616
  CDS (1)..(315): transl_table=11

SEQ ID NO: 24226 - protein, 104 aa, Escherichia coli O157:H7 EDL933; identical to SEQ ID NO: 18617

SEQ ID NO: 24227 - DNA, 273 bp, Escherichia coli O157:H7 EDL933; identical to SEQ ID NO: 18618
  CDS (1)..(273): transl_table=11

SEQ ID NO: 24228 - protein, 90 aa, Escherichia coli O157:H7 EDL933; identical to SEQ ID NO: 18619

SEQ ID NO: 24229 - DNA, 216 bp, Escherichia coli O157:H7; identical to SEQ ID NO: 18620
  CDS (1)..(216): transl_table=11

SEQ ID NO: 24230 - protein, 71 aa, Escherichia coli O157:H7; identical to SEQ ID NO: 18621

SEQ ID NO: 24231 - DNA, 207 bp, Escherichia coli O157:H7; identical to SEQ ID NO: 18622
  CDS (1)..(207): transl_table=11

SEQ ID NO: 24232 - protein, 68 aa, Escherichia coli O157:H7; identical to SEQ ID NO: 18623

SEQ ID NO: 24233 - DNA, 216 bp, Escherichia coli O157:H7; identical to SEQ ID NO: 18624
  CDS (1)..(216): transl_table=11

SEQ ID NO: 24234 - protein, 71 aa, Escherichia coli O157:H7; identical to SEQ ID NO: 18625

SEQ ID NO: 24235 - DNA, 216 bp, Escherichia coli O157:H7; identical to SEQ ID NO: 18626
  CDS (1)..(216): transl_table=11

SEQ ID NO: 24236 - protein, 71 aa, Escherichia coli O157:H7; identical to SEQ ID NO: 18627

SEQ ID NO: 24237 - DNA, 216 bp, Escherichia coli O157:H7; identical to SEQ ID NO: 18628
  CDS (1)..(216): transl_table=11

SEQ ID NO: 24238 - protein, 71 aa, Escherichia coli O157:H7; identical to SEQ ID NO: 18629

SEQ ID NO: 24239 - DNA, 207 bp, Escherichia coli O157:H7; identical to SEQ ID NO: 18630
  CDS (1)..(207): transl_table=11

SEQ ID NO: 24240 - protein, 68 aa, Escherichia coli O157:H7; identical to SEQ ID NO: 18631

SEQ ID NO: 24241 - DNA, 207 bp, Escherichia coli O157:H7; identical to SEQ ID NO: 18632
  CDS (1)..(207): transl_table=11

SEQ ID NO: 24242 - protein, 68 aa, Escherichia coli O157:H7; identical to SEQ ID NO: 18633

SEQ ID NO: 24243 - DNA, 216 bp, Shigella flexneri 2a str. 301; identical to SEQ ID NO: 18634
  CDS (1)..(216): transl_table=11

SEQ ID NO: 24244 - protein, 71 aa, Shigella flexneri 2a str. 301; identical to SEQ ID NO: 18635

SEQ ID NO: 24245 - DNA, 216 bp, Shigella flexneri 2a str. 301; identical to SEQ ID NO: 18636
  CDS (1)..(216): transl_table=11

SEQ ID NO: 24246 - protein, 71 aa, Shigella flexneri 2a str. 301; identical to SEQ ID NO: 18637

SEQ ID NO: 24247 - DNA, 321 bp, Escherichia coli CFT073; identical to SEQ ID NO: 18638
  CDS (1)..(321): transl_table=11

SEQ ID NO: 24248 - protein, 106 aa, Escherichia coli CFT073; identical to SEQ ID NO: 18639

SEQ ID NO: 24249 - DNA, 216 bp, Escherichia coli CFT073; identical to SEQ ID NO: 18640
  CDS (1)..(216): transl_table=11

SEQ ID NO: 24250 - protein, 71 aa, Escherichia coli CFT073; identical to SEQ ID NO: 18641

SEQ ID NO: 24251 - DNA, 216 bp, Shigella flexneri 2a str. 2457T; identical to SEQ ID NO: 18642
  CDS (1)..(216): transl_table=11

SEQ ID NO: 24252 - protein, 71 aa, Shigella flexneri 2a str. 2457T; identical to SEQ ID NO: 18643

SEQ ID NO: 24253 - DNA, 180 bp, Shigella flexneri 2a str. 2457T; identical to SEQ ID NO: 18644
  CDS (1)..(180): transl_table=11

SEQ ID NO: 24254 - protein, 59 aa, Shigella flexneri 2a str. 2457T; identical to SEQ ID NO: 18645

SEQ ID NO: 24255 - DNA, 213 bp, Yersinia pseudotuberculosis IP 32953; identical to SEQ ID NO: 18646
  CDS (1)..(213): transl_table=11

SEQ ID NO: 24256 - protein, 70 aa, Yersinia pseudotuberculosis IP 32953; identical to SEQ ID NO: 18647

SEQ ID NO: 24257 - DNA, 216 bp, Shigella sonnei Ss046; identical to SEQ ID NO: 18648
  CDS (1)..(216): transl_table=11

SEQ ID NO: 24258 - protein, 71 aa, Shigella sonnei Ss046; identical to SEQ ID NO: 18649

SEQ ID NO: 24259 - DNA, 216 bp, Shigella sonnei Ss046; identical to SEQ ID NO: 18650
  CDS (1)..(216): transl_table=11

SEQ ID NO: 24260 - protein, 71 aa, Shigella sonnei Ss046; identical to SEQ ID NO: 18651

SEQ ID NO: 24261 - DNA, 207 bp, Bacteriophage H19B; identical to SEQ ID NO: 18652
  CDS (1)..(207): transl_table=11

SEQ ID NO: 24262 - protein, 68 aa, Bacteriophage H19B; identical to SEQ ID NO: 18653

SEQ ID NO: 24263 - DNA, 291 bp, Stx1; identical to SEQ ID NO: 18654
  CDS (1)..(291): transl_table=11

SEQ ID NO: 24264 - protein, 96 aa, Stx1; identical to SEQ ID NO: 18655

SEQ ID NO: 24265 - DNA, 150 bp, Escherichia coli; identical to SEQ ID NO: 18656
  CDS (1)..(150): transl_table=11

SEQ ID NO: 24266 - protein, 49 aa, Escherichia coli; identical to SEQ ID NO: 18657

SEQ ID NO: 24267 - DNA, 216 bp, Escherichia coli; identical to SEQ ID NO: 18658
  CDS (1)..(216): transl_table=11

SEQ ID NO: 24268 - protein, 71 aa, Escherichia coli; identical to SEQ ID NO: 18659

SEQ ID NO: 24269 - DNA, 216 bp, Shigella dysenteriae; identical to SEQ ID NO: 18660
  CDS (1)..(216): transl_table=11

SEQ ID NO: 24270 - protein, 71 aa, Shigella dysenteriae; identical to SEQ ID NO: 18661

SEQ ID NO: 24271 - DNA, 216 bp, Escherichia coli O6; identical to SEQ ID NO: 18662
  CDS (1)..(216): transl_table=11

SEQ ID NO: 24272 - protein, 71 aa, Escherichia coli O6; identical to SEQ ID NO: 18663

SEQ ID NO: 24273 - DNA, 216 bp, Bacteriophage P21; identical to SEQ ID NO: 18664
  CDS (1)..(216): transl_table=11

SEQ ID NO: 24274 - protein, 71 aa, Bacteriophage P21; identical to SEQ ID NO: 18665

SEQ ID NO: 24275 - DNA, 24 bp, Artificial sequence
  (1)..(24): primer
atgctgtcaaaactaccccgtaga

SEQ ID NO: 24276 - DNA, 23 bp, Artificial sequence
  (1)..(23): primer
ttactctcctctcgcagccttac

SEQ ID NO: 24277 - protein, 71 aa, Artificial sequence; identical to SEQ ID NO: 18668
  Variant (2)..(3): xaa in position 2 to 3 is any amino acid
  Variant (14)..(14): xaa in position 14 is any amino acid
  Variant (18)..(20): xaa in position 18 to 20 is any amino acid
  Variant (24)..(24): xaa in position 24 is any amino acid
  Variant (27)..(27): xaa in position 27 is any amino acid
  Variant (30)..(30): xaa in position 30 is any amino acid
  Variant (37)..(37): xaa in position 37 is any amino acid
  Variant (47)..(47): xaa in position 47 is any amino acid
  Variant (49)..(49): xaa in position 49 is any amino acid
  Variant (67)..(67): xaa in position 67 is any amino acid

SEQ ID NO: 24278 - protein, 10 aa, Artificial sequence
  Variant (2)..(2): xaa in position 2 is Asp or Glu
  Variant (5)..(5): xaa in position 5 is Ser or Thr
  Variant (7)..(7): xaa in position 7 is Gly or Ser
  Variant (8)..(8): xaa in position 8 is Ile or Val
  Variant (9)..(9): xaa in position 9 is Ala or Ser
MXKIXTXXXY

SEQ ID NO: 24279 - protein, 6 aa, Artificial sequence
  Variant (2)..(2): xaa in position 2 is Phe or Leu
  Variant (5)..(5): xaa in position 5 is any amino acid
WXLQXL

SEQ ID NO: 24280 - protein, 14 aa, Artificial sequence
  Variant (5)..(5): xaa in position 5 is any or no amino acid
  Variant (7)..(7): xaa in position 7 is any or no amino acid
PSQWXAXIGVLGSL

SEQ ID NO: 24281 - DNA, 1047 bp, Escherichia coli K12; identical to SEQ ID NO: 1323
  CDS (1)..(1047)

SEQ ID NO: 24282 - protein, 348 aa, Escherichia coli K12; identical to SEQ ID NO: 1324

SEQ ID NO: 24283 - DNA, 1235 bp, Salmonella typhimurium; identical to SEQ ID NO: 1325
  CDS (165)..(1235)

SEQ ID NO: 24284 - protein, 356 aa, Salmonella typhimurium; identical to SEQ ID NO: 1326

SEQ ID NO: 24285 - DNA, 1086 bp, Deinococcus radiodurans; identical to SEQ ID NO: 1327
  CDS (1)..(1086)

SEQ ID NO: 24286 - protein, 361 aa, Deinococcus radiodurans; identical to SEQ ID NO: 1328

SEQ ID NO: 24287 - DNA, 1056 bp, Neisseria meningitidis; identical to SEQ ID NO: 1329
  CDS (1)..(1056)

SEQ ID NO: 24288 - protein, 351 aa, Neisseria meningitidis; identical to SEQ ID NO: 1330

SEQ ID NO: 24289 - DNA, 1047 bp, Yersinia pestis; identical to SEQ ID NO: 1331
  CDS (1)..(1047)

SEQ ID NO: 24290 - protein, 348 aa, Yersinia pestis; identical to SEQ ID NO: 1332

SEQ ID NO: 24291 - DNA, 1071 bp, Escherichia coli; identical to SEQ ID NO: 1333
  CDS (1)..(1071)

SEQ ID NO: 24292 - protein, 356 aa, Escherichia coli; identical to SEQ ID NO: 1334

SEQ ID NO: 24293 - DNA, 1131 bp, Nostoc sp. PCC 7120; identical to SEQ ID NO: 1335
  CDS (1)..(1131)

SEQ ID NO: 24294 - protein, 376 aa, Nostoc sp. PCC 7120; identical to SEQ ID NO: 1336

SEQ ID NO: 24295 - DNA, 1053 bp, Salmonella enterica subsp. enterica serovar Typhi; identical to SEQ ID NO: 1337
  CDS (1)..(1053)

SEQ ID NO: 24296 - protein, 350 aa, Salmonella enterica subsp. enterica serovar Typhi; identical to SEQ ID NO: 1338

SEQ ID NO: 24297 - DNA, 1077 bp, Pseudomonas aeruginosa; identical to SEQ ID NO: 1339
  CDS (1)..(1077)

SEQ ID NO: 24298 - protein, 358 aa, Pseudomonas aeruginosa; identical to SEQ ID NO: 1340

SEQ ID NO: 24299 - DNA, 1047 bp, Buchnera sp; identical to SEQ ID NO: 1341
  CDS (1)..(1047)

SEQ ID NO: 24300 - protein, 348 aa, Buchnera sp; identical to SEQ ID NO: 1342

SEQ ID NO: 24301 - DNA, 1074 bp, Vibrio cholerae; identical to SEQ ID NO: 1343
  CDS (1)..(1074)

SEQ ID NO: 24302 - protein, 357 aa, Vibrio cholerae; identical to SEQ ID NO: 1344

SEQ ID NO: 24303 - DNA, 1038 bp, Lactococcus lactis subsp. lactis; identical to SEQ ID NO: 1345
  CDS (1)..(1038)

SEQ ID NO: 24304 - protein, 345 aa, Lactococcus lactis subsp. lactis; identical to SEQ ID NO: 1346

SEQ ID NO: 24305 - DNA, 1023 bp, Lactococcus lactis subsp. lactis; identical to SEQ ID NO: 1347
  CDS (1)..(1023)

SEQ ID NO: 24306 - protein, 340 aa, Lactococcus lactis subsp. lactis; identical to SEQ ID NO: 1348

SEQ ID NO: 24307 - DNA, 1032 bp, Streptococcus pneumoniae; identical to SEQ ID NO: 1349
  CDS (1)..(1032)

SEQ ID NO: 24308 - protein, 343 aa, Streptococcus pneumoniae; identical to SEQ ID NO: 1350

SEQ ID NO: 24309 - DNA, 1095 bp, Pseudomonas aeruginosa; identical to SEQ ID NO: 1351
  CDS (1)..(1095)

SEQ ID NO: 24310 - protein, 364 aa, Pseudomonas aeruginosa; identical to SEQ ID NO: 1352

SEQ ID NO: 24311 - DNA, 1110 bp, Caulobacter crescentus; identical to SEQ ID NO: 1353
  CDS (1)..(1110)

SEQ ID NO: 24312 - protein, 369 aa, Caulobacter crescentus; identical to SEQ ID NO: 1354

SEQ ID NO: 24313 - DNA, 1032 bp, Streptococcus pneumoniae; identical to SEQ ID NO: 1355
  CDS (1)..(1032)

SEQ ID NO: 24314 - protein, 343 aa, Streptococcus pneumoniae; identical to SEQ ID NO: 1356

SEQ ID NO: 24315 - DNA, 1047 bp, Buchnera aphidicola; identical to SEQ ID NO: 1357
  CDS (1)..(1047)

SEQ ID NO: 24316 - protein, 348 aa, Buchnera aphidicola; identical to SEQ ID NO: 1358

SEQ ID NO: 24317 - DNA, 1089 bp, Haemophilus influenzae; identical to SEQ ID NO: 1359
  CDS (1)..(1089)

SEQ ID NO: 24318 - protein, 362 aa, Haemophilus influenzae; identical to SEQ ID NO: 1360

SEQ ID NO: 24319 - DNA, 1502 bp, Candida albicans; identical to SEQ ID NO: 1361
  CDS (336)..(1442)

SEQ ID NO: 24320 - protein, 368 aa, Candida albicans; identical to SEQ ID NO: 1362

SEQ ID NO: 24321 - DNA, 1113 bp, Saccharomyces cerevisiae; identical to SEQ ID NO: 1363
  CDS (1)..(1113)

SEQ ID NO: 24322 - protein, 370 aa, Saccharomyces cerevisiae; identical to SEQ ID NO: 1364

SEQ ID NO: 24323 - DNA, 2048 bp, Saccharomyces cerevisiae; identical to SEQ ID NO: 1365
  CDS (619)..(1731)

SEQ ID NO: 24324 - protein, 370 aa, Saccharomyces cerevisiae; identical to SEQ ID NO: 1366

SEQ ID NO: 24325 - DNA, 1107 bp, Schizosaccharomyces pombe; identical to SEQ ID NO: 1367
  CDS (1)..(1107)

SEQ ID NO: 24326 - protein, 368 aa, Schizosaccharomyces pombe; identical to SEQ ID NO: 1368

SEQ ID NO: 24327 - DNA, 1089 bp, Amycolatopsis orientalis; identical to SEQ ID NO: 1369
  CDS (1)..(1089)

SEQ ID NO: 24328 - protein, 362 aa, Amycolatopsis orientalis; identical to SEQ ID NO: 1370

SEQ ID NO: 24329 - DNA, 1119 bp, Schizosaccharomyces pombe; identical to SEQ ID NO: 1371
  CDS (1)..(1119)

SEQ ID NO: 24330 - protein, 372 aa, Schizosaccharomyces pombe; identical to SEQ ID NO: 1372

SEQ ID NO: 24331 - DNA, 1248 bp, Corynebacterium glutamicum; identical to SEQ ID NO: 1373
  CDS (101)..(1228)

SEQ ID NO: 24332 - protein, 375 aa, Corynebacterium glutamicum; identical to SEQ ID NO: 1374

SEQ ID NO: 24333 - DNA, 1083 bp, Methylophilus methylotrophus; identical to SEQ ID NO: 1375
  CDS (1)..(1083)

SEQ ID NO: 24334 - protein, 360 aa, Methylophilus methylotrophus; identical to SEQ ID NO: 1376

SEQ ID NO: 24335 - DNA, 1107 bp, Debaryomyces hansenii; identical to SEQ ID NO: 1377
  CDS (1)..(1107)

SEQ ID NO: 24336 - protein, 368 aa, Debaryomyces hansenii; identical to SEQ ID NO: 1378

SEQ ID NO: 24337 - DNA, 1074 bp, Yarrowia lipolytica; identical to SEQ ID NO: 1379
  CDS (1)..(1074)

SEQ ID NO: 24338 - protein, 357 aa, Yarrowia lipolytica; identical to SEQ ID NO: 1380

SEQ ID NO: 24339 - DNA, 1089 bp, Yarrowia lipolytica; identical to SEQ ID NO: 1381
  CDS (1)..(1089)

SEQ ID NO: 24340 - protein, 362 aa, Yarrowia lipolytica; identical to SEQ ID NO: 1382

SEQ ID NO: 24341 - DNA, 1119 bp, Kluyveromyces lactis; identical to SEQ ID NO: 1383
  CDS (1)..(1119)

SEQ ID NO: 24342 - protein, 372 aa, Kluyveromyces lactis; identical to SEQ ID NO: 1384

SEQ ID NO: 24343 - DNA, 1095 bp, Kluyveromyces lactis; identical to SEQ ID NO: 1385
  CDS (1)..(1095)

SEQ ID NO: 24344 - protein, 364 aa, Kluyveromyces lactis; identical to SEQ ID NO: 1386

SEQ ID NO: 24345 - DNA, 1074 bp, Erwinia carotovora subsp; identical to SEQ ID NO: 1387
  CDS (1)..(1074)

SEQ ID NO: 24346 - protein, 357 aa, Erwinia carotovora subsp; identical to SEQ ID NO: 1388

SEQ ID NO: 24347 - DNA, 1047 bp, Erwinia carotovora subsp; identical to SEQ ID NO: 1389
  CDS (1)..(1047)

SEQ ID NO: 24348 - protein, 348 aa, Erwinia carotovora subsp; identical to SEQ ID NO: 1390

SEQ ID NO: 24349 - DNA, 1056 bp, Erwinia carotovora subsp; identical to SEQ ID NO: 1391
  CDS (1)..(1056)

SEQ ID NO: 24350 - protein, 351 aa, Erwinia carotovora subsp; identical to SEQ ID NO: 1392

SEQ ID NO: 24351 - DNA, 1113 bp, Acinetobacter sp; identical to SEQ ID NO: 1393
  CDS (1)..(1113)

SEQ ID NO: 24352 - protein, 370 aa, Acinetobacter sp; identical to SEQ ID NO: 1394

SEQ ID NO: 24353 - DNA, 1056 bp, Acinetobacter sp; identical to SEQ ID NO: 1395
  CDS (1)..(1056)

SEQ ID NO: 24354 - protein, 351 aa, Acinetobacter sp; identical to SEQ ID NO: 1396

SEQ ID NO: 24355 - DNA, 1119 bp, Candida glabrata; identical to SEQ ID NO: 1397
  CDS (1)..(1119)

SEQ ID NO: 24356 - protein, 372 aa, Candida glabrata; identical to SEQ ID NO: 1398

SEQ ID NO: 24357 - DNA, 1071 bp, Candida glabrata; identical to SEQ ID NO: 1399
  CDS (1)..(1071)

SEQ ID NO: 24358 - protein, 356 aa, Candida glabrata; identical to SEQ ID NO: 1400

SEQ ID NO: 24359 - DNA, 1083 bp, Photobacterium profundum; identical to SEQ ID NO: 1401
  CDS (1)..(1083)

SEQ ID NO: 24360 - protein, 360 aa, Photobacterium profundum; identical to SEQ ID NO: 1402

SEQ ID NO: 24361 - DNA, 1053 bp, Photobacterium profundum; identical to SEQ ID NO: 1403
  CDS (1)..(1053)

SEQ ID NO: 24362 - protein, 350 aa, Photobacterium profundum; identical to SEQ ID NO: 1404

SEQ ID NO: 24363 - DNA, 1113 bp, Photobacterium profundum; identical to SEQ ID NO: 1405
  CDS (1)..(1113)

SEQ ID NO: 24364 - protein, 370 aa, Photobacterium profundum; identical to SEQ ID NO: 1406

SEQ ID NO: 24365 - DNA, 1056 bp, Photobacterium profundum; identical to SEQ ID NO: 1407
  CDS (1)..(1056)

SEQ ID NO: 24366 - protein, 351 aa, Photobacterium profundum; identical to SEQ ID NO: 1408

SEQ ID NO: 24367 - DNA, 1092 bp, Parachlamydia sp; identical to SEQ ID NO: 1409
  CDS (1)..(1092)

SEQ ID NO: 24368 - protein, 363 aa, Parachlamydia sp; identical to SEQ ID NO: 1410

SEQ ID NO: 24369 - DNA, 1095 bp, Rhodopseudomonas palustris; identical to SEQ ID NO: 1411
  CDS (1)..(1095)

SEQ ID NO: 24370 - protein, 364 aa, Rhodopseudomonas palustris; identical to SEQ ID NO: 1412

SEQ ID NO: 24371 - DNA, 1100 bp, Amycolatopsis methanolica; identical to SEQ ID NO: 1413
  CDS (1)..(1086)

SEQ ID NO: 24372 - protein, 361 aa, Amycolatopsis methanolica; identical to SEQ ID NO: 1414

SEQ ID NO: 24373 - DNA, 1071 bp, Treponema denticola; identical to SEQ ID NO: 1415
  CDS (1)..(1071)

SEQ ID NO: 24374 - protein, 356 aa, Treponema denticola; identical to SEQ ID NO: 1416

SEQ ID NO: 24375 - DNA, 1068 bp, Geobacter sulfurreducens; identical to SEQ ID NO: 1417
  CDS (1)..(1068)

SEQ ID NO: 24376 - protein, 355 aa, Geobacter sulfurreducens; identical to SEQ ID NO: 1418

SEQ ID NO: 24377 - DNA, 1095 bp, Ashbya gossypii; identical to SEQ ID NO: 1419
  CDS (1)..(1095)

SEQ ID NO: 24378 - protein, 364 aa, Ashbya gossypii; identical to SEQ ID NO: 1420

SEQ ID NO: 24379 - DNA, 1122 bp, Ashbya gossypii; identical to SEQ ID NO: 1421
  CDS (1)..(1122)

SEQ ID NO: 24380 - protein, 373 aa, Ashbya gossypii; identical to SEQ ID NO: 1422

SEQ ID NO: 24381 - DNA, 1098 bp, Amycolatopsis balhimycina; identical to SEQ ID NO: 1423
  CDS (1)..(1098)

SEQ ID NO: 24382 - protein, 365 aa, Amycolatopsis balhimycina; identical to SEQ ID NO: 1424

SEQ ID NO: 24383 - DNA, 1071 bp, Vibrio vulnificus; identical to SEQ ID NO: 1425
  CDS (1)..(1071)

SEQ ID NO: 24384 - protein, 356 aa, Vibrio vulnificus; identical to SEQ ID NO: 1426

SEQ ID NO: 24385 - DNA, 1047 bp, Photorhabdus luminescens; identical to SEQ ID NO: 1427
  CDS (1)..(1047)

SEQ ID NO: 24386 - protein, 348 aa, Photorhabdus luminescens; identical to SEQ ID NO: 1428

SEQ ID NO: 24387 - DNA, 1053 bp, Photorhabdus luminescens; identical to SEQ ID NO: 1429
  CDS (1)..(1053)

SEQ ID NO: 24388 - protein, 350 aa, Photorhabdus luminescens; identical to SEQ ID NO: 1430

SEQ ID NO: 24389 - DNA, 1095 bp, Photorhabdus luminescens; identical to SEQ ID NO: 1431
  CDS (1)..(1095)

SEQ ID NO: 24390 - protein, 364 aa, Photorhabdus luminescens; identical to SEQ ID NO: 1432

SEQ ID NO: 24391 - DNA, 1119 bp, Gloeobacter violaceus; identical to SEQ ID NO: 1433
  CDS (1)..(1119)

SEQ ID NO: 24392 - protein, 372 aa, Gloeobacter violaceus; identical to SEQ ID NO: 1434

SEQ ID NO: 24393 - DNA, 1107 bp, Chromobacterium violaceum; identical to SEQ ID NO: 1435
  CDS (1)..(1107)

SEQ ID NO: 24394 - protein, 368 aa, Chromobacterium violaceum; identical to SEQ ID NO: 1436

SEQ ID NO: 24395 - DNA, 1059 bp, Chromobacterium violaceum; identical to SEQ ID NO: 1437
  CDS (1)..(1059)

SEQ ID NO: 24396 - protein, 352 aa, Chromobacterium violaceum; identical to SEQ ID NO: 1438

SEQ ID NO: 24397 - DNA, 1140 bp, Neurospora crassa; identical to SEQ ID NO: 1439
  CDS (1)..(1140)

SEQ ID NO: 24398 - protein, 379 aa, Neurospora crassa; identical to SEQ ID NO: 1440

SEQ ID NO: 24399 - DNA, 1092 bp, Neurospora crassa; identical to SEQ ID NO: 1441
  CDS (1)..(1092)

SEQ ID NO: 24400 - protein, 363 aa, Neurospora crassa; identical to SEQ ID NO: 1442

SEQ ID NO: 24401 - DNA, 1068 bp, Synechococcus sp; identical to SEQ ID NO: 1443
  CDS (1)..(1068)

SEQ ID NO: 24402 - protein, 355 aa, Synechococcus sp; identical to SEQ ID NO: 1444

SEQ ID NO: 24403 - DNA, 1053 bp, Rhodopirellula baltica; identical to SEQ ID NO: 1445
  CDS (1)..(1053)

SEQ ID NO: 24404 - protein, 350 aa, Rhodopirellula baltica; identical to SEQ ID NO: 1446

SEQ ID NO: 24405 - DNA, 1068 bp, Prochlorococcus marinus subsp; identical to SEQ ID NO: 1447
  CDS (1)..(1068)

SEQ ID NO: 24406 - protein, 355 aa, Prochlorococcus marinus subsp; identical to SEQ ID NO: 1448

SEQ ID NO: 24407 - DNA, 1083 bp, Prochlorococcus marinus; identical to SEQ ID NO: 1449
  CDS (1)..(1083)

SEQ ID NO: 24408 - protein, 360 aa, Prochlorococcus marinus; identical to SEQ ID NO: 1450

SEQ ID NO: 24409 - DNA, 1074 bp, Prochlorococcus marinus; identical to SEQ ID NO: 1451
  CDS (1)..(1074)

SEQ ID NO: 24410 - protein, 357 aa, Prochlorococcus marinus; identical to SEQ ID NO: 1452

SEQ ID NO: 24411 - DNA, 1113 bp, Haemophilus ducreyi; identical to SEQ ID NO: 1453
  CDS (1)..(1113)

SEQ ID NO: 24412 - protein, 370 aa, Haemophilus ducreyi; identical to SEQ ID NO: 1454

SEQ ID NO: 24413 - DNA, 1080 bp, Haemophilus ducreyi; identical to SEQ ID NO: 1455
  CDS (1)..(1080)

SEQ ID NO: 24414 - protein, 359 aa, Haemophilus ducreyi; identical to SEQ ID NO: 1456

SEQ ID NO: 24415 - DNA, 1086 bp, Candidatus Blochmannia floridanus; identical to SEQ ID NO: 1457
  CDS (1)..(1086)

SEQ ID NO: 24416 - protein, 361 aa, Candidatus Blochmannia floridanus; identical to SEQ ID NO: 1458

SEQ ID NO: 24417 - DNA, 1074 bp, Bordetella pertussis; identical to SEQ ID NO: 1459
  CDS (1)..(1074)

SEQ ID NO: 24418 - protein, 357 aa, Bordetella pertussis; identical to SEQ ID NO: 1460

SEQ ID NO: 24419 - DNA, 1119 bp, Bordetella bronchiseptica; identical to SEQ ID NO: 1461
  CDS (1)..(1119)

SEQ ID NO: 24420 - protein, 372 aa, Bordetella bronchiseptica; identical to SEQ ID NO: 1462

SEQ ID NO: 24421 - DNA, 1179 bp, Nitrosomonas europaea; identical to SEQ ID NO: 1463
  CDS (1)..(1179)

SEQ ID NO: 24422 - protein, 392 aa, Nitrosomonas europaea; identical to SEQ ID NO: 1464

SEQ ID NO: 24423 - DNA, 1083 bp, Coxiella burnetii; identical to SEQ ID NO: 1465
  CDS (1)..(1083)

SEQ ID NO: 24424 - protein, 360 aa, Coxiella burnetii; identical to SEQ ID NO: 1466

SEQ ID NO: 24425 - DNA, 834 bp, Vibrio anguillarum; identical to SEQ ID NO: 1467
  CDS (1)..(834)

SEQ ID NO: 24426 - protein, 277 aa, Vibrio anguillarum; identical to SEQ ID NO: 1468

SEQ ID NO: 24427 - DNA, 1143 bp, Xylella fastidiosa; identical to SEQ ID NO: 1469
  CDS (1)..(1143)

SEQ ID NO: 24428 - protein, 380 aa, Xylella fastidiosa; identical to SEQ ID NO: 1470

SEQ ID NO: 24429 - DNA, 1053 bp, Vibrio parahaemolyticus; identical to SEQ ID NO: 1471
  CDS (1)..(1053)

SEQ ID NO: 24430 - protein, 350 aa, Vibrio parahaemolyticus; identical to SEQ ID NO: 1472

SEQ ID NO: 24431 - DNA, 1053 bp, Vibrio parahaemolyticus; identical to SEQ ID NO: 1473
  CDS (1)..(1053)

SEQ ID NO: 24432 - protein, 350 aa, Vibrio parahaemolyticus; identical to SEQ ID NO: 1474

SEQ ID NO: 24433 - DNA, 1074 bp, Vibrio parahaemolyticus; identical to SEQ ID NO: 1475
  CDS (1)..(1074)

SEQ ID NO: 24434 - protein, 357 aa, Vibrio parahaemolyticus; identical to SEQ ID NO: 1476

SEQ ID NO: 24435 - DNA, 1083 bp, Pseudomonas syringae; identical to SEQ ID NO: 1477
  CDS (1)..(1083)

SEQ ID NO: 24436 - protein, 360 aa, Pseudomonas syringae; identical to SEQ ID NO: 1478

SEQ ID NO: 24437 - DNA, 1077 bp, Pseudomonas syringae; identical to SEQ ID NO: 1479
  CDS (1)..(1077)

SEQ ID NO: 24438 - protein, 358 aa, Pseudomonas syringae; identical to SEQ ID NO: 1480

SEQ ID NO: 24439 - DNA, 1062 bp, Pseudomonas putida; identical to SEQ ID NO: 1481
  CDS (1)..(1062)

SEQ ID NO: 24440 - protein, 353 aa, Pseudomonas putida; identical to SEQ ID NO: 1482

SEQ ID NO: 24441 - DNA, 1113 bp, Pseudomonas putida; identical to SEQ ID NO: 1483
  CDS (1)..(1113)

SEQ ID NO: 24442 - protein, 370 aa, Pseudomonas putida; identical to SEQ ID NO: 1484

SEQ ID NO: 24443 - DNA, 1086 bp, Bradyrhizobium japonicum; identical to SEQ ID NO: 1485
  CDS (1)..(1086)

SEQ ID NO: 24444 - protein, 361 aa, Bradyrhizobium japonicum; identical to SEQ ID NO: 1486

SEQ ID NO: 24445 - DNA, 1053 bp, Yersinia pestis; identical to SEQ ID NO: 1487
  CDS (1)..(1053)

SEQ ID NO: 24446 - protein, 350 aa, Yersinia pestis; identical to SEQ ID NO: 1488

SEQ ID NO: 24447 - DNA, 1077 bp, Yersinia pestis; identical to SEQ ID NO: 1489
  CDS (1)..(1077)

SEQ ID NO: 24448 - protein, 358 aa, Yersinia pestis; identical to SEQ ID NO: 1490

SEQ ID NO: 24449 - DNA, 1038 bp, Wigglesworthia glossinidia brevipalpis; identical to SEQ ID NO: 1491
  CDS (1)..(1038)

SEQ ID NO: 24450 - protein, 345 aa, Wigglesworthia glossinidia brevipalpis; identical to SEQ ID NO: 1492

SEQ ID NO: 24451 - DNA, 1053 bp, Vibrio vulnificus; identical to SEQ ID NO: 1493
  CDS (1)..(1053)

SEQ ID NO: 24452 - protein, 350 aa, Vibrio vulnificus; identical to SEQ ID NO: 1494

SEQ ID NO: 24453 - DNA, 1053 bp, Vibrio vulnificus; identical to SEQ ID NO: 1495
  CDS (1)..(1053)

SEQ ID NO: 24454 - protein, 350 aa, Vibrio vulnificus; identical to SEQ ID NO: 1496

SEQ ID NO: 24455 - DNA, 1071 bp, Vibrio vulnificus; identical to SEQ ID NO: 1497
  CDS (1)..(1071)

SEQ ID NO: 24456 - protein, 356 aa, Vibrio vulnificus; identical to SEQ ID NO: 1498

SEQ ID NO: 24457 - DNA, 1062 bp, Synechococcus elongatus; identical to SEQ ID NO: 1499
  CDS (1)..(1062)

SEQ ID NO: 24458 - protein, 353 aa, Synechococcus elongatus; identical to SEQ ID NO: 1500

SEQ ID NO: 24459 - DNA, 1032 bp, Streptococcus mutans; identical to SEQ ID NO: 1501
  CDS (1)..(1032)

SEQ ID NO: 24460 - protein, 343 aa, Streptococcus mutans; identical to SEQ ID NO: 1502

SEQ ID NO: 24461 - DNA, 1035 bp, Streptococcus mutans; identical to SEQ ID NO: 1503
  CDS (1)..(1035)

SEQ ID NO: 24462 - protein, 344 aa, Streptococcus mutans; identical to SEQ ID NO: 1504

SEQ ID NO: 24463 - DNA, 1008 bp, Streptococcus agalactiae; identical to SEQ ID NO: 1505
  CDS (1)..(1008)

SEQ ID NO: 24464 - protein, 335 aa, Streptococcus agalactiae; identical to SEQ ID NO: 1506

SEQ ID NO: 24465 - DNA, 1065 bp, Shewanella oneidensis; identical to SEQ ID NO: 1507
  CDS (1)..(1065)

SEQ ID NO: 24466 - protein, 354 aa, Shewanella oneidensis; identical to SEQ ID NO: 1508

SEQ ID NO: 24467 - DNA, 1092 bp, Shewanella oneidensis; identical to SEQ ID NO: 1509
  CDS (1)..(1092)

SEQ ID NO: 24468 - protein, 363 aa, Shewanella oneidensis; identical to SEQ ID NO: 1510

SEQ ID NO: 24469 - DNA, 1059 bp, Shewanella oneidensis; identical to SEQ ID NO: 1511
  CDS (1)..(1059)

SEQ ID NO: 24470 - protein, 352 aa, Shewanella oneidensis; identical to SEQ ID NO: 1512

SEQ ID NO: 24471 - DNA, 1053 bp, Escherichia coli O6; identical to SEQ ID NO: 1513
  CDS (1)..(1053)

SEQ ID NO: 24472 - protein, 350 aa, Escherichia coli O6; identical to SEQ ID NO: 1514

SEQ ID NO: 24473 - DNA, 1170 bp, Corynebacterium efficiens; identical to SEQ ID NO: 1515
  CDS (1)..(1170)

SEQ ID NO: 24474 - protein, 389 aa, Corynebacterium efficiens; identical to SEQ ID NO: 1516

SEQ ID NO: 24475 - DNA, 1134 bp, Bifidobacterium longum; identical to SEQ ID NO: 1517
  CDS (1)..(1134)

SEQ ID NO: 24476 - protein, 377 aa, Bifidobacterium longum; identical to SEQ ID NO: 1518

SEQ ID NO: 24477 - DNA, 1233 bp, Bifidobacterium longum; identical to SEQ ID NO: 1519
  CDS (1)..(1233)

SEQ ID NO: 24478 - protein, 410 aa, Bifidobacterium longum; identical to SEQ ID NO: 1520

SEQ ID NO: 24479 - DNA, 1221 bp, Phytophthora infestans; identical to SEQ ID NO: 1521
  CDS (20)..(1153)

SEQ ID NO: 24480 - protein, 377 aa, Phytophthora infestans; identical to SEQ ID NO: 1522

SEQ ID NO: 24481 - DNA, 1062 bp, Chlorobium tepidum; identical to SEQ ID NO: 1523
  CDS (1)..(1062)

SEQ ID NO: 24482 - protein, 353 aa, Chlorobium tepidum; identical to SEQ ID NO: 1524

SEQ ID NO: 24483 - DNA, 1074 bp, Xanthomonas campestris; identical to SEQ ID NO: 1525
  CDS (1)..(1074)

SEQ ID NO: 24484 - protein, 357 aa, Xanthomonas campestris; identical to SEQ ID NO: 1526

SEQ ID NO: 24485 - DNA, 1074 bp, Xanthomonas axonopodis; identical to SEQ ID NO: 1527
  CDS (1)..(1074)

SEQ ID NO: 24486 - protein, 357 aa, Xanthomonas axonopodis; identical to SEQ ID NO: 1528

SEQ ID NO: 24487 - DNA, 1080 bp, Ralstonia solanacearum; identical to SEQ ID NO: 1529
  CDS (1)..(1080)

SEQ ID NO: 24488 - protein, 359 aa, Ralstonia solanacearum; identical to SEQ ID NO: 1530

SEQ ID NO: 24489 - DNA, 1179 bp, Ralstonia solanacearum; identical to SEQ ID NO: 1531
  CDS (1)..(1179)

SEQ ID NO: 24490 - protein, 392 aa, Ralstonia solanacearum; identical to SEQ ID NO: 1532

SEQ ID NO: 24491 - DNA, 1065 bp, Synechococcus sp; identical to SEQ ID NO: 1533
  CDS (1)..(1065)

SEQ ID NO: 24492 - protein, 354 aa, Synechococcus sp; identical to SEQ ID NO: 1534

SEQ ID NO: 24493 - DNA, 1035 bp, Escherichia coli; identical to SEQ ID NO: 1535
  CDS (1)..(1035)

SEQ ID NO: 24494 - protein, 344 aa, Escherichia coli; identical to SEQ ID NO: 1536

SEQ ID NO: 24495 - DNA, 1200 bp, Stigmatella aurantiaca; identical to SEQ ID NO: 1537
  CDS (62)..(1147)

SEQ ID NO: 24496 - protein, 361 aa, Stigmatella aurantiaca; identical to SEQ ID NO: 1538

SEQ ID NO: 24497 - DNA, 1092 bp, Rhizobium loti; identical to SEQ ID NO: 1539
  CDS (1)..(1092)

SEQ ID NO: 24498 - protein, 363 aa, Rhizobium loti; identical to SEQ ID NO: 1540

SEQ ID NO: 24499 - DNA, 1083 bp, Amycolatopsis mediterranei; identical to SEQ ID NO: 1541
  CDS (1)..(1083)

SEQ ID NO: 24500 - protein, 360 aa, Amycolatopsis mediterranei; identical to SEQ ID NO: 1542

SEQ ID NO: 24501 - DNA, 1053 bp, Pasteurella multocida; identical to SEQ ID NO: 1543
  CDS (1)..(1053)

SEQ ID NO: 24502 - protein, 350 aa, Pasteurella multocida; identical to SEQ ID NO: 1544

SEQ ID NO: 24503 - DNA, 1086 bp, Pasteurella multocida; identical to SEQ ID NO: 1545
  CDS (1)..(1086)

SEQ ID NO: 24504 - protein, 361 aa, Pasteurella multocida; identical to SEQ ID NO: 1546

SEQ ID NO: 24505 - DNA, 1125 bp, Emericella nidulans; identical to SEQ ID NO: 1547
  CDS (1)..(1125)

SEQ ID NO: 24506 - protein, 374 aa, Emericella nidulans; identical to SEQ ID NO: 1548

SEQ ID NO: 24507 - DNA, 1089 bp, Emericella nidulans; identical to SEQ ID NO: 1549
  CDS (1)..(1089)

SEQ ID NO: 24508 - protein, 362 aa, Emericella nidulans; identical to SEQ ID NO: 1550

SEQ ID NO: 24509 - DNA, 1239 bp, Vibrio cholerae; identical to SEQ ID NO: 1551
  CDS (114)..(1175)

SEQ ID NO: 24510 - protein, 353 aa, Vibrio cholerae; identical to SEQ ID NO: 1552

SEQ ID NO: 24511 - DNA, 2184 bp, Candida albicans; identical to SEQ ID NO: 1553
  CDS (461)..(1573)

SEQ ID NO: 24512 - protein, 370 aa, Candida albicans; identical to SEQ ID NO: 1554

SEQ ID NO: 24513 - DNA, 1047 bp, Buchnera aphidicola; identical to SEQ ID NO: 1555
  CDS (1)..(1047)

SEQ ID NO: 24514 - protein, 348 aa, Buchnera aphidicola; identical to SEQ ID NO: 1556

SEQ ID NO: 24515 - DNA, 1047 bp, Buchnera aphidicola; identical to SEQ ID NO: 1557
  CDS (1)..(1047)

SEQ ID NO: 24516 - protein, 348 aa, Buchnera aphidicola; identical to SEQ ID NO: 1558

SEQ ID NO: 24517 - DNA, 1047 bp, Erwinia herbicola; identical to SEQ ID NO: 1559
  CDS (1)..(1047)

SEQ ID NO: 24518 - protein, 348 aa, Erwinia herbicola; identical to SEQ ID NO: 1560

SEQ ID NO: 24519 - DNA, 1047 bp, Salmonella typhimurium; identical to SEQ ID NO: 1561
  CDS (1)..(1047)

SEQ ID NO: 24520 - protein, 348 aa, Salmonella typhimurium; identical to SEQ ID NO: 1562

SEQ ID NO: 24521 - DNA, 23 bp, Artificial sequence
  (1)..(23): primer
atgaacagaactgacgaactccg

SEQ ID NO: 24522 - DNA, 24 bp, Artificial sequence
  (1)..(24): primer
ttagaagcgggtatctaccgcaga

SEQ ID NO: 24523 - protein, 352 aa, Artificial sequence; identical to SEQ ID NO: 19007
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(40): xaa in position 37 to 40 is any amino acid
  Variant (42)..(43): xaa in position 42 to 43 is any amino acid
  Variant (45)..(46): xaa in position 45 to 46 is any amino acid
  Variant (51)..(51): xaa in position 51 is any amino acid
  Variant (54)..(55): xaa in position 54 to 55 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(128): xaa in position 121 to 128 is any amino acid
  Variant (130)..(130): xaa in position 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(152): xaa in position 148 to 152 is any amino acid
  Variant (163)..(163): xaa in position 163 is any amino acid
  Variant (166)..(167): xaa in position 166 to 167 is any amino acid
  Variant (170)..(170): xaa in position 170 is any amino acid
  Variant (173)..(173): xaa in position 173 is any amino acid
  Variant (175)..(175): xaa in position 175 is any amino acid
  Variant (180)..(180): xaa in position 180 is any amino acid
  Variant (182)..(182): xaa in position 182 is any amino acid
  Variant (184)..(187): xaa in position 184 to 187 is any amino acid
  Variant (189)..(190): xaa in position 189 to 190 is any amino acid
  Variant (192)..(194): xaa in position 192 to 194 is any amino acid
  Variant (196)..(198): xaa in position 196 to 198 is any amino acid
  Variant (200)..(200): xaa in position 200 is any amino acid
  Variant (202)..(207): xaa in position 202 to 207 is any amino acid
  Variant (209)..(214): xaa in position 209 to 214 is any amino acid
  Variant (216)..(216): xaa in position 216 is any amino acid
  Variant (219)..(221): xaa in position 219 to 221 is any amino acid
  Variant (223)..(224): xaa in position 223 to 224 is any amino acid
  Variant (229)..(237): xaa in position 229 to 237 is any amino acid
  Variant (240)..(268): xaa in position 240 to 268 is any amino acid
  Variant (270)..(270): xaa in position 270 is any amino acid
  Variant (273)..(273): xaa in position 273 is any amino acid
  Variant (276)..(276): xaa in position 276 is any amino acid
  Variant (278)..(281): xaa in position 278 to 281 is any amino acid
  Variant (283)..(284): xaa in position 283 to 284 is any amino acid
  Variant (286)..(291): xaa in position 286 to 291 is any amino acid
  Variant (293)..(295): xaa in position 293 to 295 is any amino acid
  Variant (297)..(304): xaa in position 297 to 304 is any amino acid
  Variant (306)..(306): xaa in position 306 is any amino acid
  Variant (308)..(308): xaa in position 308 is any amino acid
  Variant (311)..(314): xaa in position 311 to 314 is any amino acid
  Variant (316)..(316): xaa in position 316 is any amino acid
  Variant (318)..(333): xaa in position 318 to 333 is any amino acid
  Variant (336)..(336): xaa in position 336 is any amino acid
  Variant (338)..(338): xaa in position 338 is any amino acid
  Variant (341)..(341): xaa in position 341 is any amino acid
  Variant (343)..(344): xaa in position 343 to 344 is any amino acid
  Variant (346)..(347): xaa in position 346 to 347 is any amino acid
  Variant (349)..(351): xaa in position 349 to 351 is any amino acid

SEQ ID NO: 24524 - protein, 24 aa, Artificial sequence
  Variant (2)..(2): xaa in position 2 is any amino acid
  Variant (3)..(3): xaa in position 3 is Leu, Val, Phe, Ile, Ala or Met
  Variant (4)..(4): xaa in position 4 is Val, Ile, Leu or Ala
  Variant (5)..(5): xaa in position 5 is Val or Ile
  Variant (6)..(6): xaa in position 6 is Val, Ile, Cys or Thr
  Variant (11)..(11): xaa in position 11 is Ile, Val, Ser or Leu
  Variant (12)..(12): xaa in position 12 is His or Asp
  Variant (13)..(13): xaa in position 13 is Asp or Asn
  Variant (14)..(15): xaa in position 14 to 15 is any amino acid
  Variant (16)..(16): xaa in position 16 is Ala, Ser, Gln or Thr
  Variant (17)..(17): xaa in position 17 is Ala, Val or Gly
  Variant (18)..(18): xaa in position 18 is any amino acid
  Variant (19)..(19): xaa in position 19 is Glu, Asp, Ala or Gln
  Variant (21)..(21): xaa in position 21 is Ala, Gly, Cys or Ser
  Variant (22)..(22): xaa in position 22 is any amino acid
  Variant (23)..(23): xaa in position 23 is Arg, Lys, Gln, His or Leu
  Variant (24)..(24): xaa in position 24 is Leu, Ile or Phe
RXXXXXGPCSXXXXXXXXXYXXXX

SEQ ID NO: 24525 - protein, 42 aa, Artificial sequence; identical to SEQ ID NO: 2884
  Variant (1)..(1): xaa in position 1 is Leu, Ile, Phe or Met
  Variant (2)..(2): xaa in position 2 is any amino acid
  Variant (3)..(3): xaa in position 3 is Ile, Val, Leu or Met
  Variant (4)..(4): xaa in position 4 is Val, Ile or Leu
  Variant (7)..(7): xaa in position 7 is Val, Ala or Thr
  Variant (9)..(9): xaa in position 9 is Phe, Leu, Thr or Val
  Variant (10)..(10): xaa in position 10 is Glu or Ala
  Variant (15)..(16): xaa in position 15 to 16 is any amino acid
  Variant (17)..(17): xaa in position 17 is any or no amino acid
  Variant (19)..(19): xaa in position 19 is Trp or Tyr
  Variant (20)..(20): xaa in position 20 is Lys or Arg
  Variant (22)..(22): xaa in position 22 is Leu, Phe, Met or Tyr
  Variant (23)..(23): xaa in position 23 is Ile, Val, Ala or Leu
  Variant (24)..(24): xaa in position 24 is any amino acid
  Variant (25)..(25): xaa in position 25 is Asp, Glu or Gln
  Variant (27)..(27): xaa in position 27 is any amino acid
  Variant (28)..(28): xaa in position 28 is Leu, Met, Ile, Val, Ala or Thr
  Variant (29)..(29): xaa in position 29 is Asp, Asn or Ser
  Variant (30)..(33): xaa in position 30 to 33 is any amino acid
  Variant (34)..(34): xaa in position 34 is Ile, Val, Leu or Met
  Variant (35)..(36): xaa in position 35 to 36 is any amino acid
  Variant (38)..(38): xaa in position 38 is Leu, Ile, Met or Val
  Variant (39)..(40): xaa in position 39 to 40 is any amino acid
  Variant (41)..(41): xaa in position 41 is Ala, Ser, Gly, Val or Thr

SEQ ID NO: 24526 - protein, 65 aa, Artificial sequence; identical to SEQ ID NO: 2885
  Variant (2)..(2): xaa in position 2 is any amino acid
  Variant (4)..(4): xaa in position 4 is Asp, Tyr, Gln, Asn or Glu
  Variant (5)..(9): xaa in position 5 to 9 is any amino acid
  Variant (10)..(10): xaa in position 10 is Tyr, Phe or Leu
  Variant (11)..(12): xaa in position 11 to 12 is any amino acid
  Variant (13)..(13): xaa in position 13 is Asp or Glu
  Variant (14)..(15): xaa in position 14 to 15 is any amino acid
  Variant (16)..(16): xaa in position 16 is Ser, Ala, Thr or Cys
  Variant (17)..(17): xaa in position 17 is Trp, Phe, Tyr, Leu or Val
  Variant (18)..(18): xaa in position 18 is any amino acid
  Variant (19)..(19): xaa in position 19 is Ala or Ser
  Variant (20)..(20): xaa in position 20 is Ile or Val
  Variant (24)..(24): xaa in position 24 is Thr, Ser or Asn
  Variant (25)..(25): xaa in position 25 is Thr, Val, Ala, Ser or Ile
  Variant (26)..(26): xaa in position 26 is Glu or Ala
  Variant (27)..(27): xaa in position 27 is Ser, Asp or Asn
  Variant (29)..(29): xaa in position 29 is any amino acid
  Variant (32)..(32): xaa in position 32 is Glu, Gln, Phe or Met
  Variant (33)..(33): xaa in position 33 is Leu, Met, Val, Ile or Phe
  Variant (34)..(34): xaa in position 34 is Ala, Ser, Thr, Cys or Val
  Variant (36)..(36): xaa in position 36 is Gly, Ala or Asn
  Variant (37)..(39): xaa in position 37 to 39 is any amino acid
  Variant (40)..(40): xaa in position 40 is Pro or Ala
  Variant (41)..(41): xaa in position 41 is Val, Ile, Thr or Leu
  Variant (43)..(43): xaa in position 43 is Phe, Met, Tyr or Ile
  Variant (46)..(46): xaa in position 46 is any amino acid
  Variant (47)..(47): xaa in position 47 is Thr, Ser or Arg
  Variant (48)..(48): xaa in position 48 is any amino acid
  Variant (50)..(53): xaa in position 50 to 53 is any amino acid
  Variant (54)..(54): xaa in position 54 is Ala or Met
  Variant (55)..(55): xaa in position 55 is any amino acid
  Variant (56)..(56): xaa in position 56 is Asp, Asn or Glu
  Variant (57)..(57): xaa in position 57 is Ala or Gly
  Variant (58)..(59): xaa in position 58 to 59 is any amino acid
  Variant (60)..(60): xaa in position 60 is Ala or Ser
  Variant (61)..(61): xaa in position 61 is Ala, Ser, Val or Thr
  Variant (62)..(64): xaa in position 62 to 64 is any amino acid
  Variant (65)..(65): xaa in position 65 is His or Gln

SEQ ID NO: 24527 - protein, 71 aa, Artificial sequence; identical to SEQ ID NO: 2886
  Variant (1)..(1): xaa in position 1 is Thr or Ser
  Variant (2)..(2): xaa in position 2 is any amino acid
  Variant (5)..(7): xaa in position 5 to 7 is any amino acid
  Variant (8)..(8): xaa in position 8 is His or Phe
  Variant (9)..(9): xaa in position 9 is Val, Ile, Leu or Ala
  Variant (10)..(10): xaa in position 10 is Ile or Val
  Variant (11)..(11): xaa in position 11 is Leu or Met
  Variant (14)..(14): xaa in position 14 is Gly, Ser or Ala
  Variant (15)..(16): xaa in position 15 to 16 is any amino acid
  Variant (17)..(22): xaa in position 17 to 22 is any or no amino acid
  Variant (23)..(23): xaa in position 23 is Pro, Thr or Ser
  Variant (25)..(25): xaa in position 25 is Tyr, Phe or His
  Variant (26)..(29): xaa in position 26 to 29 is any amino acid
  Variant (30)..(30): xaa in position 30 is Val, Ile or Leu
  Variant (31)..(36): xaa in position 31 to 36 is any amino acid
  Variant (37)..(37): xaa in position 37 is Leu, Met, Ile, Tyr or His
  Variant (38)..(40): xaa in position 38 to 40 is any amino acid
  Variant (41)..(51): xaa in position 41 to 51 is any or no amino acid
  Variant (52)..(52): xaa in position 52 is Leu, Ile or Val
  Variant (53)..(53): xaa in position 53 is Met, Val, Ile or Leu
  Variant (54)..(54): xaa in position 54 is Ile or Val
  Variant (56)..(56): xaa in position 56 is Cys, Phe, Ala, Thr, Tyr or Val
  Variant (57)..(57): xaa in position 57 is Ser, Asn or Ala
  Variant (59)..(59): xaa in position 59 is Gly, Ala or Asp
  Variant (61)..(61): xaa in position 61 is Ser or Cys
  Variant (62)..(62): xaa in position 62 is any amino acid
  Variant (64)..(66): xaa in position 64 to 66 is any amino acid
  Variant (67)..(67): xaa in position 67 is Arg, Asn, Lys, Leu or Glu
  Variant (69)..(70): xaa in position 69 to 70 is any amino acid
  Variant (71)..(71): xaa in position 71 is Val or Ile

SEQ ID NO: 24528 - protein, 41 aa, Artificial sequence; identical to SEQ ID NO: 2887
  Variant (2)..(2): xaa in position 2 is any amino acid
  Variant (4)..(4): xaa in position 4 is Ile, Leu, Val, Ala or Met
  Variant (7)..(7): xaa in position 7 is His, Asn, Phe or Tyr
  Variant (8)..(8): xaa in position 8 is Leu or Ile
  Variant (9)..(10): xaa in position 9 to 10 is any amino acid
  Variant (12)..(12): xaa in position 12 is any amino acid
  Variant (14)..(19): xaa in position 14 to 19 is any amino acid
  Variant (20)..(30): xaa in position 20 to 30 is any or no amino acid
  Variant (32)..(32): xaa in position 32 is any amino acid
  Variant (34)..(34): xaa in position 34 is Ile or Val
  Variant (37)..(37): xaa in position 37 is Ala, Pro, Gly, Lys, Ser or Glu
  Variant (39)..(39): xaa in position 39 is Ile, Leu or Val
  Variant (40)..(40): xaa in position 40 is any amino acid
  Variant (41)..(41): xaa in position 41 is Trp, Ile, Leu or Phe

SEQ ID NO: 24529 - DNA, 1071 bp, Escherichia coli K12; identical to SEQ ID NO: 23463
  CDS (1)..(1071)

SEQ ID NO: 24530 - protein, 356 aa, Escherichia coli K12; identical to SEQ ID NO: 23464

SEQ ID NO: 24531 - DNA, 1068 bp, Yersinia pestis; identical to SEQ ID NO: 23465
  CDS (1)..(1068)

SEQ ID NO: 24532 - protein, 355 aa, Yersinia pestis; identical to SEQ ID NO: 23466

SEQ ID NO: 24533 - DNA, 1068 bp, Salmonella enterica subsp. enterica serovar Typhi; identical to SEQ ID NO: 23467
  CDS (1)..(1068)

SEQ ID NO: 24534 - protein, 355 aa, Salmonella enterica subsp. enterica serovar Typhi; identical to SEQ ID NO: 23468

SEQ ID NO: 24535 - DNA, 1074 bp, Vibrio cholerae; identical to SEQ ID NO: 23469
  CDS (1)..(1074)

SEQ ID NO: 24536 - protein, 357 aa, Vibrio cholerae; identical to SEQ ID NO: 23470

SEQ ID NO: 24537 - DNA, 1128 bp, Xylella fastidiosa; identical to SEQ ID NO: 23471
  CDS (1)..(1128)

SEQ ID NO: 24538 - protein, 375 aa, Xylella fastidiosa; identical to SEQ ID NO: 23472

SEQ ID NO: 24539 - DNA, 1065 bp, Salmonella typhimurium; identical to SEQ ID NO: 23473
  CDS (1)..(1065)

SEQ ID NO: 24540 - protein, 354 aa, Salmonella typhimurium; identical to SEQ ID NO: 23474

SEQ ID NO: 24541 - DNA, 1059 bp, Campylobacter jejuni; identical to SEQ ID NO: 23475
  CDS (1)..(1059)

SEQ ID NO: 24542 - protein, 352 aa, Campylobacter jejuni; identical to SEQ ID NO: 23476

SEQ ID NO: 24543 - DNA, 1089 bp, Haemophilus influenzae; identical to SEQ ID NO: 23477
  CDS (1)..(1089)

SEQ ID NO: 24544 - protein, 362 aa, Haemophilus influenzae; identical to SEQ ID NO: 23478

SEQ ID NO: 24545 - DNA, 1125 bp, Bacteroides fragilis; identical to SEQ ID NO: 23479
  CDS (1)..(1125)

SEQ ID NO: 24546 - protein, 374 aa, Bacteroides fragilis; identical to SEQ ID NO: 23480

SEQ ID NO: 24547 - DNA, 1098 bp, Mannheimia succiniciproducens MBEL55E; identical to SEQ ID NO: 23481
  CDS (1)..(1098)

SEQ ID NO: 24548 - protein, 365 aa, Mannheimia succiniciproducens MBEL55E; identical to SEQ ID NO: 23482

SEQ ID NO: 24549 - DNA, 1068 bp, Erwinia carotovora; identical to SEQ ID NO: 23483
  CDS (1)..(1068)

SEQ ID NO: 24550 - protein, 355 aa, Erwinia carotovora; identical to SEQ ID NO: 23484

SEQ ID NO: 24551 - DNA, 1125 bp, Bacteroides thetaiotaomicron; identical to SEQ ID NO: 23485
  CDS (1)..(1125)

SEQ ID NO: 24552 - protein, 374 aa, Bacteroides thetaiotaomicron; identical to SEQ ID NO: 23486

SEQ ID NO: 24553 - DNA, 1068 bp, Buchnera aphidicola; identical to SEQ ID NO: 23487
  CDS (1)..(1068)

SEQ ID NO: 24554 - protein, 355 aa, Buchnera aphidicola; identical to SEQ ID NO: 23488

SEQ ID NO: 24555 - DNA, 1074 bp, Buchnera aphidicola; identical to SEQ ID NO: 23489
  CDS (1)..(1074)

SEQ ID NO: 24556 - protein, 357 aa, Buchnera aphidicola; identical to SEQ ID NO: 23490

SEQ ID NO: 24557 - DNA, 1074 bp, Candidatus Blochmannia floridanus; identical to SEQ ID NO: 23491
  CDS (1)..(1074)

SEQ ID NO: 24558 - protein, 357 aa, Candidatus Blochmannia floridanus; identical to SEQ ID NO: 23492

SEQ ID NO: 24559 - DNA, 1092 bp, Pasteurella multocida; identical to SEQ ID NO: 23493
  CDS (1)..(1092)

SEQ ID NO: 24560 - protein, 363 aa, Pasteurella multocida; identical to SEQ ID NO: 23494

SEQ ID NO: 24561 - DNA, 1068 bp, Photorhabdus luminescens; identical to SEQ ID NO: 23495
  CDS (1)..(1068)

SEQ ID NO: 24562 - protein, 355 aa, Photorhabdus luminescens; identical to SEQ ID NO: 23496

SEQ ID NO: 24563 - DNA, 1086 bp, Photobacterium profundum; identical to SEQ ID NO: 23497
  CDS (1)..(1086)

SEQ ID NO: 24564 - protein, 361 aa, Photobacterium profundum; identical to SEQ ID NO: 23498

SEQ ID NO: 24565 - DNA, 1092 bp, Shewanella oneidensis; identical to SEQ ID NO: 23499
  CDS (1)..(1092)

SEQ ID NO: 24566 - protein, 363 aa, Shewanella oneidensis; identical to SEQ ID NO: 23500

SEQ ID NO: 24567 - DNA, 1074 bp, Vibrio vulnificus; identical to SEQ ID NO: 23501
  CDS (1)..(1074)

SEQ ID NO: 24568 - protein, 357 aa, Vibrio vulnificus; identical to SEQ ID NO: 23502

SEQ ID NO: 24569 - DNA, 1128 bp, Xanthomonas campestris; identical to SEQ ID NO: 23503
  CDS (1)..(1128)

SEQ ID NO: 24570 - protein, 375 aa, Xanthomonas campestris; identical to SEQ ID NO: 23504

SEQ ID NO: 24571 - DNA, 27 bp, Artificial sequence
  (1)..(27): primer
atgatgagtcagaagtatctttttatc

SEQ ID NO: 24572 - DNA, 23 bp, Artificial sequence
  (1)..(23): primer
ttacagcactcctttcgacgagg

SEQ ID NO: 24573 - protein, 392 aa, Artificial sequence; identical to SEQ ID NO: 23507
  Variant (6)..(8): xaa in position 6 to 8 is any amino acid
  Variant (11)..(14): xaa in position 11 to 14 is any amino acid
  Variant (16)..(16): xaa in position 16 is any amino acid
  Variant (18)..(20): xaa in position 18 to 20 is any amino acid
  Variant (23)..(47): xaa in position 23 to 47 is any amino acid
  Variant (50)..(50): xaa in position 50 is any amino acid
  Variant (54)..(57): xaa in position 54 to 57 is any amino acid
  Variant (59)..(61): xaa in position 59 to 61 is any amino acid
  Variant (63)..(68): xaa in position 63 to 68 is any amino acid
  Variant (70)..(76): xaa in position 70 to 76 is any amino acid
  Variant (78)..(79): xaa in position 78 to 79 is any amino acid
  Variant (81)..(84): xaa in position 81 to 84 is any amino acid
  Variant (86)..(96): xaa in position 86 to 96 is any amino acid
  Variant (100)..(117): xaa in position 100 to 117 is any amino acid
  Variant (119)..(121): xaa in position 119 to 121 is any amino acid
  Variant (125)..(126): xaa in position 125 to 126 is any amino acid
  Variant (128)..(163): xaa in position 128 to 163 is any amino acid
  Variant (165)..(185): xaa in position 165 to 185 is any amino acid
  Variant (187)..(191): xaa in position 187 to 191 is any amino acid
  Variant (193)..(193): xaa in position 193 is any amino acid
  Variant (195)..(195): xaa in position 195 is any amino acid
  Variant (198)..(204): xaa in position 198 to 204 is any amino acid
  Variant (206)..(214): xaa in position 206 to 214 is any amino acid
  Variant (217)..(219): xaa in position 217 to 219 is any amino acid
  Variant (221)..(221): xaa in position 221 is any amino acid
  Variant (225)..(225): xaa in position 225 is any amino acid
  Variant (227)..(229): xaa in position 227 to 229 is any amino acid
  Variant (231)..(240): xaa in position 231 to 240 is any amino acid
  Variant (243)..(245): xaa in position 243 to 245 is any amino acid
  Variant (247)..(247): xaa in position 247 is any amino acid
  Variant (250)..(251): xaa in position 250 to 251 is any amino acid
  Variant (254)..(264): xaa in position 254 to 264 is any amino acid
  Variant (266)..(268): xaa in position 266 to 268 is any amino acid
  Variant (270)..(270): xaa in position 270 is any amino acid
  Variant (272)..(273): xaa in position 272 to 273 is any amino acid
  Variant (275)..(293): xaa in position 275 to 293 is any amino acid
  Variant (295)..(296): xaa in position 295 to 296 is any amino acid
  Variant (301)..(308): xaa in position 301 to 308 is any amino acid
  Variant (310)..(312): xaa in position 310 to 312 is any amino acid
  Variant (314)..(327): xaa in position 314 to 327 is any amino acid
  Variant (329)..(336): xaa in position 329 to 336 is any amino acid
  Variant (340)..(340): xaa in position 340 is any amino acid
  Variant (342)..(349): xaa in position 342 to 349 is any amino acid
  Variant (351)..(355): xaa in position 351 to 355 is any amino acid
  Variant (357)..(357): xaa in position 357 is any amino acid
  Variant (359)..(359): xaa in position 359 is any amino acid
  Variant (362)..(363): xaa in position 362 to 363 is any amino acid
  Variant (365)..(366): xaa in position 365 to 366 is any amino acid
  Variant (369)..(390): xaa in position 369 to 390 is any amino acid

SEQ ID NO: 24574 - protein, 397 aa, Artificial sequence; identical to SEQ ID NO: 23508
  Variant (11)..(11): xaa in position 11 is any amino acid
  Variant (14)..(15): xaa in position 14 to 15 is any amino acid
  Variant (17)..(17): xaa in position 17 is any amino acid
  Variant (19)..(19): xaa in position 19 is any amino acid
  Variant (21)..(23): xaa in position 21 to 23 is any amino acid
  Variant (26)..(30): xaa in position 26 to 30 is any amino acid
  Variant (34)..(34): xaa in position 34 is any amino acid
  Variant (36)..(37): xaa in position 36 to 37 is any amino acid
  Variant (39)..(46): xaa in position 39 to 46 is any amino acid
  Variant (49)..(50): xaa in position 49 to 50 is any amino acid
  Variant (58)..(58): xaa in position 58 is any amino acid
  Variant (60)..(60): xaa in position 60 is any amino acid
  Variant (62)..(64): xaa in position 62 to 64 is any amino acid
  Variant (66)..(67): xaa in position 66 to 67 is any amino acid
  Variant (70)..(71): xaa in position 70 to 71 is any amino acid
  Variant (73)..(77): xaa in position 73 to 77 is any amino acid
  Variant (81)..(82): xaa in position 81 to 82 is any amino acid
  Variant (84)..(86): xaa in position 84 to 86 is any amino acid
  Variant (92)..(96): xaa in position 92 to 96 is any amino acid
  Variant (98)..(98): xaa in position 98 is any amino acid
  Variant (103)..(105): xaa in position 103 to 105 is any amino acid
  Variant (107)..(109): xaa in position 107 to 109 is any amino acid
  Variant (111)..(116): xaa in position 111 to 116 is any amino acid
  Variant (118)..(120): xaa in position 118 to 120 is any amino acid
  Variant (122)..(122): xaa in position 122 is any amino acid
  Variant (128)..(128): xaa in position 128 is any amino acid
  Variant (131)..(132): xaa in position 131 to 132 is any amino acid
  Variant (135)..(135): xaa in position 135 is any amino acid
  Variant (137)..(138): xaa in position 137 to 138 is any amino acid
  Variant (140)..(143): xaa in position 140 to 143 is any amino acid
  Variant (145)..(166): xaa in position 145 to 166 is any amino acid
  Variant (168)..(169): xaa in position 168 to 169 is any amino acid
  Variant (171)..(173): xaa in position 171 to 173 is any amino acid
  Variant (175)..(188): xaa in position 175 to 188 is any amino acid
  Variant (190)..(190): xaa in position 190 is any amino acid
  Variant (192)..(192): xaa in position 192 is any amino acid
  Variant (194)..(194): xaa in position 194 is any amino acid
  Variant (196)..(196): xaa in position 196 is any amino acid
  Variant (201)..(201): xaa in position 201 is any amino acid
  Variant (203)..(203): xaa in position 203 is any amino acid
  Variant (205)..(207): xaa in position 205 to 207 is any amino acid
  Variant (210)..(215): xaa in position 210 to 215 is any amino acid
  Variant (217)..(217): xaa in position 217 is any amino acid
  Variant (220)..(221): xaa in position 220 to 221 is any amino acid
  Variant (228)..(228): xaa in position 228 is any amino acid
  Variant (232)..(232): xaa in position 232 is any amino acid
  Variant (234)..(234): xaa in position 234 is any amino acid
  Variant (236)..(243): xaa in position 236 to 243 is any amino acid
  Variant (247)..(247): xaa in position 247 is any amino acid
  Variant (250)..(250): xaa in position 250 is any amino acid
  Variant (254)..(254): xaa in position 254 is any amino acid
  Variant (258)..(258): xaa in position 258 is any amino acid
  Variant (263)..(263): xaa in position 263 is any amino acid
  Variant (265)..(267): xaa in position 265 to 267 is any amino acid
  Variant (271)..(271): xaa in position 271 is any amino acid
  Variant (276)..(276): xaa in position 276 is any amino acid
  Variant (278)..(296): xaa in position 278 to 296 is any amino acid
  Variant (299)..(299): xaa in position 299 is any amino acid
  Variant (305)..(306): xaa in position 305 to 306 is any amino acid
  Variant (308)..(308): xaa in position 308 is any amino acid
  Variant (310)..(310): xaa in position 310 is any amino acid
  Variant (313)..(313): xaa in position 313 is any amino acid
  Variant (318)..(322): xaa in position 318 to 322 is any amino acid
  Variant (324)..(324): xaa in position 324 is any amino acid
  Variant (326)..(330): xaa in position 326 to 330 is any amino acid
  Variant (332)..(334): xaa in position 332 to 334 is any amino acid
  Variant (338)..(339): xaa in position 338 to 339 is any amino acid
  Variant (343)..(343): xaa in position 343 is any amino acid
  Variant (346)..(352): xaa in position 346 to 352 is any amino acid
  Variant (356)..(358): xaa in position 356 to 358 is any amino acid
  Variant (360)..(360): xaa in position 360 is any amino acid
  Variant (365)..(366): xaa in position 365 to 366 is any amino acid
  Variant (368)..(368): xaa in position 368 is any amino acid
  Variant (372)..(374): xaa in position 372 to 374 is any amino acid
  Variant (376)..(376): xaa in position 376 is any amino acid
  Variant (378)..(378): xaa in position 378 is any amino acid
  Variant (381)..(386): xaa in position 381 to 386 is any amino acid
  Variant (388)..(389): xaa in position 388 to 389 is any amino acid
  Variant (396)..(396): xaa in position 396 is any amino acid

SEQ ID NO: 24575 - protein, 25 aa, Artificial sequence
  Variant (1)..(1): xaa in position 1 is Leu or Val
  Variant (2)..(2): xaa in position 2 is Phe or Leu
  Variant (3)..(3): xaa in position 3 is Ile or Val
  Variant (9)..(9): xaa in position 9 is Leu or Ile
  Variant (10)..(10): xaa in position 10 is Ile or Val
  Variant (11)..(11): xaa in position 11 is any amino acid
  Variant (14)..(14): xaa in position 14 is any amino acid
  Variant (15)..(15): xaa in position 15 is any or no amino acid
  Variant (16)..(16): xaa in position 16 is Asp or Asn
  Variant (17)..(17): xaa in position 17 is any amino acid
  Variant (19)..(19): xaa in position 19 is Val, Ile or Leu
  Variant (21)..(22): xaa in position 21 to 22 is any amino acid
  Variant (23)..(23): xaa in position 23 is Asp, Glu, Ala or Asn
XXXDRDGTXXXEPXXXXQXDXXXKL

SEQ ID NO: 24576 - protein, 22 aa, Artificial sequence
  Variant (1)..(1): xaa in position 1 is Tyr or Phe
  Variant (2)..(2): xaa in position 2 is any amino acid
  Variant (3)..(3): xaa in position 3 is Phe or Leu
  Variant (4)..(4): xaa in position 4 is Val or Ile
  Variant (5)..(5): xaa in position 5 is Met or Ile
  Variant (6)..(6): xaa in position 6 is Val or Ile
  Variant (7)..(7): xaa in position 7 is Thr or Ser
  Variant (10)..(10): xaa in position 10 is Asp or Asn
  Variant (14)..(14): xaa in position 14 is Thr or Ser
  Variant (15)..(15): xaa in position 15 is any amino acid
  Variant (16)..(16): xaa in position 16 is Ser, Ala, Asn or Leu
  Variant (17)..(17): xaa in position 17 is Phe or Tyr
  Variant (19)..(21): xaa in position 19 to 21 is any amino acid
XXXXXXXNQXGLGXXXXPXXXF

SEQ ID NO: 24577 - protein, 42 aa, Artificial sequence; identical to SEQ ID NO: 23511
  Variant (4)..(6): xaa in position 4 to 6 is any amino acid
  Variant (7)..(7): xaa in position 7 is Leu or Met
  Variant (8)..(8): xaa in position 8 is Val, Ile, Leu or Met
  Variant (9)..(10): xaa in position 9 to 10 is any amino acid
  Variant (11)..(11): xaa in position 11 is Tyr, Trp or Phe
  Variant (12)..(12): xaa in position 12 is Leu or Ile
  Variant (13)..(17): xaa in position 13 to 17 is any amino acid
  Variant (18)..(18): xaa in position 18 is Asp or Asn
  Variant (19)..(21): xaa in position 19 to 21 is any amino acid
  Variant (23)..(23): xaa in position 23 is any amino acid
  Variant (24)..(24): xaa in position 24 is Val or Met
  Variant (25)..(25): xaa in position 25 is Ile or Val
  Variant (29)..(29): xaa in position 29 is any amino acid
  Variant (30)..(30): xaa in position 30 is Thr or Ser
  Variant (32)..(32): xaa in position 32 is Ile, Val, Leu or Met
  Variant (33)..(33): xaa in position 33 is any amino acid
  Variant (34)..(34): xaa in position 34 is Leu or Phe
  Variant (35)..(35): xaa in position 35 is Ala or Gly
  Variant (36)..(36): xaa in position 36 is any amino acid
  Variant (37)..(37): xaa in position 37 is Asn, Ala or Ser
  Variant (38)..(38): xaa in position 38 is Met, Leu or Ile
  Variant (39)..(39): xaa in position 39 is Gly, Ala or Asn
  Variant (40)..(40): xaa in position 40 is Ile, Leu, Val or Cys
  Variant (41)..(41): xaa in position 41 is any amino acid
  Variant (42)..(42): xaa in position 42 is Gly, Ala or Ser

SEQ ID NO: 24578 - protein, 45 aa, Artificial sequence; identical to SEQ ID NO: 23512
  Variant (2)..(2): xaa in position 2 is any amino acid
  Variant (3)..(3): xaa in position 3 is Ala or Arg
  Variant (4)..(4): xaa in position 4 is any amino acid
  Variant (5)..(5): xaa in position 5 is Val, Ile or Tyr
  Variant (6)..(6): xaa in position 6 is any amino acid
  Variant (8)..(8): xaa in position 8 is any amino acid
  Variant (10)..(10): xaa in position 10 is Lys, Asn or Arg
  Variant (13)..(13): xaa in position 13 is any amino acid
  Variant (14)..(14): xaa in position 14 is Ile or Val
  Variant (15)..(15): xaa in position 15 is any amino acid
  Variant (16)..(16): xaa in position 16 is Val or Ile
  Variant (17)..(17): xaa in position 17 is any amino acid
  Variant (18)..(18): xaa in position 18 is Val, Leu or Ile
  Variant (19)..(19): xaa in position 19 is any amino acid
  Variant (21)..(21): xaa in position 21 is Asp or Asn
  Variant (22)..(26): xaa in position 22 to 26 is any amino acid
  Variant (27)..(27): xaa in position 27 is any or no amino acid
  Variant (28)..(28): xaa in position 28 is Ile or Thr
  Variant (29)..(29): xaa in position 29 is any amino acid
  Variant (32)..(32): xaa in position 32 is Leu, Val or Ile
  Variant (33)..(33): xaa in position 33 is any amino acid
  Variant (34)..(34): xaa in position 34 is Phe or Met
  Variant (36)..(36): xaa in position 36 is Asp or Asn
  Variant (40)..(40): xaa in position 40 is Asp or Glu
  Variant (42)..(42): xaa in position 42 is Ile or Leu
  Variant (43)..(43): xaa in position 43 is Ala, Gly or Ser
  Variant (44)..(44): xaa in position 44 is any amino acid

SEQ ID NO: 24579 - protein, 61 aa, Artificial sequence; identical to SEQ ID NO: 23513
  Variant (3)..(3): xaa in position 3 is Leu or Ile
  Variant (4)..(4): xaa in position 4 is any amino acid
  Variant (5)..(5): xaa in position 5 is Ile or Val
  Variant (7)..(7): xaa in position 7 is Asp or Glu
  Variant (10)..(10): xaa in position 10 is Thr or Ser
  Variant (11)..(11): xaa in position 11 is Val or Ile
  Variant (14)..(14): xaa in position 14 is Thr or Val
  Variant (15)..(15): xaa in position 15 is Ala or Gly
  Variant (16)..(16): xaa in position 16 is Leu or Ile
  Variant (17)..(17): xaa in position 17 is Ala, Val or Ser
  Variant (18)..(18): xaa in position 18 is Leu or Ile
  Variant (19)..(19): xaa in position 19 is Gly or Arg
  Variant (20)..(20): xaa in position 20 is any amino acid
  Variant (21)..(21): xaa in position 21 is Ala or Cys
  Variant (22)..(22): xaa in position 22 is Leu, Ile or Val
  Variant (23)..(24): xaa in position 23 to 24 is any amino acid
  Variant (26)..(26): xaa in position 26 is Leu, Ile or Val
  Variant (27)..(27): xaa in position 27 is Gly, Asn or Arg
  Variant (28)..(28): xaa in position 28 is Asp, Asn or Ser
  Variant (30)..(30): xaa in position 30 is any amino acid
  Variant (32)..(32): xaa in position 32 is Ile or Leu
  Variant (33)..(33): xaa in position 33 is any amino acid
  Variant (35)..(35): xaa in position 35 is Phe or Tyr
  Variant (36)..(53): xaa in position 36 to 53 is any or no amino acid
  Variant (55)..(55): xaa in position 55 is Phe or Tyr
  Variant (56)..(56): xaa in position 56 is any amino acid
  Variant (61)..(61): xaa in position 61 is Glu or Asp

SEQ ID NO: 24580 - protein, 68 aa, Artificial sequence; identical to SEQ ID NO: 23514
  Variant (1)..(1): xaa in position 1 is Val, Ile or Leu
  Variant (3)..(3): xaa in position 3 is any amino acid
  Variant (4)..(4): xaa in position 4 is Leu, Met or Phe
  Variant (5)..(5): xaa in position 5 is any amino acid
  Variant (6)..(6): xaa in position 6 is Thr or Ser
  Variant (7)..(7): xaa in position 7 is Glu, His or Asp
  Variant (8)..(8): xaa in position 8 is Met or Leu
  Variant (9)..(10): xaa in position 9 to 10 is any amino acid
  Variant (14)..(14): xaa in position 14 is any amino acid
  Variant (16)..(16): xaa in position 16 is Leu, Ile, Val or Phe
  Variant (17)..(22): xaa in position 17 to 22 is any amino acid
  Variant (23)..(23): xaa in position 23 is Thr, Asn or Ser
  Variant (25)..(25): xaa in position 25 is His or Asn
  Variant (26)..(26): xaa in position 26 is Leu, Ile or Val
  Variant (27)..(29): xaa in position 27 to 29 is any amino acid
  Variant (31)..(31): xaa in position 31 is any amino acid
  Variant (33)..(33): xaa in position 33 is Asp, Glu or Ala
  Variant (36)..(37): xaa in position 36 to 37 is any amino acid
  Variant (39)..(39): xaa in position 39 is Ser, Gly or Ala
  Variant (40)..(40): xaa in position 40 is Leu, Cys or Ile
  Variant (43)..(43): xaa in position 43 is Ala, Val or Ser
  Variant (44)..(44): xaa in position 44 is Phe or Leu
  Variant (45)..(45): xaa in position 45 is Gly or Ala
  Variant (46)..(46): xaa in position 46 is Arg or Lys
  Variant (47)..(47): xaa in position 47 is Thr, Ala or Ser
  Variant (48)..(48): xaa in position 48 is Leu or Val
  Variant (49)..(49): xaa in position 49 is Arg, Lys or Asn
  Variant (50)..(50): xaa in position 50 is Gln, Met or Lys
  Variant (51)..(51): xaa in position 51 is Ala or Cys
  Variant (52)..(52): xaa in position 52 is Ile, Leu or Val
  Variant (53)..(53): xaa in position 53 is any amino acid
  Variant (54)..(55): xaa in position 54 to 55 is any or no amino acid
  Variant (56)..(56): xaa in position 56 is Val, Ile or Arg
  Variant (57)..(57): xaa in position 57 is any amino acid
  Variant (58)..(58): xaa in position 58 is Gly, His or Ser
  Variant (59)..(60): xaa in position 59 to 60 is any amino acid
  Variant (61)..(61): xaa in position 61 is Leu, Met or Ile
  Variant (62)..(62): xaa in position 62 is Pro or Ala
  Variant (63)..(64): xaa in position 63 to 64 is Ser or Thr
  Variant (67)..(67): xaa in position 67 is any amino acid
  Variant (68)..(68): xaa in position 68 is Leu or Ile

SEQ ID NO: 24581 - DNA, 1431 bp, Escherichia coli; identical to SEQ ID NO: 14875
  CDS (1)..(1431)

SEQ ID NO: 24582 - protein, 476 aa, Escherichia coli; identical to SEQ ID NO: 14876

SEQ ID NO: 24583 - DNA, 1638 bp, Fusobacterium nucleatum subsp. nucleatum ATCC 25586; identical to SEQ ID NO: 14877
  CDS (1)..(1638): transl_table=11

SEQ ID NO: 24584 - protein, 545 aa, Fusobacterium nucleatum subsp. nucleatum ATCC 25586; identical to SEQ ID NO: 14878

SEQ ID NO: 24585 - DNA, 1392 bp, Clostridium tetani E88; identical to SEQ ID NO: 14879
  CDS (1)..(1392): transl_table=11

SEQ ID NO: 24586 - protein, 463 aa, Clostridium tetani E88; identical to SEQ ID NO: 14880

SEQ ID NO: 24587 - DNA, 1380 bp, Bacteroides thetaiotaomicron VPI-5482; identical to SEQ ID NO: 14881
  CDS (1)..(1380): transl_table=11

SEQ ID NO: 24588 - protein, 459 aa, Bacteroides thetaiotaomicron VPI-5482; identical to SEQ ID NO: 14882

SEQ ID NO: 24589 - DNA, 1380 bp, Porphyromonas gingivalis W83; identical to SEQ ID NO: 14883
  CDS (1)..(1380): transl_table=11

SEQ ID NO: 24590 - protein, 459 aa, Porphyromonas gingivalis W83; identical to SEQ ID NO: 14884

SEQ ID NO: 24591 - DNA, 1449 bp, Rhodopseudomonas palustris CGA009; identical to SEQ ID NO: 14885
  CDS (1)..(1449): transl_table=11

SEQ ID NO: 24592 - protein, 482 aa, Rhodopseudomonas palustris CGA009; identical to SEQ ID NO: 14886

SEQ ID NO: 24593 - DNA, 1380 bp, Treponema denticola ATCC 35405; identical to SEQ ID NO: 14887
  CDS (1)..(1380): transl_table=11

SEQ ID NO: 24594 - protein, 459 aa, Treponema denticola ATCC 35405; identical to SEQ ID NO: 14888

SEQ ID NO: 24595 - DNA, 1380 bp, Treponema denticola ATCC 35405; identical to SEQ ID NO: 14889
  CDS (1)..(1380): transl_table=11

SEQ ID NO: 24596 - protein, 459 aa, Treponema denticola ATCC 35405; identical to SEQ ID NO: 14890

SEQ ID NO: 24597 - DNA, 1617 bp, Entamoeba histolytica HM-1:IMSS; identical to SEQ ID NO: 14891
  CDS (1)..(1617)

SEQ ID NO: 24598 - protein, 538 aa, Entamoeba histolytica HM-1:IMSS; identical to SEQ ID NO: 14892

SEQ ID NO: 24599 - DNA, 1389 bp, Desulfovibrio vulgaris subsp. vulgaris str. Hildenborough; identical to SEQ ID NO: 14893
  CDS (1)..(1389): transl_table=11

SEQ ID NO: 24600 - protein, 462 aa, Desulfovibrio vulgaris subsp. vulgaris str. Hildenborough; identical to SEQ ID NO: 14894

SEQ ID NO: 24601 - DNA, 1377 bp, Propionibacterium acnes KPA171202; identical to SEQ ID NO: 14895
  CDS (1)..(1377): transl_table=11

SEQ ID NO: 24602 - protein, 458 aa, Propionibacterium acnes KPA171202; identical to SEQ ID NO: 14896

SEQ ID NO: 24603 - DNA, 1365 bp, Symbiobacterium thermophilum IAM 14863; identical to SEQ ID NO: 14897
  CDS (1)..(1365): transl_table=11

SEQ ID NO: 24604 - protein, 454 aa, Symbiobacterium thermophilum IAM 14863; identical to SEQ ID NO: 14898

SEQ ID NO: 24605 - DNA, 1416 bp, Symbiobacterium thermophilum IAM 14863; identical to SEQ ID NO: 14899
  CDS (1)..(1416): transl_table=11

SEQ ID NO: 24606 - protein, 471 aa, Symbiobacterium thermophilum IAM 14863; identical to SEQ ID NO: 14900

SEQ ID NO: 24607 - DNA, 1443 bp, Photobacterium profundum SS9; identical to SEQ ID NO: 14901
  CDS (1)..(1443): transl_table=11

SEQ ID NO: 24608 - protein, 480 aa, Photobacterium profundum SS9; identical to SEQ ID NO: 14902

SEQ ID NO: 24609 - DNA, 1467 bp, Photobacterium profundum SS9; identical to SEQ ID NO: 14903
  CDS (1)..(1467): transl_table=11

SEQ ID NO: 24610 - protein, 488 aa, Photobacterium profundum SS9; identical to SEQ ID NO: 14904

SEQ ID NO: 24611 - DNA, 1401 bp, Photobacterium profundum SS9; identical to SEQ ID NO: 14905
  CDS (1)..(1401): transl_table=11

SEQ ID NO: 24612 - protein, 466 aa, Photobacterium profundum SS9; identical to SEQ ID NO: 14906

SEQ ID NO: 24613 - DNA, 1344 bp, Haloarcula marismortui ATCC 43049; identical to SEQ ID NO: 14907
  CDS (1)..(1344): transl_table=11

SEQ ID NO: 24614 - protein, 447 aa, Haloarcula marismortui ATCC 43049; identical to SEQ ID NO: 14908

SEQ ID NO: 24615 - DNA, 1449 bp, Azoarcus sp. EbN1; identical to SEQ ID NO: 14909
  CDS (1)..(1449): transl_table=11

SEQ ID NO: 24616 - protein, 482 aa, Azoarcus sp. EbN1; identical to SEQ ID NO: 14910

SEQ ID NO: 24617 - DNA, 1404 bp, Nostoc punctiforme PCC 73102; identical to SEQ ID NO: 14911
  CDS (1)..(1404)

SEQ ID NO: 24618 - protein, 467 aa, Nostoc punctiforme PCC 73102; identical to SEQ ID NO: 14912

SEQ ID NO: 24619 - DNA, 1416 bp, Haemophilus somnus 129PT; identical to SEQ ID NO: 14913
  CDS (1)..(1416)

SEQ ID NO: 24620 - protein, 471 aa, Haemophilus somnus 129PT; identical to SEQ ID NO: 14914

SEQ ID NO: 24621 - DNA, 1569 bp, Fusobacterium nucleatum subsp. vincentii ATCC 49256; identical to SEQ ID NO: 14915
  CDS (1)..(1569): transl_table=11

SEQ ID NO: 24622 - protein, 522 aa, Fusobacterium nucleatum subsp. vincentii ATCC 49256; identical to SEQ ID NO: 14916

SEQ ID NO: 24623 - DNA, 1383 bp, Fusobacterium nucleatum subsp. vincentii ATCC 49256; identical to SEQ ID NO: 14917
  CDS (1)..(1383): transl_table=11

SEQ ID NO: 24624 - protein, 460 aa, Fusobacterium nucleatum subsp. vincentii ATCC 49256; identical to SEQ ID NO: 14918

SEQ ID NO: 24625 - DNA, 1182 bp, Haemophilus influenzae 86-028NP; identical to SEQ ID NO: 14919
  CDS (1)..(1182)

SEQ ID NO: 24626 - protein, 393 aa, Haemophilus influenzae 86-028NP; identical to SEQ ID NO: 14920

SEQ ID NO: 24627 - DNA, 1347 bp, Solibacter usitatus Ellin6076; identical to SEQ ID NO: 14921
  CDS (1)..(1347): transl_table=11

SEQ ID NO: 24628 - protein, 448 aa, Solibacter usitatus Ellin6076; identical to SEQ ID NO: 14922

SEQ ID NO: 24629 - DNA, 1374 bp, Desulfitobacterium hafniense DCB-2; identical to SEQ ID NO: 14923
  CDS (1)..(1374): transl_table=11

SEQ ID NO: 24630 - protein, 457 aa, Desulfitobacterium hafniense DCB-2; identical to SEQ ID NO: 14924

SEQ ID NO: 24631 - DNA, 1389 bp, Desulfitobacterium hafniense DCB-2; identical to SEQ ID NO: 14925
  CDS (1)..(1389): transl_table=11

SEQ ID NO: 24632 - protein, 462 aa, Desulfitobacterium hafniense DCB-2; identical to SEQ ID NO: 14926

SEQ ID NO: 24633 - DNA, 1443 bp, uncultured bacterium; identical to SEQ ID NO: 14927
  CDS (1)..(1443)

SEQ ID NO: 24634 - protein, 480 aa, uncultured bacterium; identical to SEQ ID NO: 14928

SEQ ID NO: 24635 - DNA, 1365 bp, Symbiobacterium thermophilum; identical to SEQ ID NO: 14929
  CDS (1)..(1365)

SEQ ID NO: 24636 - protein, 454 aa, Symbiobacterium thermophilum; identical to SEQ ID NO: 14930

SEQ ID NO: 24637 - DNA, 1365 bp, Symbiobacterium thermophilum; identical to SEQ ID NO: 14897
  CDS (1)..(1365)

SEQ ID NO: 24638 - protein, 454 aa, Symbiobacterium thermophilum; identical to SEQ ID NO: 14898

SEQ ID NO: 24639 - DNA, 1386 bp, Chromobacterium violaceum; identical to SEQ ID NO: 14933
  CDS (1)..(1386): transl_table=11

SEQ ID NO: 24640 - protein, 461 aa, Chromobacterium violaceum; identical to SEQ ID NO: 14934

SEQ ID NO: 24641 - DNA, 1419 bp, Clostridium tetani; identical to SEQ ID NO: 14935
  CDS (1)..(1419): transl_table=11

SEQ ID NO: 24642 - protein, 472 aa, Clostridium tetani; identical to SEQ ID NO: 14936

SEQ ID NO: 24643 - DNA, 1389 bp, Enterobacter aerogenes; identical to SEQ ID NO: 14937
  CDS (1)..(1389): transl_table=11

SEQ ID NO: 24644 - protein, 462 aa, Enterobacter aerogenes; identical to SEQ ID NO: 14938

SEQ ID NO: 24645 - DNA, 1419 bp, Haemophilus influenzae; identical to SEQ ID NO: 14939
  CDS (1)..(1419): transl_table=11

SEQ ID NO: 24646 - protein, 472 aa, Haemophilus influenzae; identical to SEQ ID NO: 14940

SEQ ID NO: 24647 - DNA, 1347 bp, Halobacterium salinarium; identical to SEQ ID NO: 14941
  CDS (1)..(1347)

SEQ ID NO: 24648 - protein, 448 aa, Halobacterium salinarium; identical to SEQ ID NO: 14942

SEQ ID NO: 24649 - DNA, 1416 bp, Pasteurella multocida; identical to SEQ ID NO: 14943
  CDS (1)..(1416): transl_table=11

SEQ ID NO: 24650 - protein, 471 aa, Pasteurella multocida; identical to SEQ ID NO: 14944

SEQ ID NO: 24651 - DNA, 1401 bp, Photorhabdus luminescens; identical to SEQ ID NO: 14945
  CDS (1)..(1401): transl_table=11

SEQ ID NO: 24652 - protein, 466 aa, Photorhabdus luminescens; identical to SEQ ID NO: 14946

SEQ ID NO: 24653 - DNA, 1398 bp, Proteus inconstans; identical to SEQ ID NO: 14947
  CDS (1)..(1398): transl_table=11

SEQ ID NO: 24654 - protein, 465 aa, Proteus inconstans; identical to SEQ ID NO: 14948

SEQ ID NO: 24655 - DNA, 1404 bp, Proteus vulgaris; identical to SEQ ID NO: 14949
  CDS (1)..(1404): transl_table=11

SEQ ID NO: 24656 - protein, 467 aa, Proteus vulgaris; identical to SEQ ID NO: 14950

SEQ ID NO: 24657 - DNA, 1365 bp, Rhodobacter capsulatus; identical to SEQ ID NO: 14951
  CDS (1)..(1365): transl_table=11

SEQ ID NO: 24658 - protein, 454 aa, Rhodobacter capsulatus; identical to SEQ ID NO: 14952

SEQ ID NO: 24659 - DNA, 1389 bp, Thermoanaerobacter tengcongensis; identical to SEQ ID NO: 14953
  CDS (1)..(1389): transl_table=11

SEQ ID NO: 24660 - protein, 462 aa, Thermoanaerobacter tengcongensis; identical to SEQ ID NO: 14954

SEQ ID NO: 24661 - DNA, 1419 bp, Vibrio cholerae; identical to SEQ ID NO: 14955
  CDS (1)..(1419): transl_table=11

SEQ ID NO: 24662 - protein, 472 aa, Vibrio cholerae; identical to SEQ ID NO: 14956

SEQ ID NO: 24663 - DNA, 1401 bp, Vibrio parahaemolyticus; identical to SEQ ID NO: 14957
  CDS (1)..(1401): transl_table=11

SEQ ID NO: 24664 - protein, 466 aa, Vibrio parahaemolyticus; identical to SEQ ID NO: 14958

SEQ ID NO: 24665 - DNA, 1422 bp, Vibrio vulnificus; identical to SEQ ID NO: 14959
  CDS (1)..(1422): transl_table=11

SEQ ID NO: 24666 - protein, 473 aa, Vibrio vulnificus; identical to SEQ ID NO: 14960

SEQ ID NO: 24667 - DNA, 1371 bp, Citrobacter freundii; identical to SEQ ID NO: 14961
  CDS (1)..(1371): transl_table=11

SEQ ID NO: 24668 - protein, 456 aa, Citrobacter freundii; identical to SEQ ID NO: 14962

SEQ ID NO: 24669 - DNA, 1383 bp, Clostridium tetani; identical to SEQ ID NO: 14963
  CDS (1)..(1383)

SEQ ID NO: 24670 - protein, 460 aa, Clostridium tetani; identical to SEQ ID NO: 14964

SEQ ID NO: 24671 - DNA, 1371 bp, Enterobacter agglomerans; identical to SEQ ID NO: 14965
  CDS (1)..(1371): transl_table=11

SEQ ID NO: 24672 - protein, 456 aa, Enterobacter agglomerans; identical to SEQ ID NO: 14966

SEQ ID NO: 24673 - DNA, 1383 bp, Fusobacterium nucleatum; identical to SEQ ID NO: 14967
  CDS (1)..(1383): transl_table=11

SEQ ID NO: 24674 - protein, 460 aa, Fusobacterium nucleatum; identical to SEQ ID NO: 14968

SEQ ID NO: 24675 - DNA, 1377 bp, Pasteurella multocida; identical to SEQ ID NO: 14969
  CDS (1)..(1377): transl_table=11

SEQ ID NO: 24676 - protein, 458 aa, Pasteurella multocida; identical to SEQ ID NO: 14970

SEQ ID NO: 24677 - DNA, 1377 bp, Symbiobacterium sp; identical to SEQ ID NO: 14971
  CDS (1)..(1377): transl_table=11

SEQ ID NO: 24678 - protein, 458 aa, Symbiobacterium sp; identical to SEQ ID NO: 14972

SEQ ID NO: 24679 - DNA, 27 bp, Artificial sequence
  (1)..(27): primer
atgaaggattatgtaatggaaaacttt

SEQ ID NO: 24680 - DNA, 26 bp, Artificial sequence
  (1)..(26): primer
ttaaacttctttaagttttgcggtga

SEQ ID NO: 24681 - protein, 533 aa, Artificial sequence; identical to SEQ ID NO: 14975
  Variant (2)..(2): xaa in position 2 is any amino acid
  Variant (7)..(7): xaa in position 7 is any amino acid
  Variant (10)..(10): xaa in position 10 is any amino acid
  Variant (12)..(18): xaa in position 12 to 18 is any amino acid
  Variant (20)..(22): xaa in position 20 to 22 is any amino acid
  Variant (24)..(25): xaa in position 24 to 25 is any amino acid
  Variant (27)..(28): xaa in position 27 to 28 is any amino acid
  Variant (30)..(30): xaa in position 30 is any amino acid
  Variant (32)..(32): xaa in position 32 is any amino acid
  Variant (34)..(34): xaa in position 34 is any amino acid
  Variant (36)..(37): xaa in position 36 to 37 is any amino acid
  Variant (49)..(49): xaa in position 49 is any amino acid
  Variant (53)..(54): xaa in position 53 to 54 is any amino acid
  Variant (56)..(56): xaa in position 56 is any or no amino acid
  Variant (61)..(61): xaa in position 61 is any amino acid
  Variant (70)..(71): xaa in position 70 to 71 is any amino acid
  Variant (73)..(74): xaa in position 73 to 74 is any amino acid
  Variant (76)..(78): xaa in position 76 to 78 is any amino acid
  Variant (80)..(80): xaa in position 80 is any amino acid
  Variant (83)..(83): xaa in position 83 is any amino acid
  Variant (86)..(88): xaa in position 86 to 88 is any amino acid
  Variant (89)..(134): xaa in position 89 to 134 is any or no amino acid
  Variant (137)..(137): xaa in position 137 is any amino acid
  Variant (145)..(145): xaa in position 145 is any amino acid
  Variant (147)..(150): xaa in position 147 to 150 is any amino acid
  Variant (153)..(160): xaa in position 153 to 160 is any amino acid
  Variant (161)..(170): xaa in position 161 to 170 is any or no amino acid
  Variant (172)..(173): xaa in position 172 to 173 is any amino acid
  Variant (175)..(175): xaa in position 175 is any amino acid
  Variant (178)..(179): xaa in position 178 to 179 is any amino acid
  Variant (181)..(184): xaa in position 181 to 184 is any amino acid
  Variant (187)..(190): xaa in position 187 to 190 is any amino acid
  Variant (192)..(195): xaa in position 192 to 195 is any amino acid
  Variant (197)..(202): xaa in position 197 to 202 is any amino acid
  Variant (203)..(210): xaa in position 203 to 210 is any or no amino acid
  Variant (214)..(215): xaa in position 214 to 215 is any amino acid
  Variant (218)..(218): xaa in position 218 is any amino acid
  Variant (221)..(223): xaa in position 221 to 223 is any amino acid
  Variant (225)..(227): xaa in position 225 to 227 is any amino acid
  Variant (229)..(230): xaa in position 229 to 230 is any amino acid
  Variant (231)..(231): xaa in position 231 is any or no amino acid
  Variant (233)..(234): xaa in position 233 to 234 is any amino acid
  Variant (236)..(238): xaa in position 236 to 238 is any amino acid
  Variant (241)..(241): xaa in position 241 is any amino acid
  Variant (243)..(244): xaa in position 243 to 244 is any amino acid
  Variant (252)..(252): xaa in position 252 is any amino acid
  Variant (256)..(259): xaa in position 256 to 259 is any amino acid
  Variant (261)..(263): xaa in position 261 to 263 is any amino acid
  Variant (265)..(265): xaa in position 265 is any amino acid
  Variant (267)..(267): xaa in position 267 is any amino acid
  Variant (269)..(270): xaa in position 269 to 270 is any amino acid
  Variant (273)..(273): xaa in position 273 is any amino acid
  Variant (275)..(276): xaa in position 275 to 276 is any amino acid
  Variant (283)..(285): xaa in position 283 to 285 is any amino acid
  Variant (287)..(288): xaa in position 287 to 288 is any amino acid
  Variant (290)..(292): xaa in position 290 to 292 is any amino acid
  Variant (295)..(296): xaa in position 295 to 296 is any amino acid
  Variant (298)..(299): xaa in position 298 to 299 is any amino acid
  Variant (301)..(301): xaa in position 301 is any amino acid
  Variant (303)..(303): xaa in position 303 is any amino acid
  Variant (307)..(309): xaa in position 307 to 309 is any amino acid
  Variant (316)..(316): xaa in position 316 is any amino acid
  Variant (323)..(323): xaa in position 323 is any amino acid
  Variant (325)..(327): xaa in position 325 to 327 is any amino acid
  Variant (329)..(330): xaa in position 329 to 330 is any amino acid
  Variant (331)..(348): xaa in position 331 to 348 is any or no amino acid
  Variant (351)..(357): xaa in position 351 to 357 is any amino acid
  Variant (359)..(360): xaa in position 359 to 360 is any amino acid
  Variant (363)..(364): xaa in position 363 to 364 is any amino acid
  Variant (370)..(370): xaa in position 370 is any amino acid
  Variant (375)..(375): xaa in position 375 is any amino acid
  Variant (379)..(379): xaa in position 379 is any amino acid
  Variant (382)..(382): xaa in position 382 is any amino acid
  Variant (384)..(388): xaa in position 384 to 388 is any amino acid
  Variant (391)..(392): xaa in position 391 to 392 is any amino acid
  Variant (395)..(395): xaa in position 395 is any amino acid
  Variant (398)..(398): xaa in position 398 is any amino acid
  Variant (401)..(403): xaa in position 401 to 403 is any amino acid
  Variant (405)..(407): xaa in position 405 to 407 is any amino acid
  Variant (410)..(413): xaa in position 410 to 413 is any amino acid
  Variant (414)..(414): xaa in position 414 is any or no amino acid
  Variant (416)..(416): xaa in position 416 is any or no amino acid
  Variant (421)..(421): xaa in position 421 is any amino acid
  Variant (426)..(429): xaa in position 426 to 429 is any amino acid
  Variant (431)..(433): xaa in position 431 to 433 is any or no amino acid
  Variant (436)..(439): xaa in position 436 to 439 is any amino acid
  Variant (443)..(444): xaa in position 443 to 444 is any amino acid
  Variant (446)..(448): xaa in position 446 to 448 is any amino acid
  Variant (451)..(453): xaa in position 451 to 453 is any amino acid
  Variant (457)..(458): xaa in position 457 to 458 is any amino acid
  Variant (460)..(460): xaa in position 460 is any amino acid
  Variant (462)..(467): xaa in position 462 to 467 is any amino acid
  Variant (468)..(470): xaa in position 468 to 470 is any or no amino acid
  Variant (472)..(479): xaa in position 472 to 479 is any or no amino acid
  Variant (481)..(482): xaa in position 481 to 482 is any amino acid
  Variant (485)..(485): xaa in position 485 is any amino acid
  Variant (489)..(490): xaa in position 489 to 490 is any amino acid
  Variant (493)..(494): xaa in position 493 to 494 is any amino acid
  Variant (498)..(498): xaa in position 498 is any amino acid
  Variant (500)..(505): xaa in position 500 to 505 is any amino acid
  Variant (507)..(512): xaa in position 507 to 512 is any amino acid
  Variant (514)..(514): xaa in position 514 is any amino acid
  Variant (515)..(515): xaa in position 515 is any or no amino acid
  Variant (518)..(521): xaa in position 518 to 521 is any amino acid
  Variant (524)..(525): xaa in position 524 to 525 is any amino acid
  Variant (526)..(527): xaa in position 526 to 527 is any or no amino acid
  Variant (530)..(530): xaa in position 530 is any amino acid
  Variant (532)..(532): xaa in position 532 is any amino acid

SEQ ID NO: 24682 - protein, 85 aa, Artificial sequence; identical to SEQ ID NO: 14976
  Variant (2)..(2): xaa in position 2 is Pro or Ser
  Variant (3)..(4): xaa in position 3 to 4 is any amino acid
  Variant (5)..(5): xaa in position 5 is Ile, Leu or Met
  Variant (6)..(8): xaa in position 6 to 8 is any amino acid
  Variant (10)..(10): xaa in position 10 is any amino acid
  Variant (11)..(18): xaa in position 11 to 18 is any or no amino acid
  Variant (20)..(25): xaa in position 20 to 25 is any amino acid
  Variant (26)..(26): xaa in position 26 is Ala, Ser or Val
  Variant (27)..(28): xaa in position 27 to 28 is any amino acid
  Variant (30)..(30): xaa in position 30 is any amino acid
  Variant (32)..(32): xaa in position 32 is any amino acid
  Variant (33)..(33): xaa in position 33 is Ile or Leu
  Variant (34)..(34): xaa in position 34 is any amino acid
  Variant (35)..(35): xaa in position 35 is Ala, Gly or Ser
  Variant (36)..(39): xaa in position 36 to 39 is any amino acid
  Variant (49)..(49): xaa in position 49 is Ala, Gly, Asn, Ser or Thr
  Variant (51)..(51): xaa in position 51 is Ile, Met or Val
  Variant (52)..(52): xaa in position 52 is Ser or Thr
  Variant (53)..(53): xaa in position 53 is Asp, Asn, Gln or Ser
  Variant (54)..(56): xaa in position 54 to 56 is any amino acid
  Variant (57)..(57): xaa in position 57 is Ala, Gly or Ser
  Variant (58)..(58): xaa in position 58 is Ala or Gly
  Variant (59)..(59): xaa in position 59 is Ile, Leu, Met or Val
  Variant (60)..(60): xaa in position 60 is Phe, Ile, Leu or Met
  Variant (61)..(61): xaa in position 61 is any amino acid
  Variant (65)..(65): xaa in position 65 is Ala or Ser
  Variant (67)..(67): xaa in position 67 is Ala or Ser
  Variant (69)..(69): xaa in position 69 is Ala, Gly or Ser
  Variant (70)..(70): xaa in position 70 is any amino acid
  Variant (71)..(71): xaa in position 71 is Asn or Ser
  Variant (72)..(72): xaa in position 72 is Phe, Trp or Tyr
  Variant (73)..(74): xaa in position 73 to 74 is any amino acid
  Variant (75)..(75): xaa in position 75 is Phe, Leu or Met
  Variant (76)..(78): xaa in position 76 to 78 is any amino acid
  Variant (79)..(79): xaa in position 79 is Ala, Gly, Ile or Val
  Variant (80)..(83): xaa in position 80 to 83 is any amino acid
  Variant (84)..(84): xaa in position 84 is Asp, Gly, Asn or Pro
  Variant (85)..(85): xaa in position 85 is Phe or Tyr

SEQ ID NO: 24683 - protein, 41 aa, Artificial sequence; identical to SEQ ID NO: 14977
  Variant (2)..(2): xaa in position 2 is Ala or Thr
  Variant (7)..(7): xaa in position 7 is Ala or Gly
  Variant (10)..(10): xaa in position 10 is any amino acid
  Variant (11)..(15): xaa in position 11 to 15 is any or no amino acid
  Variant (17)..(40): xaa in position 17 to 40 is any amino acid
  Variant (41)..(41): xaa in position 41 is Ala, Glu, Gly, Gln or Thr

SEQ ID NO: 24684 - protein, 100 aa, Artificial sequence; identical to SEQ ID NO: 14978
  Variant (2)..(13): xaa in position 2 to 13 is any amino acid
  Variant (14)..(17): xaa in position 14 to 17 is any or no amino acid
  Variant (19)..(19): xaa in position 19 is Cys, Asn, Ser or Val
  Variant (21)..(22): xaa in position 21 to 22 is any amino acid
  Variant (27)..(27): xaa in position 27 is Ile or Val
  Variant (29)..(29): xaa in position 29 is Ile, Leu or Met
  Variant (30)..(30): xaa in position 30 is any amino acid
  Variant (32)..(32): xaa in position 32 is Ile, Leu or Met
  Variant (33)..(33): xaa in position 33 is any amino acid
  Variant (34)..(34): xaa in position 34 is Ala, Asp, Glu, Gly or Ser
  Variant (35)..(37): xaa in position 35 to 37 is any amino acid
  Variant (38)..(38): xaa in position 38 is Ile, Leu, Met or Val
  Variant (39)..(39): xaa in position 39 is Ala, Cys or Thr
  Variant (40)..(43): xaa in position 40 to 43 is any amino acid
  Variant (44)..(44): xaa in position 44 is Ile or Val
  Variant (45)..(45): xaa in position 45 is any amino acid
  Variant (46)..(46): xaa in position 46 is Phe, Ile, Leu, Met or Val
  Variant (47)..(48): xaa in position 47 to 48 is any amino acid
  Variant (50)..(50): xaa in position 50 is Ala, Ser or Val
  Variant (51)..(51): xaa in position 51 is Ala, Cys or Thr
  Variant (53)..(53): xaa in position 53 is any amino acid
  Variant (54)..(54): xaa in position 54 is Ala, Cys, Ser or Val
  Variant (57)..(57): xaa in position 57 is Ala or Cys
  Variant (58)..(58): xaa in position 58 is His, Trp or Tyr
  Variant (60)..(60): xaa in position 60 is Ile or Val
  Variant (61)..(62): xaa in position 61 to 62 is any amino acid
  Variant (63)..(63): xaa in position 63 is Asp, Gln or Arg
  Variant (64)..(64): xaa in position 64 is Asp or Glu
  Variant (65)..(68): xaa in position 65 to 68 is any amino acid
  Variant (69)..(69): xaa in position 69 is Asp, Glu, Gly, Asn or Ser
  Variant (70)..(71): xaa in position 70 to 71 is any amino acid
  Variant (72)..(72): xaa in position 72 is Ile, Leu, Pro or Val
  Variant (73)..(73): xaa in position 73 is any amino acid
  Variant (74)..(74): xaa in position 74 is Asp, Glu, Gln, Ser or Thr
  Variant (75)..(75): xaa in position 75 is Ile or Val
  Variant (76)..(77): xaa in position 76 to 77 is any amino acid
  Variant (78)..(78): xaa in position 78 is Asp, Glu or Lys
  Variant (79)..(83): xaa in position 79 to 83 is any amino acid
  Variant (84)..(84): xaa in position 84 is Asp or Glu
  Variant (85)..(88): xaa in position 85 to 88 is any amino acid
  Variant (90)..(90): xaa in position 90 is Ala, Gly or Ser
  Variant (94)..(94): xaa in position 94 is Ala, Cys, Gly, Pro or Thr
  Variant (95)..(95): xaa in position 95 is Phe, Ile, Leu or Met
  Variant (96)..(96): xaa in position 96 is Ala, Leu or Val
  Variant (97)..(97): xaa in position 97 is Asn, Pro or Gln
  Variant (98)..(98): xaa in position 98 is Ile or Met

SEQ ID NO: 24685 - protein, 84 aa, Artificial sequence; identical to SEQ ID NO: 14979
  Variant (2)..(4): xaa in position 2 to 4 is any amino acid
  Variant (8)..(8): xaa in position 8 is Leu or Met
  Variant (9)..(9): xaa in position 9 is Ala, Glu, Asn, Ser or Thr
  Variant (11)..(11): xaa in position 11 is any amino acid
  Variant (12)..(12): xaa in position 12 is Ala or Asp
  Variant (13)..(13): xaa in position 13 is Ile, Leu or Met
  Variant (14)..(16): xaa in position 14 to 16 is any amino acid
  Variant (18)..(18): xaa in position 18 is any amino acid
  Variant (20)..(20): xaa in position 20 is Phe, Ile or Leu
  Variant (21)..(31): xaa in position 21 to 31 is any amino acid
  Variant (33)..(33): xaa in position 33 is Ile or Val
  Variant (34)..(34): xaa in position 34 is any amino acid
  Variant (36)..(39): xaa in position 36 to 39 is any amino acid
  Variant (40)..(40): xaa in position 40 is Ala, Gly, Asn or Val
  Variant (41)..(42): xaa in position 41 to 42 is any amino acid
  Variant (44)..(46): xaa in position 44 to 46 is any amino acid
  Variant (47)..(47): xaa in position 47 is Asp, Glu, Gly or Asn
  Variant (48)..(48): xaa in position 48 is Ile or Val
  Variant (49)..(49): xaa in position 49 is Ala, Ile, Leu, Pro or Val
  Variant (50)..(52): xaa in position 50 to 52 is any amino acid
  Variant (53)..(53): xaa in position 53 is Ala or Pro
  Variant (54)..(54): xaa in position 54 is any amino acid
  Variant (56)..(56): xaa in position 56 is any or no amino acid
  Variant (58)..(58): xaa in position 58 is Ala, Gly or Thr
  Variant (59)..(60): xaa in position 59 to 60 is any amino acid
  Variant (61)..(61): xaa in position 61 is Ile, Leu or Val
  Variant (62)..(62): xaa in position 62 is Asp or Glu
  Variant (63)..(63): xaa in position 63 is Ala, Gly or Thr
  Variant (64)..(67): xaa in position 64 to 67 is any amino acid
  Variant (68)..(68): xaa in position 68 is Glu, Asn, Pro or Thr
  Variant (69)..(75): xaa in position 69 to 75 is any amino acid
  Variant (76)..(76): xaa in position 76 is Gly, Ile or Pro
  Variant (77)..(77): xaa in position 77 is Ala, Asp, Gly or Ser
  Variant (78)..(80): xaa in position 78 to 80 is any amino acid
  Variant (81)..(81): xaa in position 81 is Ala, Cys, Gly, Asn, Ser, Thr or Val
  Variant (82)..(83): xaa in position 82 to 83 is any amino acid
  Variant (84)..(84): xaa in position 84 is Ile, Leu or Val

SEQ ID NO: 24686 - DNA, 1113 bp, Saccharomyces cerevisiae; identical to SEQ ID NO: 1363
  CDS (1)..(1113)

SEQ ID NO: 24687 - protein, 370 aa, Saccharomyces cerevisiae; identical to SEQ ID NO: 1364

SEQ ID NO: 24688 - DNA, 1086 bp, Deinococcus radiodurans; identical to SEQ ID NO: 1327
  CDS (1)..(1086)

SEQ ID NO: 24689 - protein, 361 aa, Deinococcus radiodurans; identical to SEQ ID NO: 1328

SEQ ID NO: 24690 - DNA, 1071 bp, Salmonella enterica subsp. enterica serovar Typhi; identical to SEQ ID NO: 2245
  CDS (1)..(1071)

SEQ ID NO: 24691 - protein, 356 aa, Salmonella enterica subsp. enterica serovar Typhi; identical to SEQ ID NO: 2246

SEQ ID NO: 24692 - DNA, 1071 bp, Yersinia pestis; identical to SEQ ID NO: 2247
  CDS (1)..(1071)

SEQ ID NO: 24693 - protein, 356 aa, Yersinia pestis; identical to SEQ ID NO: 2248

SEQ ID NO: 24694 - DNA, 1047 bp, Yersinia pestis; identical to SEQ ID NO: 1331
  CDS (1)..(1047)

SEQ ID NO: 24695 - protein, 348 aa, Yersinia pestis; identical to SEQ ID NO: 1332

SEQ ID NO: 24696 - DNA, 1053 bp, Escherichia coli; identical to SEQ ID NO: 2251
  CDS (1)..(1053)

SEQ ID NO: 24697 - protein, 350 aa, Escherichia coli; identical to SEQ ID NO: 1580

SEQ ID NO: 24698 - DNA, 1071 bp, Escherichia coli; identical to SEQ ID NO: 1333
  CDS (1)..(1071)

SEQ ID NO: 24699 - protein, 356 aa, Escherichia coli; identical to SEQ ID NO: 1334

SEQ ID NO: 24700 - DNA, 1131 bp, Nostoc sp. PCC 7120; identical to SEQ ID NO: 1335
  CDS (1)..(1131)

SEQ ID NO: 24701 - protein, 376 aa, Nostoc sp. PCC 7120; identical to SEQ ID NO: 1336

SEQ ID NO: 24702 - DNA, 1053 bp, Salmonella enterica subsp. enterica serovar Typhi; identical to SEQ ID NO: 1337
  CDS (1)..(1053)

SEQ ID NO: 24703 - protein, 350 aa, Salmonella enterica subsp. enterica serovar Typhi; identical to SEQ ID NO: 1338

SEQ ID NO: 24704 - DNA, 1077 bp, Pseudomonas aeruginosa; identical to SEQ ID NO: 1339
  CDS (1)..(1077)

SEQ ID NO: 24705 - protein, 358 aa, Pseudomonas aeruginosa; identical to SEQ ID NO: 1340

SEQ ID NO: 24706 - DNA, 1074 bp, Vibrio cholerae; identical to SEQ ID NO: 1343
  CDS (1)..(1074)

SEQ ID NO: 24707 - protein, 357 aa, Vibrio cholerae; identical to SEQ ID NO: 1344

SEQ ID NO: 24708 - DNA, 1038 bp, Lactococcus lactis subsp. lactis; identical to SEQ ID NO: 1345
  CDS (1)..(1038)

SEQ ID NO: 24709 - protein, 345 aa, Lactococcus lactis subsp. lactis; identical to SEQ ID NO: 1346

SEQ ID NO: 24710 - DNA, 1023 bp, Lactococcus lactis subsp. lactis; identical to SEQ ID NO: 1347
  CDS (1)..(1023)

SEQ ID NO: 24711 - protein, 340 aa, Lactococcus lactis subsp. lactis; identical to SEQ ID NO: 1348

SEQ ID NO: 24712 - DNA, 1032 bp, Streptococcus pneumoniae; identical to SEQ ID NO: 1349
  CDS (1)..(1032)

SEQ ID NO: 24713 - protein, 343 aa, Streptococcus pneumoniae; identical to SEQ ID NO: 1350

SEQ ID NO: 24714 - DNA, 1056 bp, Neisseria meningitidis; identical to SEQ ID NO: 2269
  CDS (1)..(1056)

SEQ ID NO: 24715 - protein, 351 aa, Neisseria meningitidis; identical to SEQ ID NO: 2270

SEQ ID NO: 24716 - DNA, 1095 bp, Pseudomonas aeruginosa; identical to SEQ ID NO: 1351
  CDS (1)..(1095)

SEQ ID NO: 24717 - protein, 364 aa, Pseudomonas aeruginosa; identical to SEQ ID NO: 1352

SEQ ID NO: 24718 - DNA, 1032 bp, Streptococcus pneumoniae; identical to SEQ ID NO: 1355
  CDS (1)..(1032)

SEQ ID NO: 24719 - protein, 343 aa, Streptococcus pneumoniae; identical to SEQ ID NO: 1356

SEQ ID NO: 24720 - DNA, 1143 bp, Xylella fastidiosa; identical to SEQ ID NO: 1603
  CDS (1)..(1143)

SEQ ID NO: 24721 - protein, 380 aa, Xylella fastidiosa; identical to SEQ ID NO: 1604

SEQ ID NO: 24722 - DNA, 1047 bp, Buchnera aphidicola; identical to SEQ ID NO: 1357
  CDS (1)..(1047)

SEQ ID NO: 24723 - protein, 348 aa, Buchnera aphidicola; identical to SEQ ID NO: 1358

SEQ ID NO: 24724 - DNA, 1104 bp, Corynebacterium glutamicum; identical to SEQ ID NO: 2279
  CDS (1)..(1104)

SEQ ID NO: 24725 - protein, 367 aa, Corynebacterium glutamicum; identical to SEQ ID NO: 2280

SEQ ID NO: 24726 - DNA, 1089 bp, Haemophilus influenzae; identical to SEQ ID NO: 1359
  CDS (1)..(1089)

SEQ ID NO: 24727 - protein, 362 aa, Haemophilus influenzae; identical to SEQ ID NO: 1360

SEQ ID NO: 24728 - DNA, 1502 bp, Candida albicans; identical to SEQ ID NO: 1361
  CDS (336)..(1442)

SEQ ID NO: 24729 - protein, 368 aa, Candida albicans; identical to SEQ ID NO: 1362

SEQ ID NO: 24730 - DNA, 2048 bp, Saccharomyces cerevisiae; identical to SEQ ID NO: 1365
  CDS (619)..(1731)

SEQ ID NO: 24731 - protein, 370 aa, Saccharomyces cerevisiae; identical to SEQ ID NO: 1366

SEQ ID NO: 24732 - DNA, 1107 bp, Schizosaccharomyces pombe; identical to SEQ ID NO: 1367
  CDS (1)..(1107)

SEQ ID NO: 24733 - protein, 368 aa, Schizosaccharomyces pombe; identical to SEQ ID NO: 1368

SEQ ID NO: 24734 - DNA, 1089 bp, Amycolatopsis orientalis; identical to SEQ ID NO: 1369
  CDS (1)..(1089)

SEQ ID NO: 24735 - protein, 362 aa, Amycolatopsis orientalis; identical to SEQ ID NO: 1370

SEQ ID NO: 24736 - DNA, 1119 bp, Schizosaccharomyces pombe; identical to SEQ ID NO: 1371
  CDS (1)..(1119)

SEQ ID NO: 24737 - protein, 372 aa, Schizosaccharomyces pombe; identical to SEQ ID NO: 1372

SEQ ID NO: 24738 - DNA, 1083 bp, Methylophilus methylotrophus; identical to SEQ ID NO: 1375
  CDS (1)..(1083)

SEQ ID NO: 24739 - protein, 360 aa, Methylophilus methylotrophus; identical to SEQ ID NO: 1376

SEQ ID NO: 24740 - DNA, 1770 bp, Debaryomyces hansenii; identical to SEQ ID NO: 2295
  CDS (1)..(1770)

SEQ ID NO: 24741 - protein, 589 aa, Debaryomyces hansenii; identical to SEQ ID NO: 2296

SEQ ID NO: 24742 - DNA, 1107 bp, Debaryomyces hansenii; identical to SEQ ID NO: 1377
  CDS (1)..(1107)

SEQ ID NO: 24743 - protein, 368 aa, Debaryomyces hansenii; identical to SEQ ID NO: 1378

SEQ ID NO: 24744 - DNA, 1074 bp, Yarrowia lipolytica; identical to SEQ ID NO: 1379
  CDS (1)..(1074)

SEQ ID NO: 24745 - protein, 357 aa, Yarrowia lipolytica; identical to SEQ ID NO: 1380

SEQ ID NO: 24746 - DNA, 1089 bp, Yarrowia lipolytica; identical to SEQ ID NO: 1381
  CDS (1)..(1089)

SEQ ID NO: 24747 - protein, 362 aa, Yarrowia lipolytica; identical to SEQ ID NO: 1382

SEQ ID NO: 24748 - DNA, 1119 bp, Kluyveromyces lactis; identical to SEQ ID NO: 1383
  CDS (1)..(1119)

SEQ ID NO: 24749 - protein, 372 aa, Kluyveromyces lactis; identical to SEQ ID NO: 1384

SEQ ID NO: 24750 - DNA, 1095 bp, Kluyveromyces lactis; identical to SEQ ID NO: 1385
  CDS (1)..(1095)

SEQ ID NO: 24751 - protein, 364 aa, Kluyveromyces lactis; identical to SEQ ID NO: 1386

SEQ ID NO: 24752 - DNA, 1074 bp, Erwinia carotovora subsp; identical to SEQ ID NO: 1387
  CDS (1)..(1074)

SEQ ID NO: 24753 - protein, 357 aa, Erwinia carotovora subsp; identical to SEQ ID NO: 1388

SEQ ID NO: 24754 - DNA, 1047 bp, Erwinia carotovora subsp; identical to SEQ ID NO: 1389
  CDS (1)..(1047)

SEQ ID NO: 24755 - protein, 348 aa, Erwinia carotovora subsp; identical to SEQ ID NO: 1390

SEQ ID NO: 24756 - DNA, 1056 bp, Erwinia carotovora subsp; identical to SEQ ID NO: 1391
  CDS (1)..(1056)

SEQ ID NO: 24757 - protein, 351 aa, Erwinia carotovora subsp; identical to SEQ ID NO: 1392

SEQ ID NO: 24758 - DNA, 1113 bp, Acinetobacter sp; identical to SEQ ID NO: 1393
  CDS (1)..(1113)

SEQ ID NO: 24759 - protein, 370 aa, Acinetobacter sp; identical to SEQ ID NO: 1394

SEQ ID NO: 24760 - DNA, 1056 bp, Acinetobacter sp; identical to SEQ ID NO: 1395
  CDS (1)..(1056)

SEQ ID NO: 24761 - protein, 351 aa, Acinetobacter sp; identical to SEQ ID NO: 1396

SEQ ID NO: 24762 - DNA, 1119 bp, Candida glabrata; identical to SEQ ID NO: 1397
  CDS (1)..(1119)

SEQ ID NO: 24763 - protein, 372 aa, Candida glabrata; identical to SEQ ID NO: 1398

SEQ ID NO: 24764 - DNA, 1071 bp, Candida glabrata; identical to SEQ ID NO: 1399
  CDS (1)..(1071)

SEQ ID NO: 24765 - protein, 356 aa, Candida glabrata; identical to SEQ ID NO: 1400

SEQ ID NO: 24766 - DNA, 1083 bp, Photobacterium profundum; identical to SEQ ID NO: 1401
  CDS (1)..(1083)

SEQ ID NO: 24767 - protein, 360 aa, Photobacterium profundum; identical to SEQ ID NO: 1402

SEQ ID NO: 24768 - DNA, 1053 bp, Photobacterium profundum; identical to SEQ ID NO: 1403
  CDS (1)..(1053)

SEQ ID NO: 24769 - protein, 350 aa, Photobacterium profundum; identical to SEQ ID NO: 1404

SEQ ID NO: 24770 - DNA, 1113 bp, Photobacterium profundum; identical to SEQ ID NO: 1405
  CDS (1)..(1113)

SEQ ID NO: 24771 - protein, 370 aa, Photobacterium profundum; identical to SEQ ID NO: 1406

SEQ ID NO: 24772 - DNA, 1056 bp, Photobacterium profundum; identical to SEQ ID NO: 1407
  CDS (1)..(1056)

SEQ ID NO: 24773 - protein, 351 aa, Photobacterium profundum; identical to SEQ ID NO: 1408

SEQ ID NO: 24774 - DNA, 1092 bp, Parachlamydia sp; identical to SEQ ID NO: 1409
  CDS (1)..(1092)

SEQ ID NO: 24775 - protein, 363 aa, Parachlamydia sp; identical to SEQ ID NO: 1410

SEQ ID NO: 24776 - DNA, 1095 bp, Rhodopseudomonas palustris; identical to SEQ ID NO: 1411
  CDS (1)..(1095)

SEQ ID NO: 24777 - protein, 364 aa, Rhodopseudomonas palustris; identical to SEQ ID NO: 1412

SEQ ID NO: 24778 - DNA, 1100 bp, Amycolatopsis methanolica; identical to SEQ ID NO: 1413
  CDS (1)..(1086)

SEQ ID NO: 24779 - protein, 361 aa, Amycolatopsis methanolica; identical to SEQ ID NO: 1414

SEQ ID NO: 24780 - DNA, 1071 bp, Treponema denticola; identical to SEQ ID NO: 1415
  CDS (1)..(1071)

SEQ ID NO: 24781 - protein, 356 aa, Treponema denticola; identical to SEQ ID NO: 1416

SEQ ID NO: 24782 - DNA, 1068 bp, Geobacter sulfurreducens; identical to SEQ ID NO: 1417
  CDS (1)..(1068)

SEQ ID NO: 24783 - protein, 355 aa, Geobacter sulfurreducens; identical to SEQ ID NO: 1418

SEQ ID NO: 24784 - DNA, 1095 bp, Ashbya gossypii; identical to SEQ ID NO: 1419
  CDS (1)..(1095)

SEQ ID NO: 24785 - protein, 364 aa, Ashbya gossypii; identical to SEQ ID NO: 1420

SEQ ID NO: 24786 - DNA, 1122 bp, Ashbya gossypii; identical to SEQ ID NO: 1421
  CDS (1)..(1122)

SEQ ID NO: 24787 - protein, 373 aa, Ashbya gossypii; identical to SEQ ID NO: 1422

SEQ ID NO: 24788 - DNA, 1098 bp, Amycolatopsis balhimycina; identical to SEQ ID NO: 1423
  CDS (1)..(1098)

SEQ ID NO: 24789 - protein, 365 aa, Amycolatopsis balhimycina; identical to SEQ ID NO: 1424

SEQ ID NO: 24790 - DNA, 1053 bp, Vibrio vulnificus; identical to SEQ ID NO: 2345
  CDS (1)..(1053)

SEQ ID NO: 24791 - protein, 350 aa, Vibrio vulnificus; identical to SEQ ID NO: 2346

SEQ ID NO: 24792 - DNA, 1047 bp, Photorhabdus luminescens; identical to SEQ ID NO: 1427
  CDS (1)..(1047)

SEQ ID NO: 24793 - protein, 348 aa, Photorhabdus luminescens; identical to SEQ ID NO: 1428

SEQ ID NO: 24794 - DNA, 1053 bp, Photorhabdus luminescens; identical to SEQ ID NO: 1429
  CDS (1)..(1053)

SEQ ID NO: 24795 - protein, 350 aa, Photorhabdus luminescens; identical to SEQ ID NO: 1430

SEQ ID NO: 24796 - DNA, 1095 bp, Photorhabdus luminescens; identical to SEQ ID NO: 1431
  CDS (1)..(1095)

SEQ ID NO: 24797 - protein, 364 aa, Photorhabdus luminescens; identical to SEQ ID NO: 1432

SEQ ID NO: 24798 - DNA, 1119 bp, Gloeobacter violaceus; identical to SEQ ID NO: 1433
  CDS (1)..(1119)

SEQ ID NO: 24799 - protein, 372 aa, Gloeobacter violaceus; identical to SEQ ID NO: 1434

SEQ ID NO: 24800 - DNA, 1107 bp, Chromobacterium violaceum; identical to SEQ ID NO: 1435
  CDS (1)..(1107)

SEQ ID NO: 24801 - protein, 368 aa, Chromobacterium violaceum; identical to SEQ ID NO: 1436

SEQ ID NO: 24802 - DNA, 1059 bp, Chromobacterium violaceum; identical to SEQ ID NO: 1437
  CDS (1)..(1059)

SEQ ID NO: 24803 - protein, 352 aa, Chromobacterium violaceum; identical to SEQ ID NO: 1438

SEQ ID NO: 24804 - DNA, 1140 bp, Neurospora crassa; identical to SEQ ID NO: 1439
  CDS (1)..(1140)

SEQ ID NO: 24805 - protein, 379 aa, Neurospora crassa; identical to SEQ ID NO: 1440

SEQ ID NO: 24806 - DNA, 1092 bp, Neurospora crassa; identical to SEQ ID NO: 1441
  CDS (1)..(1092)

SEQ ID NO: 24807 - protein, 363 aa, Neurospora crassa; identical to SEQ ID NO: 1442

SEQ ID NO: 24808 - DNA, 1068 bp, Synechococcus sp; identical to SEQ ID NO: 1443
  CDS (1)..(1068)

SEQ ID NO: 24809 - protein, 355 aa, Synechococcus sp; identical to SEQ ID NO: 1444

SEQ ID NO: 24810 - DNA, 1053 bp, Rhodopirellula baltica; identical to SEQ ID NO: 1445
  CDS (1)..(1053)

SEQ ID NO: 24811 - protein, 350 aa, Rhodopirellula baltica; identical to SEQ ID NO: 1446

SEQ ID NO: 24812 - DNA, 1068 bp, Prochlorococcus marinus subsp; identical to SEQ ID NO: 1447
  CDS (1)..(1068)

SEQ ID NO: 24813 - protein, 355 aa, Prochlorococcus marinus subsp; identical to SEQ ID NO: 1448

SEQ ID NO: 24814 - DNA, 1083 bp, Prochlorococcus marinus; identical to SEQ ID NO: 1449
  CDS (1)..(1083)

SEQ ID NO: 24815 - protein, 360 aa, Prochlorococcus marinus; identical to SEQ ID NO: 1450

SEQ ID NO: 24816 - DNA, 1074 bp, Prochlorococcus marinus; identical to SEQ ID NO: 1451
  CDS (1)..(1074)

SEQ ID NO: 24817 - protein, 357 aa, Prochlorococcus marinus; identical to SEQ ID NO: 1452

SEQ ID NO: 24818 - DNA, 1113 bp, Haemophilus ducreyi; identical to SEQ ID NO: 1453
  CDS (1)..(1113)

SEQ ID NO: 24819 - protein, 370 aa, Haemophilus ducreyi; identical to SEQ ID NO: 1454

SEQ ID NO: 24820 - DNA, 1080 bp, Haemophilus ducreyi; identical to SEQ ID NO: 1455
  CDS (1)..(1080)

SEQ ID NO: 24821 - protein, 359 aa, Haemophilus ducreyi; identical to SEQ ID NO: 1456

SEQ ID NO: 24822 - DNA, 1086 bp, Candidatus Blochmannia floridanus; identical to SEQ ID NO: 1457
  CDS (1)..(1086)

SEQ ID NO: 24823 - protein, 361 aa, Candidatus Blochmannia floridanus; identical to SEQ ID NO: 1458

SEQ ID NO: 24824 - DNA, 1074 bp, Bordetella pertussis; identical to SEQ ID NO: 2379
  CDS (1)..(1074)

SEQ ID NO: 24825 - protein, 357 aa, Bordetella pertussis; identical to SEQ ID NO: 1460

SEQ ID NO: 24826 - DNA, 1119 bp, Bordetella bronchiseptica; identical to SEQ ID NO: 1461
  CDS (1)..(1119)

SEQ ID NO: 24827 - protein, 372 aa, Bordetella bronchiseptica; identical to SEQ ID NO: 1462

SEQ ID NO: 24828 - DNA, 1179 bp, Nitrosomonas europaea; identical to SEQ ID NO: 1463
  CDS (1)..(1179)

SEQ ID NO: 24829 - protein, 392 aa, Nitrosomonas europaea; identical to SEQ ID NO: 1464

SEQ ID NO: 24830 - DNA, 1083 bp, Coxiella burnetii; identical to SEQ ID NO: 1465
  CDS (1)..(1083)

SEQ ID NO: 24831 - protein, 360 aa, Coxiella burnetii; identical to SEQ ID NO: 1466

SEQ ID NO: 24832 - DNA, 1053 bp, Vibrio parahaemolyticus; identical to SEQ ID NO: 1471
  CDS (1)..(1053)

SEQ ID NO: 24833 - protein, 350 aa, Vibrio parahaemolyticus; identical to SEQ ID NO: 1472

SEQ ID NO: 24834 - DNA, 1053 bp, Vibrio parahaemolyticus; identical to SEQ ID NO: 1473
  CDS (1)..(1053)

SEQ ID NO: 24835 - protein, 350 aa, Vibrio parahaemolyticus; identical to SEQ ID NO: 1474

SEQ ID NO: 24836 - DNA, 1074 bp, Vibrio parahaemolyticus; identical to SEQ ID NO: 1475
  CDS (1)..(1074)

SEQ ID NO: 24837 - protein, 357 aa, Vibrio parahaemolyticus; identical to SEQ ID NO: 1476

SEQ ID NO: 24838 - DNA, 1083 bp, Pseudomonas syringae; identical to SEQ ID NO: 1477
  CDS (1)..(1083)

SEQ ID NO: 24839 - protein, 360 aa, Pseudomonas syringae; identical to SEQ ID NO: 1478

SEQ ID NO: 24840 - DNA, 1077 bp, Pseudomonas syringae; identical to SEQ ID NO: 1479
  CDS (1)..(1077)

SEQ ID NO: 24841 - protein, 358 aa, Pseudomonas syringae; identical to SEQ ID NO: 1480

SEQ ID NO: 24842 - DNA, 1062 bp, Pseudomonas putida; identical to SEQ ID NO: 1481
  CDS (1)..(1062)

SEQ ID NO: 24843 - protein, 353 aa, Pseudomonas putida; identical to SEQ ID NO: 1482

SEQ ID NO: 24844 - DNA, 1113 bp, Pseudomonas putida; identical to SEQ ID NO: 1483
  CDS (1)..(1113)

SEQ ID NO: 24845 - protein, 370 aa, Pseudomonas putida; identical to SEQ ID NO: 1484

SEQ ID NO: 24846 - DNA, 1086 bp, Bradyrhizobium japonicum; identical to SEQ ID NO: 1485
  CDS (1)..(1086)

SEQ ID NO: 24847 - protein, 361 aa, Bradyrhizobium japonicum; identical to SEQ ID NO: 1486

SEQ ID NO: 24848 - DNA, 1053 bp, Yersinia pestis; identical to SEQ ID NO: 1487
  CDS (1)..(1053)

SEQ ID NO: 24849 - protein, 350 aa, Yersinia pestis; identical to SEQ ID NO: 1488

SEQ ID NO: 24850 - DNA, 1038 bp, Wigglesworthia glossinidia brevipalpis; identical to SEQ ID NO: 1491
  CDS (1)..(1038)

SEQ ID NO: 24851 - protein, 345 aa, Wigglesworthia glossinidia brevipalpis; identical to SEQ ID NO: 1492

SEQ ID NO: 24852 - DNA, 1071 bp, Vibrio vulnificus; identical to SEQ ID NO: 1739
  CDS (1)..(1071)

SEQ ID NO: 24853 - protein, 356 aa, Vibrio vulnificus; identical to SEQ ID NO: 1740

SEQ ID NO: 24854 - DNA, 1053 bp, Vibrio vulnificus; identical to SEQ ID NO: 1493
  CDS (1)..(1053)

SEQ ID NO: 24855 - protein, 350 aa, Vibrio vulnificus; identical to SEQ ID NO: 1494

SEQ ID NO: 24856 - DNA, 1071 bp, Vibrio vulnificus; identical to SEQ ID NO: 1497
  CDS (1)..(1071)

SEQ ID NO: 24857 - protein, 356 aa, Vibrio vulnificus; identical to SEQ ID NO: 1498

SEQ ID NO: 24858 - DNA, 1062 bp, Synechococcus elongatus; identical to SEQ ID NO: 1499
  CDS (1)..(1062)

SEQ ID NO: 24859 - protein, 353 aa, Synechococcus elongatus; identical to SEQ ID NO: 1500

SEQ ID NO: 24860 - DNA, 1032 bp, Streptococcus mutans; identical to SEQ ID NO: 1501
  CDS (1)..(1032)

SEQ ID NO: 24861 - protein, 343 aa, Streptococcus mutans; identical to SEQ ID NO: 1502

SEQ ID NO: 24862 - DNA, 1035 bp, Streptococcus mutans; identical to SEQ ID NO: 1503
  CDS (1)..(1035)

SEQ ID NO: 24863 - protein, 344 aa, Streptococcus mutans; identical to SEQ ID NO: 1504

SEQ ID NO: 24864 - DNA, 1008 bp, Streptococcus agalactiae; identical to SEQ ID NO: 1505
  CDS (1)..(1008)

SEQ ID NO: 24865 - protein, 335 aa, Streptococcus agalactiae; identical to SEQ ID NO: 1506

SEQ ID NO: 24866 - DNA, 1065 bp, Shewanella oneidensis; identical to SEQ ID NO: 1507
  CDS (1)..(1065)

SEQ ID NO: 24867 - protein, 354 aa, Shewanella oneidensis; identical to SEQ ID NO: 1508

SEQ ID NO: 24868 - DNA, 1092 bp, Shewanella oneidensis; identical to SEQ ID NO: 1509
  CDS (1)..(1092)

SEQ ID NO: 24869 - protein, 363 aa, Shewanella oneidensis; identical to SEQ ID NO: 1510

SEQ ID NO: 24870 - DNA, 1059 bp, Shewanella oneidensis; identical to SEQ ID NO: 1511
  CDS (1)..(1059)

SEQ ID NO: 24871 - protein, 352 aa, Shewanella oneidensis; identical to SEQ ID NO: 1512

SEQ ID NO: 24872 - DNA, 1170 bp, Corynebacterium efficiens; identical to SEQ ID NO: 1515
  CDS (1)..(1170)

SEQ ID NO: 24873 - protein, 389 aa, Corynebacterium efficiens; identical to SEQ ID NO: 1516

SEQ ID NO: 24874 - DNA, 1134 bp, Bifidobacterium longum; identical to SEQ ID NO: 1517
  CDS (1)..(1134)

SEQ ID NO: 24875 - protein, 377 aa, Bifidobacterium longum; identical to SEQ ID NO: 1518

SEQ ID NO: 24876 - DNA, 1233 bp, Bifidobacterium longum; identical to SEQ ID NO: 1519
  CDS (1)..(1233)

SEQ ID NO: 24877 - protein, 410 aa, Bifidobacterium longum; identical to SEQ ID NO: 1520

SEQ ID NO: 24878 - DNA, 1221 bp, Phytophthora infestans; identical to SEQ ID NO: 1521
  CDS (20)..(1153)

SEQ ID NO: 24879 - protein, 377 aa, Phytophthora infestans; identical to SEQ ID NO: 1522

SEQ ID NO: 24880 - DNA, 1062 bp, Chlorobium tepidum; identical to SEQ ID NO: 1523
  CDS (1)..(1062)

SEQ ID NO: 24881 - protein, 353 aa, Chlorobium tepidum; identical to SEQ ID NO: 1524

SEQ ID NO: 24882 - DNA, 1074 bp, Xanthomonas campestris; identical to SEQ ID NO: 1525
  CDS (1)..(1074)

SEQ ID NO: 24883 - protein, 357 aa, Xanthomonas campestris; identical to SEQ ID NO: 1526

SEQ ID NO: 24884 - DNA, 1074 bp, Xanthomonas axonopodis; identical to SEQ ID NO: 1527
  CDS (1)..(1074)

SEQ ID NO: 24885 - protein, 357 aa, Xanthomonas axonopodis; identical to SEQ ID NO: 1528

SEQ ID NO: 24886 - DNA, 1080 bp, Ralstonia solanacearum; identical to SEQ ID NO: 1529
  CDS (1)..(1080)

SEQ ID NO: 24887 - protein, 359 aa, Ralstonia solanacearum; identical to SEQ ID NO: 1530

SEQ ID NO: 24888 - DNA, 1179 bp, Ralstonia solanacearum; identical to SEQ ID NO: 1531
  CDS (1)..(1179)

SEQ ID NO: 24889 - protein, 392 aa, Ralstonia solanacearum; identical to SEQ ID NO: 1532

SEQ ID NO: 24890 - DNA, 1065 bp, Synechococcus sp; identical to SEQ ID NO: 1533
  CDS (1)..(1065)

SEQ ID NO: 24891 - protein, 354 aa, Synechococcus sp; identical to SEQ ID NO: 1534

SEQ ID NO: 24892 - DNA, 1035 bp, Escherichia coli; identical to SEQ ID NO: 1535
  CDS (1)..(1035)

SEQ ID NO: 24893 - protein, 344 aa, Escherichia coli; identical to SEQ ID NO: 1536

SEQ ID NO: 24894 - DNA, 1200 bp, Stigmatella aurantiaca; identical to SEQ ID NO: 1537
  CDS (62)..(1147)

SEQ ID NO: 24895 - protein, 361 aa, Stigmatella aurantiaca; identical to SEQ ID NO: 1538

SEQ ID NO: 24896 - DNA, 1083 bp, Amycolatopsis mediterranei; identical to SEQ ID NO: 1541
  CDS (1)..(1083)

SEQ ID NO: 24897 - protein, 360 aa, Amycolatopsis mediterranei; identical to SEQ ID NO: 1542

SEQ ID NO: 24898 - DNA, 1053 bp, Pasteurella multocida; identical to SEQ ID NO: 1543
  CDS (1)..(1053)

SEQ ID NO: 24899 - protein, 350 aa, Pasteurella multocida; identical to SEQ ID NO: 1544

SEQ ID NO: 24900 - DNA, 1086 bp, Pasteurella multocida; identical to SEQ ID NO: 1545
  CDS (1)..(1086)

SEQ ID NO: 24901 - protein, 361 aa, Pasteurella multocida; identical to SEQ ID NO: 1546

SEQ ID NO: 24902 - DNA, 1125 bp, Emericella nidulans; identical to SEQ ID NO: 1547
  CDS (1)..(1125)

SEQ ID NO: 24903 - protein, 374 aa, Emericella nidulans; identical to SEQ ID NO: 1548

SEQ ID NO: 24904 - DNA, 1089 bp, Emericella nidulans; identical to SEQ ID NO: 1549
  CDS (1)..(1089)

SEQ ID NO: 24905 - protein, 362 aa, Emericella nidulans; identical to SEQ ID NO: 1550

SEQ ID NO: 24906 - DNA, 1239 bp, Vibrio cholerae; identical to SEQ ID NO: 1551
  CDS (114)..(1175)

SEQ ID NO: 24907 - protein, 353 aa, Vibrio cholerae; identical to SEQ ID NO: 1552

SEQ ID NO: 24908 - DNA, 2184 bp, Candida albicans; identical to SEQ ID NO: 1553
  CDS (461)..(1573)

SEQ ID NO: 24909 - protein, 370 aa, Candida albicans; identical to SEQ ID NO: 1554

SEQ ID NO: 24910 - DNA, 1047 bp, Buchnera aphidicola; identical to SEQ ID NO: 1555
  CDS (1)..(1047)

SEQ ID NO: 24911 - protein, 348 aa, Buchnera aphidicola; identical to SEQ ID NO: 1556

SEQ ID NO: 24912 - DNA, 1047 bp, Buchnera aphidicola; identical to SEQ ID NO: 1557
  CDS (1)..(1047)

SEQ ID NO: 24913 - protein, 348 aa, Buchnera aphidicola; identical to SEQ ID NO: 1558

SEQ ID NO: 24914 - DNA, 1047 bp, Erwinia herbicola; identical to SEQ ID NO: 1559
  CDS (1)..(1047)

SEQ ID NO: 24915 - protein, 348 aa, Erwinia herbicola; identical to SEQ ID NO: 1560

SEQ ID NO: 24916 - DNA, 1047 bp, Salmonella typhimurium; identical to SEQ ID NO: 1561
  CDS (1)..(1047)

SEQ ID NO: 24917 - protein, 348 aa, Salmonella typhimurium; identical to SEQ ID NO: 1562

SEQ ID NO: 24918 - DNA, 1047 bp, Shigella flexneri; identical to SEQ ID NO: 2473
  CDS (1)..(1047)

SEQ ID NO: 24919 - protein, 348 aa, Shigella flexneri; identical to SEQ ID NO: 2474

SEQ ID NO: 24920 - DNA, 25 bp, Artificial sequence
  (1)..(25): primer
atgttcattaaaaacgatcacgccg

SEQ ID NO: 24921 - DNA, 25 bp, Artificial sequence
  (1)..(25): primer
ctattttttcaaggcctttcttctg

SEQ ID NO: 24922 - protein, 353 aa, Artificial sequence
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(37): xaa in position 37 is any amino acid
  Variant (39)..(46): xaa in position 39 to 46 is any amino acid
  Variant (51)..(51): xaa in position 51 is any amino acid
  Variant (54)..(56): xaa in position 54 to 56 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(130): xaa in position 121 to 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(152): xaa in position 148 to 152 is any amino acid
  Variant (163)..(163): xaa in position 163 is any amino acid
  Variant (166)..(168): xaa in position 166 to 168 is any amino acid
  Variant (171)..(171): xaa in position 171 is any amino acid
  Variant (174)..(174): xaa in position 174 is any amino acid
  Variant (176)..(176): xaa in position 176 is any amino acid
  Variant (181)..(181): xaa in position 181 is any amino acid
  Variant (183)..(183): xaa in position 183 is any amino acid
  Variant (185)..(188): xaa in position 185 to 188 is any amino acid
  Variant (190)..(191): xaa in position 190 to 191 is any amino acid
  Variant (193)..(195): xaa in position 193 to 195 is any amino acid
  Variant (197)..(199): xaa in position 197 to 199 is any amino acid
  Variant (201)..(201): xaa in position 201 is any amino acid
  Variant (203)..(208): xaa in position 203 to 208 is any amino acid
  Variant (210)..(215): xaa in position 210 to 215 is any amino acid
  Variant (217)..(217): xaa in position 217 is any amino acid
  Variant (220)..(222): xaa in position 220 to 222 is any amino acid
  Variant (224)..(225): xaa in position 224 to 225 is any amino acid
  Variant (230)..(238): xaa in position 230 to 238 is any amino acid
  Variant (241)..(269): xaa in position 241 to 269 is any amino acid
  Variant (271)..(271): xaa in position 271 is any amino acid
  Variant (274)..(274): xaa in position 274 is any amino acid
  Variant (277)..(277): xaa in position 277 is any amino acid
  Variant (279)..(282): xaa in position 279 to 282 is any amino acid
  Variant (284)..(285): xaa in position 284 to 285 is any amino acid
  Variant (287)..(292): xaa in position 287 to 292 is any amino acid
  Variant (294)..(296): xaa in position 294 to 296 is any amino acid
  Variant (298)..(305): xaa in position 298 to 305 is any amino acid
  Variant (307)..(307): xaa in position 307 is any amino acid
  Variant (309)..(309): xaa in position 309 is any amino acid
  Variant (312)..(315): xaa in position 312 to 315 is any amino acid
  Variant (317)..(317): xaa in position 317 is any amino acid
  Variant (319)..(334): xaa in position 319 to 334 is any amino acid
  Variant (337)..(337): xaa in position 337 is any amino acid
  Variant (339)..(339): xaa in position 339 is any amino acid
  Variant (342)..(342): xaa in position 342 is any amino acid
  Variant (344)..(345): xaa in position 344 to 345 is any amino acid
  Variant (347)..(348): xaa in position 347 to 348 is any amino acid
  Variant (350)..(352): xaa in position 350 to 352 is any amino acid
LXXPXXXXXXXPXXXXXXXXXXXXRXXXXXIXXGXDXRXXXXXXXXGPCSXHDXXXAXXYAXXLXXXXXXXXXXXXLXXXMRXYXEKPRTXXXGWKGLIXDPXXXXXXXXXXGLXXXRXLXXXXXXXXXXPXAXEXLDXXXXQXXXDXXXXXAIGARTTESQXHRXXXASXLSXPXGFKNXTXGXXXXAXXAXXXAXXXHXFXXXXXXGXXXXXXTXGNXXXHXXLRGGXXXXXXXXXNYXXXXXXXXXXXXXXXXXXXXXXXXXXXXXDXSHXNSXKXXXXQXXVXXXXXXQXXXGXXXXXXXXGXMXESXXXXGXQXXXXXXXXXXXXXXXXYGXSXTDXCXXWXXTXXXL

SEQ ID NO: 24923 - protein, 72 aa, Artificial sequence; identical to SEQ ID NO: 2906
  Variant (5)..(5): xaa in position 5 is Ile, Val, Ser or Leu
  Variant (6)..(6): xaa in position 6 is His or Asp
  Variant (7)..(7): xaa in position 7 is Asp or Asn
  Variant (8)..(10): xaa in position 8 to 10 is any amino acid
  Variant (11)..(11): xaa in position 11 is Ala, Val or Gly
  Variant (12)..(12): xaa in position 12 is any amino acid
  Variant (13)..(13): xaa in position 13 is Glu, Asp, Ala or Gln
  Variant (15)..(15): xaa in position 15 is Ala, Gly or Cys
  Variant (16)..(17): xaa in position 16 to 17 is any amino acid
  Variant (18)..(18): xaa in position 18 is Leu, Ile or Phe
  Variant (19)..(28): xaa in position 19 to 28 is any amino acid
  Variant (29)..(30): xaa in position 29 to 30 is any or no amino acid
  Variant (31)..(31): xaa in position 31 is Leu, Ile, Phe or Met
  Variant (32)..(32): xaa in position 32 is any amino acid
  Variant (33)..(33): xaa in position 33 is Ile, Val, Leu or Met
  Variant (34)..(34): xaa in position 34 is Val, Ile or Leu
  Variant (37)..(37): xaa in position 37 is Val, Ala or Thr
  Variant (39)..(39): xaa in position 39 is Phe, Leu, Thr or Val
  Variant (40)..(40): xaa in position 40 is Glu or Ala
  Variant (45)..(46): xaa in position 45 to 46 is any amino acid
  Variant (47)..(47): xaa in position 47 is any or no amino acid
  Variant (49)..(49): xaa in position 49 is Trp or Tyr
  Variant (50)..(50): xaa in position 50 is Lys or Arg
  Variant (52)..(52): xaa in position 52 is Leu, Phe, Met or Tyr
  Variant (53)..(53): xaa in position 53 is Ile, Val, Ala or Leu
  Variant (54)..(54): xaa in position 54 is any amino acid
  Variant (55)..(55): xaa in position 55 is Asp, Glu or Gln
  Variant (57)..(57): xaa in position 57 is any amino acid
  Variant (58)..(58): xaa in position 58 is Leu, Met, Ile, Val, Ala or Thr
  Variant (59)..(59): xaa in position 59 is Asp, Asn or Ser
  Variant (60)..(63): xaa in position 60 to 63 is any amino acid
  Variant (64)..(64): xaa in position 64 is Ile, Val, Leu or Met
  Variant (65)..(66): xaa in position 65 to 66 is any amino acid
  Variant (68)..(68): xaa in position 68 is Leu, Ile, Met or Val
  Variant (69)..(70): xaa in position 69 to 70 is any amino acid
  Variant (71)..(71): xaa in position 71 is Ala, Ser, Gly, Val or Thr

SEQ ID NO: 24924 - protein, 76 aa, Artificial sequence; identical to SEQ ID NO: 2907
  Variant (1)..(1): xaa in position 1 is Ala or Ser
  Variant (2)..(2): xaa in position 2 is Ile or Val
  Variant (6)..(6): xaa in position 6 is Thr, Ser or Asn
  Variant (7)..(7): xaa in position 7 is Thr, Val, Ala, Ser or Ile
  Variant (8)..(8): xaa in position 8 is Glu or Ala
  Variant (9)..(9): xaa in position 9 is Ser, Asp or Asn
  Variant (11)..(11): xaa in position 11 is any amino acid
  Variant (14)..(14): xaa in position 14 is Glu, Gln, Phe or Met
  Variant (15)..(15): xaa in position 15 is Leu, Met, Val, Phe or Ile
  Variant (16)..(16): xaa in position 16 is Ala, Ser, Thr, Cys or Val
  Variant (18)..(18): xaa in position 18 is Gly, Ala or Asn
  Variant (19)..(21): xaa in position 19 to 21 is any amino acid
  Variant (22)..(22): xaa in position 22 is Pro or Ala
  Variant (23)..(23): xaa in position 23 is Val, Ile, Thr or Leu
  Variant (25)..(25): xaa in position 25 is Phe, Met, Tyr or Ile
  Variant (28)..(28): xaa in position 28 is any amino acid
  Variant (29)..(29): xaa in position 29 is Thr, Ser or Arg
  Variant (30)..(30): xaa in position 30 is any amino acid
  Variant (32)..(35): xaa in position 32 to 35 is any amino acid
  Variant (36)..(36): xaa in position 36 is Ala or Met
  Variant (37)..(37): xaa in position 37 is any amino acid
  Variant (38)..(38): xaa in position 38 is Asp, Asn or Glu
  Variant (39)..(39): xaa in position 39 is Ala or Gly
  Variant (40)..(41): xaa in position 40 to 41 is any amino acid
  Variant (42)..(42): xaa in position 42 is Ala or Ser
  Variant (43)..(43): xaa in position 43 is Ala, Ser, Val or Thr
  Variant (44)..(46): xaa in position 44 to 46 is any amino acid
  Variant (47)..(47): xaa in position 47 is His or Gln
  Variant (48)..(48): xaa in position 48 is any amino acid
  Variant (49)..(49): xaa in position 49 is Phe, Tyr, His or Val
  Variant (50)..(51): xaa in position 50 to 51 is any amino acid
  Variant (52)..(55): xaa in position 52 to 55 is any or no amino acid
  Variant (57)..(60): xaa in position 57 to 60 is any amino acid
  Variant (61)..(62): xaa in position 61 to 62 is any or no amino acid
  Variant (63)..(63): xaa in position 63 is Thr or Ser
  Variant (64)..(64): xaa in position 64 is any amino acid
  Variant (67)..(69): xaa in position 67 to 69 is any amino acid
  Variant (70)..(70): xaa in position 70 is His or Phe
  Variant (71)..(71): xaa in position 71 is Val, Ile, Leu or Ala
  Variant (72)..(72): xaa in position 72 is Ile or Val
  Variant (73)..(73): xaa in position 73 is Leu or Met
  Variant (76)..(76): xaa in position 76 is Gly, Ala or Ser

SEQ ID NO: 24925 - protein, 83 aa, Artificial sequence; identical to SEQ ID NO: 2908
  Variant (1)..(1): xaa in position 1 is Leu, Ile or Val
  Variant (2)..(2): xaa in position 2 is Met, Val, Ile or Leu
  Variant (3)..(3): xaa in position 3 is Ile or Val
  Variant (5)..(5): xaa in position 5 is Cys, Phe, Ala, Thr or Tyr
  Variant (6)..(6): xaa in position 6 is Ser, Asn or Ala
  Variant (8)..(8): xaa in position 8 is Gly, Ala or Asp
  Variant (10)..(10): xaa in position 10 is Ser or Cys
  Variant (11)..(11): xaa in position 11 is any amino acid
  Variant (13)..(15): xaa in position 13 to 15 is any amino acid
  Variant (16)..(16): xaa in position 16 is Arg, Asn, Lys, Leu or Glu
  Variant (18)..(19): xaa in position 18 to 19 is any amino acid
  Variant (20)..(20): xaa in position 20 is Val or Ile
  Variant (21)..(26): xaa in position 21 to 26 is any amino acid
  Variant (27)..(27): xaa in position 27 is Gln, Asn or Arg
  Variant (28)..(28): xaa in position 28 is Ile, Leu, Val, Arg or Met
  Variant (29)..(30): xaa in position 29 to 30 is any amino acid
  Variant (31)..(31): xaa in position 31 is Gly, Asn or Asp
  Variant (32)..(32): xaa in position 32 is any amino acid
  Variant (33)..(37): xaa in position 33 to 37 is any or no amino acid
  Variant (38)..(38): xaa in position 38 is Ile, Val or Leu
  Variant (39)..(39): xaa in position 39 is any amino acid
  Variant (41)..(41): xaa in position 41 is any amino acid
  Variant (43)..(43): xaa in position 43 is Ile, Leu, Val, Ala or Met
  Variant (46)..(46): xaa in position 46 is His, Phe, Asn or Tyr
  Variant (47)..(47): xaa in position 47 is Leu or Ile
  Variant (48)..(49): xaa in position 48 to 49 is any amino acid
  Variant (51)..(51): xaa in position 51 is any amino acid
  Variant (53)..(57): xaa in position 53 to 57 is any amino acid
  Variant (58)..(69): xaa in position 58 to 69 is any or no amino acid
  Variant (71)..(71): xaa in position 71 is any amino acid
  Variant (73)..(73): xaa in position 73 is Ile or Val
  Variant (76)..(76): xaa in position 76 is any amino acid
  Variant (78)..(78): xaa in position 78 is Ile, Leu or Val
  Variant (79)..(79): xaa in position 79 is any amino acid
  Variant (80)..(80): xaa in position 80 is Trp, Ile, Leu or Phe
  Variant (81)..(82): xaa in position 81 to 82 is any amino acid
  Variant (83)..(83): xaa in position 83 is Thr or Ser

SEQ ID NO: 24926 - DNA, 1257 bp, Saccharomyces cerevisiae; identical to SEQ ID NO: 12824
  CDS (1)..(1257)

SEQ ID NO: 24927 - protein, 418 aa, Saccharomyces cerevisiae; identical to SEQ ID NO: 12825

SEQ ID NO: 24928 - DNA, 1203 bp, Chlamydia trachomatis; identical to SEQ ID NO: 12826
  CDS (1)..(1203)

SEQ ID NO: 24929 - protein, 400 aa, Chlamydia trachomatis; identical to SEQ ID NO: 12827

SEQ ID NO: 24930 - DNA, 1242 bp, Vibrio cholerae; identical to SEQ ID NO: 12828
  CDS (1)..(1242)

SEQ ID NO: 24931 - protein, 413 aa, Vibrio cholerae; identical to SEQ ID NO: 12829

SEQ ID NO: 24932 - DNA, 1188 bp, Chlamydophila pneumoniae, Chlamydia pneumoniae; identical to SEQ ID NO: 12830
  CDS (1)..(1188)

SEQ ID NO: 24933 - protein, 395 aa, Chlamydophila pneumoniae, Chlamydia pneumoniae; identical to SEQ ID NO: 12831

SEQ ID NO: 24934 - DNA, 1194 bp, Yersinia pestis; identical to SEQ ID NO: 12832
  CDS (1)..(1194)

SEQ ID NO: 24935 - protein, 397 aa, Yersinia pestis; identical to SEQ ID NO: 12833

SEQ ID NO: 24936 - DNA, 1191 bp, Salmonella enterica subsp. enterica serovar Typhi; identical to SEQ ID NO: 12834
  CDS (1)..(1191)

SEQ ID NO: 24937 - protein, 396 aa, Salmonella enterica subsp. enterica serovar Typhi; identical to SEQ ID NO: 12835

SEQ ID NO: 24938 - DNA, 1420 bp, Rhizobium meliloti; identical to SEQ ID NO: 12836
  CDS (175)..(1344)

SEQ ID NO: 24939 - protein, 389 aa, Rhizobium meliloti; identical to SEQ ID NO: 12837

SEQ ID NO: 24940 - DNA, 1197 bp, Pseudomonas aeruginosa; identical to SEQ ID NO: 12838
  CDS (1)..(1197)

SEQ ID NO: 24941 - protein, 398 aa, Pseudomonas aeruginosa; identical to SEQ ID NO: 12839

SEQ ID NO: 24942 - DNA, 1194 bp, Neisseria meningitidis; identical to SEQ ID NO: 12840
  CDS (1)..(1194)

SEQ ID NO: 24943 - protein, 397 aa, Neisseria meningitidis; identical to SEQ ID NO: 12841

SEQ ID NO: 24944 - DNA, 1203 bp, Xylella fastidiosa; identical to SEQ ID NO: 12842
  CDS (1)..(1203)

SEQ ID NO: 24945 - protein, 400 aa, Xylella fastidiosa; identical to SEQ ID NO: 12843

SEQ ID NO: 24946 - DNA, 1200 bp, Pseudomonas aeruginosa; identical to SEQ ID NO: 12844
  CDS (1)..(1200)

SEQ ID NO: 24947 - protein, 399 aa, Pseudomonas aeruginosa; identical to SEQ ID NO: 12845

SEQ ID NO: 24948 - DNA, 1215 bp, Vibrio cholerae; identical to SEQ ID NO: 12846
  CDS (1)..(1215)

SEQ ID NO: 24949 - protein, 404 aa, Vibrio cholerae; identical to SEQ ID NO: 12847

SEQ ID NO: 24950 - DNA, 1287 bp, Staphylococcus aureus; identical to SEQ ID NO: 12848
  CDS (1)..(1287)

SEQ ID NO: 24951 - protein, 428 aa, Staphylococcus aureus; identical to SEQ ID NO: 12849

SEQ ID NO: 24952 - DNA, 1182 bp, Bacillus subtilis; identical to SEQ ID NO: 12850
  CDS (1)..(1182)

SEQ ID NO: 24953 - protein, 393 aa, Bacillus subtilis; identical to SEQ ID NO: 12851

SEQ ID NO: 24954 - DNA, 1218 bp, Plasmodium falciparum; identical to SEQ ID NO: 12852
  CDS (1)..(1218)

SEQ ID NO: 24955 - protein, 405 aa, Plasmodium falciparum; identical to SEQ ID NO: 12853

SEQ ID NO: 24956 - DNA, 1194 bp, Neisseria meningitidis; identical to SEQ ID NO: 12854
  CDS (1)..(1194)

SEQ ID NO: 24957 - protein, 397 aa, Neisseria meningitidis; identical to SEQ ID NO: 12855

SEQ ID NO: 24958 - DNA, 1293 bp, Arabidopsis thaliana (mouse-ear cress); identical to SEQ ID NO: 12856
  CDS (1)..(1293)

SEQ ID NO: 24959 - protein, 430 aa, Arabidopsis thaliana (mouse-ear cress); identical to SEQ ID NO: 12857

SEQ ID NO: 24960 - DNA, 1191 bp, Haemophilus influenzae; identical to SEQ ID NO: 12858
  CDS (1)..(1191)

SEQ ID NO: 24961 - protein, 396 aa, Haemophilus influenzae; identical to SEQ ID NO: 12859

SEQ ID NO: 24962 - DNA, 1701 bp, Bacillus circulans; identical to SEQ ID NO: 12860
  CDS (367)..(1665)

SEQ ID NO: 24963 - protein, 432 aa, Bacillus circulans; identical to SEQ ID NO: 12861

SEQ ID NO: 24964 - DNA, 1578 bp, Oryza sativa (rice); identical to SEQ ID NO: 12862
  CDS (20)..(1312)

SEQ ID NO: 24965 - protein, 430 aa, Oryza sativa (rice); identical to SEQ ID NO: 12863

SEQ ID NO: 24966 - DNA, 1334 bp, Paracoccus denitrificans; identical to SEQ ID NO: 12864
  CDS (131)..(1315)

SEQ ID NO: 24967 - protein, 394 aa, Paracoccus denitrificans; identical to SEQ ID NO: 12865

SEQ ID NO: 24968 - DNA, 1677 bp, Panicum miliaceum (proso millet); identical to SEQ ID NO: 12866
  CDS (84)..(1370)

SEQ ID NO: 24969 - protein, 428 aa, Panicum miliaceum (proso millet); identical to SEQ ID NO: 12867

SEQ ID NO: 24970 - DNA, 1659 bp, Panicum miliaceum (proso millet); identical to SEQ ID NO: 12868
  CDS (84)..(1370)

SEQ ID NO: 24971 - protein, 428 aa, Panicum miliaceum (proso millet); identical to SEQ ID NO: 12869

SEQ ID NO: 24972 - DNA, 1755 bp, Glycine max (soybean); identical to SEQ ID NO: 12870
  CDS (73)..(1464)

SEQ ID NO: 24973 - protein, 463 aa, Glycine max (soybean); identical to SEQ ID NO: 12871

SEQ ID NO: 24974 - DNA, 2114 bp, Saccharomyces cerevisiae; identical to SEQ ID NO: 12872
  CDS (466)..(1821)

SEQ ID NO: 24975 - protein, 451 aa, Saccharomyces cerevisiae; identical to SEQ ID NO: 12873

SEQ ID NO: 24976 - DNA, 1257 bp, Medicago sativa (alfalfa); identical to SEQ ID NO: 12874
  CDS (1)..(1257)

SEQ ID NO: 24977 - protein, 418 aa, Medicago sativa (alfalfa); identical to SEQ ID NO: 12875

SEQ ID NO: 24978 - DNA, 1368 bp, Medicago sativa (alfalfa); identical to SEQ ID NO: 12876
  CDS (1)..(1368)

SEQ ID NO: 24979 - protein, 455 aa, Medicago sativa (alfalfa); identical to SEQ ID NO: 12877

SEQ ID NO: 24980 - DNA, 1514 bp, Panicum miliaceum (proso millet); identical to SEQ ID NO: 12878
  CDS (47)..(1276)

SEQ ID NO: 24981 - protein, 409 aa, Panicum miliaceum (proso millet); identical to SEQ ID NO: 12879

SEQ ID NO: 24982 - DNA, 1717 bp, Glycine max (soybean); identical to SEQ ID NO: 12880
  CDS (54)..(1337)

SEQ ID NO: 24983 - protein, 427 aa, Glycine max (soybean); identical to SEQ ID NO: 12881

SEQ ID NO: 24984 - DNA, 1681 bp, Panicum miliaceum (proso millet); identical to SEQ ID NO: 12882
  CDS (64)..(1437)

SEQ ID NO: 24985 - protein, 457 aa, Panicum miliaceum (proso millet); identical to SEQ ID NO: 12883

SEQ ID NO: 24986 - DNA, 1447 bp, Arabidopsis thaliana (mouse-ear cress); identical to SEQ ID NO: 12884
  CDS (1)..(1362)

SEQ ID NO: 24987 - protein, 453 aa, Arabidopsis thaliana (mouse-ear cress); identical to SEQ ID NO: 12885

SEQ ID NO: 24988 - DNA, 1523 bp, Daucus carota (carrot); identical to SEQ ID NO: 12886
  CDS (24)..(1241)

SEQ ID NO: 24989 - protein, 405 aa, Daucus carota (carrot); identical to SEQ ID NO: 12887

SEQ ID NO: 24990 - DNA, 1245 bp, Caenorhabditis elegans; identical to SEQ ID NO: 12888
  CDS (1)..(1245)

SEQ ID NO: 24991 - protein, 414 aa, Caenorhabditis elegans; identical to SEQ ID NO: 12889

SEQ ID NO: 24992 - DNA, 1095 bp, Caenorhabditis elegans; identical to SEQ ID NO: 12890
  CDS (1)..(1095)

SEQ ID NO: 24993 - protein, 364 aa, Caenorhabditis elegans; identical to SEQ ID NO: 12891

SEQ ID NO: 24994 - DNA, 1074 bp, Caenorhabditis elegans; identical to SEQ ID NO: 12892
  CDS (1)..(1074)

SEQ ID NO: 24995 - protein, 357 aa, Caenorhabditis elegans; identical to SEQ ID NO: 12893

SEQ ID NO: 24996 - DNA, 1227 bp, Caenorhabditis elegans; identical to SEQ ID NO: 12894
  CDS (1)..(1227)

SEQ ID NO: 24997 - protein, 408 aa, Caenorhabditis elegans; identical to SEQ ID NO: 12895

SEQ ID NO: 24998 - DNA, 1350 bp, Caenorhabditis elegans; identical to SEQ ID NO: 12896
  CDS (1)..(1350)

SEQ ID NO: 24999 - protein, 449 aa, Caenorhabditis elegans; identical to SEQ ID NO: 12897

SEQ ID NO: 25000 - DNA, 1230 bp, Schizosaccharomyces pombe; identical to SEQ ID NO: 12898
  CDS (1)..(1230)

SEQ ID NO: 25001 - protein, 409 aa, Schizosaccharomyces pombe; identical to SEQ ID NO: 12899

SEQ ID NO: 25002 - DNA, 1314 bp, Schizosaccharomyces pombe; identical to SEQ ID NO: 12900
  CDS (1)..(1314)

SEQ ID NO: 25003 - protein, 437 aa, Schizosaccharomyces pombe; identical to SEQ ID NO: 12901

SEQ ID NO: 25004 - DNA, 1381 bp, Arabidopsis thaliana (mouse-ear cress); identical to SEQ ID NO: 12902
  CDS (1)..(1350)

SEQ ID NO: 25005 - protein, 449 aa, Arabidopsis thaliana (mouse-ear cress); identical to SEQ ID NO: 12903

SEQ ID NO: 25006 - DNA, 1791 bp, Gallus gallus (chicken); identical to SEQ ID NO: 12904
  CDS (25)..(1263)

SEQ ID NO: 25007 - protein, 412 aa, Gallus gallus (chicken); identical to SEQ ID NO: 12905

SEQ ID NO: 25008 - DNA, 1331 bp, Escherichia coli; identical to SEQ ID NO: 12906
  CDS (10)..(1200)

SEQ ID NO: 25009 - protein, 396 aa, Escherichia coli; identical to SEQ ID NO: 12907

SEQ ID NO: 25010 - DNA, 1208 bp, Escherichia coli; identical to SEQ ID NO: 12908
  CDS (14)..(1207)

SEQ ID NO: 25011 - protein, 397 aa, Escherichia coli; identical to SEQ ID NO: 12909

SEQ ID NO: 25012 - DNA, 1266 bp, Homo sapiens; identical to SEQ ID NO: 12910
  CDS (1)..(1266)

SEQ ID NO: 25013 - protein, 421 aa, Homo sapiens; identical to SEQ ID NO: 12911

SEQ ID NO: 25014 - DNA, 1685 bp, Lotus corniculatus; identical to SEQ ID NO: 12912
  CDS (119)..(1492)

SEQ ID NO: 25015 - protein, 457 aa, Lotus corniculatus; identical to SEQ ID NO: 12913

SEQ ID NO: 25016 - DNA, 1748 bp, Moraxella sp; identical to SEQ ID NO: 12914
  CDS (340)..(1533)

SEQ ID NO: 25017 - protein, 397 aa, Moraxella sp; identical to SEQ ID NO: 12915

SEQ ID NO: 25018 - DNA, 1194 bp, Klebsiella pneumoniae; identical to SEQ ID NO: 12916
  CDS (1)..(1194)

SEQ ID NO: 25019 - protein, 397 aa, Klebsiella pneumoniae; identical to SEQ ID NO: 12917

SEQ ID NO: 25020 - DNA, 1737 bp, Canavalia lineata; identical to SEQ ID NO: 12918
  CDS (44)..(1441)

SEQ ID NO: 25021 - protein, 465 aa, Canavalia lineata; identical to SEQ ID NO: 12919

SEQ ID NO: 25022 - DNA, 1263 bp, Lupinus angustifolius; identical to SEQ ID NO: 12920
  CDS (1)..(1263)

SEQ ID NO: 25023 - protein, 420 aa, Lupinus angustifolius; identical to SEQ ID NO: 12921

SEQ ID NO: 25024 - DNA, 1753 bp, Lotus japonicus; identical to SEQ ID NO: 12922
  CDS (86)..(1342)

SEQ ID NO: 25025 - protein, 418 aa, Lotus japonicus; identical to SEQ ID NO: 12923

SEQ ID NO: 25026 - DNA, 1263 bp, Debaryomyces hansenii CBS767; identical to SEQ ID NO: 12924
  CDS (1)..(1263)

SEQ ID NO: 25027 - protein, 420 aa, Debaryomyces hansenii CBS767; identical to SEQ ID NO: 12925

SEQ ID NO: 25028 - DNA, 1296 bp, Debaryomyces hansenii CBS767; identical to SEQ ID NO: 12926
  CDS (1)..(1296)

SEQ ID NO: 25029 - protein, 431 aa, Debaryomyces hansenii CBS767; identical to SEQ ID NO: 12927

SEQ ID NO: 25030 - DNA, 1212 bp, Debaryomyces hansenii CBS767; identical to SEQ ID NO: 12928
  CDS (1)..(1212)

SEQ ID NO: 25031 - protein, 403 aa, Debaryomyces hansenii CBS767; identical to SEQ ID NO: 12929

SEQ ID NO: 25032 - DNA, 1296 bp, Yarrowia lipolytica CLIB99; identical to SEQ ID NO: 12930
  CDS (1)..(1296)

SEQ ID NO: 25033 - protein, 431 aa, Yarrowia lipolytica CLIB99; identical to SEQ ID NO: 12931

SEQ ID NO: 25034 - DNA, 1302 bp, Yarrowia lipolytica CLIB99; identical to SEQ ID NO: 12932
  CDS (1)..(1302)

SEQ ID NO: 25035 - protein, 433 aa, Yarrowia lipolytica CLIB99; identical to SEQ ID NO: 12933

SEQ ID NO: 25036 - DNA, 1266 bp, Kluyveromyces lactis NRRL Y; identical to SEQ ID NO: 12934
  CDS (1)..(1266)

SEQ ID NO: 25037 - protein, 421 aa, Kluyveromyces lactis NRRL Y; identical to SEQ ID NO: 12935

SEQ ID NO: 25038 - DNA, 1257 bp, Kluyveromyces lactis NRRL Y; identical to SEQ ID NO: 12936
  CDS (1)..(1257)

SEQ ID NO: 25039 - protein, 418 aa, Kluyveromyces lactis NRRL Y; identical to SEQ ID NO: 12937

SEQ ID NO: 25040 - DNA, 1194 bp, Erwinia carotovora subsp; identical to SEQ ID NO: 12938
  CDS (1)..(1194)

SEQ ID NO: 25041 - protein, 397 aa, Erwinia carotovora subsp; identical to SEQ ID NO: 12939

SEQ ID NO: 25042 - DNA, 1191 bp, Erwinia carotovora subsp; identical to SEQ ID NO: 12940
  CDS (1)..(1191)

SEQ ID NO: 25043 - protein, 396 aa, Erwinia carotovora subsp; identical to SEQ ID NO: 12941

SEQ ID NO: 25044 - DNA, 1232 bp, Pseudomonas putida; identical to SEQ ID NO: 12942
  CDS (10)..(1206)

SEQ ID NO: 25045 - protein, 398 aa, Pseudomonas putida; identical to SEQ ID NO: 12943

SEQ ID NO: 25046 - DNA, 1765 bp, Oryza sativa; identical to SEQ ID NO: 12944
  CDS (152)..(1450)

SEQ ID NO: 25047 - protein, 432 aa, Oryza sativa; identical to SEQ ID NO: 12945

SEQ ID NO: 25048 - DNA, 1215 bp, Acinetobacter sp; identical to SEQ ID NO: 12946
  CDS (1)..(1215)

SEQ ID NO: 25049 - protein, 404 aa, Acinetobacter sp; identical to SEQ ID NO: 12947

SEQ ID NO: 25050 - DNA, 1362 bp, Candida glabrata CBS138; identical to SEQ ID NO: 12948
  CDS (1)..(1362)

SEQ ID NO: 25051 - protein, 453 aa, Candida glabrata CBS138; identical to SEQ ID NO: 12949

SEQ ID NO: 25052 - DNA, 1260 bp, Candida glabrata CBS138; identical to SEQ ID NO: 12950
  CDS (1)..(1260)

SEQ ID NO: 25053 - protein, 419 aa, Candida glabrata CBS138; identical to SEQ ID NO: 12951

SEQ ID NO: 25054 - DNA, 1257 bp, Candida glabrata CBS138; identical to SEQ ID NO: 12952
  CDS (1)..(1257)

SEQ ID NO: 25055 - protein, 418 aa, Candida glabrata CBS138; identical to SEQ ID NO: 12953

SEQ ID NO: 25056 - DNA, 1287 bp, Staphylococcus aureus subsp; identical to SEQ ID NO: 12954
  CDS (1)..(1287)

SEQ ID NO: 25057 - protein, 428 aa, Staphylococcus aureus subsp; identical to SEQ ID NO: 12955

SEQ ID NO: 25058 - DNA, 1681 bp, Oryza sativa; identical to SEQ ID NO: 12956
  CDS (62)..(1438)

SEQ ID NO: 25059 - protein, 458 aa, Oryza sativa; identical to SEQ ID NO: 12957

SEQ ID NO: 25060 - DNA, 1182 bp, Photobacterium profundum; identical to SEQ ID NO: 12958
  CDS (1)..(1182)

SEQ ID NO: 25061 - protein, 393 aa, Photobacterium profundum; identical to SEQ ID NO: 12959

SEQ ID NO: 25062 - DNA, 1191 bp, Photobacterium profundum; identical to SEQ ID NO: 12960
  CDS (1)..(1191)

SEQ ID NO: 25063 - protein, 396 aa, Photobacterium profundum; identical to SEQ ID NO: 12961

SEQ ID NO: 25064 - DNA, 1221 bp, Parachlamydia sp; identical to SEQ ID NO: 12962
  CDS (1)..(1221)

SEQ ID NO: 25065 - protein, 406 aa, Parachlamydia sp; identical to SEQ ID NO: 12963

SEQ ID NO: 25066 - DNA, 1191 bp, Rhodopseudomonas palustris; identical to SEQ ID NO: 12964
  CDS (1)..(1191)

SEQ ID NO: 25067 - protein, 396 aa, Rhodopseudomonas palustris; identical to SEQ ID NO: 12965

SEQ ID NO: 25068 - DNA, 1194 bp, Neisseria subflava; identical to SEQ ID NO: 12966
  CDS (1)..(1194)

SEQ ID NO: 25069 - protein, 397 aa, Neisseria subflava; identical to SEQ ID NO: 12967

SEQ ID NO: 25070 - DNA, 1329 bp, Bacillus amyloliquefaciens; identical to SEQ ID NO: 12968
  CDS (1)..(1329)

SEQ ID NO: 25071 - protein, 442 aa, Bacillus amyloliquefaciens; identical to SEQ ID NO: 12969

SEQ ID NO: 25072 - DNA, 1260 bp, Ashbya gossypii; identical to SEQ ID NO: 12970
  CDS (1)..(1260)

SEQ ID NO: 25073 - protein, 419 aa, Ashbya gossypii; identical to SEQ ID NO: 12971

SEQ ID NO: 25074 - DNA, 1332 bp, Ashbya gossypii; identical to SEQ ID NO: 12972
  CDS (1)..(1332)

SEQ ID NO: 25075 - protein, 443 aa, Ashbya gossypii; identical to SEQ ID NO: 12973

SEQ ID NO: 25076 - DNA, 1690 bp, Glycine max; identical to SEQ ID NO: 12974
  CDS (263)..(1522)

SEQ ID NO: 25077 - protein, 419 aa, Glycine max; identical to SEQ ID NO: 12975

SEQ ID NO: 25078 - DNA, 1197 bp, Vibrio vulnificus; identical to SEQ ID NO: 12976
  CDS (1)..(1197)

SEQ ID NO: 25079 - protein, 398 aa, Vibrio vulnificus; identical to SEQ ID NO: 12977

SEQ ID NO: 25080 - DNA, 1200 bp, Photorhabdus luminescens; identical to SEQ ID NO: 12978
  CDS (1)..(1200)

SEQ ID NO: 25081 - protein, 399 aa, Photorhabdus luminescens; identical to SEQ ID NO: 12979

SEQ ID NO: 25082 - DNA, 1191 bp, Photorhabdus luminescens; identical to SEQ ID NO: 12980
  CDS (1)..(1191)

SEQ ID NO: 25083 - protein, 396 aa, Photorhabdus luminescens; identical to SEQ ID NO: 12981

SEQ ID NO: 25084 - DNA, 1209 bp, Chromobacterium violaceum; identical to SEQ ID NO: 12982
  CDS (1)..(1209)

SEQ ID NO: 25085 - protein, 402 aa, Chromobacterium violaceum; identical to SEQ ID NO: 12983

SEQ ID NO: 25086 - DNA, 1194 bp, Chromobacterium violaceum; identical to SEQ ID NO: 12984
  CDS (1)..(1194)

SEQ ID NO: 25087 - protein, 397 aa, Chromobacterium violaceum; identical to SEQ ID NO: 12985

SEQ ID NO: 25088 - DNA, 1233 bp, Plasmodium yoelii yoelii; identical to SEQ ID NO: 12986
  CDS (1)..(1233)

SEQ ID NO: 25089 - protein, 410 aa, Plasmodium yoelii yoelii; identical to SEQ ID NO: 12987

SEQ ID NO: 25090 - DNA, 1449 bp, Neurospora crassa; identical to SEQ ID NO: 12988
  CDS (1)..(1449)

SEQ ID NO: 25091 - protein, 482 aa, Neurospora crassa; identical to SEQ ID NO: 12989

SEQ ID NO: 25092 - DNA, 1290 bp, Neurospora crassa; identical to SEQ ID NO: 12990
  CDS (1)..(1290)

SEQ ID NO: 25093 - protein, 429 aa, Neurospora crassa; identical to SEQ ID NO: 12991

SEQ ID NO: 25094 - DNA, 1451 bp, Mus musculus; identical to SEQ ID NO: 12992
  CDS (62)..(1276)

SEQ ID NO: 25095 - protein, 404 aa, Mus musculus; identical to SEQ ID NO: 12993

SEQ ID NO: 25096 - DNA, 1194 bp, Rhodopirellula baltica; identical to SEQ ID NO: 12994
  CDS (1)..(1194)

SEQ ID NO: 25097 - protein, 397 aa, Rhodopirellula baltica; identical to SEQ ID NO: 12995

SEQ ID NO: 25098 - DNA, 1191 bp, Haemophilus ducreyi; identical to SEQ ID NO: 12996
  CDS (1)..(1191)

SEQ ID NO: 25099 - protein, 396 aa, Haemophilus ducreyi; identical to SEQ ID NO: 12997

SEQ ID NO: 25100 - DNA, 1221 bp, Candidatus Blochmannia floridanus; identical to SEQ ID NO: 12998
  CDS (1)..(1221)

SEQ ID NO: 25101 - protein, 406 aa, Candidatus Blochmannia floridanus; identical to SEQ ID NO: 12999

SEQ ID NO: 25102 - DNA, 1203 bp, Bordetella bronchiseptica; identical to SEQ ID NO: 13000
  CDS (1)..(1203)

SEQ ID NO: 25103 - protein, 400 aa, Bordetella bronchiseptica; identical to SEQ ID NO: 13001

SEQ ID NO: 25104 - DNA, 1200 bp, Bordetella bronchiseptica; identical to SEQ ID NO: 13002
  CDS (1)..(1200)

SEQ ID NO: 25105 - protein, 399 aa, Bordetella bronchiseptica; identical to SEQ ID NO: 13003

SEQ ID NO: 25106 - DNA, 1586 bp, Drosophila melanogaster; identical to SEQ ID NO: 13004
  CDS (1)..(1251)

SEQ ID NO: 25107 - protein, 416 aa, Drosophila melanogaster; identical to SEQ ID NO: 13005

SEQ ID NO: 25108 - DNA, 1191 bp, Chlamydophila caviae; identical to SEQ ID NO: 13006
  CDS (1)..(1191)

SEQ ID NO: 25109 - protein, 396 aa, Chlamydophila caviae; identical to SEQ ID NO: 13007

SEQ ID NO: 25110 - DNA, 1236 bp, Shigella flexneri; identical to SEQ ID NO: 13008
  CDS (1)..(1236)

SEQ ID NO: 25111 - protein, 411 aa, Shigella flexneri; identical to SEQ ID NO: 13009

SEQ ID NO: 25112 - DNA, 1203 bp, Xylella fastidiosa; identical to SEQ ID NO: 13010
  CDS (1)..(1203)

SEQ ID NO: 25113 - protein, 400 aa, Xylella fastidiosa; identical to SEQ ID NO: 13011

SEQ ID NO: 25114 - DNA, 1197 bp, Vibrio parahaemolyticus; identical to SEQ ID NO: 13012
  CDS (1)..(1197)

SEQ ID NO: 25115 - protein, 398 aa, Vibrio parahaemolyticus; identical to SEQ ID NO: 13013

SEQ ID NO: 25116 - DNA, 1245 bp, Vibrio parahaemolyticus; identical to SEQ ID NO: 13014
  CDS (1)..(1245)

SEQ ID NO: 25117 - protein, 414 aa, Vibrio parahaemolyticus; identical to SEQ ID NO: 13015

SEQ ID NO: 25118 - DNA, 1200 bp, Pseudomonas syringae; identical to SEQ ID NO: 13016
  CDS (1)..(1200)

SEQ ID NO: 25119 - protein, 399 aa, Pseudomonas syringae; identical to SEQ ID NO: 13017

SEQ ID NO: 25120 - DNA, 1197 bp, Pseudomonas syringae; identical to SEQ ID NO: 13018
  CDS (1)..(1197)

SEQ ID NO: 25121 - protein, 398 aa, Pseudomonas syringae; identical to SEQ ID NO: 13019

SEQ ID NO: 25122 - DNA, 1197 bp, Pseudomonas putida; identical to SEQ ID NO: 13020
  CDS (1)..(1197)

SEQ ID NO: 25123 - protein, 398 aa, Pseudomonas putida; identical to SEQ ID NO: 13021

SEQ ID NO: 25124 - DNA, 1197 bp, Pseudomonas putida; identical to SEQ ID NO: 13022
  CDS (1)..(1197)

SEQ ID NO: 25125 - protein, 398 aa, Pseudomonas putida; identical to SEQ ID NO: 13023

SEQ ID NO: 25126 - DNA, 1305 bp, Staphylococcus epidermidis; identical to SEQ ID NO: 13024
  CDS (19)..(1305)

SEQ ID NO: 25127 - protein, 428 aa, Staphylococcus epidermidis; identical to SEQ ID NO: 13025

SEQ ID NO: 25128 - DNA, 1206 bp, Yersinia pestis; identical to SEQ ID NO: 13026
  CDS (1)..(1206)

SEQ ID NO: 25129 - protein, 401 aa, Yersinia pestis; identical to SEQ ID NO: 13027

SEQ ID NO: 25130 - DNA, 1197 bp, Wigglesworthia glossinidia brevipalpis; identical to SEQ ID NO: 13028
  CDS (1)..(1197)

SEQ ID NO: 25131 - protein, 398 aa, Wigglesworthia glossinidia brevipalpis; identical to SEQ ID NO: 13029

SEQ ID NO: 25132 - DNA, 1200 bp, Vibrio vulnificus; identical to SEQ ID NO: 13030
  CDS (1)..(1200)

SEQ ID NO: 25133 - protein, 399 aa, Vibrio vulnificus; identical to SEQ ID NO: 13031

SEQ ID NO: 25134 - DNA, 1191 bp, Shewanella oneidensis; identical to SEQ ID NO: 13032
  CDS (1)..(1191)

SEQ ID NO: 25135 - protein, 396 aa, Shewanella oneidensis; identical to SEQ ID NO: 13033

SEQ ID NO: 25136 - DNA, 1194 bp, Shewanella oneidensis; identical to SEQ ID NO: 13034
  CDS (1)..(1194)

SEQ ID NO: 25137 - protein, 397 aa, Shewanella oneidensis; identical to SEQ ID NO: 13035

SEQ ID NO: 25138 - DNA, 1236 bp, Escherichia coli O6; identical to SEQ ID NO: 13036
  CDS (1)..(1236)

SEQ ID NO: 25139 - protein, 411 aa, Escherichia coli O6; identical to SEQ ID NO: 13037

SEQ ID NO: 25140 - DNA, 1797 bp, Phaseolus vulgaris; identical to SEQ ID NO: 13038
  CDS (176)..(1561)

SEQ ID NO: 25141 - protein, 461 aa, Phaseolus vulgaris; identical to SEQ ID NO: 13039

SEQ ID NO: 25142 - DNA, 1179 bp, Ruegeria sp; identical to SEQ ID NO: 13040
  CDS (1)..(1179)

SEQ ID NO: 25143 - protein, 392 aa, Ruegeria sp; identical to SEQ ID NO: 13041

SEQ ID NO: 25144 - DNA, 1203 bp, Xanthomonas campestris; identical to SEQ ID NO: 13042
  CDS (1)..(1203)

SEQ ID NO: 25145 - protein, 400 aa, Xanthomonas campestris; identical to SEQ ID NO: 13043

SEQ ID NO: 25146 - DNA, 1203 bp, Xanthomonas axonopodis; identical to SEQ ID NO: 13044
  CDS (1)..(1203)

SEQ ID NO: 25147 - protein, 400 aa, Xanthomonas axonopodis; identical to SEQ ID NO: 13045

SEQ ID NO: 25148 - DNA, 1248 bp, Fusobacterium nucleatum; identical to SEQ ID NO: 13046
  CDS (1)..(1248)

SEQ ID NO: 25149 - protein, 415 aa, Fusobacterium nucleatum; identical to SEQ ID NO: 13047

SEQ ID NO: 25150 - DNA, 1197 bp, Ralstonia solanacearum; identical to SEQ ID NO: 13048
  CDS (1)..(1197)

SEQ ID NO: 25151 - protein, 398 aa, Ralstonia solanacearum; identical to SEQ ID NO: 13049

SEQ ID NO: 25152 - DNA, 1369 bp, Brugia malayi; identical to SEQ ID NO: 13050
  CDS (23)..(1237)

SEQ ID NO: 25153 - protein, 404 aa, Brugia malayi; identical to SEQ ID NO: 13051

SEQ ID NO: 25154 - DNA, 1284 bp, Giardia lamblia; identical to SEQ ID NO: 13052
  CDS (1)..(1284)

SEQ ID NO: 25155 - protein, 427 aa, Giardia lamblia; identical to SEQ ID NO: 13053

SEQ ID NO: 25156 - DNA, 1173 bp, Trypanosoma brucei; identical to SEQ ID NO: 13054
  CDS (1)..(1173)

SEQ ID NO: 25157 - protein, 390 aa, Trypanosoma brucei; identical to SEQ ID NO: 13055

SEQ ID NO: 25158 - DNA, 1212 bp, Trypanosoma brucei; identical to SEQ ID NO: 13056
  CDS (1)..(1212)

SEQ ID NO: 25159 - protein, 403 aa, Trypanosoma brucei; identical to SEQ ID NO: 13057

SEQ ID NO: 25160 - DNA, 1218 bp, Crithidia fasciculata; identical to SEQ ID NO: 13058
  CDS (1)..(1218)

SEQ ID NO: 25161 - protein, 405 aa, Crithidia fasciculata; identical to SEQ ID NO: 13059

SEQ ID NO: 25162 - DNA, 1185 bp, Rhizobium loti; identical to SEQ ID NO: 13060
  CDS (1)..(1185)

SEQ ID NO: 25163 - protein, 394 aa, Rhizobium loti; identical to SEQ ID NO: 13061

SEQ ID NO: 25164 - DNA, 1191 bp, Pasteurella multocida; identical to SEQ ID NO: 13062
  CDS (1)..(1191)

SEQ ID NO: 25165 - protein, 396 aa, Pasteurella multocida; identical to SEQ ID NO: 13063

SEQ ID NO: 25166 - DNA, 1302 bp, Bacillus subtilis; identical to SEQ ID NO: 13064
  CDS (1)..(1302)

SEQ ID NO: 25167 - protein, 433 aa, Bacillus subtilis; identical to SEQ ID NO: 13065

SEQ ID NO: 25168 - DNA, 1203 bp, Chlamydia muridarum; identical to SEQ ID NO: 13066
  CDS (1)..(1203)

SEQ ID NO: 25169 - protein, 400 aa, Chlamydia muridarum; identical to SEQ ID NO: 13067

SEQ ID NO: 25170 - DNA, 1191 bp, Aeromonas hydrophila; identical to SEQ ID NO: 13068
  CDS (1)..(1191)

SEQ ID NO: 25171 - protein, 396 aa, Aeromonas hydrophila; identical to SEQ ID NO: 13069

SEQ ID NO: 25172 - DNA, 1574 bp, Drosophila melanogaster; identical to SEQ ID NO: 13070
  CDS (106)..(1380)

SEQ ID NO: 25173 - protein, 424 aa, Drosophila melanogaster; identical to SEQ ID NO: 13071

SEQ ID NO: 25174 - DNA, 1535 bp, Arabidopsis thaliana; identical to SEQ ID NO: 13072
  CDS (96)..(1313)

SEQ ID NO: 25175 - protein, 405 aa, Arabidopsis thaliana; identical to SEQ ID NO: 13073

SEQ ID NO: 25176 - DNA, 1490 bp, Arabidopsis thaliana; identical to SEQ ID NO: 13074
  CDS (48)..(1259)

SEQ ID NO: 25177 - protein, 403 aa, Arabidopsis thaliana; identical to SEQ ID NO: 13075

SEQ ID NO: 25178 - DNA, 2001 bp, Sus scrofa; identical to SEQ ID NO: 13076
  CDS (54)..(1295)

SEQ ID NO: 25179 - protein, 413 aa, Sus scrofa; identical to SEQ ID NO: 13077

SEQ ID NO: 25180 - DNA, 1194 bp, Salmonella typhimurium; identical to SEQ ID NO: 13078
  CDS (1)..(1194)

SEQ ID NO: 25181 - protein, 397 aa, Salmonella typhimurium; identical to SEQ ID NO: 13079

SEQ ID NO: 25182 - DNA, 2032 bp, Xenopus tropicalis; identical to SEQ ID NO: 13080
  CDS (30)..(1265)

SEQ ID NO: 25183 - protein, 411 aa, Xenopus tropicalis; identical to SEQ ID NO: 13081

SEQ ID NO: 25184 - DNA, 26 bp, Artificial sequence
  (1)..(26): primer
atgaacaaaagaacacaggaatacaa

SEQ ID NO: 25185 - DNA, 28 bp, Artificial sequence
  (1)..(28): primer
ttacaatttagcttcaatagtatagaag

SEQ ID NO: 25186 - protein, 437 aa, Artificial sequence; identical to SEQ ID NO: 13495
  Variant (2)..(16): xaa in position 2 to 16 is any amino acid
  Variant (18)..(21): xaa in position 18 to 21 is any amino acid
  Variant (23)..(23): xaa in position 23 is any amino acid
  Variant (26)..(27): xaa in position 26 to 27 is any amino acid
  Variant (29)..(29): xaa in position 29 is any amino acid
  Variant (31)..(42): xaa in position 31 to 42 is any amino acid
  Variant (44)..(45): xaa in position 44 to 45 is any amino acid
  Variant (47)..(61): xaa in position 47 to 61 is any amino acid
  Variant (63)..(66): xaa in position 63 to 66 is any amino acid
  Variant (68)..(77): xaa in position 68 to 77 is any amino acid
  Variant (79)..(96): xaa in position 79 to 96 is any amino acid
  Variant (98)..(101): xaa in position 98 to 101 is any amino acid
  Variant (103)..(105): xaa in position 103 to 105 is any amino acid
  Variant (107)..(107): xaa in position 107 is any amino acid
  Variant (111)..(137): xaa in position 111 to 137 is any amino acid
  Variant (139)..(139): xaa in position 139 is any amino acid
  Variant (141)..(141): xaa in position 141 is any amino acid
  Variant (144)..(146): xaa in position 144 to 146 is any amino acid
  Variant (148)..(150): xaa in position 148 to 150 is any amino acid
  Variant (152)..(157): xaa in position 152 to 157 is any amino acid
  Variant (159)..(159): xaa in position 159 is any amino acid
  Variant (161)..(195): xaa in position 161 to 195 is any amino acid
  Variant (198)..(198): xaa in position 198 is any amino acid
  Variant (200)..(200): xaa in position 200 is any amino acid
  Variant (206)..(206): xaa in position 206 is any amino acid
  Variant (208)..(212): xaa in position 208 to 212 is any amino acid
  Variant (214)..(234): xaa in position 214 to 234 is any amino acid
  Variant (236)..(236): xaa in position 236 is any amino acid
  Variant (242)..(243): xaa in position 242 to 243 is any amino acid
  Variant (245)..(248): xaa in position 245 to 248 is any amino acid
  Variant (251)..(253): xaa in position 251 to 253 is any amino acid
  Variant (255)..(273): xaa in position 255 to 273 is any amino acid
  Variant (275)..(276): xaa in position 275 to 276 is any amino acid
  Variant (278)..(280): xaa in position 278 to 280 is any amino acid
  Variant (283)..(283): xaa in position 283 is any amino acid
  Variant (286)..(286): xaa in position 286 is any amino acid
  Variant (288)..(323): xaa in position 288 to 323 is any amino acid
  Variant (325)..(327): xaa in position 325 to 327 is any amino acid
  Variant (329)..(329): xaa in position 329 is any amino acid
  Variant (332)..(333): xaa in position 332 to 333 is any amino acid
  Variant (335)..(341): xaa in position 335 to 341 is any amino acid
  Variant (343)..(347): xaa in position 343 to 347 is any amino acid
  Variant (349)..(351): xaa in position 349 to 351 is any amino acid
  Variant (353)..(358): xaa in position 353 to 358 is any amino acid
  Variant (360)..(361): xaa in position 360 to 361 is any amino acid
  Variant (363)..(366): xaa in position 363 to 366 is any amino acid
  Variant (368)..(373): xaa in position 368 to 373 is any amino acid
  Variant (375)..(393): xaa in position 375 to 393 is any amino acid
  Variant (395)..(395): xaa in position 395 is any amino acid
  Variant (399)..(401): xaa in position 399 to 401 is any amino acid
  Variant (403)..(406): xaa in position 403 to 406 is any amino acid
  Variant (408)..(421): xaa in position 408 to 421 is any amino acid
  Variant (423)..(426): xaa in position 423 to 426 is any amino acid
  Variant (428)..(431): xaa in position 428 to 431 is any amino acid
  Variant (433)..(436): xaa in position 433 to 436 is any amino acid

SEQ ID NO: 25187 - protein, 55 aa, Artificial sequence; identical to SEQ ID NO: 13492
  Variant (1)..(1): xaa in position 1 is Gly, Ala or Val
  Variant (2)..(2): xaa in position 2 is Thr or Ser
  Variant (3)..(3): xaa in position 3 is Gly or Asn
  Variant (4)..(4): xaa in position 4 is Ala or Ser
  Variant (5)..(5): xaa in position 5 is Leu, Cys, Ile or Phe
  Variant (6)..(18): xaa in position 6 to 18 is any amino acid
  Variant (19)..(27): xaa in position 19 to 27 is any or no amino acid
  Variant (28)..(28): xaa in position 28 is Val, Ile or Leu
  Variant (29)..(30): xaa in position 29 to 30 is any amino acid
  Variant (31)..(31): xaa in position 31 is Ser, Pro or Thr
  Variant (32)..(34): xaa in position 32 to 34 is any amino acid
  Variant (35)..(35): xaa in position 35 is Trp or Tyr
  Variant (36)..(37): xaa in position 36 to 37 is any amino acid
  Variant (38)..(38): xaa in position 38 is His or Tyr
  Variant (39)..(40): xaa in position 39 to 40 is any amino acid
  Variant (41)..(41): xaa in position 41 is Ile, Val, Leu or Met
  Variant (42)..(51): xaa in position 42 to 51 is any amino acid
  Variant (52)..(52): xaa in position 52 is any or no amino acid
  Variant (53)..(53): xaa in position 53 is Tyr or Phe
  Variant (54)..(55): xaa in position 54 to 55 is any amino acid

SEQ ID NO: 25188 - protein, 93 aa, Artificial sequence; identical to SEQ ID NO: 13493
  Variant (1)..(1): xaa in position 1 is Leu, Val, Ile or Met
  Variant (2)..(2): xaa in position 2 is Leu, Phe, Ile or Val
  Variant (3)..(3): xaa in position 3 is His, Leu or Gln
  Variant (4)..(5): xaa in position 4 to 5 is any amino acid
  Variant (6)..(6): xaa in position 6 is Cys, Ala or Pro
  Variant (7)..(7): xaa in position 7 is His or Asn
  Variant (10)..(10): xaa in position 10 is Thr or Ser
  Variant (12)..(13): xaa in position 12 to 13 is any amino acid
  Variant (14)..(14): xaa in position 14 is Pro, Leu, Ile, Met or Phe
  Variant (15)..(18): xaa in position 15 to 18 is any amino acid
  Variant (19)..(19): xaa in position 19 is Trp or Val
  Variant (20)..(21): xaa in position 20 to 21 is any amino acid
  Variant (22)..(22): xaa in position 22 is Ile, Leu or Val
  Variant (23)..(33): xaa in position 23 to 33 is any amino acid
  Variant (34)..(38): xaa in position 34 to 38 is any or no amino acid
  Variant (39)..(39): xaa in position 39 is Phe, Leu, Ile or Val
  Variant (40)..(40): xaa in position 40 is any amino acid
  Variant (42)..(42): xaa in position 42 is any amino acid
  Variant (45)..(45): xaa in position 45 is Gln, Tyr, Leu or Phe
  Variant (47)..(47): xaa in position 47 is Phe, Leu or Tyr
  Variant (48)..(53): xaa in position 48 to 53 is any amino acid
  Variant (54)..(54): xaa in position 54 is any or no amino acid
  Variant (55)..(55): xaa in position 55 is Asp, Gln or Glu
  Variant (56)..(65): xaa in position 56 to 65 is any amino acid
  Variant (66)..(77): xaa in position 66 to 77 is any or no amino acid
  Variant (78)..(78): xaa in position 78 is Ala, Cys, Ser, Thr, Ile or Leu
  Variant (79)..(79): xaa in position 79 is any amino acid
  Variant (80)..(80): xaa in position 80 is Ser or Gly
  Variant (81)..(81): xaa in position 81 is Phe, Tyr, Cys, Ala or Leu
  Variant (82)..(82): xaa in position 82 is Ser, Ala or Thr
  Variant (84)..(84): xaa in position 84 is Asn, Ser, Ile or Glu
  Variant (85)..(85): xaa in position 85 is any amino acid
  Variant (86)..(86): xaa in position 86 is Gly, Ser or Phe
  Variant (87)..(87): xaa in position 87 is Leu, Met, Ile or Ala
  Variant (88)..(88): xaa in position 88 is Tyr or Trp
  Variant (89)..(89): xaa in position 89 is Gly, Asn, Ala, Arg or Ser
  Variant (90)..(90): xaa in position 90 is any amino acid
  Variant (92)..(92): xaa in position 92 is Val, Ile, Ala, Thr or Cys

SEQ ID NO: 25189 - protein, 120 aa, Artificial sequence; identical to SEQ ID NO: 13494
  Variant (1)..(1): xaa in position 1 is Leu, Val, Met, Ile or Thr
  Variant (2)..(5): xaa in position 2 to 5 is any amino acid
  Variant (6)..(6): xaa in position 6 is Arg or Gln
  Variant (7)..(9): xaa in position 7 to 9 is any amino acid
  Variant (10)..(10): xaa in position 10 is Ser or Thr
  Variant (11)..(11): xaa in position 11 is Asn, Ser, Met or Thr
  Variant (12)..(12): xaa in position 12 is Pro, Ala, Ser or Gly
  Variant (13)..(13): xaa in position 13 is Pro, Ala or Ser
  Variant (14)..(15): xaa in position 14 to 15 is any amino acid
  Variant (16)..(16): xaa in position 16 is Gly, Ser or Thr
  Variant (17)..(18): xaa in position 17 to 18 is any amino acid
  Variant (19)..(19): xaa in position 19 is Ile, Val, Leu, Ala, Thr or Phe
  Variant (20)..(20): xaa in position 20 is Val, Ala or Ile
  Variant (21)..(22): xaa in position 21 to 22 is any amino acid
  Variant (23)..(23): xaa in position 23 is Ile, Val, Thr, Ala or Leu
  Variant (24)..(24): xaa in position 24 is Leu, Val, Met or Phe
  Variant (25)..(28): xaa in position 25 to 28 is any amino acid
  Variant (29)..(29): xaa in position 29 is any or no amino acid
  Variant (30)..(30): xaa in position 30 is Leu, Met or Phe
  Variant (31)..(33): xaa in position 31 to 33 is any amino acid
  Variant (34)..(34): xaa in position 34 is Trp, Phe, Lys or Ile
  Variant (35)..(36): xaa in position 35 to 36 is any amino acid
  Variant (37)..(37): xaa in position 37 is Glu, Asp, Asn, Ser or Lys
  Variant (38)..(38): xaa in position 38 is Leu, Val, Met or Ile
  Variant (39)..(40): xaa in position 39 to 40 is any amino acid
  Variant (41)..(41): xaa in position 41 is Met, Ile, Leu or Val
  Variant (42)..(43): xaa in position 42 to 43 is any amino acid
  Variant (44)..(44): xaa in position 44 is Arg, Ser or His
  Variant (45)..(45): xaa in position 45 is Ile, Leu, Met, Tyr, Val or Ala
  Variant (46)..(47): xaa in position 46 to 47 is any amino acid
  Variant (48)..(48): xaa in position 48 is Met, Ile, Leu, Val, Thr or Arg
  Variant (49)..(49): xaa in position 49 is Arg or Lys
  Variant (50)..(51): xaa in position 50 to 51 is any amino acid
  Variant (52)..(52): xaa in position 52 is Leu, Phe, Met, Val or Ile
  Variant (53)..(60): xaa in position 53 to 60 is any amino acid
  Variant (61)..(69): xaa in position 61 to 69 is any or no amino acid
  Variant (70)..(70): xaa in position 70 is Trp, Phe or Leu
  Variant (71)..(72): xaa in position 71 to 72 is any amino acid
  Variant (73)..(73): xaa in position 73 is Ile, Leu, Val, Tyr or Phe
  Variant (74)..(77): xaa in position 74 to 77 is any amino acid
  Variant (79)..(79): xaa in position 79 is Met, Phe, Tyr or Leu
  Variant (81)..(83): xaa in position 81 to 83 is any amino acid
  Variant (84)..(84): xaa in position 84 is Gly, Lys, Pro or Arg
  Variant (85)..(97): xaa in position 85 to 97 is any amino acid
  Variant (98)..(102): xaa in position 98 to 102 is any or no amino acid
  Variant (103)..(103): xaa in position 103 is Ile or Val
  Variant (104)..(104): xaa in position 104 is Tyr, Gly or Phe
  Variant (105)..(108): xaa in position 105 to 108 is any amino acid
  Variant (109)..(109): xaa in position 109 is Gly, Ser or Asn
  Variant (110)..(113): xaa in position 110 to 113 is any or no amino acid
  Variant (115)..(115): xaa in position 115 is Ile, Met, Val, Ala, Phe or Leu
  Variant (116)..(116): xaa in position 116 is any amino acid
  Variant (117)..(117): xaa in position 117 is Val, Met, Leu, Ile or Phe
  Variant (118)..(118): xaa in position 118 is Ala, Ser, Cys or Asn
  Variant (119)..(119): xaa in position 119 is Gly, Ala, Cys or Ser
  Variant (120)..(120): xaa in position 120 is Leu, Ile, Val or Met

SEQ ID NO: 25190 - DNA, 1518 bp, Saccharomyces cerevisiae; identical to SEQ ID NO: 2533
  CDS (1)..(1518)

SEQ ID NO: 25191 - protein, 505 aa, Saccharomyces cerevisiae; identical to SEQ ID NO: 2534

SEQ ID NO: 25192 - DNA, 1548 bp, Mus musculus (house mouse); identical to SEQ ID NO: 2535
  CDS (1)..(1548)

SEQ ID NO: 25193 - protein, 515 aa, Mus musculus (house mouse); identical to SEQ ID NO: 2536

SEQ ID NO: 25194 - DNA, 1593 bp, Fugu rubripes (Japanese pufferfish); identical to SEQ ID NO: 2537
  CDS (1)..(1593)

SEQ ID NO: 25195 - protein, 530 aa, Fugu rubripes (Japanese pufferfish); identical to SEQ ID NO: 2538

SEQ ID NO: 25196 - DNA, 1506 bp, Vibrio cholerae; identical to SEQ ID NO: 2539
  CDS (1)..(1506)

SEQ ID NO: 25197 - protein, 501 aa, Vibrio cholerae; identical to SEQ ID NO: 2540

SEQ ID NO: 25198 - DNA, 1470 bp, Pseudomonas aeruginosa; identical to SEQ ID NO: 2541
  CDS (1)..(1470)

SEQ ID NO: 25199 - protein, 489 aa, Pseudomonas aeruginosa; identical to SEQ ID NO: 2542

SEQ ID NO: 25200 - DNA, 1485 bp, Staphylococcus aureus; identical to SEQ ID NO: 2543
  CDS (1)..(1485)

SEQ ID NO: 25201 - protein, 494 aa, Staphylococcus aureus; identical to SEQ ID NO: 2544

SEQ ID NO: 25202 - DNA, 1488 bp, Streptococcus pneumoniae; identical to SEQ ID NO: 2545
  CDS (1)..(1488)

SEQ ID NO: 25203 - protein, 495 aa, Streptococcus pneumoniae; identical to SEQ ID NO: 2546

SEQ ID NO: 25204 - DNA, 1476 bp, Salmonella enterica subsp. enterica serovar Typhi; identical to SEQ ID NO: 2547
  CDS (1)..(1476)

SEQ ID NO: 25205 - protein, 491 aa, Salmonella enterica subsp. enterica serovar Typhi; identical to SEQ ID NO: 2548

SEQ ID NO: 25206 - DNA, 1476 bp, Agrobacterium tumefaciens; identical to SEQ ID NO: 2549
  CDS (1)..(1476)

SEQ ID NO: 25207 - protein, 491 aa, Agrobacterium tumefaciens; identical to SEQ ID NO: 2550

SEQ ID NO: 25208 - DNA, 1530 bp, Nostoc sp. PCC 7120; identical to SEQ ID NO: 2551
  CDS (1)..(1530)

SEQ ID NO: 25209 - protein, 509 aa, Nostoc sp. PCC 7120; identical to SEQ ID NO: 2552

SEQ ID NO: 25210 - DNA, 1386 bp, Agrobacterium tumefaciens; identical to SEQ ID NO: 2553
  CDS (1)..(1386)

SEQ ID NO: 25211 - protein, 461 aa, Agrobacterium tumefaciens; identical to SEQ ID NO: 2554

SEQ ID NO: 25212 - DNA, 1476 bp, Brucella melitensis; identical to SEQ ID NO: 2555
  CDS (1)..(1476)

SEQ ID NO: 25213 - protein, 491 aa, Brucella melitensis; identical to SEQ ID NO: 2556

SEQ ID NO: 25214 - DNA, 1458 bp, Zymomonas mobilis; identical to SEQ ID NO: 2557
  CDS (1)..(1458)

SEQ ID NO: 25215 - protein, 485 aa, Zymomonas mobilis; identical to SEQ ID NO: 2558

SEQ ID NO: 25216 - DNA, 1470 bp, Bacillus subtilis; identical to SEQ ID NO: 2559
  CDS (1)..(1470)

SEQ ID NO: 25217 - protein, 489 aa, Bacillus subtilis; identical to SEQ ID NO: 2560

SEQ ID NO: 25218 - DNA, 1401 bp, Mycobacterium tuberculosis; identical to SEQ ID NO: 2561
  CDS (1)..(1401)

SEQ ID NO: 25219 - protein, 466 aa, Mycobacterium tuberculosis; identical to SEQ ID NO: 2562

SEQ ID NO: 25220 - DNA, 1545 bp, Mycobacterium tuberculosis; identical to SEQ ID NO: 2563
  CDS (1)..(1545)

SEQ ID NO: 25221 - protein, 514 aa, Mycobacterium tuberculosis; identical to SEQ ID NO: 2564

SEQ ID NO: 25222 - DNA, 1320 bp, Chlamydia trachomatis; identical to SEQ ID NO: 2565
  CDS (1)..(1320)

SEQ ID NO: 25223 - protein, 439 aa, Chlamydia trachomatis; identical to SEQ ID NO: 2566

SEQ ID NO: 25224 - DNA, 1773 bp, Deinococcus radiodurans; identical to SEQ ID NO: 2567
  CDS (1)..(1773)

SEQ ID NO: 25225 - protein, 590 aa, Deinococcus radiodurans; identical to SEQ ID NO: 2568

SEQ ID NO: 25226 - DNA, 1467 bp, Pseudomonas aeruginosa; identical to SEQ ID NO: 2569
  CDS (1)..(1467)

SEQ ID NO: 25227 - protein, 488 aa, Pseudomonas aeruginosa; identical to SEQ ID NO: 2570

SEQ ID NO: 25228 - DNA, 1422 bp, Caulobacter crescentus; identical to SEQ ID NO: 2571
  CDS (1)..(1422)

SEQ ID NO: 25229 - protein, 473 aa, Caulobacter crescentus; identical to SEQ ID NO: 2572

SEQ ID NO: 25230 - DNA, 1437 bp, Borrelia burgdorferi (Lyme disease spirochete); identical to SEQ ID NO: 2573
  CDS (1)..(1437)

SEQ ID NO: 25231 - protein, 478 aa, Borrelia burgdorferi (Lyme disease spirochete); identical to SEQ ID NO: 2574

SEQ ID NO: 25232 - DNA, 1539 bp, Chlamydophila pneumoniae, Chlamydia pneumoniae; identical to SEQ ID NO: 2575
  CDS (1)..(1539)

SEQ ID NO: 25233 - protein, 512 aa, Chlamydophila pneumoniae, Chlamydia pneumoniae; identical to SEQ ID NO: 2576

SEQ ID NO: 25234 - DNA, 1476 bp, Escherichia coli; identical to SEQ ID NO: 2577
  CDS (1)..(1476)

SEQ ID NO: 25235 - protein, 491 aa, Escherichia coli; identical to SEQ ID NO: 2578

SEQ ID NO: 25236 - DNA, 1548 bp, Treponema pallidum subsp. pallidum (syphilis spirochete); identical to SEQ ID NO: 2579
  CDS (1)..(1548)

SEQ ID NO: 25237 - protein, 515 aa, Treponema pallidum subsp. pallidum (syphilis spirochete); identical to SEQ ID NO: 2580

SEQ ID NO: 25238 - DNA, 1476 bp, Buchnera sp; identical to SEQ ID NO: 2581
  CDS (1)..(1476)

SEQ ID NO: 25239 - protein, 491 aa, Buchnera sp; identical to SEQ ID NO: 2582

SEQ ID NO: 25240 - DNA, 1512 bp, Lactococcus lactis subsp. lactis; identical to SEQ ID NO: 2583
  CDS (1)..(1512)

SEQ ID NO: 25241 - protein, 503 aa, Lactococcus lactis subsp. lactis; identical to SEQ ID NO: 2584

SEQ ID NO: 25242 - DNA, 1572 bp, Drosophila melanogaster; identical to SEQ ID NO: 2585
  CDS (1)..(1572)

SEQ ID NO: 25243 - protein, 523 aa, Drosophila melanogaster; identical to SEQ ID NO: 2586

SEQ ID NO: 25244 - DNA, 1575 bp, Synechococcus sp; identical to SEQ ID NO: 2587
  CDS (1)..(1575)

SEQ ID NO: 25245 - protein, 524 aa, Synechococcus sp; identical to SEQ ID NO: 2588

SEQ ID NO: 25246 - DNA, 1485 bp, Haemophilus influenzae; identical to SEQ ID NO: 2589
  CDS (1)..(1485)

SEQ ID NO: 25247 - protein, 494 aa, Haemophilus influenzae; identical to SEQ ID NO: 2590

SEQ ID NO: 25248 - DNA, 1446 bp, Neisseria meningitidis; identical to SEQ ID NO: 2591
  CDS (1)..(1446)

SEQ ID NO: 25249 - protein, 481 aa, Neisseria meningitidis; identical to SEQ ID NO: 2592

SEQ ID NO: 25250 - DNA, 1278 bp, Helicobacter pylori; identical to SEQ ID NO: 2593
  CDS (1)..(1278)

SEQ ID NO: 25251 - protein, 425 aa, Helicobacter pylori; identical to SEQ ID NO: 2594

SEQ ID NO: 25252 - DNA, 1434 bp, Xylella fastidiosa; identical to SEQ ID NO: 2595
  CDS (1)..(1434)

SEQ ID NO: 25253 - protein, 477 aa, Xylella fastidiosa; identical to SEQ ID NO: 2596

SEQ ID NO: 25254 - DNA, 1296 bp, Aquifex aeolicus; identical to SEQ ID NO: 2597
  CDS (1)..(1296)

SEQ ID NO: 25255 - protein, 431 aa, Aquifex aeolicus; identical to SEQ ID NO: 2598

SEQ ID NO: 25256 - DNA, 1491 bp, Thermotoga maritima; identical to SEQ ID NO: 2599
  CDS (1)..(1491)

SEQ ID NO: 25257 - protein, 496 aa, Thermotoga maritima; identical to SEQ ID NO: 2600

SEQ ID NO: 25258 - DNA, 1494 bp, Kluyveromyces marxianus var. lactis, Candida sphaerica; identical to SEQ ID NO: 2601
  CDS (1)..(1494)

SEQ ID NO: 25259 - protein, 497 aa, Kluyveromyces marxianus var. lactis, Candida sphaerica; identical to SEQ ID NO: 2602

SEQ ID NO: 25260 - DNA, 2813 bp, Erwinia chrysanthemi; identical to SEQ ID NO: 2603
  CDS (322)..(1797)

SEQ ID NO: 25261 - protein, 491 aa, Erwinia chrysanthemi; identical to SEQ ID NO: 2604

SEQ ID NO: 25262 - DNA, 3244 bp, Plasmodium falciparum; identical to SEQ ID NO: 2605
  CDS (184)..(2916)

SEQ ID NO: 25263 - protein, 910 aa, Plasmodium falciparum; identical to SEQ ID NO: 2606

SEQ ID NO: 25264 - DNA, 1785 bp, Medicago sativa (alfalfa); identical to SEQ ID NO: 2607
  CDS (38)..(1585)

SEQ ID NO: 25265 - protein, 515 aa, Medicago sativa (alfalfa); identical to SEQ ID NO: 2608

SEQ ID NO: 25266 - DNA, 1689 bp, Solanum tuberosum (potato); identical to SEQ ID NO: 2609
  CDS (46)..(1581)

SEQ ID NO: 25267 - protein, 511 aa, Solanum tuberosum (potato); identical to SEQ ID NO: 2610

SEQ ID NO: 25268 - DNA, 1530 bp, Synechocystis sp; identical to SEQ ID NO: 2611
  CDS (1)..(1530)

SEQ ID NO: 25269 - protein, 509 aa, Synechocystis sp; identical to SEQ ID NO: 2612

SEQ ID NO: 25270 - DNA, 1953 bp, Nicotiana tabacum (common tobacco); identical to SEQ ID NO: 2613
  CDS (43)..(1824)

SEQ ID NO: 25271 - protein, 593 aa, Nicotiana tabacum (common tobacco); identical to SEQ ID NO: 2614

SEQ ID NO: 25272 - DNA, 1869 bp, Nicotiana tabacum (common tobacco); identical to SEQ ID NO: 2615
  CDS (22)..(1788)

SEQ ID NO: 25273 - protein, 588 aa, Nicotiana tabacum (common tobacco); identical to SEQ ID NO: 2616

SEQ ID NO: 25274 - DNA, 2058 bp, Solanum tuberosum (potato); identical to SEQ ID NO: 2617
  CDS (41)..(1774)

SEQ ID NO: 25275 - protein, 577 aa, Solanum tuberosum (potato); identical to SEQ ID NO: 2618

SEQ ID NO: 25276 - DNA, 2049 bp, Spinacia oleracea (spinach); identical to SEQ ID NO: 2619
  CDS (147)..(1871)

SEQ ID NO: 25277 - protein, 574 aa, Spinacia oleracea (spinach); identical to SEQ ID NO: 2620

SEQ ID NO: 25278 - DNA, 2359 bp, Petroselinum crispum (parsley); identical to SEQ ID NO: 2621
  CDS (172)..(1986)

SEQ ID NO: 25279 - protein, 604 aa, Petroselinum crispum (parsley); identical to SEQ ID NO: 2622

SEQ ID NO: 25280 - DNA, 1848 bp, Petroselinum crispum (parsley); identical to SEQ ID NO: 2623
  CDS (41)..(1528)

SEQ ID NO: 25281 - protein, 495 aa, Petroselinum crispum (parsley); identical to SEQ ID NO: 2624

SEQ ID NO: 25282 - DNA, 1957 bp, Petroselinum crispum (parsley); identical to SEQ ID NO: 2625
  CDS (74)..(1678)

SEQ ID NO: 25283 - protein, 534 aa, Petroselinum crispum (parsley); identical to SEQ ID NO: 2626

SEQ ID NO: 25284 - DNA, 1569 bp, Caenorhabditis elegans; identical to SEQ ID NO: 2627
  CDS (1)..(1569)

SEQ ID NO: 25285 - protein, 522 aa, Caenorhabditis elegans; identical to SEQ ID NO: 2628

SEQ ID NO: 25286 - DNA, 1779 bp, Streptomyces coelicolor; identical to SEQ ID NO: 2629
  CDS (1)..(1779)

SEQ ID NO: 25287 - protein, 592 aa, Streptomyces coelicolor; identical to SEQ ID NO: 2630

SEQ ID NO: 25288 - DNA, 1524 bp, Streptomyces coelicolor; identical to SEQ ID NO: 2631
  CDS (1)..(1524)

SEQ ID NO: 25289 - protein, 507 aa, Streptomyces coelicolor; identical to SEQ ID NO: 2632

SEQ ID NO: 25290 - DNA, 1422 bp, Schizosaccharomyces pombe; identical to SEQ ID NO: 2633
  CDS (1)..(1422)

SEQ ID NO: 25291 - protein, 473 aa, Schizosaccharomyces pombe; identical to SEQ ID NO: 2634

SEQ ID NO: 25292 - DNA, 1503 bp, Schizosaccharomyces pombe; identical to SEQ ID NO: 2635
  CDS (1)..(1503)

SEQ ID NO: 25293 - protein, 500 aa, Schizosaccharomyces pombe; identical to SEQ ID NO: 2636

SEQ ID NO: 25294 - DNA, 1428 bp, Schizosaccharomyces pombe; identical to SEQ ID NO: 2637
  CDS (1)..(1428)

SEQ ID NO: 25295 - protein, 475 aa, Schizosaccharomyces pombe; identical to SEQ ID NO: 2638

SEQ ID NO: 25296 - DNA, 1461 bp, Leuconostoc mesenteroides; identical to SEQ ID NO: 2639
  CDS (1)..(1461)

SEQ ID NO: 25297 - protein, 486 aa, Leuconostoc mesenteroides; identical to SEQ ID NO: 2640

SEQ ID NO: 25298 - DNA, 3038 bp, Corynebacterium glutamicum; identical to SEQ ID NO: 2641
  CDS (115)..(1659)

SEQ ID NO: 25299 - protein, 514 aa, Corynebacterium glutamicum; identical to SEQ ID NO: 2642

SEQ ID NO: 25300 - DNA, 1852 bp, Nicotiana tabacum; identical to SEQ ID NO: 2643
  CDS (102)..(1634)

SEQ ID NO: 25301 - protein, 510 aa, Nicotiana tabacum; identical to SEQ ID NO: 2644

SEQ ID NO: 25302 - DNA, 1821 bp, Nicotiana tabacum; identical to SEQ ID NO: 2645
  CDS (88)..(1623)

SEQ ID NO: 25303 - protein, 511 aa, Nicotiana tabacum; identical to SEQ ID NO: 2646

SEQ ID NO: 25304 - DNA, 1808 bp, Chlamydia trachomatis; identical to SEQ ID NO: 2647
  CDS (105)..(1643)

SEQ ID NO: 25305 - protein, 512 aa, Chlamydia trachomatis; identical to SEQ ID NO: 2648

SEQ ID NO: 25306 - DNA, 2750 bp, Plasmodium falciparum; identical to SEQ ID NO: 2649
  CDS (48)..(2258)

SEQ ID NO: 25307 - protein, 736 aa, Plasmodium falciparum; identical to SEQ ID NO: 2650

SEQ ID NO: 25308 - DNA, 1509 bp, Debaryomyces hansenii; identical to SEQ ID NO: 2651
  CDS (1)..(1509)

SEQ ID NO: 25309 - protein, 502 aa, Debaryomyces hansenii; identical to SEQ ID NO: 2652

SEQ ID NO: 25310 - DNA, 1503 bp, Candida glabrata; identical to SEQ ID NO: 2653
  CDS (1)..(1503)

SEQ ID NO: 25311 - protein, 500 aa, Candida glabrata; identical to SEQ ID NO: 2654

SEQ ID NO: 25312 - DNA, 1485 bp, Bacillus thuringiensis serovar konkukian str; identical to SEQ ID NO: 2655
  CDS (1)..(1485)

SEQ ID NO: 25313 - protein, 494 aa, Bacillus thuringiensis serovar konkukian str; identical to SEQ ID NO: 2656

SEQ ID NO: 25314 - DNA, 1554 bp, Oryza sativa; identical to SEQ ID NO: 2657
  CDS (1)..(1554)

SEQ ID NO: 25315 - protein, 517 aa, Oryza sativa; identical to SEQ ID NO: 2658

SEQ ID NO: 25316 - DNA, 1500 bp, Photobacterium profundum; identical to SEQ ID NO: 2659
  CDS (1)..(1500)

SEQ ID NO: 25317 - protein, 499 aa, Photobacterium profundum; identical to SEQ ID NO: 2660

SEQ ID NO: 25318 - DNA, 1551 bp, Parachlamydia sp; identical to SEQ ID NO: 2661
  CDS (1)..(1551)

SEQ ID NO: 25319 - protein, 516 aa, Parachlamydia sp; identical to SEQ ID NO: 2662

SEQ ID NO: 25320 - DNA, 1515 bp, Rhodopseudomonas palustris; identical to SEQ ID NO: 2663
  CDS (1)..(1515)

SEQ ID NO: 25321 - protein, 504 aa, Rhodopseudomonas palustris; identical to SEQ ID NO: 2664

SEQ ID NO: 25322 - DNA, 1650 bp, Corynebacterium diphtheriae; identical to SEQ ID NO: 2665
  CDS (1)..(1650)

SEQ ID NO: 25323 - protein, 549 aa, Corynebacterium diphtheriae; identical to SEQ ID NO: 2666

SEQ ID NO: 25324 - DNA, 1446 bp, uncultured bacterium 581; identical to SEQ ID NO: 2667
  CDS (1)..(1446)

SEQ ID NO: 25325 - protein, 481 aa, uncultured bacterium 581; identical to SEQ ID NO: 2668

SEQ ID NO: 25326 - DNA, 1602 bp, Nonomuraea sp; identical to SEQ ID NO: 2669
  CDS (1)..(1602)

SEQ ID NO: 25327 - protein, 533 aa, Nonomuraea sp; identical to SEQ ID NO: 2670

SEQ ID NO: 25328 - DNA, 1476 bp, Listeria monocytogenes; identical to SEQ ID NO: 2671
  CDS (1)..(1476)

SEQ ID NO: 25329 - protein, 491 aa, Listeria monocytogenes; identical to SEQ ID NO: 2672

SEQ ID NO: 25330 - DNA, 1485 bp, Bacillus cereus; identical to SEQ ID NO: 2673
  CDS (1)..(1485)

SEQ ID NO: 25331 - protein, 494 aa, Bacillus cereus; identical to SEQ ID NO: 2674

SEQ ID NO: 25332 - DNA, 1410 bp, Mycobacterium paratuberculosis; identical to SEQ ID NO: 2675
  CDS (1)..(1410)

SEQ ID NO: 25333 - protein, 469 aa, Mycobacterium paratuberculosis; identical to SEQ ID NO: 2676

SEQ ID NO: 25334 - DNA, 2454 bp, Mycobacterium paratuberculosis; identical to SEQ ID NO: 2677
  CDS (1)..(2454)

SEQ ID NO: 25335 - protein, 817 aa, Mycobacterium paratuberculosis; identical to SEQ ID NO: 2678

SEQ ID NO: 25336 - DNA, 1545 bp, Mycobacterium paratuberculosis; identical to SEQ ID NO: 2679
  CDS (1)..(1545)

SEQ ID NO: 25337 - protein, 514 aa, Mycobacterium paratuberculosis; identical to SEQ ID NO: 2680

SEQ ID NO: 25338 - DNA, 1449 bp, Lactobacillus johnsonii; identical to SEQ ID NO: 2681
  CDS (1)..(1449)

SEQ ID NO: 25339 - protein, 482 aa, Lactobacillus johnsonii; identical to SEQ ID NO: 2682

SEQ ID NO: 25340 - DNA, 1539 bp, Ashbya gossypii; identical to SEQ ID NO: 2683
  CDS (1)..(1539)

SEQ ID NO: 25341 - protein, 512 aa, Ashbya gossypii; identical to SEQ ID NO: 2684

SEQ ID NO: 25342 - DNA, 1734 bp, Oryza sativa; identical to SEQ ID NO: 2685
  CDS (1)..(1734)

SEQ ID NO: 25343 - protein, 577 aa, Oryza sativa; identical to SEQ ID NO: 2686

SEQ ID NO: 25344 - DNA, 1467 bp, Gluconobacter oxydans; identical to SEQ ID NO: 2687
  CDS (1)..(1467)

SEQ ID NO: 25345 - protein, 488 aa, Gluconobacter oxydans; identical to SEQ ID NO: 2688

SEQ ID NO: 25346 - DNA, 1581 bp, Vibrio vulnificus; identical to SEQ ID NO: 2689
  CDS (1)..(1581)

SEQ ID NO: 25347 - protein, 526 aa, Vibrio vulnificus; identical to SEQ ID NO: 2690

SEQ ID NO: 25348 - DNA, 1476 bp, Photorhabdus luminescens; identical to SEQ ID NO: 2691
  CDS (1)..(1476)

SEQ ID NO: 25349 - protein, 491 aa, Photorhabdus luminescens; identical to SEQ ID NO: 2692

SEQ ID NO: 25350 - DNA, 1539 bp, Gloeobacter violaceus; identical to SEQ ID NO: 2693
  CDS (1)..(1539)

SEQ ID NO: 25351 - protein, 512 aa, Gloeobacter violaceus; identical to SEQ ID NO: 2694

SEQ ID NO: 25352 - DNA, 1539 bp, Gloeobacter violaceus; identical to SEQ ID NO: 2695
  CDS (1)..(1539)

SEQ ID NO: 25353 - protein, 512 aa, Gloeobacter violaceus; identical to SEQ ID NO: 2696

SEQ ID NO: 25354 - DNA, 1479 bp, Chromobacterium violaceum; identical to SEQ ID NO: 2697
  CDS (1)..(1479)

SEQ ID NO: 25355 - protein, 492 aa, Chromobacterium violaceum; identical to SEQ ID NO: 2698

SEQ ID NO: 25356 - DNA, 2229 bp, Giardia lamblia ATCC 50803; identical to SEQ ID NO: 2699
  CDS (1)..(2229)

SEQ ID NO: 25357 - protein, 742 aa, Giardia lamblia ATCC 50803; identical to SEQ ID NO: 2700

SEQ ID NO: 25358 - DNA, 2850 bp, Plasmodium yoelii yoelii; identical to SEQ ID NO: 2701
  CDS (1)..(2850)

SEQ ID NO: 25359 - protein, 949 aa, Plasmodium yoelii yoelii; identical to SEQ ID NO: 2702

SEQ ID NO: 25360 - DNA, 1476 bp, Neurospora crassa; identical to SEQ ID NO: 2703
  CDS (1)..(1476)

SEQ ID NO: 25361 - protein, 491 aa, Neurospora crassa; identical to SEQ ID NO: 2704

SEQ ID NO: 25362 - DNA, 1524 bp, Synechococcus sp; identical to SEQ ID NO: 2705
  CDS (1)..(1524)

SEQ ID NO: 25363 - protein, 507 aa, Synechococcus sp; identical to SEQ ID NO: 2706

SEQ ID NO: 25364 - DNA, 1455 bp, Rhodopirellula baltica; identical to SEQ ID NO: 2707
  CDS (1)..(1455)

SEQ ID NO: 25365 - protein, 484 aa, Rhodopirellula baltica; identical to SEQ ID NO: 2708

SEQ ID NO: 25366 - DNA, 1524 bp, Prochlorococcus marinus subsp; identical to SEQ ID NO: 2709
  CDS (1)..(1524)

SEQ ID NO: 25367 - protein, 507 aa, Prochlorococcus marinus subsp; identical to SEQ ID NO: 2710

SEQ ID NO: 25368 - DNA, 1524 bp, Prochlorococcus marinus; identical to SEQ ID NO: 2711
  CDS (1)..(1524)

SEQ ID NO: 25369 - protein, 507 aa, Prochlorococcus marinus; identical to SEQ ID NO: 2712

SEQ ID NO: 25370 - DNA, 1521 bp, Prochlorococcus marinus; identical to SEQ ID NO: 2713
  CDS (1)..(1521)

SEQ ID NO: 25371 - protein, 506 aa, Prochlorococcus marinus; identical to SEQ ID NO: 2714

SEQ ID NO: 25372 - DNA, 1488 bp, Haemophilus ducreyi; identical to SEQ ID NO: 2715
  CDS (1)..(1488)

SEQ ID NO: 25373 - protein, 495 aa, Haemophilus ducreyi; identical to SEQ ID NO: 2716

SEQ ID NO: 25374 - DNA, 1497 bp, Candidatus Blochmannia floridanus; identical to SEQ ID NO: 2717
  CDS (1)..(1497)

SEQ ID NO: 25375 - protein, 498 aa, Candidatus Blochmannia floridanus; identical to SEQ ID NO: 2718

SEQ ID NO: 25376 - DNA, 1768 bp, Oryza sativa; identical to SEQ ID NO: 2719
  CDS (2)..(1768)

SEQ ID NO: 25377 - protein, 588 aa, Oryza sativa; identical to SEQ ID NO: 2720

SEQ ID NO: 25378 - DNA, 1548 bp, Bos indicus; identical to SEQ ID NO: 2721
  CDS (1)..(1548)

SEQ ID NO: 25379 - protein, 515 aa, Bos indicus; identical to SEQ ID NO: 2722

SEQ ID NO: 25380 - DNA, 1536 bp, Chlamydophila caviae; identical to SEQ ID NO: 2723
  CDS (1)..(1536)

SEQ ID NO: 25381 - protein, 511 aa, Chlamydophila caviae; identical to SEQ ID NO: 2724

SEQ ID NO: 25382 - DNA, 1524 bp, Streptomyces avermitilis; identical to SEQ ID NO: 2725
  CDS (1)..(1524)

SEQ ID NO: 25383 - protein, 507 aa, Streptomyces avermitilis; identical to SEQ ID NO: 2726

SEQ ID NO: 25384 - DNA, 1647 bp, Streptomyces avermitilis; identical to SEQ ID NO: 2727
  CDS (1)..(1647)

SEQ ID NO: 25385 - protein, 548 aa, Streptomyces avermitilis; identical to SEQ ID NO: 2728

SEQ ID NO: 25386 - DNA, 1491 bp, Nitrosomonas europaea; identical to SEQ ID NO: 2729
  CDS (1)..(1491)

SEQ ID NO: 25387 - protein, 496 aa, Nitrosomonas europaea; identical to SEQ ID NO: 2730

SEQ ID NO: 25388 - DNA, 1524 bp, Enterococcus faecalis; identical to SEQ ID NO: 2731
  CDS (1)..(1524)

SEQ ID NO: 25389 - protein, 507 aa, Enterococcus faecalis; identical to SEQ ID NO: 2732

SEQ ID NO: 25390 - DNA, 1464 bp, Tropheryma whipplei; identical to SEQ ID NO: 2733
  CDS (1)..(1464)

SEQ ID NO: 25391 - protein, 487 aa, Tropheryma whipplei; identical to SEQ ID NO: 2734

SEQ ID NO: 25392 - DNA, 2145 bp, Leishmania mexicana; identical to SEQ ID NO: 2735
  CDS (298)..(1986)

SEQ ID NO: 25393 - protein, 562 aa, Leishmania mexicana; identical to SEQ ID NO: 2736

SEQ ID NO: 25394 - DNA, 1494 bp, Dictyostelium discoideum; identical to SEQ ID NO: 2737
  CDS (1)..(1494)

SEQ ID NO: 25395 - protein, 497 aa, Dictyostelium discoideum; identical to SEQ ID NO: 2738

SEQ ID NO: 25396 - DNA, 1503 bp, Xylella fastidiosa; identical to SEQ ID NO: 2739
  CDS (1)..(1503)

SEQ ID NO: 25397 - protein, 500 aa, Xylella fastidiosa; identical to SEQ ID NO: 2740

SEQ ID NO: 25398 - DNA, 1506 bp, Vibrio parahaemolyticus; identical to SEQ ID NO: 2741
  CDS (1)..(1506)

SEQ ID NO: 25399 - protein, 501 aa, Vibrio parahaemolyticus; identical to SEQ ID NO: 2742

SEQ ID NO: 25400 - DNA, 1533 bp, Pseudomonas syringae; identical to SEQ ID NO: 2743
  CDS (1)..(1533)

SEQ ID NO: 25401 - protein, 510 aa, Pseudomonas syringae; identical to SEQ ID NO: 2744

SEQ ID NO: 25402 - DNA, 1470 bp, Pseudomonas syringae; identical to SEQ ID NO: 2745
  CDS (1)..(1470)

SEQ ID NO: 25403 - protein, 489 aa, Pseudomonas syringae; identical to SEQ ID NO: 2746

SEQ ID NO: 25404 - DNA, 1458 bp, Pseudomonas putida; identical to SEQ ID NO: 2747
  CDS (1)..(1458)

SEQ ID NO: 25405 - protein, 485 aa, Pseudomonas putida; identical to SEQ ID NO: 2748

SEQ ID NO: 25406 - DNA, 1506 bp, Pseudomonas putida; identical to SEQ ID NO: 2749
  CDS (1)..(1506)

SEQ ID NO: 25407 - protein, 501 aa, Pseudomonas putida; identical to SEQ ID NO: 2750

SEQ ID NO: 25408 - DNA, 1470 bp, Pseudomonas putida; identical to SEQ ID NO: 2751
  CDS (1)..(1470)

SEQ ID NO: 25409 - protein, 489 aa, Pseudomonas putida; identical to SEQ ID NO: 2752

SEQ ID NO: 25410 - DNA, 1485 bp, Lactobacillus plantarum; identical to SEQ ID NO: 2753
  CDS (1)..(1485)

SEQ ID NO: 25411 - protein, 494 aa, Lactobacillus plantarum; identical to SEQ ID NO: 2754

SEQ ID NO: 25412 - DNA, 1440 bp, Clostridium tetani; identical to SEQ ID NO: 2755
  CDS (1)..(1440)

SEQ ID NO: 25413 - protein, 479 aa, Clostridium tetani; identical to SEQ ID NO: 2756

SEQ ID NO: 25414 - DNA, 1512 bp, Bradyrhizobium japonicum; identical to SEQ ID NO: 2757
  CDS (1)..(1512)

SEQ ID NO: 25415 - protein, 503 aa, Bradyrhizobium japonicum; identical to SEQ ID NO: 2758

SEQ ID NO: 25416 - DNA, 1497 bp, Bacteroides thetaiotaomicron; identical to SEQ ID NO: 2759
  CDS (1)..(1497)

SEQ ID NO: 25417 - protein, 498 aa, Bacteroides thetaiotaomicron; identical to SEQ ID NO: 2760

SEQ ID NO: 25418 - DNA, 4583 bp, Mus musculus; identical to SEQ ID NO: 2761
  CDS (119)..(2488)

SEQ ID NO: 25419 - protein, 789 aa, Mus musculus; identical to SEQ ID NO: 2762

SEQ ID NO: 25420 - DNA, 1485 bp, Staphylococcus epidermidis; identical to SEQ ID NO: 2763
  CDS (1)..(1485)

SEQ ID NO: 25421 - protein, 494 aa, Staphylococcus epidermidis; identical to SEQ ID NO: 2764

SEQ ID NO: 25422 - DNA, 1590 bp, Yersinia pestis; identical to SEQ ID NO: 2765
  CDS (1)..(1590)

SEQ ID NO: 25423 - protein, 529 aa, Yersinia pestis; identical to SEQ ID NO: 2766

SEQ ID NO: 25424 - DNA, 1530 bp, Synechococcus elongatus; identical to SEQ ID NO: 2767
  CDS (1)..(1530)

SEQ ID NO: 25425 - protein, 509 aa, Synechococcus elongatus; identical to SEQ ID NO: 2768

SEQ ID NO: 25426 - DNA, 1473 bp, Shewanella oneidensis; identical to SEQ ID NO: 2769
  CDS (1)..(1473)

SEQ ID NO: 25427 - protein, 490 aa, Shewanella oneidensis; identical to SEQ ID NO: 2770

SEQ ID NO: 25428 - DNA, 1476 bp, Oceanobacillus iheyensis; identical to SEQ ID NO: 2771
  CDS (1)..(1476)

SEQ ID NO: 25429 - protein, 491 aa, Oceanobacillus iheyensis; identical to SEQ ID NO: 2772

SEQ ID NO: 25430 - DNA, 1344 bp, Corynebacterium efficiens; identical to SEQ ID NO: 2773
  CDS (1)..(1344)

SEQ ID NO: 25431 - protein, 447 aa, Corynebacterium efficiens; identical to SEQ ID NO: 2774

SEQ ID NO: 25432 - DNA, 1545 bp, Corynebacterium efficiens; identical to SEQ ID NO: 2775
  CDS (1)..(1545)

SEQ ID NO: 25433 - protein, 514 aa, Corynebacterium efficiens; identical to SEQ ID NO: 2776

SEQ ID NO: 25434 - DNA, 1668 bp, Bifidobacterium longum; identical to SEQ ID NO: 2777
  CDS (1)..(1668)

SEQ ID NO: 25435 - protein, 555 aa, Bifidobacterium longum; identical to SEQ ID NO: 2778

SEQ ID NO: 25436 - DNA, 1284 bp, Rhodococcus opacus; identical to SEQ ID NO: 2779
  CDS (1)..(1284)

SEQ ID NO: 25437 - protein, 427 aa, Rhodococcus opacus; identical to SEQ ID NO: 2780

SEQ ID NO: 25438 - DNA, 2879 bp, Leishmania guyanensis; identical to SEQ ID NO: 2781
  CDS (205)..(1893): n means a or g or c or t/u, s means g or c

SEQ ID NO: 25439 - protein, 562 aa, Leishmania guyanensis; identical to SEQ ID NO: 2782

SEQ ID NO: 25440 - DNA, 1689 bp, Leishmania mexicana; identical to SEQ ID NO: 2783
  CDS (1)..(1689): n means a or g or c or t/u, s means g or c

SEQ ID NO: 25441 - protein, 562 aa, Leishmania mexicana; identical to SEQ ID NO: 2784
  Xaa in the positions 76-148, 187, 197, 224, 243, 250 and 492-510 is unknown

SEQ ID NO: 25442 - DNA, 2916 bp, Leishmania amazonensis; identical to SEQ ID NO: 2785
  CDS (207)..(1895): n means a or g or c or t/u, s means g or c

SEQ ID NO: 25443 - protein, 562 aa, Leishmania amazonensis; identical to SEQ ID NO: 2786
  Xaa in positions 463 and 481 is unknown

SEQ ID NO: 25444 - DNA, 1440 bp, Chlorobium tepidum; identical to SEQ ID NO: 2787
  CDS (1)..(1440)

SEQ ID NO: 25445 - protein, 479 aa, Chlorobium tepidum; identical to SEQ ID NO: 2788

SEQ ID NO: 25446 - DNA, 2187 bp, Methylobacterium extorquens; identical to SEQ ID NO: 2789
  CDS (640)..(2187)

SEQ ID NO: 25447 - protein, 515 aa, Methylobacterium extorquens; identical to SEQ ID NO: 2790

SEQ ID NO: 25448 - DNA, 1476 bp, Bartonella henselae; identical to SEQ ID NO: 2791
  CDS (1)..(1476)

SEQ ID NO: 25449 - protein, 491 aa, Bartonella henselae; identical to SEQ ID NO: 2792

SEQ ID NO: 25450 - DNA, 2266 bp, Toxoplasma gondii; identical to SEQ ID NO: 2793
  CDS (169)..(1851)

SEQ ID NO: 25451 - protein, 560 aa, Toxoplasma gondii; identical to SEQ ID NO: 2794

SEQ ID NO: 25452 - DNA, 1923 bp, Xanthomonas campestris; identical to SEQ ID NO: 2795
  CDS (1)..(1923)

SEQ ID NO: 25453 - protein, 640 aa, Xanthomonas campestris; identical to SEQ ID NO: 2796

SEQ ID NO: 25454 - DNA, 1431 bp, Xanthomonas campestris; identical to SEQ ID NO: 2797
  CDS (1)..(1431)

SEQ ID NO: 25455 - protein, 476 aa, Xanthomonas campestris; identical to SEQ ID NO: 2798

SEQ ID NO: 25456 - DNA, 1839 bp, Xanthomonas axonopodis; identical to SEQ ID NO: 2799
  CDS (1)..(1839)

SEQ ID NO: 25457 - protein, 612 aa, Xanthomonas axonopodis; identical to SEQ ID NO: 2800

SEQ ID NO: 25458 - DNA, 1431 bp, Xanthomonas axonopodis; identical to SEQ ID NO: 2801
  CDS (1)..(1431)

SEQ ID NO: 25459 - protein, 476 aa, Xanthomonas axonopodis; identical to SEQ ID NO: 2802

SEQ ID NO: 25460 - DNA, 1458 bp, Thermoanaerobacter tengcongensis; identical to SEQ ID NO: 2803
  CDS (1)..(1458)

SEQ ID NO: 25461 - protein, 485 aa, Thermoanaerobacter tengcongensis; identical to SEQ ID NO: 2804

SEQ ID NO: 25462 - DNA, 1762 bp, Oryza sativa; identical to SEQ ID NO: 2805
  CDS (41)..(1558)

SEQ ID NO: 25463 - protein, 505 aa, Oryza sativa; identical to SEQ ID NO: 2806

SEQ ID NO: 25464 - DNA, 1305 bp, Encephalitozoon cuniculi; identical to SEQ ID NO: 2807
  CDS (1)..(1305)

SEQ ID NO: 25465 - protein, 434 aa, Encephalitozoon cuniculi; identical to SEQ ID NO: 2808

SEQ ID NO: 25466 - DNA, 2125 bp, Drosophila melanogaster; identical to SEQ ID NO: 2809
  CDS (158)..(1738)

SEQ ID NO: 25467 - protein, 526 aa, Drosophila melanogaster; identical to SEQ ID NO: 2810

SEQ ID NO: 25468 - DNA, 1470 bp, Ralstonia solanacearum; identical to SEQ ID NO: 2811
  CDS (1)..(1470)

SEQ ID NO: 25469 - protein, 489 aa, Ralstonia solanacearum; identical to SEQ ID NO: 2812

SEQ ID NO: 25470 - DNA, 1521 bp, Enterococcus mundtii; identical to SEQ ID NO: 2813
  CDS (1)..(1521)

SEQ ID NO: 25471 - protein, 506 aa, Enterococcus mundtii; identical to SEQ ID NO: 2814

SEQ ID NO: 25472 - DNA, 2230 bp, Homo sapiens; identical to SEQ ID NO: 2815
  CDS (54)..(1601)

SEQ ID NO: 25473 - protein, 515 aa, Homo sapiens [sequence omitted]

SEQ ID NO: 25474 - DNA, 1470 bp, Rhizobium loti; identical to SEQ ID NO: 2817
  CDS (1)..(1470)

SEQ ID NO: 25475 - protein, 489 aa, Rhizobium loti; identical to SEQ ID NO: 2818

SEQ ID NO: 25476 - DNA, 1428 bp, Rhizobium loti; identical to SEQ ID NO: 2819
  CDS (1)..(1428)

SEQ ID NO: 25477 - protein, 475 aa, Rhizobium loti; identical to SEQ ID NO: 2820

SEQ ID NO: 25478 - DNA, 3584 bp, Plasmodium berghei; identical to SEQ ID NO: 2821
  CDS (370)..(3222)

SEQ ID NO: 25479 - protein, 950 aa, Plasmodium berghei; identical to SEQ ID NO: 2822

SEQ ID NO: 25480 - DNA, 1491 bp, Pasteurella multocida; identical to SEQ ID NO: 2823
  CDS (1)..(1491)

SEQ ID NO: 25481 - protein, 496 aa, Pasteurella multocida; identical to SEQ ID NO: 2824

SEQ ID NO: 25482 - DNA, 1470 bp, Pseudomonas putida; identical to SEQ ID NO: 2825
  CDS (1)..(1470)

SEQ ID NO: 25483 - protein, 489 aa, Pseudomonas putida; identical to SEQ ID NO: 2826

SEQ ID NO: 25484 - DNA, 1566 bp, Trypanosoma brucei; identical to SEQ ID NO: 2827
  CDS (1)..(1566)

SEQ ID NO: 25485 - protein, 521 aa, Trypanosoma brucei; identical to SEQ ID NO: 2828

SEQ ID NO: 25486 - DNA, 1904 bp, Triticum aestivum; identical to SEQ ID NO: 2829
  CDS (153)..(1682)

SEQ ID NO: 25487 - protein, 509 aa, Triticum aestivum; identical to SEQ ID NO: 2830

SEQ ID NO: 25488 - DNA, 2098 bp, Solanum tuberosum; identical to SEQ ID NO: 2831
  CDS (27)..(1775)

SEQ ID NO: 25489 - protein, 582 aa, Solanum tuberosum; identical to SEQ ID NO: 2832

SEQ ID NO: 25490 - DNA, 1924 bp, Dunaliella bioculata; identical to SEQ ID NO: 2833
  CDS (68)..(1840)

SEQ ID NO: 25491 - protein, 590 aa, Dunaliella bioculata; identical to SEQ ID NO: 2834

SEQ ID NO: 25492 - DNA, 1976 bp, Cyanidium caldarium; identical to SEQ ID NO: 2835
  CDS (46)..(1848)

SEQ ID NO: 25493 - protein, 600 aa, Cyanidium caldarium; identical to SEQ ID NO: 2836

SEQ ID NO: 25494 - DNA, 2106 bp, Drosophila melanogaster; identical to SEQ ID NO: 2837
  CDS (28)..(1746)

SEQ ID NO: 25495 - protein, 572 aa, Drosophila melanogaster; identical to SEQ ID NO: 2838

SEQ ID NO: 25496 - DNA, 1777 bp, Mesembryanthemum crystallinum; identical to SEQ ID NO: 2839
  CDS (39)..(1589)

SEQ ID NO: 25497 - protein, 516 aa, Mesembryanthemum crystallinum; identical to SEQ ID NO: 2840

SEQ ID NO: 25498 - DNA, 1542 bp, Mus musculus; identical to SEQ ID NO: 2841
  CDS (1)..(1542)

SEQ ID NO: 25499 - protein, 513 aa, Mus musculus; identical to SEQ ID NO: 2842

SEQ ID NO: 25500 - DNA, 1485 bp, Actinobacillus actinomycetemcomitans; identical to SEQ ID NO: 2843
  CDS (1)..(1485)

SEQ ID NO: 25501 - protein, 494 aa, Actinobacillus actinomycetemcomitans; identical to SEQ ID NO: 2844

SEQ ID NO: 25502 - DNA, 1473 bp, Buchnera aphidicola; identical to SEQ ID NO: 2845
  CDS (1)..(1473)

SEQ ID NO: 25503 - protein, 490 aa, Buchnera aphidicola; identical to SEQ ID NO: 2846

SEQ ID NO: 25504 - DNA, 1473 bp, Buchnera aphidicola; identical to SEQ ID NO: 2847
  CDS (1)..(1473)

SEQ ID NO: 25505 - protein, 490 aa, Buchnera aphidicola; identical to SEQ ID NO: 2848

SEQ ID NO: 25506 - DNA, 2049 bp, Ceratitis capitata; identical to SEQ ID NO: 2849
  CDS (60)..(1640)

SEQ ID NO: 25507 - protein, 526 aa, Ceratitis capitata; identical to SEQ ID NO: 2850

SEQ ID NO: 25508 - DNA, 1524 bp, Chlamydia muridarum; identical to SEQ ID NO: 2851
  CDS (1)..(1524)

SEQ ID NO: 25509 - protein, 507 aa, Chlamydia muridarum; identical to SEQ ID NO: 2852

SEQ ID NO: 25510 - DNA, 2062 bp, Drosophila melanogaster; identical to SEQ ID NO: 2853
  CDS (303)..(1877)

SEQ ID NO: 25511 - protein, 524 aa, Drosophila melanogaster; identical to SEQ ID NO: 2854

SEQ ID NO: 25512 - DNA, 1536 bp, Emericella nidulans; identical to SEQ ID NO: 2855
  CDS (1)..(1536)

SEQ ID NO: 25513 - protein, 511 aa, Emericella nidulans; identical to SEQ ID NO: 2856

SEQ ID NO: 25514 - DNA, 1957 bp, Leuconostoc mesenteroides; identical to SEQ ID NO: 2857
  CDS (206)..(1666)

SEQ ID NO: 25515 - protein, 486 aa, Leuconostoc mesenteroides; identical to SEQ ID NO: 2858

SEQ ID NO: 25516 - DNA, 2055 bp, Macropus robustus; identical to SEQ ID NO: 2859
  CDS (94)..(1641)

SEQ ID NO: 25517 - protein, 515 aa, Macropus robustus; identical to SEQ ID NO: 2860

SEQ ID NO: 25518 - DNA, 1530 bp, Nostoc punctiforme; identical to SEQ ID NO: 2861
  CDS (1)..(1530)

SEQ ID NO: 25519 - protein, 509 aa, Nostoc punctiforme; identical to SEQ ID NO: 2862

SEQ ID NO: 25520 - DNA, 1476 bp, Rhizobium meliloti; identical to SEQ ID NO: 2863
  CDS (1)..(1476)

SEQ ID NO: 25521 - protein, 491 aa, Rhizobium meliloti; identical to SEQ ID NO: 2864

SEQ ID NO: 25522 - DNA, 2853 bp, Homo sapiens; identical to SEQ ID NO: 2865
  CDS (273)..(2648)

SEQ ID NO: 25523 - protein, 791 aa, Homo sapiens; identical to SEQ ID NO: 2866

SEQ ID NO: 25524 - DNA, 1970 bp, Arabidopsis thaliana; identical to SEQ ID NO: 2867
  CDS (60)..(1790)

SEQ ID NO: 25525 - protein, 576 aa, Arabidopsis thaliana; identical to SEQ ID NO: 2868

SEQ ID NO: 25526 - DNA, 2112 bp, Arabidopsis thaliana; identical to SEQ ID NO: 2869
  CDS (142)..(1932)

SEQ ID NO: 25527 - protein, 596 aa, Arabidopsis thaliana; identical to SEQ ID NO: 2870

SEQ ID NO: 25528 - DNA, 2161 bp, Arabidopsis thaliana; identical to SEQ ID NO: 2871
  CDS (90)..(1967)

SEQ ID NO: 25529 - protein, 625 aa, Arabidopsis thaliana; identical to SEQ ID NO: 2872

SEQ ID NO: 25530 - DNA, 1936 bp, Arabidopsis thaliana; identical to SEQ ID NO: 2873
  CDS (136)..(1686)

SEQ ID NO: 25531 - protein, 516 aa, Arabidopsis thaliana; identical to SEQ ID NO: 2874

SEQ ID NO: 25532 - DNA, 1959 bp, Arabidopsis thaliana; identical to SEQ ID NO: 2875
  CDS (194)..(1741)

SEQ ID NO: 25533 - protein, 515 aa, Arabidopsis thaliana [sequence omitted]

SEQ ID NO: 25534 - DNA, 1503 bp, Xenopus laevis; identical to SEQ ID NO: 2877
  CDS (1)..(1503)

SEQ ID NO: 25535 - protein, 500 aa, Xenopus laevis; identical to SEQ ID NO: 2878

SEQ ID NO: 25536 - DNA, 2004 bp, Arabidopsis thaliana; identical to SEQ ID NO: 2879
  CDS (51)..(1850)

SEQ ID NO: 25537 - protein, 599 aa, Arabidopsis thaliana; identical to SEQ ID NO: 2880

SEQ ID NO: 25538 - DNA, 23 bp, Artificial sequence
  (1)..(23): primer
atgagtgaaggccccgtcaaatt

SEQ ID NO: 25539 - DNA, 25 bp, Artificial sequence
  (1)..(25): primer
ctaattatccttcgtatcttctggc

SEQ ID NO: 25540 - protein, 806 aa, Artificial sequence; identical to SEQ ID NO: 18604
  Variant (2)..(3): xaa in position 2 to 3 is any amino acid
  Variant (7)..(9): xaa in position 7 to 9 is any amino acid
  Variant (11)..(12): xaa in position 11 to 12 is any amino acid
  Variant (14)..(17): xaa in position 14 to 17 is any amino acid
  Variant (19)..(23): xaa in position 19 to 23 is any amino acid
  Variant (25)..(32): xaa in position 25 to 32 is any amino acid
  Variant (34)..(35): xaa in position 34 to 35 is any amino acid
  Variant (37)..(81): xaa in position 37 to 81 is any amino acid
  Variant (83)..(95): xaa in position 83 to 95 is any amino acid
  Variant (97)..(225): xaa in position 97 to 225 is any amino acid
  Variant (227)..(230): xaa in position 227 to 230 is any amino acid
  Variant (232)..(258): xaa in position 232 to 258 is any amino acid
  Variant (260)..(262): xaa in position 260 to 262 is any amino acid
  Variant (266)..(266): xaa in position 266 is any amino acid
  Variant (268)..(268): xaa in position 268 is any amino acid
  Variant (270)..(271): xaa in position 270 to 271 is any amino acid
  Variant (273)..(275): xaa in position 273 to 275 is any amino acid
  Variant (277)..(285): xaa in position 277 to 285 is any amino acid
  Variant (287)..(290): xaa in position 287 to 290 is any amino acid
  Variant (300)..(300): xaa in position 300 is any amino acid
  Variant (302)..(302): xaa in position 302 is any amino acid
  Variant (304)..(307): xaa in position 304 to 307 is any amino acid
  Variant (310)..(310): xaa in position 310 is any amino acid
  Variant (312)..(318): xaa in position 312 to 318 is any amino acid
  Variant (321)..(323): xaa in position 321 to 323 is any amino acid
  Variant (325)..(328): xaa in position 325 to 328 is any amino acid
  Variant (330)..(332): xaa in position 330 to 332 is any amino acid
  Variant (334)..(335): xaa in position 334 to 335 is any amino acid
  Variant (337)..(339): xaa in position 337 to 339 is any amino acid
  Variant (341)..(342): xaa in position 341 to 342 is any amino acid
  Variant (344)..(347): xaa in position 344 to 347 is any amino acid
  Variant (349)..(351): xaa in position 349 to 351 is any amino acid
  Variant (354)..(355): xaa in position 354 to 355 is any amino acid
  Variant (359)..(360): xaa in position 359 to 360 is any amino acid
  Variant (362)..(366): xaa in position 362 to 366 is any amino acid
  Variant (370)..(370): xaa in position 370 is any amino acid
  Variant (372)..(382): xaa in position 372 to 382 is any amino acid
  Variant (385)..(385): xaa in position 385 is any amino acid
  Variant (387)..(387): xaa in position 387 is any amino acid
  Variant (389)..(405): xaa in position 389 to 405 is any amino acid
  Variant (409)..(438): xaa in position 409 to 438 is any amino acid
  Variant (440)..(451): xaa in position 440 to 451 is any amino acid
  Variant (453)..(455): xaa in position 453 to 455 is any amino acid
  Variant (457)..(465): xaa in position 457 to 465 is any amino acid
  Variant (467)..(467): xaa in position 467 is any amino acid
  Variant (470)..(470): xaa in position 470 is any amino acid
  Variant (475)..(478): xaa in position 475 to 478 is any amino acid
  Variant (481)..(493): xaa in position 481 to 493 is any amino acid
  Variant (495)..(524): xaa in position 495 to 524 is any amino acid
  Variant (526)..(531): xaa in position 526 to 531 is any amino acid
  Variant (534)..(534): xaa in position 534 is any amino acid
  Variant (536)..(543): xaa in position 536 to 543 is any amino acid
  Variant (545)..(545): xaa in position 545 is any amino acid
  Variant (548)..(588): xaa in position 548 to 588 is any amino acid
  Variant (592)..(592): xaa in position 592 is any amino acid
  Variant (594)..(595): xaa in position 594 to 595 is any amino acid
  Variant (597)..(599): xaa in position 597 to 599 is any amino acid
  Variant (601)..(604): xaa in position 601 to 604 is any amino acid
  Variant (606)..(609): xaa in position 606 to 609 is any amino acid
  Variant (611)..(614): xaa in position 611 to 614 is any amino acid
  Variant (616)..(797): xaa in position 616 to 797 is any amino acid
  Variant (799)..(800): xaa in position 799 to 800 is any amino acid
  Variant (802)..(805): xaa in position 802 to 805 is any amino acid

SEQ ID NO: 25541 - protein, 150 aa, Artificial sequence; identical to SEQ ID NO: 2917
  Variant (1)..(1): xaa in position 1 is Arg or Lys
  Variant (2)..(2): xaa in position 2 is Val, Ile, Leu or Ala
  Variant (3)..(3): xaa in position 3 is Ile, Val, Met or Ala
  Variant (4)..(4): xaa in position 4 is Ile, Val, Leu, Met or Ala
  Variant (8)..(8): xaa in position 8 is Phe, Ile, Leu or Tyr
  Variant (9)..(9): xaa in position 9 is Gly or Ala
  Variant (10)..(10): xaa in position 10 is any amino acid
  Variant (11)..(11): xaa in position 11 is Asp, Ser or Asn
  Variant (12)..(13): xaa in position 12 to 13 is any amino acid
  Variant (14)..(14): xaa in position 14 is Ser, Thr or Asn
  Variant (15)..(15): xaa in position 15 is Ala, Ser, Phe or Tyr
  Variant (16)..(17): xaa in position 16 to 17 is any amino acid
  Variant (18)..(18): xaa in position 18 is Leu, Ile, Val or Phe
  Variant (19)..(21): xaa in position 19 to 21 is any amino acid
  Variant (22)..(22): xaa in position 22 is Leu, Ile or Val
  Variant (23)..(27): xaa in position 23 to 27 is any amino acid
  Variant (28)..(28): xaa in position 28 is Glu, Asp, Pro or Ser
  Variant (29)..(30): xaa in position 29 to 30 is any amino acid
  Variant (31)..(31): xaa in position 31 is Ile, Val, Leu, Thr or Met
  Variant (32)..(32): xaa in position 32 is Tyr, Phe or Leu
  Variant (33)..(33): xaa in position 33 is Arg, His or Leu
  Variant (34)..(34): xaa in position 34 is Ile, Val, Met or Leu
  Variant (37)..(37): xaa in position 37 is Tyr or Phe
  Variant (39)..(39): xaa in position 39 is Gly, Ser or Ala
  Variant (40)..(40): xaa in position 40 is Lys, Arg or Glu
  Variant (41)..(42): xaa in position 41 to 42 is any amino acid
  Variant (43)..(43): xaa in position 43 is Val, Ile, Leu, Ala or Met
  Variant (44)..(44): xaa in position 44 is any amino acid
  Variant (45)..(45): xaa in position 45 is Asn, Gly, Gln or Ala
  Variant (46)..(46): xaa in position 46 is Leu, Ile, Met, Phe or Val
  Variant (47)..(49): xaa in position 47 to 49 is any amino acid
  Variant (50)..(50): xaa in position 50 is Arg, Lys or Glu
  Variant (51)..(51): xaa in position 51 is Phe or Tyr
  Variant (52)..(52): xaa in position 52 is any amino acid
  Variant (54)..(59): xaa in position 54 to 59 is any amino acid
  Variant (60)..(60): xaa in position 60 is any or no amino acid
  Variant (61)..(61): xaa in position 61 is Trp, Met, Asn or Leu
  Variant (62)..(63): xaa in position 62 to 63 is any amino acid
  Variant (64)..(65): xaa in position 64 to 65 is any or no amino acid
  Variant (66)..(66): xaa in position 66 is Ile, Val or Ala
  Variant (67)..(68): xaa in position 67 to 68 is any amino acid
  Variant (69)..(69): xaa in position 69 is Val, Ile, Met or Leu
  Variant (70)..(70): xaa in position 70 is any amino acid
  Variant (71)..(71): xaa in position 71 is Ile, Leu, Val, Phe or Ser
  Variant (72)..(74): xaa in position 72 to 74 is any amino acid
  Variant (76)..(77): xaa in position 76 to 77 is any amino acid
  Variant (78)..(78): xaa in position 78 is Gly, Asp, Val or Ala
  Variant (79)..(81): xaa in position 79 to 81 is any amino acid
  Variant (82)..(82): xaa in position 82 is Arg or Lys
  Variant (83)..(84): xaa in position 83 to 84 is any or no amino acid
  Variant (85)..(85): xaa in position 85 is Tyr or Phe
  Variant (86)..(86): xaa in position 86 is Tyr, Phe or Trp
  Variant (87)..(87): xaa in position 87 is Asp, Glu, Ala or Asn
  Variant (88)..(89): xaa in position 88 to 89 is any amino acid
  Variant (91)..(91): xaa in position 91 is any amino acid
  Variant (92)..(92): xaa in position 92 is any or no amino acid
  Variant (93)..(93): xaa in position 93 is Leu, Ile, Val, Met or Ala
  Variant (94)..(94): xaa in position 94 is Arg, Lys or Leu
  Variant (96)..(96): xaa in position 96 is Met, Val, Ile or Leu
  Variant (97)..(97): xaa in position 97 is Val, Met, Ile, Leu or Phe
  Variant (98)..(98): xaa in position 98 is Gln, Pro or Thr
  Variant (99)..(99): xaa in position 99 is Asn or Ser
  Variant (100)..(100): xaa in position 100 is His, Gln or Pro
  Variant (101)..(102): xaa in position 101 to 102 is any amino acid
  Variant (103)..(103): xaa in position 103 is Gln, Glu, Asn or Leu
  Variant (104)..(104): xaa in position 104 is Leu, Ile, Val, Met or Thr
  Variant (105)..(105): xaa in position 105 is Leu, Met, Val, Ile, Phe or Tyr
  Variant (106)..(106): xaa in position 106 is any amino acid
  Variant (107)..(107): xaa in position 107 is Leu, Met, Ile, Val, Trp or Phe
  Variant (108)..(109): xaa in position 108 to 109 is any amino acid
  Variant (111)..(111): xaa in position 111 is Glu, Asp, Ser or Asn
  Variant (112)..(112): xaa in position 112 is any amino acid
  Variant (114)..(118): xaa in position 114 to 118 is any amino acid
  Variant (119)..(121): xaa in position 119 to 121 is any or no amino acid
  Variant (122)..(122): xaa in position 122 is Ile, Val, Leu, Phe or Met
  Variant (123)..(124): xaa in position 123 to 124 is any amino acid
  Variant (125)..(125): xaa in position 125 is Glu, Lys, Ala, Arg or His
  Variant (126)..(126): xaa in position 126 is Lys or Val
  Variant (127)..(128): xaa in position 127 to 128 is any amino acid
  Variant (129)..(129): xaa in position 129 is Val, Ile, Ala, Leu or Phe
  Variant (130)..(130): xaa in position 130 is Leu, Ile, Val, Phe or Met
  Variant (131)..(140): xaa in position 131 to 140 is any amino acid
  Variant (141)..(145): xaa in position 141 to 145 is any or no amino acid
  Variant (146)..(146): xaa in position 146 is Val, Leu, Ile, Ala or Ser
  Variant (147)..(147): xaa in position 147 is any amino acid
  Variant (148)..(148): xaa in position 148 is Gly or Ala
  Variant (149)..(149): xaa in position 149 is Gln or Arg
  Variant (150)..(150): xaa in position 150 is Tyr or Phe

SEQ ID NO: 25542 - protein, 44 aa, Artificial sequence; identical to SEQ ID NO: 2918
  Variant (1)..(1): xaa in position 1 is Tyr or Leu
  Variant (2)..(2): xaa in position 2 is any amino acid
  Variant (3)..(13): xaa in position 3 to 13 is any or no amino acid
  Variant (15)..(17): xaa in position 15 to 17 is any amino acid
  Variant (19)..(19): xaa in position 19 is Phe or Tyr
  Variant (20)..(25): xaa in position 20 to 25 is any amino acid
  Variant (26)..(26): xaa in position 26 is Ile, Val, Leu or Phe
  Variant (27)..(29): xaa in position 27 to 29 is any amino acid
  Variant (30)..(30): xaa in position 30 is Arg, Asn, Phe or Gln
  Variant (31)..(31): xaa in position 31 is Trp or Phe
  Variant (32)..(32): xaa in position 32 is any amino acid
  Variant (33)..(33): xaa in position 33 is Gly or Asp
  Variant (34)..(34): xaa in position 34 is Val or Thr
  Variant (36)..(36): xaa in position 36 is Phe or Ile
  Variant (37)..(37): xaa in position 37 is any amino acid
  Variant (38)..(38): xaa in position 38 is Leu, Met, Ile, Val or Phe
  Variant (39)..(40): xaa in position 39 to 40 is any amino acid
  Variant (41)..(41): xaa in position 41 is Gly or Ala
  Variant (43)..(43): xaa in position 43 is any amino acid
  Variant (44)..(44): xaa in position 44 is Leu, Met or Val

SEQ ID NO: 25543 - protein, 97 aa, Artificial sequence; identical to SEQ ID NO: 2919
  Variant (1)..(1): xaa in position 1 is Asn, Asp, Gln, Arg or Lys
  Variant (2)..(4): xaa in position 2 to 4 is any amino acid
  Variant (5)..(5): xaa in position 5 is Ile, Leu, Met, Phe or Val
  Variant (6)..(6): xaa in position 6 is any amino acid
  Variant (7)..(7): xaa in position 7 is Ile, Leu, Val, Ala or Ser
  Variant (8)..(8): xaa in position 8 is any amino acid
  Variant (9)..(9): xaa in position 9 is Pro or His
  Variant (10)..(12): xaa in position 10 to 12 is any amino acid
  Variant (13)..(13): xaa in position 13 is Ile, Val, Met, Leu, Phe or Ala
  Variant (14)..(19): xaa in position 14 to 19 is any amino acid
  Variant (20)..(20): xaa in position 20 is Lys, Ser or Arg
  Variant (21)..(29): xaa in position 21 to 29 is any amino acid
  Variant (30)..(35): xaa in position 30 to 35 is any or no amino acid
  Variant (36)..(36): xaa in position 36 is Leu, Ile, Met or Val
  Variant (37)..(44): xaa in position 37 to 44 is any amino acid
  Variant (45)..(64): xaa in position 45 to 64 is any or no amino acid
  Variant (65)..(65): xaa in position 65 is Ala, Gly, Pro or Ser
  Variant (66)..(66): xaa in position 66 is Tyr or Leu
  Variant (67)..(68): xaa in position 67 to 68 is any amino acid
  Variant (69)..(69): xaa in position 69 is Leu, Met or Tyr
  Variant (70)..(70): xaa in position 70 is Leu, Ile, Phe or Met
  Variant (71)..(71): xaa in position 71 is any amino acid
  Variant (72)..(72): xaa in position 72 is Asp, Glu, Ala, Asn or His
  Variant (73)..(75): xaa in position 73 to 75 is any amino acid
  Variant (76)..(76): xaa in position 76 is Gly, Ser or Asp
  Variant (77)..(80): xaa in position 77 to 80 is any amino acid
  Variant (81)..(81): xaa in position 81 is Phe or Tyr
  Variant (82)..(85): xaa in position 82 to 85 is any amino acid
  Variant (86)..(86): xaa in position 86 is any or no amino acid
  Variant (87)..(87): xaa in position 87 is Val, Ile, Leu, Ala or Gln
  Variant (88)..(90): xaa in position 88 to 90 is any amino acid
  Variant (92)..(96): xaa in position 92 to 96 is any amino acid
  Variant (97)..(97): xaa in position 97 is Ile, Val, Leu, Phe or Ala

SEQ ID NO: 25544 - DNA, 612 bp, Escherichia coli; identical to SEQ ID NO: 15395
  CDS (1)..(612)

SEQ ID NO: 25545 - protein, 203 aa, Escherichia coli; identical to SEQ ID NO: 15396

SEQ ID NO: 25546 - DNA, 558 bp, Mesorhizobium loti MAFF303099; identical to SEQ ID NO: 15397
  CDS (1)..(558): transl_table=11

SEQ ID NO: 25547 - protein, 185 aa, Mesorhizobium loti MAFF303099; identical to SEQ ID NO: 15398

SEQ ID NO: 25548 - DNA, 591 bp, Mesorhizobium loti MAFF303099; identical to SEQ ID NO: 15399
  CDS (1)..(591): transl_table=11

SEQ ID NO: 25549 - protein, 196 aa, Mesorhizobium loti MAFF303099; identical to SEQ ID NO: 15400

SEQ ID NO: 25550 - DNA, 558 bp, Mesorhizobium loti MAFF303099; identical to SEQ ID NO: 15401
  CDS (1)..(558): transl_table=11

SEQ ID NO: 25551 - protein, 185 aa, Mesorhizobium loti MAFF303099; identical to SEQ ID NO: 15402

SEQ ID NO: 25552 - DNA, 579 bp, Vibrio cholerae O1 biovar eltor str. N16961; identical to SEQ ID NO: 15403
  CDS (1)..(579): transl_table=11

SEQ ID NO: 25553 - protein, 192 aa, Vibrio cholerae O1 biovar eltor str. N16961; identical to SEQ ID NO: 15404

SEQ ID NO: 25554 - DNA, 561 bp, Bacillus halodurans C-125; identical to SEQ ID NO: 15405
  CDS (1)..(561): transl_table=11

SEQ ID NO: 25555 - protein, 186 aa, Bacillus halodurans C-125; identical to SEQ ID NO: 15406

SEQ ID NO: 25556 - DNA, 612 bp, Pasteurella multocida subsp. multocida str. Pm70; identical to SEQ ID NO: 15407
  CDS (1)..(612): transl_table=11

SEQ ID NO: 25557 - protein, 203 aa, Pasteurella multocida subsp. multocida str. Pm70; identical to SEQ ID NO: 15408

SEQ ID NO: 25558 - DNA, 771 bp, Lactococcus lactis subsp. lactis Il1403; identical to SEQ ID NO: 15409
  CDS (1)..(771): transl_table=11

SEQ ID NO: 25559 - protein, 256 aa, Lactococcus lactis subsp. lactis Il1403; identical to SEQ ID NO: 15410

SEQ ID NO: 25560 - DNA, 612 bp, Lactococcus lactis subsp. lactis Il1403; identical to SEQ ID NO: 15411
  CDS (1)..(612): transl_table=11

SEQ ID NO: 25561 - protein, 203 aa, Lactococcus lactis subsp. lactis Il1403; identical to SEQ ID NO: 15412

SEQ ID NO: 25562 - DNA, 603 bp, Lactococcus lactis subsp. lactis Il1403; identical to SEQ ID NO: 15413
  CDS (1)..(603): transl_table=11

SEQ ID NO: 25563 - protein, 200 aa, Lactococcus lactis subsp. lactis Il1403; identical to SEQ ID NO: 15414

SEQ ID NO: 25564 - DNA, 612 bp, Lactococcus lactis subsp. lactis Il1403; identical to SEQ ID NO: 15415
  CDS (1)..(612): transl_table=11

SEQ ID NO: 25565 - protein, 203 aa, Lactococcus lactis subsp. lactis Il1403; identical to SEQ ID NO: 15416

SEQ ID NO: 25566 - DNA, 462 bp, Lactococcus lactis subsp. lactis Il1403; identical to SEQ ID NO: 15417
  CDS (1)..(462): transl_table=11

SEQ ID NO: 25567 - protein, 153 aa, Lactococcus lactis subsp. lactis Il1403; identical to SEQ ID NO: 15418

SEQ ID NO: 25568 - DNA, 567 bp, Streptococcus pyogenes M1 GAS; identical to SEQ ID NO: 15419
  CDS (1)..(567): transl_table=11

SEQ ID NO: 25569 - protein, 188 aa, Streptococcus pyogenes M1 GAS; identical to SEQ ID NO: 15420

SEQ ID NO: 25570 - DNA, 513 bp, Neisseria meningitidis Z2491; identical to SEQ ID NO: 15421
  CDS (1)..(513): transl_table=11

SEQ ID NO: 25571 - protein, 170 aa, Neisseria meningitidis Z2491; identical to SEQ ID NO: 15422

SEQ ID NO: 25572 - DNA, 549 bp, Escherichia coli O157:H7; identical to SEQ ID NO: 15423
  CDS (1)..(549): transl_table=11

SEQ ID NO: 25573 - protein, 182 aa, Escherichia coli O157:H7; identical to SEQ ID NO: 15424

SEQ ID NO: 25574 - DNA, 558 bp, Streptococcus pneumoniae TIGR4; identical to SEQ ID NO: 15425
  CDS (1)..(558): transl_table=11

SEQ ID NO: 25575 - protein, 185 aa, Streptococcus pneumoniae TIGR4; identical to SEQ ID NO: 15426

SEQ ID NO: 25576 - DNA, 561 bp, Clostridium acetobutylicum ATCC 824; identical to SEQ ID NO: 15427
  CDS (1)..(561): transl_table=11

SEQ ID NO: 25577 - protein, 186 aa, Clostridium acetobutylicum ATCC 824; identical to SEQ ID NO: 15428

SEQ ID NO: 25578 - DNA, 615 bp, Clostridium acetobutylicum ATCC 824; identical to SEQ ID NO: 15429
  CDS (1)..(615): transl_table=11

SEQ ID NO: 25579 - protein, 204 aa, Clostridium acetobutylicum ATCC 824; identical to SEQ ID NO: 15430

SEQ ID NO: 25580 - DNA, 600 bp, Staphylococcus aureus subsp. aureus Mu50; identical to SEQ ID NO: 15431
  CDS (1)..(600): transl_table=11

SEQ ID NO: 25581 - protein, 199 aa, Staphylococcus aureus subsp. aureus Mu50; identical to SEQ ID NO: 15432

SEQ ID NO: 25582 - DNA, 552 bp, Escherichia coli K12; identical to SEQ ID NO: 15433
  CDS (1)..(552): transl_table=11

SEQ ID NO: 25583 - protein, 183 aa, Escherichia coli K12; identical to SEQ ID NO: 15434

SEQ ID NO: 25584 - DNA, 615 bp, Sinorhizobium meliloti 1021; identical to SEQ ID NO: 15435
  CDS (1)..(615): transl_table=11

SEQ ID NO: 25585 - protein, 204 aa, Sinorhizobium meliloti 1021; identical to SEQ ID NO: 15436

SEQ ID NO: 25586 - DNA, 552 bp, Salmonella typhimurium LT2; identical to SEQ ID NO: 15437
  CDS (1)..(552): transl_table=11

SEQ ID NO: 25587 - protein, 183 aa, Salmonella typhimurium LT2; identical to SEQ ID NO: 15438

SEQ ID NO: 25588 - DNA, 564 bp, Listeria monocytogenes EGD-e; identical to SEQ ID NO: 15439
  CDS (1)..(564): transl_table=11

SEQ ID NO: 25589 - protein, 187 aa, Listeria monocytogenes EGD-e; identical to SEQ ID NO: 15440

SEQ ID NO: 25590 - DNA, 570 bp, Listeria innocua Clip11262; identical to SEQ ID NO: 15441
  CDS (1)..(570): transl_table=11

SEQ ID NO: 25591 - protein, 189 aa, Listeria innocua Clip11262; identical to SEQ ID NO: 15442

SEQ ID NO: 25592 - DNA, 564 bp, Listeria innocua Clip11262; identical to SEQ ID NO: 15443
  CDS (1)..(564): transl_table=11

SEQ ID NO: 25593 - protein, 187 aa, Listeria innocua Clip11262; identical to SEQ ID NO: 15444

SEQ ID NO: 25594 - DNA, 579 bp, Nostoc sp. PCC 7120; identical to SEQ ID NO: 15445
  CDS (1)..(579): transl_table=11

SEQ ID NO: 25595 - protein, 192 aa, Nostoc sp. PCC 7120; identical to SEQ ID NO: 15446

SEQ ID NO: 25596 - DNA, 828 bp, Nostoc sp. PCC 7120; identical to SEQ ID NO: 15447
  CDS (1)..(828): transl_table=11

SEQ ID NO: 25597 - protein, 275 aa, Nostoc sp. PCC 7120; identical to SEQ ID NO: 15448

SEQ ID NO: 25598 - DNA, 513 bp, Ralstonia solanacearum GMI1000; identical to SEQ ID NO: 15449
  CDS (1)..(513): transl_table=11

SEQ ID NO: 25599 - protein, 170 aa, Ralstonia solanacearum GMI1000; identical to SEQ ID NO: 15450

SEQ ID NO: 25600 - DNA, 618 bp, Agrobacterium tumefaciens str. C58; identical to SEQ ID NO: 15451
  CDS (1)..(618): transl_table=11

SEQ ID NO: 25601 - protein, 205 aa, Agrobacterium tumefaciens str. C58; identical to SEQ ID NO: 15452

SEQ ID NO: 25602 - DNA, 561 bp, Agrobacterium tumefaciens str. C58; identical to SEQ ID NO: 15453
  CDS (1)..(561): transl_table=11

SEQ ID NO: 25603 - protein, 186 aa, Agrobacterium tumefaciens str. C58; identical to SEQ ID NO: 15454

SEQ ID NO: 25604 - DNA, 633 bp, Agrobacterium tumefaciens str. C58; identical to SEQ ID NO: 15455
  CDS (1)..(633): transl_table=11

SEQ ID NO: 25605 - protein, 210 aa, Agrobacterium tumefaciens str. C58; identical to SEQ ID NO: 15456

SEQ ID NO: 25606 - DNA, 687 bp, Brucella melitensis 16M; identical to SEQ ID NO: 15457
  CDS (1)..(687): transl_table=11

SEQ ID NO: 25607 - protein, 228 aa, Brucella melitensis 16M; identical to SEQ ID NO: 15458

SEQ ID NO: 25608 - DNA, 681 bp, Pyrobaculum aerophilum str. IM2; identical to SEQ ID NO: 15459
  CDS (1)..(681): transl_table=11

SEQ ID NO: 25609 - protein, 226 aa, Pyrobaculum aerophilum str. IM2; identical to SEQ ID NO: 15460

SEQ ID NO: 25610 - DNA, 585 bp, Clostridium perfringens str. 13; identical to SEQ ID NO: 15461
  CDS (1)..(585): transl_table=11

SEQ ID NO: 25611 - protein, 194 aa, Clostridium perfringens str. 13; identical to SEQ ID NO: 15462

SEQ ID NO: 25612 - DNA, 501 bp, Pyrococcus furiosus DSM 3638; identical to SEQ ID NO: 15463
  CDS (1)..(501): transl_table=11

SEQ ID NO: 25613 - protein, 166 aa, Pyrococcus furiosus DSM 3638; identical to SEQ ID NO: 15464

SEQ ID NO: 25614 - DNA, 687 bp, Corynebacterium glutamicum ATCC 13032; identical to SEQ ID NO: 15465
  CDS (1)..(687): transl_table=11

SEQ ID NO: 25615 - protein, 228 aa, Corynebacterium glutamicum ATCC 13032; identical to SEQ ID NO: 15466

SEQ ID NO: 25616 - DNA, 576 bp, Methanosarcina acetivorans C2A; identical to SEQ ID NO: 15467
  CDS (1)..(576): transl_table=11

SEQ ID NO: 25617 - protein, 191 aa, Methanosarcina acetivorans C2A; identical to SEQ ID NO: 15468

SEQ ID NO: 25618 - DNA, 600 bp, Methanosarcina acetivorans C2A; identical to SEQ ID NO: 15469
  CDS (1)..(600): transl_table=11

SEQ ID NO: 25619 - protein, 199 aa, Methanosarcina acetivorans C2A; identical to SEQ ID NO: 15470

SEQ ID NO: 25620 - DNA, 525 bp, Methanosarcina acetivorans C2A; identical to SEQ ID NO: 15471
  CDS (1)..(525): transl_table=11

SEQ ID NO: 25621 - protein, 174 aa, Methanosarcina acetivorans C2A; identical to SEQ ID NO: 15472

SEQ ID NO: 25622 - DNA, 555 bp, Methanosarcina acetivorans C2A; identical to SEQ ID NO: 15473
  CDS (1)..(555): transl_table=11

SEQ ID NO: 25623 - protein, 184 aa, Methanosarcina acetivorans C2A; identical to SEQ ID NO: 15474

SEQ ID NO: 25624 - DNA, 663 bp, Thermoanaerobacter tengcongensis MB4; identical to SEQ ID NO: 15475
  CDS (1)..(663): transl_table=11

SEQ ID NO: 25625 - protein, 220 aa, Thermoanaerobacter tengcongensis MB4; identical to SEQ ID NO: 15476

SEQ ID NO: 25626 - DNA, 528 bp, Streptomyces coelicolor A3(2); identical to SEQ ID NO: 15477
  CDS (1)..(528)

SEQ ID NO: 25627 - protein, 175 aa, Streptomyces coelicolor A3(2); identical to SEQ ID NO: 15478

SEQ ID NO: 25628 - DNA, 804 bp, Streptomyces coelicolor A3(2); identical to SEQ ID NO: 15479
  CDS (1)..(804)

SEQ ID NO: 25629 - protein, 267 aa, Streptomyces coelicolor A3(2); identical to SEQ ID NO: 15480

SEQ ID NO: 25630 - DNA, 582 bp, Streptomyces coelicolor A3(2); identical to SEQ ID NO: 15481
  CDS (1)..(582)

SEQ ID NO: 25631 - protein, 193 aa, Streptomyces coelicolor A3(2); identical to SEQ ID NO: 15482

SEQ ID NO: 25632 - DNA, 564 bp, Methanosarcina mazei Go1; identical to SEQ ID NO: 15483
  CDS (1)..(564): transl_table=11

SEQ ID NO: 25633 - protein, 187 aa, Methanosarcina mazei Go1; identical to SEQ ID NO: 15484

SEQ ID NO: 25634 - DNA, 702 bp, Methanosarcina mazei Go1; identical to SEQ ID NO: 15485
  CDS (1)..(702): transl_table=11

SEQ ID NO: 25635 - protein, 233 aa, Methanosarcina mazei Go1; identical to SEQ ID NO: 15486

SEQ ID NO: 25636 - DNA, 579 bp, Xanthomonas campestris pv. campestris str. ATCC 33913; identical to SEQ ID NO: 15487
  CDS (1)..(579): transl_table=11

SEQ ID NO: 25637 - protein, 192 aa, Xanthomonas campestris pv. campestris str. ATCC 33913; identical to SEQ ID NO: 15488

SEQ ID NO: 25638 - DNA, 579 bp, Xanthomonas axonopodis pv. citri str. 306; identical to SEQ ID NO: 15489
  CDS (1)..(579): transl_table=11

SEQ ID NO: 25639 - protein, 192 aa, Xanthomonas axonopodis pv. citri str. 306; identical to SEQ ID NO: 15490

SEQ ID NO: 25640 - DNA, 639 bp, Streptococcus agalactiae 2603V/R; identical to SEQ ID NO: 15491
  CDS (1)..(639): transl_table=11

SEQ ID NO: 25641 - protein, 212 aa, Streptococcus agalactiae 2603V/R; identical to SEQ ID NO: 15492

SEQ ID NO: 25642 - DNA, 549 bp, Streptococcus agalactiae 2603V/R; identical to SEQ ID NO: 15493
  CDS (1)..(549): transl_table=11

SEQ ID NO: 25643 - protein, 182 aa, Streptococcus agalactiae 2603V/R; identical to SEQ ID NO: 15494

SEQ ID NO: 25644 - DNA, 540 bp, Oceanobacillus iheyensis HTE831; identical to SEQ ID NO: 15495
  CDS (1)..(540): transl_table=11

SEQ ID NO: 25645 - protein, 179 aa, Oceanobacillus iheyensis HTE831; identical to SEQ ID NO: 15496

SEQ ID NO: 25646 - DNA, 675 bp, Bifidobacterium longum NCC2705; identical to SEQ ID NO: 15497
  CDS (1)..(675): transl_table=11

SEQ ID NO: 25647 - protein, 224 aa, Bifidobacterium longum NCC2705; identical to SEQ ID NO: 15498

SEQ ID NO: 25648 - DNA, 678 bp, Bifidobacterium longum NCC2705; identical to SEQ ID NO: 15499
  CDS (1)..(678): transl_table=11

SEQ ID NO: 25649 - protein, 225 aa, Bifidobacterium longum NCC2705; identical to SEQ ID NO: 15500

SEQ ID NO: 25650 - DNA, 597 bp, Leptospira interrogans serovar Lai str. 56601; identical to SEQ ID NO: 15501
  CDS (1)..(597): transl_table=11

SEQ ID NO: 25651 - protein, 198 aa, Leptospira interrogans serovar Lai str. 56601; identical to SEQ ID NO: 15502

SEQ ID NO: 25652 - DNA, 579 bp, Shewanella oneidensis MR-1; identical to SEQ ID NO: 15503
  CDS (1)..(579): transl_table=11

SEQ ID NO: 25653 - protein, 192 aa, Shewanella oneidensis MR-1; identical to SEQ ID NO: 15504

SEQ ID NO: 25654 - DNA, 630 bp, Shewanella oneidensis MR-1; identical to SEQ ID NO: 15505
  CDS (1)..(630): transl_table=11

SEQ ID NO: 25655 - protein, 209 aa, Shewanella oneidensis MR-1; identical to SEQ ID NO: 15506

SEQ ID NO: 25656 - DNA, 699 bp, Streptococcus mutans UA159; identical to SEQ ID NO: 15507
  CDS (1)..(699): transl_table=11

SEQ ID NO: 25657 - protein, 232 aa, Streptococcus mutans UA159; identical to SEQ ID NO: 15508

SEQ ID NO: 25658 - DNA, 648 bp, Streptomyces coelicolor A3(2); identical to SEQ ID NO: 15509
  CDS (1)..(648)

SEQ ID NO: 25659 - protein, 215 aa, Streptomyces coelicolor A3(2); identical to SEQ ID NO: 15510

SEQ ID NO: 25660 - DNA, 567 bp, Pseudomonas putida KT2440; identical to SEQ ID NO: 15511
  CDS (1)..(567): transl_table=11

SEQ ID NO: 25661 - protein, 188 aa, Pseudomonas putida KT2440; identical to SEQ ID NO: 15512

SEQ ID NO: 25662 - DNA, 552 bp, Escherichia coli CFT073; identical to SEQ ID NO: 15513
  CDS (1)..(552): transl_table=11

SEQ ID NO: 25663 - protein, 183 aa, Escherichia coli CFT073; identical to SEQ ID NO: 15514

SEQ ID NO: 25664 - DNA, 549 bp, Escherichia coli CFT073; identical to SEQ ID NO: 15515
  CDS (1)..(549): transl_table=11

SEQ ID NO: 25665 - protein, 182 aa, Escherichia coli CFT073; identical to SEQ ID NO: 15516

SEQ ID NO: 25666 - DNA, 588 bp, Mycoplasma penetrans HF-2; identical to SEQ ID NO: 15517
  CDS (1)..(588): transl_table=4

SEQ ID NO: 25667 - protein, 195 aa, Mycoplasma penetrans HF-2; identical to SEQ ID NO: 15518

SEQ ID NO: 25668 - DNA, 771 bp, Vibrio vulnificus CMCP6; identical to SEQ ID NO: 15519
  CDS (1)..(771): transl_table=11

SEQ ID NO: 25669 - protein, 256 aa, Vibrio vulnificus CMCP6; identical to SEQ ID NO: 15520

SEQ ID NO: 25670 - DNA, 594 bp, Vibrio vulnificus CMCP6; identical to SEQ ID NO: 15521
  CDS (1)..(594): transl_table=11

SEQ ID NO: 25671 - protein, 197 aa, Vibrio vulnificus CMCP6; identical to SEQ ID NO: 15522

SEQ ID NO: 25672 - DNA, 549 bp, Vibrio vulnificus CMCP6; identical to SEQ ID NO: 15523
  CDS (1)..(549): transl_table=11

SEQ ID NO: 25673 - protein, 182 aa, Vibrio vulnificus CMCP6; identical to SEQ ID NO: 15524

SEQ ID NO: 25674 - DNA, 621 bp, Bradyrhizobium japonicum USDA 110; identical to SEQ ID NO: 15525
  CDS (1)..(621)

SEQ ID NO: 25675 - protein, 206 aa, Bradyrhizobium japonicum USDA 110; identical to SEQ ID NO: 15526

SEQ ID NO: 25676 - DNA, 564 bp, Clostridium tetani E88; identical to SEQ ID NO: 15527
  CDS (1)..(564): transl_table=11

SEQ ID NO: 25677 - protein, 187 aa, Clostridium tetani E88; identical to SEQ ID NO: 15528

SEQ ID NO: 25678 - DNA, 618 bp, Lactobacillus plantarum WCFS1; identical to SEQ ID NO: 15529
  CDS (1)..(618): transl_table=11

SEQ ID NO: 25679 - protein, 205 aa, Lactobacillus plantarum WCFS1; identical to SEQ ID NO: 15530

SEQ ID NO: 25680 - DNA, 609 bp, Lactobacillus plantarum WCFS1; identical to SEQ ID NO: 15531
  CDS (1)..(609): transl_table=11

SEQ ID NO: 25681 - protein, 202 aa, Lactobacillus plantarum WCFS1; identical to SEQ ID NO: 15532

SEQ ID NO: 25682 - DNA, 555 bp, Lactobacillus plantarum WCFS1; identical to SEQ ID NO: 15533
  CDS (1)..(555): transl_table=11

SEQ ID NO: 25683 - protein, 184 aa, Lactobacillus plantarum WCFS1; identical to SEQ ID NO: 15534

SEQ ID NO: 25684 - DNA, 603 bp, Lactobacillus plantarum WCFS1; identical to SEQ ID NO: 15535
  CDS (1)..(603): transl_table=11

SEQ ID NO: 25685 - protein, 200 aa, Lactobacillus plantarum WCFS1; identical to SEQ ID NO: 15536

SEQ ID NO: 25686 - DNA, 621 bp, Lactobacillus plantarum WCFS1; identical to SEQ ID NO: 15537
  CDS (1)..(621): transl_table=11

SEQ ID NO: 25687 - protein, 206 aa, Lactobacillus plantarum WCFS1; identical to SEQ ID NO: 15538

SEQ ID NO: 25688 - DNA, 570 bp, Lactobacillus plantarum WCFS1; identical to SEQ ID NO: 15539
  CDS (1)..(570): transl_table=11

SEQ ID NO: 25689 - protein, 189 aa, Lactobacillus plantarum WCFS1; identical to SEQ ID NO: 15540

SEQ ID NO: 25690 - DNA, 561 bp, Lactobacillus plantarum WCFS1; identical to SEQ ID NO: 15541
  CDS (1)..(561): transl_table=11

SEQ ID NO: 25691 - protein, 186 aa, Lactobacillus plantarum WCFS1; identical to SEQ ID NO: 15542

SEQ ID NO: 25692 - DNA, 555 bp, Vibrio parahaemolyticus RIMD 2210633; identical to SEQ ID NO: 15543
  CDS (1)..(555): transl_table=11

SEQ ID NO: 25693 - protein, 184 aa, Vibrio parahaemolyticus RIMD 2210633; identical to SEQ ID NO: 15544

SEQ ID NO: 25694 - DNA, 549 bp, Vibrio parahaemolyticus RIMD 2210633; identical to SEQ ID NO: 15545
  CDS (1)..(549): transl_table=11

SEQ ID NO: 25695 - protein, 182 aa, Vibrio parahaemolyticus RIMD 2210633; identical to SEQ ID NO: 15546

SEQ ID NO: 25696 - DNA, 552 bp, Salmonella enterica subsp. enterica serovar Typhi Ty2; identical to SEQ ID NO: 15547
  CDS (1)..(552): transl_table=11

SEQ ID NO: 25697 - protein, 183 aa, Salmonella enterica subsp. enterica serovar Typhi Ty2; identical to SEQ ID NO: 15548

SEQ ID NO: 25698 - DNA, 759 bp, Bacteroides thetaiotaomicron VPI-5482; identical to SEQ ID NO: 15549
  CDS (1)..(759): transl_table=11

SEQ ID NO: 25699 - protein, 252 aa, Bacteroides thetaiotaomicron VPI-5482; identical to SEQ ID NO: 15550

SEQ ID NO: 25700 - DNA, 624 bp, Bacteroides thetaiotaomicron VPI-5482; identical to SEQ ID NO: 15551
  CDS (1)..(624): transl_table=11

SEQ ID NO: 25701 - protein, 207 aa, Bacteroides thetaiotaomicron VPI-5482; identical to SEQ ID NO: 15552

SEQ ID NO: 25702 - DNA, 564 bp, Bacteroides thetaiotaomicron VPI-5482; identical to SEQ ID NO: 15553
  CDS (1)..(564): transl_table=11

SEQ ID NO: 25703 - protein, 187 aa, Bacteroides thetaiotaomicron VPI-5482; identical to SEQ ID NO: 15554

SEQ ID NO: 25704 - DNA, 606 bp, Bacteroides thetaiotaomicron VPI-5482; identical to SEQ ID NO: 15555
  CDS (1)..(606): transl_table=11

SEQ ID NO: 25705 - protein, 201 aa, Bacteroides thetaiotaomicron VPI-5482; identical to SEQ ID NO: 15556

SEQ ID NO: 25706 - DNA, 552 bp, Bacteroides thetaiotaomicron VPI-5482; identical to SEQ ID NO: 15557
  CDS (1)..(552): transl_table=11

SEQ ID NO: 25707 - protein, 183 aa, Bacteroides thetaiotaomicron VPI-5482; identical to SEQ ID NO: 15558

SEQ ID NO: 25708 - DNA, 846 bp, Enterococcus faecalis V583; identical to SEQ ID NO: 15559
  CDS (1)..(846): transl_table=11

SEQ ID NO: 25709 - protein, 281 aa, Enterococcus faecalis V583; identical to SEQ ID NO: 15560

SEQ ID NO: 25710 - DNA, 639 bp, Enterococcus faecalis V583; identical to SEQ ID NO: 15561
  CDS (1)..(639): transl_table=11

SEQ ID NO: 25711 - protein, 212 aa, Enterococcus faecalis V583; identical to SEQ ID NO: 15562

SEQ ID NO: 25712 - DNA, 582 bp, Enterococcus faecalis V583; identical to SEQ ID NO: 15563
  CDS (1)..(582): transl_table=11

SEQ ID NO: 25713 - protein, 193 aa, Enterococcus faecalis V583; identical to SEQ ID NO: 15564

SEQ ID NO: 25714 - DNA, 723 bp, Bacillus cereus ATCC 14579; identical to SEQ ID NO: 15565
  CDS (1)..(723): transl_table=11

SEQ ID NO: 25715 - protein, 240 aa, Bacillus cereus ATCC 14579; identical to SEQ ID NO: 15566

SEQ ID NO: 25716 - DNA, 561 bp, Bacillus cereus ATCC 14579; identical to SEQ ID NO: 15567
  CDS (1)..(561): transl_table=11

SEQ ID NO: 25717 - protein, 186 aa, Bacillus cereus ATCC 14579; identical to SEQ ID NO: 15568

SEQ ID NO: 25718 - DNA, 666 bp, Bacillus anthracis str. Ames; identical to SEQ ID NO: 15569
  CDS (1)..(666): transl_table=11

SEQ ID NO: 25719 - protein, 221 aa, Bacillus anthracis str. Ames; identical to SEQ ID NO: 15570

SEQ ID NO: 25720 - DNA, 564 bp, Bacillus anthracis str. Ames; identical to SEQ ID NO: 15571
  CDS (1)..(564): transl_table=11

SEQ ID NO: 25721 - protein, 187 aa, Bacillus anthracis str. Ames; identical to SEQ ID NO: 15572

SEQ ID NO: 25722 - DNA, 723 bp, Bacillus anthracis str. Ames; identical to SEQ ID NO: 15573
  CDS (1)..(723): transl_table=11

SEQ ID NO: 25723 - protein, 240 aa, Bacillus anthracis str. Ames; identical to SEQ ID NO: 15574

SEQ ID NO: 25724 - DNA, 618 bp, Helicobacter hepaticus ATCC 51449; identical to SEQ ID NO: 15575
  CDS (1)..(618): transl_table=11

SEQ ID NO: 25725 - protein, 205 aa, Helicobacter hepaticus ATCC 51449; identical to SEQ ID NO: 15576

SEQ ID NO: 25726 - DNA, 555 bp, Rhodopirellula baltica SH 1; identical to SEQ ID NO: 15577
  CDS (1)..(555): transl_table=11

SEQ ID NO: 25727 - protein, 184 aa, Rhodopirellula baltica SH 1; identical to SEQ ID NO: 15578

SEQ ID NO: 25728 - DNA, 522 bp, Chromobacterium violaceum ATCC 12472; identical to SEQ ID NO: 15579
  CDS (1)..(522): transl_table=11

SEQ ID NO: 25729 - protein, 173 aa, Chromobacterium violaceum ATCC 12472; identical to SEQ ID NO: 15580

SEQ ID NO: 25730 - DNA, 561 bp, Gloeobacter violaceus PCC 7421; identical to SEQ ID NO: 15581
  CDS (1)..(561): transl_table=11

SEQ ID NO: 25731 - protein, 186 aa, Gloeobacter violaceus PCC 7421; identical to SEQ ID NO: 15582

SEQ ID NO: 25732 - DNA, 771 bp, Vibrio vulnificus YJ016; identical to SEQ ID NO: 15583
  CDS (1)..(771): transl_table=11

SEQ ID NO: 25733 - protein, 256 aa, Vibrio vulnificus YJ016; identical to SEQ ID NO: 15584

SEQ ID NO: 25734 - DNA, 558 bp, Vibrio vulnificus YJ016; identical to SEQ ID NO: 15585
  CDS (1)..(558): transl_table=11

SEQ ID NO: 25735 - protein, 185 aa, Vibrio vulnificus YJ016; identical to SEQ ID NO: 15586

SEQ ID NO: 25736 - DNA, 657 bp, Vibrio vulnificus YJ016; identical to SEQ ID NO: 15587
  CDS (1)..(657): transl_table=11

SEQ ID NO: 25737 - protein, 218 aa, Vibrio vulnificus YJ016; identical to SEQ ID NO: 15588

SEQ ID NO: 25738 - DNA, 621 bp, Vibrio vulnificus YJ016; identical to SEQ ID NO: 15589
  CDS (1)..(621): transl_table=11

SEQ ID NO: 25739 - protein, 206 aa, Vibrio vulnificus YJ016; identical to SEQ ID NO: 15590

SEQ ID NO: 25740 - DNA, 570 bp, Corynebacterium diphtheriae NCTC 13129; identical to SEQ ID NO: 15591
  CDS (1)..(570): transl_table=11

SEQ ID NO: 25741 - protein, 189 aa, Corynebacterium diphtheriae NCTC 13129; identical to SEQ ID NO: 15592

SEQ ID NO: 25742 - DNA, 573 bp, Rhodopseudomonas palustris CGA009; identical to SEQ ID NO: 15593
  CDS (1)..(573): transl_table=11

SEQ ID NO: 25743 - protein, 190 aa, Rhodopseudomonas palustris CGA009; identical to SEQ ID NO: 15594

SEQ ID NO: 25744 - DNA, 615 bp, Lactobacillus johnsonii NCC 533; identical to SEQ ID NO: 15595
  CDS (1)..(615): transl_table=11

SEQ ID NO: 25745 - protein, 204 aa, Lactobacillus johnsonii NCC 533; identical to SEQ ID NO: 15596

SEQ ID NO: 25746 - DNA, 564 bp, Bacillus cereus ATCC 10987; identical to SEQ ID NO: 15597
  CDS (1)..(564): transl_table=11

SEQ ID NO: 25747 - protein, 187 aa, Bacillus cereus ATCC 10987; identical to SEQ ID NO: 15598

SEQ ID NO: 25748 - DNA, 2154 bp, Neurospora crassa; identical to SEQ ID NO: 15599
  CDS (1)..(2154)

SEQ ID NO: 25749 - protein, 717 aa, Neurospora crassa; identical to SEQ ID NO: 15600

SEQ ID NO: 25750 - DNA, 660 bp, Magnaporthe grisea 70-15; identical to SEQ ID NO: 15601
  CDS (1)..(660)

SEQ ID NO: 25751 - protein, 219 aa, Magnaporthe grisea 70-15; identical to SEQ ID NO: 15602

SEQ ID NO: 25752 - DNA, 699 bp, Gibberella zeae PH-1; identical to SEQ ID NO: 15603
  CDS (1)..(699)

SEQ ID NO: 25753 - protein, 232 aa, Gibberella zeae PH-1; identical to SEQ ID NO: 15604

SEQ ID NO: 25754 - DNA, 699 bp, Gibberella zeae PH-1; identical to SEQ ID NO: 15605
  CDS (1)..(699)

SEQ ID NO: 25755 - protein, 232 aa, Gibberella zeae PH-1; identical to SEQ ID NO: 15606

SEQ ID NO: 25756 - DNA, 690 bp, Ustilago maydis 521; identical to SEQ ID NO: 15607
  CDS (1)..(690)

SEQ ID NO: 25757 - protein, 229 aa, Ustilago maydis 521; identical to SEQ ID NO: 15608

SEQ ID NO: 25758 - DNA, 702 bp, Aspergillus nidulans FGSC A4; identical to SEQ ID NO: 15609
  CDS (1)..(702)

SEQ ID NO: 25759 - protein, 233 aa, Aspergillus nidulans FGSC A4; identical to SEQ ID NO: 15610

SEQ ID NO: 25760 - DNA, 618 bp, Aspergillus nidulans FGSC A4; identical to SEQ ID NO: 15611
  CDS (1)..(618)

SEQ ID NO: 25761 - protein, 205 aa, Aspergillus nidulans FGSC A4; identical to SEQ ID NO: 15612

SEQ ID NO: 25762 - DNA, 573 bp, Candida glabrata CBS138; identical to SEQ ID NO: 15613
  CDS (1)..(573)

SEQ ID NO: 25763 - protein, 190 aa, Candida glabrata CBS138; identical to SEQ ID NO: 15614

SEQ ID NO: 25764 - DNA, 570 bp, Kluyveromyces lactis NRRL Y-1140; identical to SEQ ID NO: 15615
  CDS (1)..(570)

SEQ ID NO: 25765 - protein, 189 aa, Kluyveromyces lactis NRRL Y-1140; identical to SEQ ID NO: 15616

SEQ ID NO: 25766 - DNA, 693 bp, Debaryomyces hansenii CBS767; identical to SEQ ID NO: 15617
  CDS (1)..(693)

SEQ ID NO: 25767 - protein, 230 aa, Debaryomyces hansenii CBS767; identical to SEQ ID NO: 15618

SEQ ID NO: 25768 - DNA, 690 bp, Debaryomyces hansenii CBS767; identical to SEQ ID NO: 15619
  CDS (1)..(690)

SEQ ID NO: 25769 - protein, 229 aa, Debaryomyces hansenii CBS767; identical to SEQ ID NO: 15620

SEQ ID NO: 25770 - DNA, 666 bp, Yarrowia lipolytica CLIB99; identical to SEQ ID NO: 15621
  CDS (1)..(666)

SEQ ID NO: 25771 - protein, 221 aa, Yarrowia lipolytica CLIB99; identical to SEQ ID NO: 15622

SEQ ID NO: 25772 - DNA, 840 bp, Yarrowia lipolytica CLIB99; identical to SEQ ID NO: 15623
  CDS (1)..(840)

SEQ ID NO: 25773 - protein, 279 aa, Yarrowia lipolytica CLIB99; identical to SEQ ID NO: 15624

SEQ ID NO: 25774 - DNA, 642 bp, Cryptococcus neoformans var. neoformans JEC21; identical to SEQ ID NO: 15625
  CDS (1)..(642)

SEQ ID NO: 25775 - protein, 213 aa, Cryptococcus neoformans var. neoformans JEC21; identical to SEQ ID NO: 15626

SEQ ID NO: 25776 - DNA, 546 bp, Dictyostelium discoideum; identical to SEQ ID NO: 15627
  CDS (1)..(546)

SEQ ID NO: 25777 - protein, 181 aa, Dictyostelium discoideum; identical to SEQ ID NO: 15628

SEQ ID NO: 25778 - DNA, 576 bp, Dictyostelium discoideum; identical to SEQ ID NO: 15629
  CDS (1)..(576)

SEQ ID NO: 25779 - protein, 191 aa, Dictyostelium discoideum; identical to SEQ ID NO: 15630

SEQ ID NO: 25780 - DNA, 591 bp, Dictyostelium discoideum; identical to SEQ ID NO: 15631
  CDS (1)..(591)

SEQ ID NO: 25781 - protein, 196 aa, Dictyostelium discoideum; identical to SEQ ID NO: 15632

SEQ ID NO: 25782 - DNA, 573 bp, Dictyostelium discoideum; identical to SEQ ID NO: 15633
  CDS (1)..(573)

SEQ ID NO: 25783 - protein, 190 aa, Dictyostelium discoideum; identical to SEQ ID NO: 15634

SEQ ID NO: 25784 - DNA, 459 bp, Entamoeba histolytica HM-1:IMSS; identical to SEQ ID NO: 15635
  CDS (1)..(459)

SEQ ID NO: 25785 - protein, 152 aa, Entamoeba histolytica HM-1:IMSS; identical to SEQ ID NO: 15636

SEQ ID NO: 25786 - DNA, 609 bp, Entamoeba histolytica HM-1:IMSS; identical to SEQ ID NO: 15637
  CDS (1)..(609)

SEQ ID NO: 25787 - protein, 202 aa, Entamoeba histolytica HM-1:IMSS; identical to SEQ ID NO: 15638

SEQ ID NO: 25788 - DNA, 609 bp, Entamoeba histolytica HM-1:IMSS; identical to SEQ ID NO: 15639
  CDS (1)..(609)

SEQ ID NO: 25789 - protein, 202 aa, Entamoeba histolytica HM-1:IMSS; identical to SEQ ID NO: 15640

SEQ ID NO: 25790 - DNA, 549 bp, Entamoeba histolytica HM-1:IMSS; identical to SEQ ID NO: 15641
  CDS (1)..(549)

SEQ ID NO: 25791 - protein, 182 aa, Entamoeba histolytica HM-1:IMSS; identical to SEQ ID NO: 15642

SEQ ID NO: 25792 - DNA, 612 bp, Entamoeba histolytica HM-1:IMSS; identical to SEQ ID NO: 15643
  CDS (1)..(612)

SEQ ID NO: 25793 - protein, 203 aa, Entamoeba histolytica HM-1:IMSS; identical to SEQ ID NO: 15644

SEQ ID NO: 25794 - DNA, 615 bp, Entamoeba histolytica HM-1:IMSS; identical to SEQ ID NO: 15645
  CDS (1)..(615)

SEQ ID NO: 25795 - protein, 204 aa, Entamoeba histolytica HM-1:IMSS; identical to SEQ ID NO: 15646

SEQ ID NO: 25796 - DNA, 924 bp, Candida albicans SC5314; identical to SEQ ID NO: 15647
  CDS (1)..(924): transl_table=12

SEQ ID NO: 25797 - protein, 307 aa, Candida albicans SC5314; identical to SEQ ID NO: 15648

SEQ ID NO: 25798 - DNA, 888 bp, Thermus thermophilus HB27; identical to SEQ ID NO: 15649
  CDS (1)..(888): transl_table=11

SEQ ID NO: 25799 - protein, 295 aa, Thermus thermophilus HB27; identical to SEQ ID NO: 15650

SEQ ID NO: 25800 - DNA, 594 bp, Desulfovibrio vulgaris subsp. vulgaris str. Hildenborough; identical to SEQ ID NO: 15651
  CDS (1)..(594): transl_table=11

SEQ ID NO: 25801 - protein, 197 aa, Desulfovibrio vulgaris subsp. vulgaris str. Hildenborough; identical to SEQ ID NO: 15652

SEQ ID NO: 25802 - DNA, 570 bp, Listeria monocytogenes str. 4b F2365; identical to SEQ ID NO: 15653
  CDS (1)..(570): transl_table=11

SEQ ID NO: 25803 - protein, 189 aa, Listeria monocytogenes str. 4b F2365; identical to SEQ ID NO: 15654

SEQ ID NO: 25804 - DNA, 564 bp, Listeria monocytogenes str. 4b F2365; identical to SEQ ID NO: 15655
  CDS (1)..(564): transl_table=11

SEQ ID NO: 25805 - protein, 187 aa, Listeria monocytogenes str. 4b F2365; identical to SEQ ID NO: 15656

SEQ ID NO: 25806 - DNA, 564 bp, Bacillus thuringiensis serovar konkukian str. 97-27; identical to SEQ ID NO: 15657
  CDS (1)..(564): transl_table=11

SEQ ID NO: 25807 - protein, 187 aa, Bacillus thuringiensis serovar konkukian str. 97-27; identical to SEQ ID NO: 15658

SEQ ID NO: 25808 - DNA, 486 bp, Staphylococcus aureus subsp. aureus MRSA252; identical to SEQ ID NO: 15659
  CDS (1)..(486): transl_table=11

SEQ ID NO: 25809 - protein, 161 aa, Staphylococcus aureus subsp. aureus MRSA252; identical to SEQ ID NO: 15660

SEQ ID NO: 25810 - DNA, 600 bp, Staphylococcus aureus subsp. aureus MRSA252; identical to SEQ ID NO: 15661
  CDS (1)..(600): transl_table=11

SEQ ID NO: 25811 - protein, 199 aa, Staphylococcus aureus subsp. aureus MRSA252; identical to SEQ ID NO: 15662

SEQ ID NO: 25812 - DNA, 627 bp, Erwinia carotovora subsp. atroseptica SCRI1043; identical to SEQ ID NO: 15663
  CDS (1)..(627)

SEQ ID NO: 25813 - protein, 208 aa, Erwinia carotovora subsp. atroseptica SCRI1043; identical to SEQ ID NO: 15664

SEQ ID NO: 25814 - DNA, 573 bp, Propionibacterium acnes KPA171202; identical to SEQ ID NO: 15665
  CDS (1)..(573): transl_table=11

SEQ ID NO: 25815 - protein, 190 aa, Propionibacterium acnes KPA171202; identical to SEQ ID NO: 15666

SEQ ID NO: 25816 - DNA, 510 bp, Desulfotalea psychrophila LSv54; identical to SEQ ID NO: 15667
  CDS (1)..(510): transl_table=11

SEQ ID NO: 25817 - protein, 169 aa, Desulfotalea psychrophila LSv54; identical to SEQ ID NO: 15668

SEQ ID NO: 25818 - DNA, 579 bp, Bacillus licheniformis ATCC 14580; identical to SEQ ID NO: 15669
  CDS (1)..(579): transl_table=11

SEQ ID NO: 25819 - protein, 192 aa, Bacillus licheniformis ATCC 14580; identical to SEQ ID NO: 15670

SEQ ID NO: 25820 - DNA, 564 bp, Bacillus cereus E33L; identical to SEQ ID NO: 15671
  CDS (1)..(564): transl_table=11

SEQ ID NO: 25821 - protein, 187 aa, Bacillus cereus E33L; identical to SEQ ID NO: 15672

SEQ ID NO: 25822 - DNA, 603 bp, Mannheimia succiniciproducens MBEL55E; identical to SEQ ID NO: 15673
  CDS (1)..(603): transl_table=11

SEQ ID NO: 25823 - protein, 200 aa, Mannheimia succiniciproducens MBEL55E; identical to SEQ ID NO: 15674

SEQ ID NO: 25824 - DNA, 597 bp, Mannheimia succiniciproducens MBEL55E; identical to SEQ ID NO: 15675
  CDS (1)..(597): transl_table=11

SEQ ID NO: 25825 - protein, 198 aa, Mannheimia succiniciproducens MBEL55E; identical to SEQ ID NO: 15676

SEQ ID NO: 25826 - DNA, 606 bp, Bacteroides fragilis YCH46; identical to SEQ ID NO: 15677
  CDS (1)..(606): transl_table=11

SEQ ID NO: 25827 - protein, 201 aa, Bacteroides fragilis YCH46; identical to SEQ ID NO: 15678

SEQ ID NO: 25828 - DNA, 630 bp, Bacteroides fragilis YCH46; identical to SEQ ID NO: 15679
  CDS (1)..(630): transl_table=11

SEQ ID NO: 25829 - protein, 209 aa, Bacteroides fragilis YCH46; identical to SEQ ID NO: 15680

SEQ ID NO: 25830 - DNA, 627 bp, Bacteroides fragilis YCH46; identical to SEQ ID NO: 15681
  CDS (1)..(627): transl_table=11

SEQ ID NO: 25831 - protein, 208 aa, Bacteroides fragilis YCH46; identical to SEQ ID NO: 15682

SEQ ID NO: 25832 - DNA, 591 bp, Methylococcus capsulatus str. Bath; identical to SEQ ID NO: 15683
  CDS (1)..(591): transl_table=11

SEQ ID NO: 25833 - protein, 196 aa, Methylococcus capsulatus str. Bath; identical to SEQ ID NO: 15684

SEQ ID NO: 25834 - DNA, 648 bp, Photobacterium profundum SS9; identical to SEQ ID NO: 15685
  CDS (1)..(648): transl_table=11

SEQ ID NO: 25835 - protein, 215 aa, Photobacterium profundum SS9; identical to SEQ ID NO: 15686

SEQ ID NO: 25836 - DNA, 549 bp, Photobacterium profundum SS9; identical to SEQ ID NO: 15687
  CDS (1)..(549): transl_table=11

SEQ ID NO: 25837 - protein, 182 aa, Photobacterium profundum SS9; identical to SEQ ID NO: 15688

SEQ ID NO: 25838 - DNA, 564 bp, Photobacterium profundum SS9; identical to SEQ ID NO: 15689
  CDS (1)..(564): transl_table=11

SEQ ID NO: 25839 - protein, 187 aa, Photobacterium profundum SS9; identical to SEQ ID NO: 15690

SEQ ID NO: 25840 - DNA, 561 bp, Haloarcula marismortui ATCC 43049; identical to SEQ ID NO: 15691
  CDS (1)..(561): transl_table=11

SEQ ID NO: 25841 - protein, 186 aa, Haloarcula marismortui ATCC 43049; identical to SEQ ID NO: 15692

SEQ ID NO: 25842 - DNA, 675 bp, Geobacillus kaustophilus HTA426; identical to SEQ ID NO: 15693
  CDS (1)..(675): transl_table=11

SEQ ID NO: 25843 - protein, 224 aa, Geobacillus kaustophilus HTA426; identical to SEQ ID NO: 15694

SEQ ID NO: 25844 - DNA, 558 bp, Geobacillus kaustophilus HTA426; identical to SEQ ID NO: 15695
  CDS (1)..(558): transl_table=11

SEQ ID NO: 25845 - protein, 185 aa, Geobacillus kaustophilus HTA426; identical to SEQ ID NO: 15696

SEQ ID NO: 25846 - DNA, 552 bp, Azoarcus sp. EbN1; identical to SEQ ID NO: 15697
  CDS (1)..(552): transl_table=11

SEQ ID NO: 25847 - protein, 183 aa, Azoarcus sp. EbN1; identical to SEQ ID NO: 15698

SEQ ID NO: 25848 - DNA, 600 bp, Zymomonas mobilis subsp. mobilis ZM4; identical to SEQ ID NO: 15699
  CDS (1)..(600): transl_table=11

SEQ ID NO: 25849 - protein, 199 aa, Zymomonas mobilis subsp. mobilis ZM4; identical to SEQ ID NO: 15700

SEQ ID NO: 25850 - DNA, 693 bp, Dehalococcoides ethenogenes 195; identical to SEQ ID NO: 15701
  CDS (1)..(693): transl_table=11

SEQ ID NO: 25851 - protein, 230 aa, Dehalococcoides ethenogenes 195; identical to SEQ ID NO: 15702

SEQ ID NO: 25852 - DNA, 486 bp, Staphylococcus aureus subsp. aureus COL; identical to SEQ ID NO: 15703
  CDS (1)..(486): transl_table=11

SEQ ID NO: 25853 - protein, 161 aa, Staphylococcus aureus subsp. aureus COL; identical to SEQ ID NO: 15704

SEQ ID NO: 25854 - DNA, 600 bp, Staphylococcus aureus subsp. aureus COL; identical to SEQ ID NO: 15705
  CDS (1)..(600): transl_table=11

SEQ ID NO: 25855 - protein, 199 aa, Staphylococcus aureus subsp. aureus COL; identical to SEQ ID NO: 15706

SEQ ID NO: 25856 - DNA, 615 bp, Lactobacillus acidophilus NCFM; identical to SEQ ID NO: 15707
  CDS (1)..(615): transl_table=11

SEQ ID NO: 25857 - protein, 204 aa, Lactobacillus acidophilus NCFM; identical to SEQ ID NO: 15708

SEQ ID NO: 25858 - DNA, 600 bp, Vibrio fischeri ES114; identical to SEQ ID NO: 15709
  CDS (1)..(600): transl_table=11

SEQ ID NO: 25859 - protein, 199 aa, Vibrio fischeri ES114; identical to SEQ ID NO: 15710

SEQ ID NO: 25860 - DNA, 546 bp, Vibrio fischeri ES114; identical to SEQ ID NO: 15711
  CDS (1)..(546): transl_table=11

SEQ ID NO: 25861 - protein, 181 aa, Vibrio fischeri ES114; identical to SEQ ID NO: 15712

SEQ ID NO: 25862 - DNA, 552 bp, Vibrio fischeri ES114; identical to SEQ ID NO: 15713
  CDS (1)..(552): transl_table=11

SEQ ID NO: 25863 - protein, 183 aa, Vibrio fischeri ES114; identical to SEQ ID NO: 15714

SEQ ID NO: 25864 - DNA, 756 bp, Vibrio fischeri ES114; identical to SEQ ID NO: 15715
  CDS (1)..(756): transl_table=11

SEQ ID NO: 25865 - protein, 251 aa, Vibrio fischeri ES114; identical to SEQ ID NO: 15716

SEQ ID NO: 25866 - DNA, 522 bp, Bacteroides fragilis NCTC 9343; identical to SEQ ID NO: 15717
  CDS (1)..(522): transl_table=11

SEQ ID NO: 25867 - protein, 173 aa, Bacteroides fragilis NCTC 9343; identical to SEQ ID NO: 15718

SEQ ID NO: 25868 - DNA, 600 bp, Bacteroides fragilis NCTC 9343; identical to SEQ ID NO: 15719
  CDS (1)..(600): transl_table=11

SEQ ID NO: 25869 - protein, 199 aa, Bacteroides fragilis NCTC 9343; identical to SEQ ID NO: 15720

SEQ ID NO: 25870 - DNA, 630 bp, Bacteroides fragilis NCTC 9343; identical to SEQ ID NO: 15721
  CDS (1)..(630): transl_table=11

SEQ ID NO: 25871 - protein, 209 aa, Bacteroides fragilis NCTC 9343; identical to SEQ ID NO: 15722

SEQ ID NO: 25872 - DNA, 624 bp, Bacteroides fragilis NCTC 9343; identical to SEQ ID NO: 15723
  CDS (1)..(624): transl_table=11

SEQ ID NO: 25873 - protein, 207 aa, Bacteroides fragilis NCTC 9343; identical to SEQ ID NO: 15724

SEQ ID NO: 25874 - DNA, 552 bp, Bacteroides fragilis NCTC 9343; identical to SEQ ID NO: 15725
  CDS (1)..(552): transl_table=11

SEQ ID NO: 25875 - protein, 183 aa, Bacteroides fragilis NCTC 9343; identical to SEQ ID NO: 15726

SEQ ID NO: 25876 - DNA, 588 bp, Bacteroides fragilis NCTC 9343; identical to SEQ ID NO: 15727
  CDS (1)..(588): transl_table=11

SEQ ID NO: 25877 - protein, 195 aa, Bacteroides fragilis NCTC 9343; identical to SEQ ID NO: 15728

SEQ ID NO: 25878 - DNA, 690 bp, Brucella abortus biovar 1 str. 9-941; identical to SEQ ID NO: 15729
  CDS (1)..(690): transl_table=11

SEQ ID NO: 25879 - protein, 229 aa, Brucella abortus biovar 1 str. 9-941; identical to SEQ ID NO: 15730

SEQ ID NO: 25880 - DNA, 690 bp, Chloroflexus aurantiacus; identical to SEQ ID NO: 15731
  CDS (1)..(690)

SEQ ID NO: 25881 - protein, 229 aa, Chloroflexus aurantiacus; identical to SEQ ID NO: 15732

SEQ ID NO: 25882 - DNA, 564 bp, Chloroflexus aurantiacus; identical to SEQ ID NO: 15733
  CDS (1)..(564)

SEQ ID NO: 25883 - protein, 187 aa, Chloroflexus aurantiacus; identical to SEQ ID NO: 15734

SEQ ID NO: 25884 - DNA, 615 bp, Lactobacillus gasseri; identical to SEQ ID NO: 15735
  CDS (1)..(615)

SEQ ID NO: 25885 - protein, 204 aa, Lactobacillus gasseri; identical to SEQ ID NO: 15736

SEQ ID NO: 25886 - DNA, 606 bp, Magnetospirillum magnetotacticum MS-1; identical to SEQ ID NO: 15737
  CDS (1)..(606)

SEQ ID NO: 25887 - protein, 201 aa, Magnetospirillum magnetotacticum MS-1; identical to SEQ ID NO: 15738

SEQ ID NO: 25888 - DNA, 702 bp, Leuconostoc mesenteroides subsp. mesenteroides ATCC 8293; identical to SEQ ID NO: 15739
  CDS (1)..(702)

SEQ ID NO: 25889 - protein, 233 aa, Leuconostoc mesenteroides subsp. mesenteroides ATCC 8293; identical to SEQ ID NO: 15740

SEQ ID NO: 25890 - DNA, 561 bp, Nostoc punctiforme PCC 73102; identical to SEQ ID NO: 15741
  CDS (1)..(561)

SEQ ID NO: 25891 - protein, 186 aa, Nostoc punctiforme PCC 73102; identical to SEQ ID NO: 15742

SEQ ID NO: 25892 - DNA, 594 bp, Nostoc punctiforme PCC 73102; identical to SEQ ID NO: 15743
  CDS (1)..(594)

SEQ ID NO: 25893 - protein, 197 aa, Nostoc punctiforme PCC 73102; identical to SEQ ID NO: 15744

SEQ ID NO: 25894 - DNA, 702 bp, Nostoc punctiforme PCC 73102; identical to SEQ ID NO: 15745
  CDS (1)..(702)

SEQ ID NO: 25895 - protein, 233 aa, Nostoc punctiforme PCC 73102; identical to SEQ ID NO: 15746

SEQ ID NO: 25896 - DNA, 675 bp, Bifidobacterium longum DJO10A; identical to SEQ ID NO: 15747
  CDS (1)..(675)

SEQ ID NO: 25897 - protein, 224 aa, Bifidobacterium longum DJO10A; identical to SEQ ID NO: 15748

SEQ ID NO: 25898 - DNA, 633 bp, Bifidobacterium longum DJO10A; identical to SEQ ID NO: 15749
  CDS (1)..(633)

SEQ ID NO: 25899 - protein, 210 aa, Bifidobacterium longum DJO10A; identical to SEQ ID NO: 15750

SEQ ID NO: 25900 - DNA, 609 bp, Desulfovibrio desulfuricans G20; identical to SEQ ID NO: 15751
  CDS (1)..(609)

SEQ ID NO: 25901 - protein, 202 aa, Desulfovibrio desulfuricans G20; identical to SEQ ID NO: 15752

SEQ ID NO: 25902 - DNA, 558 bp, Desulfovibrio desulfuricans G20; identical to SEQ ID NO: 15753
  CDS (1)..(558)

SEQ ID NO: 25903 - protein, 185 aa, Desulfovibrio desulfuricans G20; identical to SEQ ID NO: 15754

SEQ ID NO: 25904 - DNA, 576 bp, Anabaena variabilis ATCC 29413; identical to SEQ ID NO: 15755
  CDS (1)..(576)

SEQ ID NO: 25905 - protein, 191 aa, Anabaena variabilis ATCC 29413; identical to SEQ ID NO: 15756

SEQ ID NO: 25906 - DNA, 561 bp, Anabaena variabilis ATCC 29413; identical to SEQ ID NO: 15757
  CDS (1)..(561)

SEQ ID NO: 25907 - protein, 186 aa, Anabaena variabilis ATCC 29413; identical to SEQ ID NO: 15758

SEQ ID NO: 25908 - DNA, 576 bp, Actinobacillus pleuropneumoniae serovar 1 str. 4074; identical to SEQ ID NO: 15759
  CDS (1)..(576)

SEQ ID NO: 25909 - protein, 191 aa, Actinobacillus pleuropneumoniae serovar 1 str. 4074; identical to SEQ ID NO: 15760

SEQ ID NO: 25910 - DNA, 501 bp, Burkholderia cepacia R18194; identical to SEQ ID NO: 15761
  CDS (1)..(501)

SEQ ID NO: 25911 - protein, 166 aa, Burkholderia cepacia R18194; identical to SEQ ID NO: 15762

SEQ ID NO: 25912 - DNA, 609 bp, Burkholderia cepacia R18194; identical to SEQ ID NO: 15763
  CDS (1)..(609)

SEQ ID NO: 25913 - protein, 202 aa, Burkholderia cepacia R18194; identical to SEQ ID NO: 15764

SEQ ID NO: 25914 - DNA, 528 bp, Listeria monocytogenes str. 4b H7858; identical to SEQ ID NO: 15765
  CDS (1)..(528): transl_table=11

SEQ ID NO: 25915 - protein, 175 aa, Listeria monocytogenes str. 4b H7858; identical to SEQ ID NO: 15766

SEQ ID NO: 25916 - DNA, 570 bp, Listeria monocytogenes str. 4b H7858; identical to SEQ ID NO: 15767
  CDS (1)..(570): transl_table=11

SEQ ID NO: 25917 - protein, 189 aa, Listeria monocytogenes str. 4b H7858; identical to SEQ ID NO: 15768

SEQ ID NO: 25918 - DNA, 564 bp, Bacillus cereus G9241; identical to SEQ ID NO: 15769
  CDS (1)..(564): transl_table=11

SEQ ID NO: 25919 - protein, 187 aa, Bacillus cereus G9241; identical to SEQ ID NO: 15770

SEQ ID NO: 25920 - DNA, 558 bp, Bacillus cereus G9241; identical to SEQ ID NO: 15771
  CDS (1)..(558): transl_table=11

SEQ ID NO: 25921 - protein, 185 aa, Bacillus cereus G9241; identical to SEQ ID NO: 15772

SEQ ID NO: 25922 - DNA, 588 bp, Burkholderia fungorum LB400; identical to SEQ ID NO: 15773
  CDS (1)..(588)

SEQ ID NO: 25923 - protein, 195 aa, Burkholderia fungorum LB400; identical to SEQ ID NO: 15774

SEQ ID NO: 25924 - DNA, 555 bp, Thermobifida fusca; identical to SEQ ID NO: 15775
  CDS (1)..(555)

SEQ ID NO: 25925 - protein, 184 aa, Thermobifida fusca; identical to SEQ ID NO: 15776

SEQ ID NO: 25926 - DNA, 513 bp, Cytophaga hutchinsonii; identical to SEQ ID NO: 15777
  CDS (1)..(513)

SEQ ID NO: 25927 - protein, 170 aa, Cytophaga hutchinsonii; identical to SEQ ID NO: 15778

SEQ ID NO: 25928 - DNA, 654 bp, Cytophaga hutchinsonii; identical to SEQ ID NO: 15779
  CDS (1)..(654)

SEQ ID NO: 25929 - protein, 217 aa, Cytophaga hutchinsonii; identical to SEQ ID NO: 15780

SEQ ID NO: 25930 - DNA, 744 bp, Microbulbifer degradans 2-40; identical to SEQ ID NO: 15781
  CDS (1)..(744)

SEQ ID NO: 25931 - protein, 247 aa, Microbulbifer degradans 2-40; identical to SEQ ID NO: 15782

SEQ ID NO: 25932 - DNA, 549 bp, Microbulbifer degradans 2-40; identical to SEQ ID NO: 15783
  CDS (1)..(549)

SEQ ID NO: 25933 - protein, 182 aa, Microbulbifer degradans 2-40; identical to SEQ ID NO: 15784

SEQ ID NO: 25934 - DNA, 417 bp, Oenococcus oeni PSU-1; identical to SEQ ID NO: 15785
  CDS (1)..(417)

SEQ ID NO: 25935 - protein, 138 aa, Oenococcus oeni PSU-1; identical to SEQ ID NO: 15786

SEQ ID NO: 25936 - DNA, 567 bp, Pediococcus pentosaceus ATCC 25745; identical to SEQ ID NO: 15787
  CDS (1)..(567)

SEQ ID NO: 25937 - protein, 188 aa, Pediococcus pentosaceus ATCC 25745; identical to SEQ ID NO: 15788

SEQ ID NO: 25938 - DNA, 555 bp, Pediococcus pentosaceus ATCC 25745; identical to SEQ ID NO: 15789
  CDS (1)..(555)

SEQ ID NO: 25939 - protein, 184 aa, Pediococcus pentosaceus ATCC 25745; identical to SEQ ID NO: 15790

SEQ ID NO: 25940 - DNA, 552 bp, Pediococcus pentosaceus ATCC 25745; identical to SEQ ID NO: 15791
  CDS (1)..(552)

SEQ ID NO: 25941 - protein, 183 aa, Pediococcus pentosaceus ATCC 25745; identical to SEQ ID NO: 15792

SEQ ID NO: 25942 - DNA, 465 bp, Streptococcus suis 89/1591; identical to SEQ ID NO: 15793
  CDS (1)..(465)

SEQ ID NO: 25943 - protein, 154 aa, Streptococcus suis 89/1591; identical to SEQ ID NO: 15794

SEQ ID NO: 25944 - DNA, 606 bp, Desulfovibrio desulfuricans G20; identical to SEQ ID NO: 15795
  CDS (1)..(606)

SEQ ID NO: 25945 - protein, 201 aa, Desulfovibrio desulfuricans G20; identical to SEQ ID NO: 15796

SEQ ID NO: 25946 - DNA, 543 bp, Chloroflexus aurantiacus; identical to SEQ ID NO: 15797
  CDS (1)..(543)

SEQ ID NO: 25947 - protein, 180 aa, Chloroflexus aurantiacus; identical to SEQ ID NO: 15798

SEQ ID NO: 25948 - DNA, 186 bp, Brevibacterium linens BL2; identical to SEQ ID NO: 15799
  CDS (1)..(186)

SEQ ID NO: 25949 - protein, 61 aa, Brevibacterium linens BL2; identical to SEQ ID NO: 15800

SEQ ID NO: 25950 - DNA, 612 bp, Lactococcus lactis subsp. cremoris SK11; identical to SEQ ID NO: 15801
  CDS (1)..(612)

SEQ ID NO: 25951 - protein, 203 aa, Lactococcus lactis subsp. cremoris SK11; identical to SEQ ID NO: 15802

SEQ ID NO: 25952 - DNA, 588 bp, Lactococcus lactis subsp. cremoris SK11; identical to SEQ ID NO: 15803
  CDS (1)..(588)

SEQ ID NO: 25953 - protein, 195 aa, Lactococcus lactis subsp. cremoris SK11; identical to SEQ ID NO: 15804

SEQ ID NO: 25954 - DNA, 597 bp, Lactobacillus casei ATCC 334; identical to SEQ ID NO: 15805
  CDS (1)..(597)

SEQ ID NO: 25955 - protein, 198 aa, Lactobacillus casei ATCC 334; identical to SEQ ID NO: 15806

SEQ ID NO: 25956 - DNA, 705 bp, Lactobacillus casei ATCC 334; identical to SEQ ID NO: 15807
  CDS (1)..(705)

SEQ ID NO: 25957 - protein, 234 aa, Lactobacillus casei ATCC 334; identical to SEQ ID NO: 15808

SEQ ID NO: 25958 - DNA, 591 bp, Lactobacillus delbrueckii subsp. bulgaricus ATCC BAA-365; identical to SEQ ID NO: 15809
  CDS (1)..(591)

SEQ ID NO: 25959 - protein, 196 aa, Lactobacillus delbrueckii subsp. bulgaricus ATCC BAA-365; identical to SEQ ID NO: 15810

SEQ ID NO: 25960 - DNA, 609 bp, Bacillus anthracis str. A2012; identical to SEQ ID NO: 15811
  CDS (1)..(609): n means a or g or c or t/u, s means g or c

SEQ ID NO: 25961 - protein, 202 aa, Bacillus anthracis str. A2012; identical to SEQ ID NO: 15812
  Xaa in position 136 is unknown

SEQ ID NO: 25962 - DNA, 534 bp, Anaeromyxobacter dehalogenans 2CP-C; identical to SEQ ID NO: 15813
  CDS (1)..(534): transl_table=11

SEQ ID NO: 25963 - protein, 177 aa, Anaeromyxobacter dehalogenans 2CP-C; identical to SEQ ID NO: 15814

SEQ ID NO: 25964 - DNA, 663 bp, Streptococcus pneumoniae TIGR4; identical to SEQ ID NO: 15815
  CDS (1)..(663)

SEQ ID NO: 25965 - protein, 220 aa, Streptococcus pneumoniae TIGR4; identical to SEQ ID NO: 15816

SEQ ID NO: 25966 - DNA, 558 bp, Burkholderia vietnamiensis G4; identical to SEQ ID NO: 15817
  CDS (1)..(558): transl_table=11

SEQ ID NO: 25967 - protein, 185 aa, Burkholderia vietnamiensis G4; identical to SEQ ID NO: 15818

SEQ ID NO: 25968 - DNA, 576 bp, Crocosphaera watsonii WH 8501; identical to SEQ ID NO: 15819
  CDS (1)..(576): transl_table=11

SEQ ID NO: 25969 - protein, 191 aa, Crocosphaera watsonii WH 8501; identical to SEQ ID NO: 15820

SEQ ID NO: 25970 - DNA, 555 bp, Chlorobium phaeobacteroides DSM 266; identical to SEQ ID NO: 15821
  CDS (1)..(555): transl_table=11

SEQ ID NO: 25971 - protein, 184 aa, Chlorobium phaeobacteroides DSM 266; identical to SEQ ID NO: 15822

SEQ ID NO: 25972 - DNA, 618 bp, Chlorobium phaeobacteroides BS1; identical to SEQ ID NO: 15823
  CDS (1)..(618): transl_table=11

SEQ ID NO: 25973 - protein, 205 aa, Chlorobium phaeobacteroides BS1; identical to SEQ ID NO: 15824

SEQ ID NO: 25974 - DNA, 576 bp, Exiguobacterium sp. 255-15; identical to SEQ ID NO: 15825
  CDS (1)..(576): transl_table=11

SEQ ID NO: 25975 - protein, 191 aa, Exiguobacterium sp. 255-15; identical to SEQ ID NO: 15826

SEQ ID NO: 25976 - DNA, 552 bp, Exiguobacterium sp. 255-15; identical to SEQ ID NO: 15827
  CDS (1)..(552): transl_table=11

SEQ ID NO: 25977 - protein, 183 aa, Exiguobacterium sp. 255-15; identical to SEQ ID NO: 15828

SEQ ID NO: 25978 - DNA, 702 bp, Exiguobacterium sp. 255-15; identical to SEQ ID NO: 15829
  CDS (1)..(702): transl_table=11

SEQ ID NO: 25979 - protein, 233 aa, Exiguobacterium sp. 255-15; identical to SEQ ID NO: 15830

SEQ ID NO: 25980 - DNA, 642 bp, Methanosarcina barkeri str. fusaro; identical to SEQ ID NO: 15831
  CDS (1)..(642): transl_table=11

SEQ ID NO: 25981 - protein, 213 aa, Methanosarcina barkeri str. fusaro; identical to SEQ ID NO: 15832

SEQ ID NO: 25982 - DNA, 600 bp, Methanosarcina barkeri str. fusaro; identical to SEQ ID NO: 15833
  CDS (1)..(600): transl_table=11

SEQ ID NO: 25983 - protein, 199 aa, Methanosarcina barkeri str. fusaro; identical to SEQ ID NO: 15834

SEQ ID NO: 25984 - DNA, 549 bp, Methanosarcina barkeri str. fusaro; identical to SEQ ID NO: 15835
  CDS (1)..(549): transl_table=11

SEQ ID NO: 25985 - protein, 182 aa, Methanosarcina barkeri str. fusaro; identical to SEQ ID NO: 15836

SEQ ID NO: 25986 - DNA, 609 bp, Methanosarcina barkeri str. fusaro; identical to SEQ ID NO: 15837
  CDS (1)..(609): transl_table=11

SEQ ID NO: 25987 - protein, 202 aa, Methanosarcina barkeri str. fusaro; identical to SEQ ID NO: 15838

SEQ ID NO: 25988 - DNA, 531 bp, Desulfuromonas acetoxidans DSM 684; identical to SEQ ID NO: 15839
  CDS (1)..(531): transl_table=11

SEQ ID NO: 25989 - protein, 176 aa, Desulfuromonas acetoxidans DSM 684; identical to SEQ ID NO: 15840

SEQ ID NO: 25990 - DNA, 555 bp, Jannaschia sp. CCS1; identical to SEQ ID NO: 15841
  CDS (1)..(555): transl_table=11

SEQ ID NO: 25991 - protein, 184 aa, Jannaschia sp. CCS1; identical to SEQ ID NO: 15842

SEQ ID NO: 25992 - DNA, 630 bp, Frankia sp. EAN1pec; identical to SEQ ID NO: 15843
  CDS (1)..(630): transl_table=11

SEQ ID NO: 25993 - protein, 209 aa, Frankia sp. EAN1pec; identical to SEQ ID NO: 15844

SEQ ID NO: 25994 - DNA, 555 bp, Shewanella baltica OS155; identical to SEQ ID NO: 15845
  CDS (1)..(555): transl_table=11

SEQ ID NO: 25995 - protein, 184 aa, Shewanella baltica OS155; identical to SEQ ID NO: 15846

SEQ ID NO: 25996 - DNA, 585 bp, Shewanella baltica OS155; identical to SEQ ID NO: 15847
  CDS (1)..(585): transl_table=11

SEQ ID NO: 25997 - protein, 194 aa, Shewanella baltica OS155; identical to SEQ ID NO: 15848

SEQ ID NO: 25998 - DNA, 726 bp, Ralstonia metallidurans CH34; identical to SEQ ID NO: 15849
  CDS (1)..(726): transl_table=11

SEQ ID NO: 25999 - protein, 241 aa, Ralstonia metallidurans CH34; identical to SEQ ID NO: 15850

SEQ ID NO: 26000 - DNA, 549 bp, Paracoccus denitrificans PD1222; identical to SEQ ID NO: 15851
  CDS (1)..(549): transl_table=11

SEQ ID NO: 26001 - protein, 182 aa, Paracoccus denitrificans PD1222; identical to SEQ ID NO: 15852

SEQ ID NO: 26002 - DNA, 615 bp, Shewanella frigidimarina NCIMB 400; identical to SEQ ID NO: 15853
  CDS (1)..(615): transl_table=11

SEQ ID NO: 26003 - protein, 204 aa, Shewanella frigidimarina NCIMB 400; identical to SEQ ID NO: 15854

SEQ ID NO: 26004 - DNA, 777 bp, Escherichia coli; identical to SEQ ID NO: 15855
  CDS (1)..(777): transl_table=11

SEQ ID NO: 26005 - protein, 258 aa, Escherichia coli; identical to SEQ ID NO: 15856

SEQ ID NO: 26006 - DNA, 651 bp, Pseudomonas fluorescens; identical to SEQ ID NO: 15857
  CDS (1)..(651): transl_table=11

SEQ ID NO: 26007 - protein, 216 aa, Pseudomonas fluorescens; identical to SEQ ID NO: 15858

SEQ ID NO: 26008 - DNA, 579 bp, Staphylococcus haemolyticus; identical to SEQ ID NO: 15859
  CDS (1)..(579): transl_table=11

SEQ ID NO: 26009 - protein, 192 aa, Staphylococcus haemolyticus; identical to SEQ ID NO: 15860

SEQ ID NO: 26010 - DNA, 648 bp, Aspergillus fumigatus Af293; identical to SEQ ID NO: 15861
  CDS (1)..(648)

SEQ ID NO: 26011 - protein, 215 aa, Aspergillus fumigatus Af293; identical to SEQ ID NO: 15862

SEQ ID NO: 26012 - DNA, 747 bp, Aspergillus fumigatus Af293; identical to SEQ ID NO: 15863
  CDS (1)..(747)

SEQ ID NO: 26013 - protein, 248 aa, Aspergillus fumigatus Af293; identical to SEQ ID NO: 15864

SEQ ID NO: 26014 - DNA, 687 bp, Aspergillus fumigatus Af293; identical to SEQ ID NO: 15865
  CDS (1)..(687)

SEQ ID NO: 26015 - protein, 228 aa, Aspergillus fumigatus Af293; identical to SEQ ID NO: 15866

SEQ ID NO: 26016 - DNA, 603 bp, Lactobacillus crispatus; identical to SEQ ID NO: 15867
  CDS (1)..(603): transl_table=11

SEQ ID NO: 26017 - protein, 200 aa, Lactobacillus crispatus; identical to SEQ ID NO: 15868

SEQ ID NO: 26018 - DNA, 642 bp, Cryptococcus neoformans var; identical to SEQ ID NO: 15869
  CDS (1)..(642)

SEQ ID NO: 26019 - protein, 213 aa, Cryptococcus neoformans var; identical to SEQ ID NO: 15870

SEQ ID NO: 26020 - DNA, 513 bp, Klebsiella pneumoniae; identical to SEQ ID NO: 15871
  CDS (1)..(513): transl_table=11

SEQ ID NO: 26021 - protein, 170 aa, Klebsiella pneumoniae; identical to SEQ ID NO: 15872

SEQ ID NO: 26022 - DNA, 555 bp, Vibrio cholerae non; identical to SEQ ID NO: 15873
  CDS (1)..(555): transl_table=11

SEQ ID NO: 26023 - protein, 184 aa, Vibrio cholerae non; identical to SEQ ID NO: 15874

SEQ ID NO: 26024 - DNA, 645 bp, Rhizobium etli; identical to SEQ ID NO: 15875
  CDS (1)..(645): transl_table=11

SEQ ID NO: 26025 - protein, 214 aa, Rhizobium etli; identical to SEQ ID NO: 15876

SEQ ID NO: 26026 - DNA, 558 bp, Bacillus stearothermophilus; identical to SEQ ID NO: 15877
  CDS (1)..(558): transl_table=11

SEQ ID NO: 26027 - protein, 185 aa, Bacillus stearothermophilus; identical to SEQ ID NO: 15878

SEQ ID NO: 26028 - DNA, 594 bp, Rhizobium leguminosarum bv; identical to SEQ ID NO: 15879
  CDS (1)..(594): transl_table=11

SEQ ID NO: 26029 - protein, 197 aa, Rhizobium leguminosarum bv; identical to SEQ ID NO: 15880

SEQ ID NO: 26030 - DNA, 573 bp, Dictyostelium discoideum; identical to SEQ ID NO: 15881
  CDS (1)..(573)

SEQ ID NO: 26031 - protein, 190 aa, Dictyostelium discoideum; identical to SEQ ID NO: 15882

SEQ ID NO: 26032 - DNA, 657 bp, Physcomitrella patens; identical to SEQ ID NO: 15883
  CDS (1)..(657)

SEQ ID NO: 26033 - protein, 218 aa, Physcomitrella patens; identical to SEQ ID NO: 15884

SEQ ID NO: 26034 - DNA, 636 bp, Aeromonas hydrophila; identical to SEQ ID NO: 15885
  CDS (1)..(636): transl_table=11

SEQ ID NO: 26035 - protein, 211 aa, Aeromonas hydrophila; identical to SEQ ID NO: 15886

SEQ ID NO: 26036 - DNA, 600 bp, Aeromonas hydrophila; identical to SEQ ID NO: 15887
  CDS (1)..(600): transl_table=11

SEQ ID NO: 26037 - protein, 199 aa, Aeromonas hydrophila; identical to SEQ ID NO: 15888

SEQ ID NO: 26038 - DNA, 678 bp, Corynebacterium glutamicum; identical to SEQ ID NO: 15889
  CDS (1)..(678): transl_table=11

SEQ ID NO: 26039 - protein, 225 aa, Corynebacterium glutamicum; identical to SEQ ID NO: 15890

SEQ ID NO: 26040 - DNA, 624 bp, Lactococcus lactis; identical to SEQ ID NO: 15891
  CDS (1)..(624): transl_table=11

SEQ ID NO: 26041 - protein, 207 aa, Lactococcus lactis; identical to SEQ ID NO: 15892

SEQ ID NO: 26042 - DNA, 621 bp, Candida albicans; identical to SEQ ID NO: 15893
  CDS (1)..(621): transl_table=12

SEQ ID NO: 26043 - protein, 206 aa, Candida albicans; identical to SEQ ID NO: 15894

SEQ ID NO: 26044 - DNA, 519 bp, Staphylococcus aureus; identical to SEQ ID NO: 15895
  CDS (1)..(519): transl_table=11

SEQ ID NO: 26045 - protein, 172 aa, Staphylococcus aureus; identical to SEQ ID NO: 15896

SEQ ID NO: 26046 - DNA, 555 bp, Bacillus subtilis; identical to SEQ ID NO: 15897
  CDS (1)..(555): transl_table=11

SEQ ID NO: 26047 - protein, 184 aa, Bacillus subtilis; identical to SEQ ID NO: 15898

SEQ ID NO: 26048 - DNA, 552 bp, Escherichia coli; identical to SEQ ID NO: 15433
  CDS (1)..(552)

SEQ ID NO: 26049 - protein, 183 aa, Escherichia coli; identical to SEQ ID NO: 15434

SEQ ID NO: 26050 - DNA, 573 bp, Rhizobium leguminosarum bv; identical to SEQ ID NO: 15901
  CDS (1)..(573): transl_table=11

SEQ ID NO: 26051 - protein, 190 aa, Rhizobium leguminosarum bv; identical to SEQ ID NO: 15902

SEQ ID NO: 26052 - DNA, 552 bp, Rhizobium meliloti; identical to SEQ ID NO: 15903
  CDS (1)..(552): transl_table=11

SEQ ID NO: 26053 - protein, 183 aa, Rhizobium meliloti; identical to SEQ ID NO: 15904

SEQ ID NO: 26054 - DNA, 624 bp, Lactococcus lactis subsp; identical to SEQ ID NO: 15905
  CDS (1)..(624): transl_table=11

SEQ ID NO: 26055 - protein, 207 aa, Lactococcus lactis subsp; identical to SEQ ID NO: 15906

SEQ ID NO: 26056 - DNA, 645 bp, Methanococcus jannaschii; identical to SEQ ID NO: 15907
  CDS (1)..(645): transl_table=11

SEQ ID NO: 26057 - protein, 214 aa, Methanococcus jannaschii; identical to SEQ ID NO: 15908

SEQ ID NO: 26058 - DNA, 624 bp, Schizosaccharomyces pombe; identical to SEQ ID NO: 15909
  CDS (1)..(624)

SEQ ID NO: 26059 - protein, 207 aa, Schizosaccharomyces pombe; identical to SEQ ID NO: 15910

SEQ ID NO: 26060 - DNA, 591 bp, Saccharomyces cerevisiae; identical to SEQ ID NO: 15911
  CDS (1)..(591)

SEQ ID NO: 26061 - protein, 196 aa, Saccharomyces cerevisiae; identical to SEQ ID NO: 15912

SEQ ID NO: 26062 - DNA, 25 bp, Artificial sequence
  (1)..(25): primer
atgaacatgccaatgaccgaaagaa

SEQ ID NO: 26063 - DNA, 28 bp, Artificial sequence
  (1)..(28): primer
ttaaactgacgattcaactttataatct

SEQ ID NO: 26064 - protein, 204 aa, Artificial sequence; identical to SEQ ID NO: 15915
  Variant (2)..(4): xaa in position 2 to 4 is any amino acid
  Variant (5)..(9): xaa in position 5 to 9 is any or no amino acid
  Variant (11)..(26): xaa in position 11 to 26 is any or no amino acid
  Variant (28)..(28): xaa in position 28 is any amino acid
  Variant (31)..(41): xaa in position 31 to 41 is any amino acid
  Variant (42)..(92): xaa in position 42 to 92 is any or no amino acid
  Variant (94)..(94): xaa in position 94 is any or no amino acid
  Variant (97)..(97): xaa in position 97 is any amino acid
  Variant (98)..(101): xaa in position 98 to 101 is any or no amino acid
  Variant (103)..(106): xaa in position 103 to 106 is any amino acid
  Variant (108)..(109): xaa in position 108 to 109 is any amino acid
  Variant (110)..(112): xaa in position 110 to 112 is any or no amino acid
  Variant (114)..(119): xaa in position 114 to 119 is any amino acid
  Variant (120)..(152): xaa in position 120 to 152 is any or no amino acid
  Variant (154)..(154): xaa in position 154 is any amino acid
  Variant (156)..(159): xaa in position 156 to 159 is any amino acid
  Variant (163)..(166): xaa in position 163 to 166 is any or no amino acid
  Variant (168)..(169): xaa in position 168 to 169 is any or no amino acid
  Variant (172)..(172): xaa in position 172 is any or no amino acid
  Variant (175)..(177): xaa in position 175 to 177 is any or no amino acid
  Variant (188)..(188): xaa in position 188 is any amino acid
  Variant (191)..(193): xaa in position 191 to 193 is any amino acid
  Variant (195)..(196): xaa in position 195 to 196 is any amino acid
  Variant (198)..(198): xaa in position 198 is any amino acid
  Variant (200)..(200): xaa in position 200 is any amino acid

SEQ ID NO: 26065 - protein, 12 aa, Artificial sequence
  Variant (2)..(2): xaa in position 2 is any or no amino acid
  Variant (4)..(5): xaa in position 4 to 5 is any amino acid
  Variant (6)..(6): xaa in position 6 is Ala, Cys, Thr or Val
  Variant (7)..(7): xaa in position 7 is any amino acid
  Variant (8)..(8): xaa in position 8 is Phe, Ile, Leu, Met or Val
  Variant (9)..(11): xaa in position 9 to 11 is any amino acid
  Variant (12)..(12): xaa in position 12 is Ala, Cys, Asp, Gly, Asn, Ser, Thr or Val
IXGXXXXXXXXX

SEQ ID NO: 26066 - protein, 43 aa, Artificial sequence; identical to SEQ ID NO: 15917
  Variant (2)..(2): xaa in position 2 is any amino acid
  Variant (3)..(4): xaa in position 3 to 4 is any or no amino acid
  Variant (6)..(10): xaa in position 6 to 10 is any amino acid
  Variant (11)..(12): xaa in position 11 to 12 is any or no amino acid
  Variant (14)..(14): xaa in position 14 is Ala, Ile or Val
  Variant (15)..(15): xaa in position 15 is any amino acid
  Variant (16)..(16): xaa in position 16 is Ile, Leu or Val
  Variant (17)..(17): xaa in position 17 is Asp, Gly or Thr
  Variant (18)..(19): xaa in position 18 to 19 is any amino acid
  Variant (20)..(20): xaa in position 20 is Ala, Cys, Gly, Ser, Thr or Val
  Variant (21)..(21): xaa in position 21 is any amino acid
  Variant (22)..(22): xaa in position 22 is Ala, Ile, Leu or Val
  Variant (23)..(23): xaa in position 23 is Ala, Gly or Ser
  Variant (24)..(25): xaa in position 24 to 25 is any amino acid
  Variant (26)..(26): xaa in position 26 is Ala, Cys, Ser or Thr
  Variant (27)..(27): xaa in position 27 is any amino acid
  Variant (28)..(28): xaa in position 28 is Ala, Ile or Val
  Variant (29)..(31): xaa in position 29 to 31 is any amino acid
  Variant (32)..(32): xaa in position 32 is Phe, Ile, Leu, Met or Val
  Variant (33)..(39): xaa in position 33 to 39 is any amino acid
  Variant (41)..(41): xaa in position 41 is any amino acid
  Variant (43)..(43): xaa in position 43 is Ala, Cys or Gly

SEQ ID NO: 26067 - DNA, 1818 bp, Escherichia coli; identical to SEQ ID NO: 13510
  CDS (1)..(1818)

SEQ ID NO: 26068 - protein, 605 aa, Escherichia coli; identical to SEQ ID NO: 13511

SEQ ID NO: 26069 - DNA, 1665 bp, Mesorhizobium loti MAFF303099; identical to SEQ ID NO: 13512
  CDS (1)..(1665): transl_table=11

SEQ ID NO: 26070 - protein, 554 aa, Mesorhizobium loti MAFF303099; identical to SEQ ID NO: 13513

SEQ ID NO: 26071 - DNA, 1635 bp, Mesorhizobium loti MAFF303099; identical to SEQ ID NO: 13514
  CDS (1)..(1635): transl_table=11

SEQ ID NO: 26072 - protein, 544 aa, Mesorhizobium loti MAFF303099; identical to SEQ ID NO: 13515

SEQ ID NO: 26073 - DNA, 1851 bp, Thermoplasma volcanium GSS1; identical to SEQ ID NO: 13516
  CDS (1)..(1851): transl_table=11

SEQ ID NO: 26074 - protein, 616 aa, Thermoplasma volcanium GSS1; identical to SEQ ID NO: 13517

SEQ ID NO: 26075 - DNA, 1422 bp, Thermotoga maritima MSB8; identical to SEQ ID NO: 13518
  CDS (1)..(1422): transl_table=11

SEQ ID NO: 26076 - protein, 473 aa, Thermotoga maritima MSB8; identical to SEQ ID NO: 13519

SEQ ID NO: 26077 - DNA, 1671 bp, Thermotoga maritima MSB8; identical to SEQ ID NO: 13520
  CDS (1)..(1671): transl_table=11

SEQ ID NO: 26078 - protein, 556 aa, Thermotoga maritima MSB8; identical to SEQ ID NO: 13521

SEQ ID NO: 26079 - DNA, 1737 bp, Bacillus halodurans C-125; identical to SEQ ID NO: 13522
  CDS (1)..(1737): transl_table=11

SEQ ID NO: 26080 - protein, 578 aa, Bacillus halodurans C-125; identical to SEQ ID NO: 13523

SEQ ID NO: 26081 - DNA, 1704 bp, Streptococcus pyogenes M1 GAS; identical to SEQ ID NO: 13524
  CDS (1)..(1704): transl_table=11

SEQ ID NO: 26082 - protein, 567 aa, Streptococcus pyogenes M1 GAS; identical to SEQ ID NO: 13525

SEQ ID NO: 26083 - DNA, 1614 bp, Streptococcus pyogenes M1 GAS; identical to SEQ ID NO: 13526
  CDS (1)..(1614): transl_table=11

SEQ ID NO: 26084 - protein, 537 aa, Streptococcus pyogenes M1 GAS; identical to SEQ ID NO: 13527

SEQ ID NO: 26085 - DNA, 1974 bp, Deinococcus radiodurans R1; identical to SEQ ID NO: 13528
  CDS (1)..(1974): transl_table=11

SEQ ID NO: 26086 - protein, 657 aa, Deinococcus radiodurans R1; identical to SEQ ID NO: 13529

SEQ ID NO: 26087 - DNA, 1497 bp, Deinococcus radiodurans R1; identical to SEQ ID NO: 13530
  CDS (1)..(1497): transl_table=11

SEQ ID NO: 26088 - protein, 498 aa, Deinococcus radiodurans R1; identical to SEQ ID NO: 13531

SEQ ID NO: 26089 - DNA, 1695 bp, Deinococcus radiodurans R1; identical to SEQ ID NO: 13532
  CDS (1)..(1695): transl_table=11

SEQ ID NO: 26090 - protein, 564 aa, Deinococcus radiodurans R1; identical to SEQ ID NO: 13533

SEQ ID NO: 26091 - DNA, 1452 bp, Deinococcus radiodurans R1; identical to SEQ ID NO: 13534
  CDS (1)..(1452): transl_table=11

SEQ ID NO: 26092 - protein, 483 aa, Deinococcus radiodurans R1; identical to SEQ ID NO: 13535

SEQ ID NO: 26093 - DNA, 1659 bp, Deinococcus radiodurans R1; identical to SEQ ID NO: 13536
  CDS (1)..(1659): transl_table=11

SEQ ID NO: 26094 - protein, 552 aa, Deinococcus radiodurans R1; identical to SEQ ID NO: 13537

SEQ ID NO: 26095 - DNA, 1824 bp, Mycoplasma pulmonis UAB CTIP; identical to SEQ ID NO: 13538
  CDS (1)..(1824): transl_table=4

SEQ ID NO: 26096 - protein, 607 aa, Mycoplasma pulmonis UAB CTIP; identical to SEQ ID NO: 13539

SEQ ID NO: 26097 - DNA, 1806 bp, Mycobacterium tuberculosis CDC1551; identical to SEQ ID NO: 13540
  CDS (1)..(1806): transl_table=11

SEQ ID NO: 26098 - protein, 601 aa, Mycobacterium tuberculosis CDC1551; identical to SEQ ID NO: 13541

SEQ ID NO: 26099 - DNA, 1641 bp, Mycobacterium tuberculosis CDC1551; identical to SEQ ID NO: 13542
  CDS (1)..(1641): transl_table=11

SEQ ID NO: 26100 - protein, 546 aa, Mycobacterium tuberculosis CDC1551; identical to SEQ ID NO: 13543

SEQ ID NO: 26101 - DNA, 1356 bp, Clostridium acetobutylicum ATCC 824; identical to SEQ ID NO: 13544
  CDS (1)..(1356): transl_table=11

SEQ ID NO: 26102 - protein, 451 aa, Clostridium acetobutylicum ATCC 824; identical to SEQ ID NO: 13545

SEQ ID NO: 26103 - DNA, 1785 bp, Agrobacterium tumefaciens str. C58; identical to SEQ ID NO: 13546
  CDS (1)..(1785): transl_table=11

SEQ ID NO: 26104 - protein, 594 aa, Agrobacterium tumefaciens str. C58; identical to SEQ ID NO: 13547

SEQ ID NO: 26105 - DNA, 1608 bp, Streptococcus pneumoniae R6; identical to SEQ ID NO: 13548
  CDS (1)..(1608): transl_table=11

SEQ ID NO: 26106 - protein, 535 aa, Streptococcus pneumoniae R6; identical to SEQ ID NO: 13549

SEQ ID NO: 26107 - DNA, 1764 bp, Streptococcus pneumoniae R6; identical to SEQ ID NO: 13550
  CDS (1)..(1764): transl_table=11

SEQ ID NO: 26108 - protein, 587 aa, Streptococcus pneumoniae R6; identical to SEQ ID NO: 13551

SEQ ID NO: 26109 - DNA, 1851 bp, Thermoplasma acidophilum DSM 1728; identical to SEQ ID NO: 13552
  CDS (1)..(1851): transl_table=11

SEQ ID NO: 26110 - protein, 616 aa, Thermoplasma acidophilum DSM 1728; identical to SEQ ID NO: 13553

SEQ ID NO: 26111 - DNA, 1527 bp, Synechocystis sp. PCC 6803; identical to SEQ ID NO: 13554
  CDS (1)..(1527): transl_table=11

SEQ ID NO: 26112 - protein, 508 aa, Synechocystis sp. PCC 6803; identical to SEQ ID NO: 13555

SEQ ID NO: 26113 - DNA, 1818 bp, Salmonella typhimurium LT2; identical to SEQ ID NO: 13556
  CDS (1)..(1818): transl_table=11

SEQ ID NO: 26114 - protein, 605 aa, Salmonella typhimurium LT2; identical to SEQ ID NO: 13557

SEQ ID NO: 26115 - DNA, 1662 bp, Listeria monocytogenes EGD-e; identical to SEQ ID NO: 13558
  CDS (1)..(1662): transl_table=11

SEQ ID NO: 26116 - protein, 553 aa, Listeria monocytogenes EGD-e; identical to SEQ ID NO: 13559

SEQ ID NO: 26117 - DNA, 1776 bp, Listeria monocytogenes EGD-e; identical to SEQ ID NO: 13560
  CDS (1)..(1776): transl_table=11

SEQ ID NO: 26118 - protein, 591 aa, Listeria monocytogenes EGD-e; identical to SEQ ID NO: 13561

SEQ ID NO: 26119 - DNA, 1467 bp, Nostoc sp. PCC 7120; identical to SEQ ID NO: 13562
  CDS (1)..(1467): transl_table=11

SEQ ID NO: 26120 - protein, 488 aa, Nostoc sp. PCC 7120; identical to SEQ ID NO: 13563

SEQ ID NO: 26121 - DNA, 3483 bp, Ralstonia solanacearum GMI1000; identical to SEQ ID NO: 13564
  CDS (1)..(3483): transl_table=11

SEQ ID NO: 26122 - protein, 1160 aa, Ralstonia solanacearum GMI1000; identical to SEQ ID NO: 13565

SEQ ID NO: 26123 - DNA, 1821 bp, Clostridium perfringens str. 13; identical to SEQ ID NO: 13566
  CDS (1)..(1821): transl_table=11

SEQ ID NO: 26124 - protein, 606 aa, Clostridium perfringens str. 13; identical to SEQ ID NO: 13567

SEQ ID NO: 26125 - DNA, 1665 bp, Clostridium perfringens str. 13; identical to SEQ ID NO: 13568
  CDS (1)..(1665): transl_table=11

SEQ ID NO: 26126 - protein, 554 aa, Clostridium perfringens str. 13; identical to SEQ ID NO: 13569

SEQ ID NO: 26127 - DNA, 1833 bp, Clostridium perfringens str. 13; identical to SEQ ID NO: 13570
  CDS (1)..(1833): transl_table=11

SEQ ID NO: 26128 - protein, 610 aa, Clostridium perfringens str. 13; identical to SEQ ID NO: 13571

SEQ ID NO: 26129 - DNA, 1938 bp, Pyrococcus furiosus DSM 3638; identical to SEQ ID NO: 13572
  CDS (1)..(1938): transl_table=11

SEQ ID NO: 26130 - protein, 645 aa, Pyrococcus furiosus DSM 3638; identical to SEQ ID NO: 13573

SEQ ID NO: 26131 - DNA, 1614 bp, Streptococcus pyogenes MGAS8232; identical to SEQ ID NO: 13574
  CDS (1)..(1614): transl_table=11

SEQ ID NO: 26132 - protein, 537 aa, Streptococcus pyogenes MGAS8232; identical to SEQ ID NO: 13575

SEQ ID NO: 26133 - DNA, 1725 bp, Thermoanaerobacter tengcongensis MB4; identical to SEQ ID NO: 13576
  CDS (1)..(1725): transl_table=11

SEQ ID NO: 26134 - protein, 574 aa, Thermoanaerobacter tengcongensis MB4; identical to SEQ ID NO: 13577

SEQ ID NO: 26135 - DNA, 1575 bp, Thermoanaerobacter tengcongensis MB4; identical to SEQ ID NO: 13578
  CDS (1)..(1575): transl_table=11

SEQ ID NO: 26136 - protein, 524 aa, Thermoanaerobacter tengcongensis MB4; identical to SEQ ID NO: 13579

SEQ ID NO: 26137 - DNA, 1719 bp, Streptomyces coelicolor A3(2); identical to SEQ ID NO: 13580
  CDS (1)..(1719)

SEQ ID NO: 26138 - protein, 572 aa, Streptomyces coelicolor A3(2); identical to SEQ ID NO: 13581

SEQ ID NO: 26139 - DNA, 3351 bp, Xanthomonas campestris pv. campestris str. ATCC 33913; identical to SEQ ID NO: 13582
  CDS (1)..(3351): transl_table=11

SEQ ID NO: 26140 - protein, 1116 aa, Xanthomonas campestris pv. campestris str. ATCC 33913; identical to SEQ ID NO: 13583

SEQ ID NO: 26141 - DNA, 1617 bp, Xanthomonas campestris pv. campestris str. ATCC 33913; identical to SEQ ID NO: 13584
  CDS (1)..(1617): transl_table=11

SEQ ID NO: 26142 - protein, 538 aa, Xanthomonas campestris pv. campestris str. ATCC 33913; identical to SEQ ID NO: 13585

SEQ ID NO: 26143 - DNA, 1617 bp, Xanthomonas axonopodis pv. citri str. 306; identical to SEQ ID NO: 13586
  CDS (1)..(1617): transl_table=11

SEQ ID NO: 26144 - protein, 538 aa, Xanthomonas axonopodis pv. citri str. 306; identical to SEQ ID NO: 13587

SEQ ID NO: 26145 - DNA, 3327 bp, Chlorobium tepidum TLS; identical to SEQ ID NO: 13588
  CDS (1)..(3327): transl_table=11

SEQ ID NO: 26146 - protein, 1108 aa, Chlorobium tepidum TLS; identical to SEQ ID NO: 13589

SEQ ID NO: 26147 - DNA, 1668 bp, Yersinia pestis KIM; identical to SEQ ID NO: 13590
  CDS (1)..(1668): transl_table=11

SEQ ID NO: 26148 - protein, 555 aa, Yersinia pestis KIM; identical to SEQ ID NO: 13591

SEQ ID NO: 26149 - DNA, 1830 bp, Yersinia pestis KIM; identical to SEQ ID NO: 13592
  CDS (1)..(1830): transl_table=11

SEQ ID NO: 26150 - protein, 609 aa, Yersinia pestis KIM; identical to SEQ ID NO: 13593

SEQ ID NO: 26151 - DNA, 1608 bp, Streptococcus agalactiae 2603V/R; identical to SEQ ID NO: 13594
  CDS (1)..(1608): transl_table=11

SEQ ID NO: 26152 - protein, 535 aa, Streptococcus agalactiae 2603V/R; identical to SEQ ID NO: 13595

SEQ ID NO: 26153 - DNA, 1497 bp, Oceanobacillus iheyensis HTE831; identical to SEQ ID NO: 13596
  CDS (1)..(1497): transl_table=11

SEQ ID NO: 26154 - protein, 498 aa, Oceanobacillus iheyensis HTE831; identical to SEQ ID NO: 13597

SEQ ID NO: 26155 - DNA, 1752 bp, Oceanobacillus iheyensis HTE831; identical to SEQ ID NO: 13598
  CDS (1)..(1752): transl_table=11

SEQ ID NO: 26156 - protein, 583 aa, Oceanobacillus iheyensis HTE831; identical to SEQ ID NO: 13599

SEQ ID NO: 26157 - DNA, 1398 bp, Bifidobacterium longum NCC2705; identical to SEQ ID NO: 13600
  CDS (1)..(1398): transl_table=11

SEQ ID NO: 26158 - protein, 465 aa, Bifidobacterium longum NCC2705; identical to SEQ ID NO: 13601

SEQ ID NO: 26159 - DNA, 1818 bp, Shigella flexneri 2a str. 301; identical to SEQ ID NO: 13602
  CDS (1)..(1818): transl_table=11

SEQ ID NO: 26160 - protein, 605 aa, Shigella flexneri 2a str. 301; identical to SEQ ID NO: 13603

SEQ ID NO: 26161 - DNA, 1746 bp, Leptospira interrogans serovar Lai str. 56601; identical to SEQ ID NO: 13604
  CDS (1)..(1746): transl_table=11

SEQ ID NO: 26162 - protein, 581 aa, Leptospira interrogans serovar Lai str. 56601; identical to SEQ ID NO: 13605

SEQ ID NO: 26163 - DNA, 1839 bp, Corynebacterium efficiens YS-314; identical to SEQ ID NO: 13606
  CDS (1)..(1839): transl_table=11

SEQ ID NO: 26164 - protein, 612 aa, Corynebacterium efficiens YS-314; identical to SEQ ID NO: 13607

SEQ ID NO: 26165 - DNA, 1839 bp, Vibrio vulnificus CMCP6; identical to SEQ ID NO: 13608
  CDS (1)..(1839): transl_table=11

SEQ ID NO: 26166 - protein, 612 aa, Vibrio vulnificus CMCP6; identical to SEQ ID NO: 13609

SEQ ID NO: 26167 - DNA, 2064 bp, Vibrio vulnificus CMCP6; identical to SEQ ID NO: 13610
  CDS (1)..(2064): transl_table=11

SEQ ID NO: 26168 - protein, 687 aa, Vibrio vulnificus CMCP6; identical to SEQ ID NO: 13611

SEQ ID NO: 26169 - DNA, 1464 bp, Bradyrhizobium japonicum USDA 110; identical to SEQ ID NO: 13612
  CDS (1)..(1464)

SEQ ID NO: 26170 - protein, 487 aa, Bradyrhizobium japonicum USDA 110; identical to SEQ ID NO: 13613

SEQ ID NO: 26171 - DNA, 1698 bp, Bradyrhizobium japonicum USDA 110; identical to SEQ ID NO: 13614
  CDS (1)..(1698)

SEQ ID NO: 26172 - protein, 565 aa, Bradyrhizobium japonicum USDA 110; identical to SEQ ID NO: 13615

SEQ ID NO: 26173 - DNA, 1626 bp, Lactobacillus plantarum WCFS1; identical to SEQ ID NO: 13616
  CDS (1)..(1626): transl_table=11

SEQ ID NO: 26174 - protein, 541 aa, Lactobacillus plantarum WCFS1; identical to SEQ ID NO: 13617

SEQ ID NO: 26175 - DNA, 1827 bp, Vibrio parahaemolyticus RIMD 2210633; identical to SEQ ID NO: 13618
  CDS (1)..(1827): transl_table=11

SEQ ID NO: 26176 - protein, 608 aa, Vibrio parahaemolyticus RIMD 2210633; identical to SEQ ID NO: 13619

SEQ ID NO: 26177 - DNA, 1818 bp, Salmonella enterica subsp. enterica serovar Typhi Ty2; identical to SEQ ID NO: 13620
  CDS (1)..(1818): transl_table=11

SEQ ID NO: 26178 - protein, 605 aa, Salmonella enterica subsp. enterica serovar Typhi Ty2; identical to SEQ ID NO: 13621

SEQ ID NO: 26179 - DNA, 2079 bp, Bacteroides thetaiotaomicron VPI-5482; identical to SEQ ID NO: 13622
  CDS (1)..(2079): transl_table=11

SEQ ID NO: 26180 - protein, 692 aa, Bacteroides thetaiotaomicron VPI-5482; identical to SEQ ID NO: 13623

SEQ ID NO: 26181 - DNA, 1854 bp, Bacteroides thetaiotaomicron VPI-5482; identical to SEQ ID NO: 13624
  CDS (1)..(1854): transl_table=11

SEQ ID NO: 26182 - protein, 617 aa, Bacteroides thetaiotaomicron VPI-5482; identical to SEQ ID NO: 13625

SEQ ID NO: 26183 - DNA, 1767 bp, Enterococcus faecalis V583; identical to SEQ ID NO: 13626
  CDS (1)..(1767): transl_table=11

SEQ ID NO: 26184 - protein, 588 aa, Enterococcus faecalis V583; identical to SEQ ID NO: 13627

SEQ ID NO: 26185 - DNA, 1614 bp, Enterococcus faecalis V583; identical to SEQ ID NO: 13628
  CDS (1)..(1614): transl_table=11

SEQ ID NO: 26186 - protein, 537 aa, Enterococcus faecalis V583; identical to SEQ ID NO: 13629

SEQ ID NO: 26187 - DNA, 1674 bp, Enterococcus faecalis V583; identical to SEQ ID NO: 13630
  CDS (1)..(1674): transl_table=11

SEQ ID NO: 26188 - protein, 557 aa, Enterococcus faecalis V583; identical to SEQ ID NO: 13631

SEQ ID NO: 26189 - DNA, 1719 bp, Streptomyces avermitilis MA-4680; identical to SEQ ID NO: 13632
  CDS (1)..(1719)

SEQ ID NO: 26190 - protein, 572 aa, Streptomyces avermitilis MA-4680; identical to SEQ ID NO: 13633

SEQ ID NO: 26191 - DNA, 1752 bp, Streptomyces avermitilis MA-4680; identical to SEQ ID NO: 13634
  CDS (1)..(1752)

SEQ ID NO: 26192 - protein, 583 aa, Streptomyces avermitilis MA-4680; identical to SEQ ID NO: 13635

SEQ ID NO: 26193 - DNA, 1665 bp, Bacillus anthracis str. Ames; identical to SEQ ID NO: 13636
  CDS (1)..(1665): transl_table=11

SEQ ID NO: 26194 - protein, 554 aa, Bacillus anthracis str. Ames; identical to SEQ ID NO: 13637

SEQ ID NO: 26195 - DNA, 1761 bp, Bacillus anthracis str. Ames; identical to SEQ ID NO: 13638
  CDS (1)..(1761): transl_table=11

SEQ ID NO: 26196 - protein, 586 aa, Bacillus anthracis str. Ames; identical to SEQ ID NO: 13639

SEQ ID NO: 26197 - DNA, 1641 bp, Mycobacterium bovis AF2122/97; identical to SEQ ID NO: 13640
  CDS (1)..(1641): transl_table=11

SEQ ID NO: 26198 - protein, 546 aa, Mycobacterium bovis AF2122/97; identical to SEQ ID NO: 13641

SEQ ID NO: 26199 - DNA, 1761 bp, Rhodopirellula baltica SH 1; identical to SEQ ID NO: 13642
  CDS (1)..(1761): transl_table=11

SEQ ID NO: 26200 - protein, 586 aa, Rhodopirellula baltica SH 1; identical to SEQ ID NO: 13643

SEQ ID NO: 26201 - DNA, 3342 bp, Bordetella pertussis Tohama I; identical to SEQ ID NO: 13644
  CDS (1)..(3342): transl_table=11

SEQ ID NO: 26202 - protein, 1113 aa, Bordetella pertussis Tohama I; identical to SEQ ID NO: 13645

SEQ ID NO: 26203 - DNA, 3342 bp, Bordetella bronchiseptica RB50; identical to SEQ ID NO: 13646
  CDS (1)..(3342)

SEQ ID NO: 26204 - protein, 1113 aa, Bordetella bronchiseptica RB50; identical to SEQ ID NO: 13647

SEQ ID NO: 26205 - DNA, 1452 bp, Prochlorococcus marinus str. MIT 9313; identical to SEQ ID NO: 13648
  CDS (1)..(1452): transl_table=11

SEQ ID NO: 26206 - protein, 483 aa, Prochlorococcus marinus str. MIT 9313; identical to SEQ ID NO: 13649

SEQ ID NO: 26207 - DNA, 1407 bp, Synechococcus sp. WH 8102; identical to SEQ ID NO: 13650
  CDS (1)..(1407): transl_table=11

SEQ ID NO: 26208 - protein, 468 aa, Synechococcus sp. WH 8102; identical to SEQ ID NO: 13651

SEQ ID NO: 26209 - DNA, 1662 bp, Synechococcus sp. WH 8102; identical to SEQ ID NO: 13652
  CDS (1)..(1662): transl_table=11

SEQ ID NO: 26210 - protein, 553 aa, Synechococcus sp. WH 8102; identical to SEQ ID NO: 13653

SEQ ID NO: 26211 - DNA, 1863 bp, Gloeobacter violaceus PCC 7421; identical to SEQ ID NO: 13654
  CDS (1)..(1863): transl_table=11

SEQ ID NO: 26212 - protein, 620 aa, Gloeobacter violaceus PCC 7421; identical to SEQ ID NO: 13655

SEQ ID NO: 26213 - DNA, 1443 bp, Gloeobacter violaceus PCC 7421; identical to SEQ ID NO: 13656
  CDS (1)..(1443): transl_table=11

SEQ ID NO: 26214 - protein, 480 aa, Gloeobacter violaceus PCC 7421; identical to SEQ ID NO: 13657

SEQ ID NO: 26215 - DNA, 1635 bp, Vibrio vulnificus YJ016; identical to SEQ ID NO: 13658
  CDS (1)..(1635): transl_table=11

SEQ ID NO: 26216 - protein, 544 aa, Vibrio vulnificus YJ016; identical to SEQ ID NO: 13659

SEQ ID NO: 26217 - DNA, 3303 bp, Rhodopseudomonas palustris CGA009; identical to SEQ ID NO: 13660
  CDS (1)..(3303): transl_table=11

SEQ ID NO: 26218 - protein, 1100 aa, Rhodopseudomonas palustris CGA009; identical to SEQ ID NO: 13661

SEQ ID NO: 26219 - DNA, 1617 bp, Rhodopseudomonas palustris CGA009; identical to SEQ ID NO: 13662
  CDS (1)..(1617): transl_table=11

SEQ ID NO: 26220 - protein, 538 aa, Rhodopseudomonas palustris CGA009; identical to SEQ ID NO: 13663

SEQ ID NO: 26221 - DNA, 3336 bp, Geobacter sulfurreducens PCA; identical to SEQ ID NO: 13664
  CDS (1)..(3336): transl_table=11

SEQ ID NO: 26222 - protein, 1111 aa, Geobacter sulfurreducens PCA; identical to SEQ ID NO: 13665

SEQ ID NO: 26223 - DNA, 1335 bp, Mycobacterium avium subsp. paratuberculosis str. k10; identical to SEQ ID NO: 13666
  CDS (1)..(1335): transl_table=11

SEQ ID NO: 26224 - protein, 444 aa, Mycobacterium avium subsp. paratuberculosis str. k10; identical to SEQ ID NO: 13667

SEQ ID NO: 26225 - DNA, 1773 bp, Mycobacterium avium subsp. paratuberculosis str. k10; identical to SEQ ID NO: 13668
  CDS (1)..(1773): transl_table=11

SEQ ID NO: 26226 - protein, 590 aa, Mycobacterium avium subsp. paratuberculosis str. k10; identical to SEQ ID NO: 13669

SEQ ID NO: 26227 - DNA, 1725 bp, Lactobacillus johnsonii NCC 533; identical to SEQ ID NO: 13670
  CDS (1)..(1725): transl_table=11

SEQ ID NO: 26228 - protein, 574 aa, Lactobacillus johnsonii NCC 533; identical to SEQ ID NO: 13671

SEQ ID NO: 26229 - DNA, 1668 bp, Lactobacillus johnsonii NCC 533; identical to SEQ ID NO: 13672
  CDS (1)..(1668): transl_table=11

SEQ ID NO: 26230 - protein, 555 aa, Lactobacillus johnsonii NCC 533; identical to SEQ ID NO: 13673

SEQ ID NO: 26231 - DNA, 1665 bp, Bacillus cereus ATCC 10987; identical to SEQ ID NO: 13674
  CDS (1)..(1665): transl_table=11

SEQ ID NO: 26232 - protein, 554 aa, Bacillus cereus ATCC 10987; identical to SEQ ID NO: 13675

SEQ ID NO: 26233 - DNA, 1710 bp, Anopheles gambiae str. PEST; identical to SEQ ID NO: 13676
  CDS (1)..(1710)

SEQ ID NO: 26234 - protein, 569 aa, Anopheles gambiae str. PEST; identical to SEQ ID NO: 13677

SEQ ID NO: 26235 - DNA, 1800 bp, Anopheles gambiae str. PEST; identical to SEQ ID NO: 13678
  CDS (1)..(1800)

SEQ ID NO: 26236 - protein, 599 aa, Anopheles gambiae str. PEST; identical to SEQ ID NO: 13679

SEQ ID NO: 26237 - DNA, 1509 bp, Anopheles gambiae str. PEST; identical to SEQ ID NO: 13680
  CDS (1)..(1509)

SEQ ID NO: 26238 - protein, 502 aa, Anopheles gambiae str. PEST; identical to SEQ ID NO: 13681

SEQ ID NO: 26239 - DNA, 1716 bp, Gibberella zeae PH-1; identical to SEQ ID NO: 13682
  CDS (1)..(1716)

SEQ ID NO: 26240 - protein, 571 aa, Gibberella zeae PH-1; identical to SEQ ID NO: 13683

SEQ ID NO: 26241 - DNA, 1635 bp, Leptospira interrogans serovar Copenhageni str. Fiocruz L1-130; identical to SEQ ID NO: 13684
  CDS (1)..(1635): transl_table=11

SEQ ID NO: 26242 - protein, 544 aa, Leptospira interrogans serovar Copenhageni str. Fiocruz L1-130; identical to SEQ ID NO: 13685

SEQ ID NO: 26243 - DNA, 1251 bp, Thermus thermophilus HB27; identical to SEQ ID NO: 13686
  CDS (1)..(1251): transl_table=11

SEQ ID NO: 26244 - protein, 416 aa, Thermus thermophilus HB27 [sequence omitted]

SEQ ID NO: 26245 - DNA, 1662 bp, Listeria monocytogenes str. 4b F2365; identical to SEQ ID NO: 13688
  CDS (1)..(1662): transl_table=11

SEQ ID NO: 26246 - protein, 553 aa, Listeria monocytogenes str. 4b F2365; identical to SEQ ID NO: 13689

SEQ ID NO: 26247 - DNA, 1533 bp, Listeria monocytogenes str. 4b F2365; identical to SEQ ID NO: 13690
  CDS (1)..(1533): transl_table=11

SEQ ID NO: 26248 - protein, 510 aa, Listeria monocytogenes str. 4b F2365; identical to SEQ ID NO: 13691

SEQ ID NO: 26249 - DNA, 1761 bp, Bacillus thuringiensis serovar konkukian str. 97-27; identical to SEQ ID NO: 13692
  CDS (1)..(1761): transl_table=11

SEQ ID NO: 26250 - protein, 586 aa, Bacillus thuringiensis serovar konkukian str. 97-27; identical to SEQ ID NO: 13693

SEQ ID NO: 26251 - DNA, 1710 bp, Leifsonia xyli subsp. xyli str. CTCB07; identical to SEQ ID NO: 13694
  CDS (1)..(1710): transl_table=11

SEQ ID NO: 26252 - protein, 569 aa, Leifsonia xyli subsp. xyli str. CTCB07; identical to SEQ ID NO: 13695

SEQ ID NO: 26253 - DNA, 1683 bp, Bacillus licheniformis ATCC 14580; identical to SEQ ID NO: 13696
  CDS (1)..(1683): transl_table=11

SEQ ID NO: 26254 - protein, 560 aa, Bacillus licheniformis ATCC 14580; identical to SEQ ID NO: 13697

SEQ ID NO: 26255 - DNA, 1764 bp, Bacillus licheniformis ATCC 14580; identical to SEQ ID NO: 13698
  CDS (1)..(1764): transl_table=11

SEQ ID NO: 26256 - protein, 587 aa, Bacillus licheniformis ATCC 14580; identical to SEQ ID NO: 13699

SEQ ID NO: 26257 - DNA, 1620 bp, Methylococcus capsulatus str. Bath; identical to SEQ ID NO: 13700
  CDS (1)..(1620): transl_table=11

SEQ ID NO: 26258 - protein, 539 aa, Methylococcus capsulatus str. Bath; identical to SEQ ID NO: 13701

SEQ ID NO: 26259 - DNA, 1866 bp, Photobacterium profundum SS9; identical to SEQ ID NO: 13702
  CDS (1)..(1866): transl_table=11

SEQ ID NO: 26260 - protein, 621 aa, Photobacterium profundum SS9; identical to SEQ ID NO: 13703

SEQ ID NO: 26261 - DNA, 1656 bp, Thermus thermophilus HB8; identical to SEQ ID NO: 13704
  CDS (1)..(1656): transl_table=11

SEQ ID NO: 26262 - protein, 551 aa, Thermus thermophilus HB8; identical to SEQ ID NO: 13705

SEQ ID NO: 26263 - DNA, 1767 bp, Geobacillus kaustophilus HTA426; identical to SEQ ID NO: 13706
  CDS (1)..(1767): transl_table=11

SEQ ID NO: 26264 - protein, 588 aa, Geobacillus kaustophilus HTA426; identical to SEQ ID NO: 13707

SEQ ID NO: 26265 - DNA, 1542 bp, Geobacillus kaustophilus HTA426; identical to SEQ ID NO: 13708
  CDS (1)..(1542): transl_table=11

SEQ ID NO: 26266 - protein, 513 aa, Geobacillus kaustophilus HTA426; identical to SEQ ID NO: 13709

SEQ ID NO: 26267 - DNA, 4983 bp, Geobacillus kaustophilus HTA426; identical to SEQ ID NO: 13710
  CDS (1)..(4983): transl_table=11

SEQ ID NO: 26268 - protein, 1660 aa, Geobacillus kaustophilus HTA426; identical to SEQ ID NO: 13711

SEQ ID NO: 26269 - DNA, 1689 bp, Azoarcus sp. EbN1; identical to SEQ ID NO: 13712
  CDS (1)..(1689): transl_table=11

SEQ ID NO: 26270 - protein, 562 aa, Azoarcus sp. EbN1; identical to SEQ ID NO: 13713

SEQ ID NO: 26271 - DNA, 1770 bp, Bacillus clausii KSM-K16; identical to SEQ ID NO: 13714
  CDS (1)..(1770): transl_table=11

SEQ ID NO: 26272 - protein, 589 aa, Bacillus clausii KSM-K16; identical to SEQ ID NO: 13715

SEQ ID NO: 26273 - DNA, 2298 bp, Thermococcus kodakarensis KOD1; identical to SEQ ID NO: 13716
  CDS (1)..(2298): transl_table=11

SEQ ID NO: 26274 - protein, 765 aa, Thermococcus kodakarensis KOD1; identical to SEQ ID NO: 13717

SEQ ID NO: 26275 - DNA, 2724 bp, Xanthomonas oryzae pv. oryzae KACC10331; identical to SEQ ID NO: 13718
  CDS (1)..(2724): transl_table=11

SEQ ID NO: 26276 - protein, 907 aa, Xanthomonas oryzae pv. oryzae KACC10331; identical to SEQ ID NO: 13719

SEQ ID NO: 26277 - DNA, 1260 bp, Vibrio fischeri ES114; identical to SEQ ID NO: 13720
  CDS (1)..(1260): transl_table=11

SEQ ID NO: 26278 - protein, 419 aa, Vibrio fischeri ES114; identical to SEQ ID NO: 13721

SEQ ID NO: 26279 - DNA, 1815 bp, Corynebacterium glutamicum ATCC 13032; identical to SEQ ID NO: 13722
  CDS (1)..(1815): transl_table=11

SEQ ID NO: 26280 - protein, 604 aa, Corynebacterium glutamicum ATCC 13032; identical to SEQ ID NO: 13723

SEQ ID NO: 26281 - DNA, 3327 bp, Pseudomonas syringae pv. syringae B728a; identical to SEQ ID NO: 13724
  CDS (1)..(3327)

SEQ ID NO: 26282 - protein, 1108 aa, Pseudomonas syringae pv. syringae B728a; identical to SEQ ID NO: 13725

SEQ ID NO: 26283 - DNA, 1659 bp, Lactobacillus gasseri; identical to SEQ ID NO: 13726
  CDS (1)..(1659)

SEQ ID NO: 26284 - protein, 552 aa, Lactobacillus gasseri; identical to SEQ ID NO: 13727

SEQ ID NO: 26285 - DNA, 1467 bp, Nostoc punctiforme PCC 73102; identical to SEQ ID NO: 13728
  CDS (1)..(1467)

SEQ ID NO: 26286 - protein, 488 aa, Nostoc punctiforme PCC 73102; identical to SEQ ID NO: 13729

SEQ ID NO: 26287 - DNA, 1674 bp, Nostoc punctiforme PCC 73102; identical to SEQ ID NO: 13730
  CDS (1)..(1674)

SEQ ID NO: 26288 - protein, 557 aa, Nostoc punctiforme PCC 73102; identical to SEQ ID NO: 13731

SEQ ID NO: 26289 - DNA, 1266 bp, Bifidobacterium longum DJO10A; identical to SEQ ID NO: 13732
  CDS (1)..(1266)

SEQ ID NO: 26290 - protein, 421 aa, Bifidobacterium longum DJO10A; identical to SEQ ID NO: 13733

SEQ ID NO: 26291 - DNA, 3333 bp, Desulfovibrio desulfuricans G20; identical to SEQ ID NO: 13734
  CDS (1)..(3333)

SEQ ID NO: 26292 - protein, 1110 aa, Desulfovibrio desulfuricans G20; identical to SEQ ID NO: 13735

SEQ ID NO: 26293 - DNA, 1467 bp, Anabaena variabilis ATCC 29413; identical to SEQ ID NO: 13736
  CDS (1)..(1467)

SEQ ID NO: 26294 - protein, 488 aa, Anabaena variabilis ATCC 29413; identical to SEQ ID NO: 13737

SEQ ID NO: 26295 - DNA, 3366 bp, Ralstonia eutropha JMP134; identical to SEQ ID NO: 13738
  CDS (1)..(3366)

SEQ ID NO: 26296 - protein, 1121 aa, Ralstonia eutropha JMP134; identical to SEQ ID NO: 13739

SEQ ID NO: 26297 - DNA, 2586 bp, Rhodobacter sphaeroides 2.4.1; identical to SEQ ID NO: 13740
  CDS (1)..(2586)

SEQ ID NO: 26298 - protein, 861 aa, Rhodobacter sphaeroides 2.4.1; identical to SEQ ID NO: 13741

SEQ ID NO: 26299 - DNA, 3417 bp, Burkholderia cepacia R18194; identical to SEQ ID NO: 13742
  CDS (1)..(3417)

SEQ ID NO: 26300 - protein, 1138 aa, Burkholderia cepacia R18194; identical to SEQ ID NO: 13743

SEQ ID NO: 26301 - DNA, 1776 bp, Listeria monocytogenes str. 4b H7858; identical to SEQ ID NO: 13744
  CDS (1)..(1776): transl_table=11

SEQ ID NO: 26302 - protein, 591 aa, Listeria monocytogenes str. 4b H7858; identical to SEQ ID NO: 13745

SEQ ID NO: 26303 - DNA, 1533 bp, Listeria monocytogenes str. 1/2a F6854; identical to SEQ ID NO: 13746
  CDS (1)..(1533): transl_table=11

SEQ ID NO: 26304 - protein, 510 aa, Listeria monocytogenes str. 1/2a F6854; identical to SEQ ID NO: 13747

SEQ ID NO: 26305 - DNA, 1662 bp, Listeria monocytogenes str. 1/2a F6854; identical to SEQ ID NO: 13748
  CDS (1)..(1662): transl_table=11

SEQ ID NO: 26306 - protein, 553 aa, Listeria monocytogenes str. 1/2a F6854; identical to SEQ ID NO: 13749

SEQ ID NO: 26307 - DNA, 3342 bp, Pseudomonas fluorescens PfO-1; identical to SEQ ID NO: 13750
  CDS (1)..(3342)

SEQ ID NO: 26308 - protein, 1113 aa, Pseudomonas fluorescens PfO-1; identical to SEQ ID NO: 13751

SEQ ID NO: 26309 - DNA, 1629 bp, Rhodospirillum rubrum; identical to SEQ ID NO: 13752
  CDS (1)..(1629)

SEQ ID NO: 26310 - protein, 542 aa, Rhodospirillum rubrum; identical to SEQ ID NO: 13753

SEQ ID NO: 26311 - DNA, 3303 bp, Rhodospirillum rubrum; identical to SEQ ID NO: 13754
  CDS (1)..(3303)

SEQ ID NO: 26312 - protein, 1100 aa, Rhodospirillum rubrum; identical to SEQ ID NO: 13755

SEQ ID NO: 26313 - DNA, 3465 bp, Burkholderia fungorum LB400; identical to SEQ ID NO: 13756
  CDS (1)..(3465)

SEQ ID NO: 26314 - protein, 1154 aa, Burkholderia fungorum LB400; identical to SEQ ID NO: 13757

SEQ ID NO: 26315 - DNA, 1821 bp, Thermobifida fusca; identical to SEQ ID NO: 13758
  CDS (1)..(1821)

SEQ ID NO: 26316 - protein, 606 aa, Thermobifida fusca; identical to SEQ ID NO: 13759

SEQ ID NO: 26317 - DNA, 1563 bp, Microbulbifer degradans 2-40; identical to SEQ ID NO: 13760
  CDS (1)..(1563)

SEQ ID NO: 26318 - protein, 520 aa, Microbulbifer degradans 2-40; identical to SEQ ID NO: 13761

SEQ ID NO: 26319 - DNA, 1671 bp, Oenococcus oeni PSU-1; identical to SEQ ID NO: 13762
  CDS (1)..(1671)

SEQ ID NO: 26320 - protein, 556 aa, Oenococcus oeni PSU-1; identical to SEQ ID NO: 13763

SEQ ID NO: 26321 - DNA, 1482 bp, Trichodesmium erythraeum IMS101; identical to SEQ ID NO: 13764
  CDS (1)..(1482)

SEQ ID NO: 26322 - protein, 493 aa, Trichodesmium erythraeum IMS101; identical to SEQ ID NO: 13765

SEQ ID NO: 26323 - DNA, 3288 bp, Thiobacillus denitrificans ATCC 25259; identical to SEQ ID NO: 13766
  CDS (1)..(3288)

SEQ ID NO: 26324 - protein, 1095 aa, Thiobacillus denitrificans ATCC 25259; identical to SEQ ID NO: 13767

SEQ ID NO: 26325 - DNA, 1815 bp, Chloroflexus aurantiacus; identical to SEQ ID NO: 13768
  CDS (1)..(1815)

SEQ ID NO: 26326 - protein, 604 aa, Chloroflexus aurantiacus; identical to SEQ ID NO: 13769

SEQ ID NO: 26327 - DNA, 4140 bp, Chloroflexus aurantiacus; identical to SEQ ID NO: 13770
  CDS (1)..(4140)

SEQ ID NO: 26328 - protein, 1379 aa, Chloroflexus aurantiacus; identical to SEQ ID NO: 13771

SEQ ID NO: 26329 - DNA, 3363 bp, Chloroflexus aurantiacus; identical to SEQ ID NO: 13772
  CDS (1)..(3363)

SEQ ID NO: 26330 - protein, 1120 aa, Chloroflexus aurantiacus; identical to SEQ ID NO: 13773

SEQ ID NO: 26331 - DNA, 1803 bp, Lactococcus lactis subsp. cremoris SK11; identical to SEQ ID NO: 13774
  CDS (1)..(1803)

SEQ ID NO: 26332 - protein, 600 aa, Lactococcus lactis subsp. cremoris SK11; identical to SEQ ID NO: 13775

SEQ ID NO: 26333 - DNA, 1755 bp, Lactococcus lactis subsp. cremoris SK11; identical to SEQ ID NO: 13776
  CDS (1)..(1755)

SEQ ID NO: 26334 - protein, 584 aa, Lactococcus lactis subsp. cremoris SK11; identical to SEQ ID NO: 13777

SEQ ID NO: 26335 - DNA, 1695 bp, Lactobacillus casei ATCC 334; identical to SEQ ID NO: 13778
  CDS (1)..(1695)

SEQ ID NO: 26336 - protein, 564 aa, Lactobacillus casei ATCC 334; identical to SEQ ID NO: 13779

SEQ ID NO: 26337 - DNA, 1779 bp, Lactobacillus casei ATCC 334; identical to SEQ ID NO: 13780
  CDS (1)..(1779)

SEQ ID NO: 26338 - protein, 592 aa, Lactobacillus casei ATCC 334; identical to SEQ ID NO: 13781

SEQ ID NO: 26339 - DNA, 1668 bp, Lactobacillus casei ATCC 334; identical to SEQ ID NO: 13782
  CDS (1)..(1668)

SEQ ID NO: 26340 - protein, 555 aa, Lactobacillus casei ATCC 334; identical to SEQ ID NO: 13783

SEQ ID NO: 26341 - DNA, 570 bp, Lactobacillus delbrueckii subsp. bulgaricus ATCC BAA-365; identical to SEQ ID NO: 13784
  CDS (1)..(570)

SEQ ID NO: 26342 - protein, 189 aa, Lactobacillus delbrueckii subsp. bulgaricus ATCC BAA-365; identical to SEQ ID NO: 13785

SEQ ID NO: 26343 - DNA, 1827 bp, Deinococcus geothermalis DSM 11300; identical to SEQ ID NO: 13786
  CDS (1)..(1827): transl_table=11

SEQ ID NO: 26344 - protein, 608 aa, Deinococcus geothermalis DSM 11300; identical to SEQ ID NO: 13787

SEQ ID NO: 26345 - DNA, 1491 bp, Deinococcus geothermalis DSM 11300; identical to SEQ ID NO: 13788
  CDS (1)..(1491): transl_table=11

SEQ ID NO: 26346 - protein, 496 aa, Deinococcus geothermalis DSM 11300; identical to SEQ ID NO: 13789

SEQ ID NO: 26347 - DNA, 2097 bp, Deinococcus geothermalis DSM 11300; identical to SEQ ID NO: 13790
  CDS (1)..(2097): transl_table=11

SEQ ID NO: 26348 - protein, 698 aa, Deinococcus geothermalis DSM 11300; identical to SEQ ID NO: 13791

SEQ ID NO: 26349 - DNA, 1662 bp, Anaeromyxobacter dehalogenans 2CP-C; identical to SEQ ID NO: 13792
  CDS (1)..(1662): transl_table=11

SEQ ID NO: 26350 - protein, 553 aa, Anaeromyxobacter dehalogenans 2CP-C; identical to SEQ ID NO: 13793

SEQ ID NO: 26351 - DNA, 1638 bp, Anaeromyxobacter dehalogenans 2CP-C; identical to SEQ ID NO: 13794
  CDS (1)..(1638): transl_table=11

SEQ ID NO: 26352 - protein, 545 aa, Anaeromyxobacter dehalogenans 2CP-C; identical to SEQ ID NO: 13795

SEQ ID NO: 26353 - DNA, 1602 bp, Anaeromyxobacter dehalogenans 2CP-C; identical to SEQ ID NO: 13796
  CDS (1)..(1602): transl_table=11

SEQ ID NO: 26354 - protein, 533 aa, Anaeromyxobacter dehalogenans 2CP-C; identical to SEQ ID NO: 13797

SEQ ID NO: 26355 - DNA, 1188 bp, Streptococcus pneumoniae TIGR4; identical to SEQ ID NO: 13798
  CDS (1)..(1188)

SEQ ID NO: 26356 - protein, 395 aa, Streptococcus pneumoniae TIGR4; identical to SEQ ID NO: 13799

SEQ ID NO: 26357 - DNA, 1407 bp, Arthrobacter sp. FB24; identical to SEQ ID NO: 13800
  CDS (1)..(1407): transl_table=11

SEQ ID NO: 26358 - protein, 468 aa, Arthrobacter sp. FB24; identical to SEQ ID NO: 13801

SEQ ID NO: 26359 - DNA, 1968 bp, Arthrobacter sp. FB24; identical to SEQ ID NO: 13802
  CDS (1)..(1968): transl_table=11

SEQ ID NO: 26360 - protein, 655 aa, Arthrobacter sp. FB24; identical to SEQ ID NO: 13803

SEQ ID NO: 26361 - DNA, 1797 bp, Arthrobacter sp. FB24; identical to SEQ ID NO: 13804
  CDS (1)..(1797): transl_table=11

SEQ ID NO: 26362 - protein, 598 aa, Arthrobacter sp. FB24; identical to SEQ ID NO: 13805

SEQ ID NO: 26363 - DNA, 3327 bp, Azotobacter vinelandii AvOP; identical to SEQ ID NO: 13806
  CDS (1)..(3327): transl_table=11

SEQ ID NO: 26364 - protein, 1108 aa, Azotobacter vinelandii AvOP; identical to SEQ ID NO: 13807

SEQ ID NO: 26365 - DNA, 3414 bp, Burkholderia vietnamiensis G4; identical to SEQ ID NO: 13808
  CDS (1)..(3414): transl_table=11

SEQ ID NO: 26366 - protein, 1137 aa, Burkholderia vietnamiensis G4; identical to SEQ ID NO: 13809

SEQ ID NO: 26367 - DNA, 3414 bp, Burkholderia cenocepacia HI2424; identical to SEQ ID NO: 13810
  CDS (1)..(3414): transl_table=11

SEQ ID NO: 26368 - protein, 1137 aa, Burkholderia cenocepacia HI2424; identical to SEQ ID NO: 13811

SEQ ID NO: 26369 - DNA, 1614 bp, Chromohalobacter salexigens DSM 3043; identical to SEQ ID NO: 13812
  CDS (1)..(1614): transl_table=11

SEQ ID NO: 26370 - protein, 537 aa, Chromohalobacter salexigens DSM 3043; identical to SEQ ID NO: 13813

SEQ ID NO: 26371 - DNA, 3396 bp, Burkholderia pseudomallei S13; identical to SEQ ID NO: 13814
  CDS (1)..(3396)

SEQ ID NO: 26372 - protein, 1131 aa, Burkholderia pseudomallei S13; identical to SEQ ID NO: 13815

SEQ ID NO: 26373 - DNA, 1728 bp, Clostridium thermocellum ATCC 27405; identical to SEQ ID NO: 13816
  CDS (1)..(1728): transl_table=11

SEQ ID NO: 26374 - protein, 575 aa, Clostridium thermocellum ATCC 27405; identical to SEQ ID NO: 13817

SEQ ID NO: 26375 - DNA, 1461 bp, Crocosphaera watsonii WH 8501; identical to SEQ ID NO: 13818
  CDS (1)..(1461): transl_table=11

SEQ ID NO: 26376 - protein, 486 aa, Crocosphaera watsonii WH 8501; identical to SEQ ID NO: 13819

SEQ ID NO: 26377 - DNA, 3318 bp, Chlorobium phaeobacteroides BS1; identical to SEQ ID NO: 13820
  CDS (1)..(3318): transl_table=11

SEQ ID NO: 26378 - protein, 1105 aa, Chlorobium phaeobacteroides BS1; identical to SEQ ID NO: 13821

SEQ ID NO: 26379 - DNA, 3339 bp, Geobacter metallireducens GS-15; identical to SEQ ID NO: 13822
  CDS (1)..(3339): transl_table=11

SEQ ID NO: 26380 - protein, 1112 aa, Geobacter metallireducens GS-15; identical to SEQ ID NO: 13823

SEQ ID NO: 26381 - DNA, 1785 bp, Exiguobacterium sp. 255-15; identical to SEQ ID NO: 13824
  CDS (1)..(1785): transl_table=11

SEQ ID NO: 26382 - protein, 594 aa, Exiguobacterium sp. 255-15; identical to SEQ ID NO: 13825

SEQ ID NO: 26383 - DNA, 1674 bp, Exiguobacterium sp. 255-15; identical to SEQ ID NO: 13826
  CDS (1)..(1674): transl_table=11

SEQ ID NO: 26384 - protein, 557 aa, Exiguobacterium sp. 255-15; identical to SEQ ID NO: 13827

SEQ ID NO: 26385 - DNA, 1611 bp, Exiguobacterium sp. 255-15; identical to SEQ ID NO: 13828
  CDS (1)..(1611): transl_table=11

SEQ ID NO: 26386 - protein, 536 aa, Exiguobacterium sp. 255-15; identical to SEQ ID NO: 13829

SEQ ID NO: 26387 - DNA, 1788 bp, Exiguobacterium sp. 255-15; identical to SEQ ID NO: 13830
  CDS (1)..(1788): transl_table=11

SEQ ID NO: 26388 - protein, 595 aa, Exiguobacterium sp. 255-15; identical to SEQ ID NO: 13831

SEQ ID NO: 26389 - DNA, 1803 bp, Frankia sp. CcI3; identical to SEQ ID NO: 13832
  CDS (1)..(1803): transl_table=11

SEQ ID NO: 26390 - protein, 600 aa, Frankia sp. CcI3; identical to SEQ ID NO: 13833

SEQ ID NO: 26391 - DNA, 3582 bp, Desulfitobacterium hafniense DCB-2; identical to SEQ ID NO: 13834
  CDS (1)..(3582): transl_table=11

SEQ ID NO: 26392 - protein, 1193 aa, Desulfitobacterium hafniense DCB-2; identical to SEQ ID NO: 13835

SEQ ID NO: 26393 - DNA, 1719 bp, Frankia sp. EAN1pec; identical to SEQ ID NO: 13836
  CDS (1)..(1719): transl_table=11

SEQ ID NO: 26394 - protein, 572 aa, Frankia sp. EAN1pec; identical to SEQ ID NO: 13837

SEQ ID NO: 26395 - DNA, 1761 bp, Moorella thermoacetica ATCC 39073; identical to SEQ ID NO: 13838
  CDS (1)..(1761): transl_table=11

SEQ ID NO: 26396 - protein, 586 aa, Moorella thermoacetica ATCC 39073; identical to SEQ ID NO: 13839

SEQ ID NO: 26397 - DNA, 1623 bp, Shewanella baltica OS155; identical to SEQ ID NO: 13840
  CDS (1)..(1623): transl_table=11

SEQ ID NO: 26398 - protein, 540 aa, Shewanella baltica OS155; identical to SEQ ID NO: 13841

SEQ ID NO: 26399 - DNA, 1635 bp, Shewanella amazonensis SB2B; identical to SEQ ID NO: 13842
  CDS (1)..(1635): transl_table=11

SEQ ID NO: 26400 - protein, 544 aa, Shewanella amazonensis SB2B; identical to SEQ ID NO: 13843

SEQ ID NO: 26401 - DNA, 3297 bp, Pelodictyon phaeoclathratiforme BU-1; identical to SEQ ID NO: 13844
  CDS (1)..(3297): transl_table=11

SEQ ID NO: 26402 - protein, 1098 aa, Pelodictyon phaeoclathratiforme BU-1; identical to SEQ ID NO: 13845

SEQ ID NO: 26403 - DNA, 3414 bp, Prosthecochloris aestuarii DSM 271; identical to SEQ ID NO: 13846
  CDS (1)..(3414): transl_table=11

SEQ ID NO: 26404 - protein, 1137 aa, Prosthecochloris aestuarii DSM 271; identical to SEQ ID NO: 13847

SEQ ID NO: 26405 - DNA, 1593 bp, Rubrobacter xylanophilus DSM 9941; identical to SEQ ID NO: 13848
  CDS (1)..(1593): transl_table=11

SEQ ID NO: 26406 - protein, 530 aa, Rubrobacter xylanophilus DSM 9941; identical to SEQ ID NO: 13849

SEQ ID NO: 26407 - DNA, 5328 bp, Rubrobacter xylanophilus DSM 9941; identical to SEQ ID NO: 13850
  CDS (1)..(5328): transl_table=11

SEQ ID NO: 26408 - protein, 1775 aa, Rubrobacter xylanophilus DSM 9941; identical to SEQ ID NO: 13851

SEQ ID NO: 26409 - DNA, 1755 bp, Mesorhizobium sp. BNC1; identical to SEQ ID NO: 13852
  CDS (1)..(1755): transl_table=11

SEQ ID NO: 26410 - protein, 584 aa, Mesorhizobium sp. BNC1; identical to SEQ ID NO: 13853

SEQ ID NO: 26411 - DNA, 3348 bp, Mesorhizobium sp. BNC1; identical to SEQ ID NO: 13854
  CDS (1)..(3348): transl_table=11

SEQ ID NO: 26412 - protein, 1115 aa, Mesorhizobium sp. BNC1; identical to SEQ ID NO: 13855

SEQ ID NO: 26413 - DNA, 1653 bp, Silicibacter sp. TM1040; identical to SEQ ID NO: 13856
  CDS (1)..(1653): transl_table=11

SEQ ID NO: 26414 - protein, 550 aa, Silicibacter sp. TM1040; identical to SEQ ID NO: 13857

SEQ ID NO: 26415 - DNA, 3267 bp, Nitrobacter hamburgensis X14; identical to SEQ ID NO: 13858
  CDS (1)..(3267): transl_table=11

SEQ ID NO: 26416 - protein, 1088 aa, Nitrobacter hamburgensis X14; identical to SEQ ID NO: 13859

SEQ ID NO: 26417 - DNA, 1926 bp, Shewanella denitrificans OS-217; identical to SEQ ID NO: 13860
  CDS (1)..(1926): transl_table=11

SEQ ID NO: 26418 - protein, 641 aa, Shewanella denitrificans OS-217; identical to SEQ ID NO: 13861

SEQ ID NO: 26419 - DNA, 1419 bp, Thermotoga neapolitana; identical to SEQ ID NO: 13862
  CDS (1)..(1419): transl_table=11

SEQ ID NO: 26420 - protein, 472 aa, Thermotoga neapolitana; identical to SEQ ID NO: 13863

SEQ ID NO: 26421 - DNA, 1701 bp, Bacteroides thetaiotaomicron; identical to SEQ ID NO: 13864
  CDS (1)..(1701): transl_table=11

SEQ ID NO: 26422 - protein, 566 aa, Bacteroides thetaiotaomicron; identical to SEQ ID NO: 13865

SEQ ID NO: 26423 - DNA, 3906 bp, Alicyclobacillus acidocaldarius; identical to SEQ ID NO: 13866
  CDS (1)..(3906): transl_table=11

SEQ ID NO: 26424 - protein, 1301 aa, Alicyclobacillus acidocaldarius; identical to SEQ ID NO: 13867

SEQ ID NO: 26425 - DNA, 1797 bp, Klebsiella oxytoca; identical to SEQ ID NO: 13868
  CDS (1)..(1797): transl_table=11

SEQ ID NO: 26426 - protein, 598 aa, Klebsiella oxytoca; identical to SEQ ID NO: 13869

SEQ ID NO: 26427 - DNA, 1581 bp, Bacillus sp; identical to SEQ ID NO: 13870
  CDS (1)..(1581): transl_table=11

SEQ ID NO: 26428 - protein, 526 aa, Bacillus sp; identical to SEQ ID NO: 13871

SEQ ID NO: 26429 - DNA, 1761 bp, Anoxybacillus flavithermus; identical to SEQ ID NO: 13872
  CDS (1)..(1761): transl_table=11

SEQ ID NO: 26430 - protein, 586 aa, Anoxybacillus flavithermus; identical to SEQ ID NO: 13873

SEQ ID NO: 26431 - DNA, 1749 bp, Thermoactinomyces thalpophilus; identical to SEQ ID NO: 13874
  CDS (1)..(1749): transl_table=11

SEQ ID NO: 26432 - protein, 582 aa, Thermoactinomyces thalpophilus; identical to SEQ ID NO: 13875

SEQ ID NO: 26433 - DNA, 1332 bp, Anaerobranca gottschalkii; identical to SEQ ID NO: 13876
  CDS (1)..(1332): transl_table=11

SEQ ID NO: 26434 - protein, 443 aa, Anaerobranca gottschalkii; identical to SEQ ID NO: 13877

SEQ ID NO: 26435 - DNA, 1740 bp, Aedes albopictus; identical to SEQ ID NO: 13878
  CDS (1)..(1740)

SEQ ID NO: 26436 - protein, 579 aa, Aedes albopictus; identical to SEQ ID NO: 13879

SEQ ID NO: 26437 - DNA, 1170 bp, Aeromonas hydrophila; identical to SEQ ID NO: 13880
  CDS (1)..(1170): n means a or g or c or t/u, s means g or c

SEQ ID NO: 26438 - protein, 389 aa, Aeromonas hydrophila; identical to SEQ ID NO: 13881
  Xaa in position 289 is unknown

SEQ ID NO: 26439 - DNA, 1449 bp, Thermoactinomyces vulgaris; identical to SEQ ID NO: 13882
  CDS (1)..(1449): transl_table=11

SEQ ID NO: 26440 - protein, 482 aa, Thermoactinomyces vulgaris; identical to SEQ ID NO: 13883

SEQ ID NO: 26441 - DNA, 1581 bp, Xanthomonas campestris; identical to SEQ ID NO: 13884
  CDS (1)..(1581): transl_table=11

SEQ ID NO: 26442 - protein, 526 aa, Xanthomonas campestris; identical to SEQ ID NO: 13885

SEQ ID NO: 26443 - DNA, 3309 bp, Rhodobacter sphaeroides f; identical to SEQ ID NO: 13886
  CDS (1)..(3309): transl_table=11

SEQ ID NO: 26444 - protein, 1102 aa, Rhodobacter sphaeroides f; identical to SEQ ID NO: 13887

SEQ ID NO: 26445 - DNA, 1548 bp, Ostreococcus tauri; identical to SEQ ID NO: 13888
  CDS (1)..(1548)

SEQ ID NO: 26446 - protein, 515 aa, Ostreococcus tauri; identical to SEQ ID NO: 13889

SEQ ID NO: 26447 - DNA, 1554 bp, uncultured bacterium; identical to SEQ ID NO: 13890
  CDS (1)..(1554)

SEQ ID NO: 26448 - protein, 517 aa, uncultured bacterium; identical to SEQ ID NO: 13891

SEQ ID NO: 26449 - DNA, 2628 bp, Chlamydomonas reinhardtii; identical to SEQ ID NO: 13892
  CDS (1)..(2628)

SEQ ID NO: 26450 - protein, 875 aa, Chlamydomonas reinhardtii; identical to SEQ ID NO: 13893

SEQ ID NO: 26451 - DNA, 1962 bp, Paenibacillus sp; identical to SEQ ID NO: 13894
  CDS (1)..(1962): transl_table=11

SEQ ID NO: 26452 - protein, 653 aa, Paenibacillus sp; identical to SEQ ID NO: 13895

SEQ ID NO: 26453 - DNA, 1548 bp, Halothermothrix orenii; identical to SEQ ID NO: 13896
  CDS (1)..(1548): transl_table=11

SEQ ID NO: 26454 - protein, 515 aa, Halothermothrix orenii; identical to SEQ ID NO: 13897

SEQ ID NO: 26455 - DNA, 1533 bp, Paenibacillus sp; identical to SEQ ID NO: 13898
  CDS (1)..(1533): transl_table=11

SEQ ID NO: 26456 - protein, 510 aa, Paenibacillus sp; identical to SEQ ID NO: 13899

SEQ ID NO: 26457 - DNA, 1767 bp, Bacillus stearothermophilus; identical to SEQ ID NO: 13900
  CDS (1)..(1767): transl_table=11

SEQ ID NO: 26458 - protein, 588 aa, Bacillus stearothermophilus; identical to SEQ ID NO: 13901

SEQ ID NO: 26459 - DNA, 6057 bp, Bacillus stearothermophilus; identical to SEQ ID NO: 13902
  CDS (1)..(6057): transl_table=11

SEQ ID NO: 26460 - protein, 2018 aa, Bacillus stearothermophilus; identical to SEQ ID NO: 13903

SEQ ID NO: 26461 - DNA, 1983 bp, Thermococcus sp; identical to SEQ ID NO: 13904
  CDS (1)..(1983): transl_table=11

SEQ ID NO: 26462 - protein, 660 aa, Thermococcus sp; identical to SEQ ID NO: 13905

SEQ ID NO: 26463 - DNA, 2181 bp, Thermococcus sp; identical to SEQ ID NO: 13906
  CDS (1)..(2181)

SEQ ID NO: 26464 - protein, 726 aa, Thermococcus sp; identical to SEQ ID NO: 13907

SEQ ID NO: 26465 - DNA, 2220 bp, Thermococcus sp; identical to SEQ ID NO: 13908
  CDS (1)..(2220): transl_table=11

SEQ ID NO: 26466 - protein, 739 aa, Thermococcus sp; identical to SEQ ID NO: 13909

SEQ ID NO: 26467 - DNA, 1737 bp, Alicyclobacillus acidocaldarius; identical to SEQ ID NO: 13910
  CDS (1)..(1737): transl_table=11

SEQ ID NO: 26468 - protein, 578 aa, Alicyclobacillus acidocaldarius; identical to SEQ ID NO: 13911

SEQ ID NO: 26469 - DNA, 1548 bp, Paenibacillus polymyxa; identical to SEQ ID NO: 13912
  CDS (1)..(1548): transl_table=11

SEQ ID NO: 26470 - protein, 515 aa, Paenibacillus polymyxa; identical to SEQ ID NO: 13913

SEQ ID NO: 26471 - DNA, 1689 bp, Dictyoglomus thermophilum; identical to SEQ ID NO: 13914
  CDS (1)..(1689): transl_table=11

SEQ ID NO: 26472 - protein, 562 aa, Dictyoglomus thermophilum; identical to SEQ ID NO: 13915

SEQ ID NO: 26473 - DNA, 1497 bp, Dictyoglomus thermophilum; identical to SEQ ID NO: 13916
  CDS (1)..(1497): transl_table=11

SEQ ID NO: 26474 - protein, 498 aa, Dictyoglomus thermophilum; identical to SEQ ID NO: 13917

SEQ ID NO: 26475 - DNA, 1242 bp, Triticum aestivum; identical to SEQ ID NO: 13918
  CDS (1)..(1242)

SEQ ID NO: 26476 - protein, 413 aa, Triticum aestivum; identical to SEQ ID NO: 13919

SEQ ID NO: 26477 - DNA, 1761 bp, Bacillus acidopullulyticus; identical to SEQ ID NO: 13920
  CDS (1)..(1761): transl_table=11

SEQ ID NO: 26478 - protein, 586 aa, Bacillus acidopullulyticus; identical to SEQ ID NO: 13921

SEQ ID NO: 26479 - DNA, 1563 bp, Bacillus megaterium; identical to SEQ ID NO: 13922
  CDS (1)..(1563): transl_table=11

SEQ ID NO: 26480 - protein, 520 aa, Bacillus megaterium; identical to SEQ ID NO: 13923

SEQ ID NO: 26481 - DNA, 4428 bp, Thermoanaerobacter thermohydrosulfuricus; identical to SEQ ID NO: 13924
  CDS (1)..(4428): transl_table=11

SEQ ID NO: 26482 - protein, 1475 aa, Thermoanaerobacter thermohydrosulfuricus; identical to SEQ ID NO: 13925

SEQ ID NO: 26483 - DNA, 1776 bp, Bacillus sphaericus; identical to SEQ ID NO: 13926
  CDS (1)..(1776): transl_table=11

SEQ ID NO: 26484 - protein, 591 aa, Bacillus sphaericus; identical to SEQ ID NO: 13927

SEQ ID NO: 26485 - DNA, 1725 bp, Thermoanaerobacter ethanolicus; identical to SEQ ID NO: 13928
  CDS (1)..(1725): transl_table=11

SEQ ID NO: 26486 - protein, 574 aa, Thermoanaerobacter ethanolicus; identical to SEQ ID NO: 13929

SEQ ID NO: 26487 - DNA, 1761 bp, Drosophila virilis; identical to SEQ ID NO: 13930
  CDS (1)..(1761)

SEQ ID NO: 26488 - protein, 586 aa, Drosophila virilis; identical to SEQ ID NO: 13931

SEQ ID NO: 26489 - DNA, 1329 bp, Thermotoga neapolitana; identical to SEQ ID NO: 13932
  CDS (1)..(1329): transl_table=11

SEQ ID NO: 26490 - protein, 442 aa, Thermotoga neapolitana; identical to SEQ ID NO: 13933

SEQ ID NO: 26491 - DNA, 2001 bp, Thermoactinomyces vulgaris; identical to SEQ ID NO: 13934
  CDS (1)..(2001): transl_table=11

SEQ ID NO: 26492 - protein, 666 aa, Thermoactinomyces vulgaris; identical to SEQ ID NO: 13935

SEQ ID NO: 26493 - DNA, 1758 bp, Thermoactinomyces vulgaris; identical to SEQ ID NO: 13936
  CDS (1)..(1758): transl_table=11

SEQ ID NO: 26494 - protein, 585 aa, Thermoactinomyces vulgaris; identical to SEQ ID NO: 13937

SEQ ID NO: 26495 - DNA, 24 bp, Artificial sequence
  (1)..(24): primer
atgatgttaaatgcatggcacctg

SEQ ID NO: 26496 - DNA, 24 bp, Artificial sequence
  (1)..(24): primer
ttagttcatccataccgtagccga

SEQ ID NO: 26497 - protein, 917 aa, Artificial sequence; identical to SEQ ID NO: 13940
  Variant (2)..(2): xaa in position 2 is any amino acid
  Variant (6)..(6): xaa in position 6 is any amino acid
  Variant (15)..(16): xaa in position 15 to 16 is any amino acid
  Variant (18)..(18): xaa in position 18 is any amino acid
  Variant (22)..(22): xaa in position 22 is any amino acid
  Variant (25)..(25): xaa in position 25 is any amino acid
  Variant (26)..(85): xaa in position 26 to 85 is any or no amino acid
  Variant (89)..(89): xaa in position 89 is any amino acid
  Variant (93)..(93): xaa in position 93 is any amino acid
  Variant (99)..(99): xaa in position 99 is any amino acid
  Variant (101)..(108): xaa in position 101 to 108 is any or no amino acid
  Variant (112)..(112): xaa in position 112 is any amino acid
  Variant (117)..(117): xaa in position 117 is any amino acid
  Variant (121)..(121): xaa in position 121 is any amino acid
  Variant (124)..(125): xaa in position 124 to 125 is any amino acid
  Variant (126)..(152): xaa in position 126 to 152 is any or no amino acid
  Variant (158)..(158): xaa in position 158 is any amino acid
  Variant (161)..(162): xaa in position 161 to 162 is any amino acid
  Variant (166)..(166): xaa in position 166 is any amino acid
  Variant (171)..(171): xaa in position 171 is any amino acid
  Variant (174)..(175): xaa in position 174 to 175 is any amino acid
  Variant (178)..(179): xaa in position 178 to 179 is any amino acid
  Variant (182)..(182): xaa in position 182 is any amino acid
  Variant (186)..(189): xaa in position 186 to 189 is any or no amino acid
  Variant (195)..(195): xaa in position 195 is any amino acid
  Variant (197)..(197): xaa in position 197 is any amino acid
  Variant (203)..(203): xaa in position 203 is any amino acid
  Variant (205)..(205): xaa in position 205 is any amino acid
  Variant (208)..(208): xaa in position 208 is any amino acid
  Variant (211)..(214): xaa in position 211 to 214 is any amino acid
  Variant (215)..(256): xaa in position 215 to 256 is any or no amino acid
  Variant (258)..(258): xaa in position 258 is any or no amino acid
  Variant (266)..(266): xaa in position 266 is any or no amino acid
  Variant (268)..(269): xaa in position 268 to 269 is any amino acid
  Variant (270)..(394): xaa in position 270 to 394 is any or no amino acid
  Variant (397)..(399): xaa in position 397 to 399 is any or no amino acid
  Variant (401)..(402): xaa in position 401 to 402 is any amino acid
  Variant (403)..(404): xaa in position 403 to 404 is any or no amino acid
  Variant (413)..(413): xaa in position 413 is any amino acid
  Variant (415)..(417): xaa in position 415 to 417 is any amino acid
  Variant (420)..(420): xaa in position 420 is any amino acid
  Variant (421)..(426): xaa in position 421 to 426 is any or no amino acid
  Variant (433)..(433): xaa in position 433 is any amino acid
  Variant (434)..(434): xaa in position 434 is any or no amino acid
  Variant (436)..(441): xaa in position 436 to 441 is any or no amino acid
  Variant (449)..(449): xaa in position 449 is any amino acid
  Variant (451)..(452): xaa in position 451 to 452 is any amino acid
  Variant (454)..(458): xaa in position 454 to 458 is any amino acid
  Variant (459)..(487): xaa in position 459 to 487 is any or no amino acid
  Variant (489)..(490): xaa in position 489 to 490 is any amino acid
  Variant (492)..(495): xaa in position 492 to 495 is any amino acid
  Variant (498)..(498): xaa in position 498 is any amino acid
  Variant (504)..(509): xaa in position 504 to 509 is any amino acid
  Variant (510)..(529): xaa in position 510 to 529 is any or no amino acid
  Variant (532)..(534): xaa in position 532 to 534 is any amino acid
  Variant (535)..(538): xaa in position 535 to 538 is any or no amino acid
  Variant (540)..(544): xaa in position 540 to 544 is any amino acid
  Variant (547)..(554): xaa in position 547 to 554 is any amino acid
  Variant (555)..(592): xaa in position 555 to 592 is any or no amino acid
  Variant (594)..(607): xaa in position 594 to 607 is any amino acid
  Variant (608)..(611): xaa in position 608 to 611 is any or no amino acid
  Variant (613)..(613): xaa in position 613 is any amino acid
  Variant (617)..(618): xaa in position 617 to 618 is any amino acid
  Variant (620)..(620): xaa in position 620 is any amino acid
  Variant (623)..(623): xaa in position 623 is any amino acid
  Variant (625)..(627): xaa in position 625 to 627 is any amino acid
  Variant (628)..(667): xaa in position 628 to 667 is any or no amino acid
  Variant (672)..(674): xaa in position 672 to 674 is any amino acid
  Variant (684)..(684): xaa in position 684 is any amino acid
  Variant (694)..(697): xaa in position 694 to 697 is any amino acid
  Variant (698)..(737): xaa in position 698 to 737 is any or no amino acid
  Variant (739)..(739): xaa in position 739 is any amino acid
  Variant (740)..(740): xaa in position 740 is any or no amino acid
  Variant (742)..(742): xaa in position 742 is any or no amino acid
  Variant (745)..(745): xaa in position 745 is any or no amino acid
  Variant (747)..(750): xaa in position 747 to 750 is any amino acid
  Variant (752)..(797): xaa in position 752 to 797 is any or no amino acid
  Variant (801)..(801): xaa in position 801 is any amino acid
  Variant (803)..(803): xaa in position 803 is any amino acid
  Variant (805)..(805): xaa in position 805 is any amino acid
  Variant (808)..(808): xaa in position 808 is any amino acid
  Variant (812)..(814): xaa in position 812 to 814 is any amino acid
  Variant (817)..(817): xaa in position 817 is any amino acid
  Variant (818)..(818): xaa in position 818 is any or no amino acid
  Variant (820)..(827): xaa in position 820 to 827 is any amino acid
  Variant (828)..(840): xaa in position 828 to 840 is any or no amino acid
  Variant (845)..(845): xaa in position 845 is any amino acid
  Variant (847)..(850): xaa in position 847 to 850 is any amino acid
  Variant (852)..(852): xaa in position 852 is any amino acid
  Variant (857)..(857): xaa in position 857 is any amino acid
  Variant (859)..(864): xaa in position 859 to 864 is any amino acid
  Variant (865)..(886): xaa in position 865 to 886 is any or no amino acid
  Variant (888)..(898): xaa in position 888 to 898 is any amino acid
  Variant (899)..(909): xaa in position 899 to 909 is any or no amino acid
  Variant (911)..(915): xaa in position 911 to 915 is any amino acid
  Variant (916)..(916): xaa in position 916 is any or no amino acid

SEQ ID NO: 26498 - protein, 8 aa, Artificial sequence
  Variant (2)..(2): xaa in position 2 is Glu or Gln
  Variant (3)..(3): xaa in position 3 is Ile, Leu or Val
  Variant (4)..(7): xaa in position 4 to 7 is any amino acid
YXXXXXXF

SEQ ID NO: 26499 - protein, 72 aa, Artificial sequence; identical to SEQ ID NO: 13942
  Variant (2)..(12): xaa in position 2 to 12 is any amino acid
  Variant (14)..(16): xaa in position 14 to 16 is any amino acid
  Variant (17)..(17): xaa in position 17 is Phe, Ile, Leu, Met or Val
  Variant (18)..(18): xaa in position 18 is Trp or Tyr
  Variant (19)..(19): xaa in position 19 is Phe, Ile, Leu, Met or Val
  Variant (20)..(20): xaa in position 20 is any amino acid
  Variant (22)..(30): xaa in position 22 to 30 is any amino acid
  Variant (31)..(31): xaa in position 31 is any or no amino acid
  Variant (33)..(35): xaa in position 33 to 35 is any amino acid
  Variant (36)..(36): xaa in position 36 is Asp, Glu, Asn or Thr
  Variant (37)..(39): xaa in position 37 to 39 is any amino acid
  Variant (40)..(40): xaa in position 40 is Phe, Ile, Leu or Val
  Variant (41)..(44): xaa in position 41 to 44 is any amino acid
  Variant (46)..(52): xaa in position 46 to 52 is any amino acid
  Variant (53)..(53): xaa in position 53 is Phe, Leu, Met or Val
  Variant (54)..(61): xaa in position 54 to 61 is any amino acid
  Variant (62)..(62): xaa in position 62 is Phe, Ile, Leu, Met or Val
  Variant (63)..(63): xaa in position 63 is any amino acid
  Variant (64)..(64): xaa in position 64 is Ile, Leu or Val
  Variant (65)..(66): xaa in position 65 to 66 is any amino acid
  Variant (67)..(67): xaa in position 67 is Asp or Glu
  Variant (68)..(71): xaa in position 68 to 71 is any amino acid

SEQ ID NO: 26500 - protein, 14 aa, Artificial sequence
  Variant (2)..(6): xaa in position 2 to 6 is any amino acid
  Variant (7)..(8): xaa in position 7 to 8 is any or no amino acid
  Variant (10)..(10): xaa in position 10 is Ala or Gly
  Variant (11)..(11): xaa in position 11 is any amino acid
  Variant (13)..(13): xaa in position 13 is Phe, Ile, Leu, Met or Val
WXXXXXXXDXXRXD

SEQ ID NO: 26501 - protein, 12 aa, Artificial sequence
  Variant (2)..(2): xaa in position 2 is any amino acid
  Variant (3)..(3): xaa in position 3 is Ala, Ile, Pro or Val
  Variant (4)..(5): xaa in position 4 to 5 is any amino acid
  Variant (7)..(7): xaa in position 7 is any amino acid
  Variant (9)..(9): xaa in position 9 is Asp, Glu, Gly, Asn, Gln, Ser or Thr
  Variant (11)..(11): xaa in position 11 is any amino acid
GXXXXYXGXEXG

SEQ ID NO: 26502 - DNA, 966 bp, Escherichia coli K12
  CDS (1)..(966): transl_table=11
atgagtaaacccattgtgatggaacgcggtgttaaataccgcgatgccgataagatggcccttatcccggttaaaaacgtggcaacagagcgcgaagccctgctgcgcaagccggaatggatgaaaatcaagcttccagcggactctacacgtatccagggcatcaaagccgcaatgcgcaaaaatggcctgcattctgtctgcgaggaagcctcctgccctaacctggcggaatgcttcaaccacggcacagcaacgtttatgatcctcggcgctatttgtacccgccgttgtccgttctgtgatgttgcccacggtcgcccggtagctcctgatgccaatgaaccagtgaaactggcgcagaccattgccgatatggcgctgcgttatgtggttatcacctccgttgaccgtgatgacctgcgcgatggcggtgcccagcactttgcggattgcattactgccattcgggaaaaaagcccgcaaatcaaaattgaaactctggtgccggatttccgcggtcgtatggatcgtgctctggatattctgactgcaacgccaccagatgtgttcaaccataacctggaaaacgtaccgcgtatttaccgtcaggtacggcctggtgcagattacaactggtcgctgaagctgctggaacgctttaaagaagcgcatccggaaatcccgaccaagtctggtctgatggtgggactgggtgaaaccaatgaagaaattattgaggtaatgcgcgacctgcgccgtcatggtgtgacgatgttaacgctggggcaatatttgcagccaagccgccatcacctgccggttcaacgttacgttagcccggatgagttcgacgaaatgaaagccgaagcgctggcgatgggctttacccatgctgcatgcggtccgtttgtccgctcttcttaccacgccgatttgcaggcgaaagggatggaagttaagtaa

SEQ ID NO: 26503 - protein, 321 aa, Escherichia coli K12
MSKPIVMERGVKYRDADKMALIPVKNVATEREALLRKPEWMKIKLPADSTRIQGIKAAMRKNGLHSVCEEASCPNLAECFNHGTATFMILGAICTRRCPFCDVAHGRPVAPDANEPVKLAQTIADMALRYVVITSVDRDDLRDGGAQHFADCITAIREKSPQIKIETLVPDFRGRMDRALDILTATPPDVFNHNLENVPRIYRQVRPGADYNWSLKLLERFKEAHPEIPTKSGLMVGLGETNEEIIEVMRDLRRHGVTMLTLGQYLQPSRHHLPVQRYVSPDEFDEMKAEALAMGFTHAACGPFVRSSYHADLQAKGMEVK

SEQ ID NO: 26504 - DNA, 984 bp, Xenopus tropicalis
  CDS (1)..(984)
atgagactgtgtgggcttcgcagaggggcagaacttctacggacttgtgggttagccgaataccacacctcgtacagggcgttaagcaatttgccagatgagaagaaggaactcatcaagaatggacccgatctgcaggactttctgtcgggagagctaactgataagagttcctgggctgcatacaaaggcaacttaaagaggctgaaaggagagagattaagactcccaccttgggtgaggactgaaatcccaatgggtaaaaattacaacaagctgaaaaacacactgcgaaaccttaatcttcacactgtgtgtgaagaagctcggtgtcctaatattggggagtgctgggggggaggagaatacggcacggccacagcaactataatgttgatgggtgacacatgtacccgaggttgtcgtttctgttcggtgaaaactgcaaggaaccctcctcccctggacccagatgagccatttaatacagcaaaagcaattgcagactggggcctggattatgtagtactgacatcagtagaccgagacgacatttcagatgggggtgctgagcacattgcaaaaacagtgtcactgttaaaagagagaaaccaaacaattcttattgaatgcctcacgccagatttccgaggaaacctgaaggcagtggaaactgtagctgggtctgggttggatgtttatgcccacaatgtagagactgttccagcactgcaaaggcatgtacgtgatcctagagctaattttgaccagtcagtgaatgttctgaaacacgccaaaaatgtacggcctgaacttatatccaaaacatccatcatgttgggcttaggggaaacagatgaacaaatctactccacaatgaaagcactgcgagaagcgggtgtggattgtttgacccttggtcagtacatgcagccgacaaaacgacatcttaaggttgaggagtacatcacgccagagccctga

SEQ ID NO: 26505 - protein, 327 aa, Xenopus tropicalis
MRLCGLRRGAELLRTCGLAEYHTSYRALSNLPDEKKELIKNGPDLQDFLSGELTDKSSWAAYKGNLKRLKGERLRLPPWVRTEIPMGKNYNKLKNTLRNLNLHTVCEEARCPNIGECWGGGEYGTATATIMLMGDTCTRGCRFCSVKTARNPPPLDPDEPFNTAKAIADWGLDYVVLTSVDRDDISDGGAEHIAKTVSLLKERNQTILIECLTPDFRGNLKAVETVAGSGLDVYAHNVETVPALQRHVRDPRANFDQSVNVLKHAKNVRPELISKTSIMLGLGETDEQIYSTMKALREAGVDCLTLGQYMQPTKRHLKVEEYITPEP

SEQ ID NO: 26506 - DNA, 1122 bp, Rattus norvegicus
  CDS (1)..(1122)
atggctttacgctgctgggatgcagctcgcagcctggggtcccggatatttggaagatatgcgtgctcggttagagcattaagttctttgccagatgagaaaaagaaatttttgcataatgggccagaccttcaagattttgtatctggtgatcttgcagacaagagtacctgggatgattataaaggaaacttaaagcgccagaaaggagaaaggttaagactacctccgtggttaaagacaaagatacccatgggtaaaaattacaataagctgaaaaatacgttgcggaatttaaatctccacacagtatgtgaggaagcccgatgtccaaacatcggagagtgttggggaggtggggaatatgccaccgccacagccacgatcatgttgatgggggacacatgcacaagaggttgcagattttgctctgttaagacggcaagaaatccccctccattggatcccagtgagcccgacaatacggccagagcaatcgcagagtggggtctggactatgttgtgctgacgtctgtggaccgagatgatgtggtcgatgggggagctgagcacattgccaagacagtgtcatgcttgaaggaaaggaatccaaaaatcctcgtggaatgcctcacccccgacttccgaggagatctgagagctgtagaaaaggtggcgctgtctggactagatgtgtatgcacacaatgtagagacggttccagaattacagaggaaagtccgtgatccccgggccaattttgaccagtctcttcgtgtattgaaacatgccaaggaggtgcagcctgatgttgtttccaaaacatcaataatgctgggcctcggtgagacagacgagcaggtctatgccacgatgaaagctctccgtgcagccgatgtggactgtttaactctcgggcagtatatgcagccgaccaagcgccaccttaaggttgaagagtacgttactcctgagaagttcaaatactgggaagaagtaggaaatgaacttggatttcactacactgcaagtggccctttggtgcgatcttcatataaagcaggtgaatttttcctgaaaaatctagtggctaaaagaaaaacaaaagtttctaaagtttag

SEQ ID NO: 26507 - protein, 373 aa, Rattus norvegicus
MALRCWDAARSLGSRIFGRYACSVRALSSLPDEKKKFLHNGPDLQDFVSGDLADKSTWDDYKGNLKRQKGERLRLPPWLKTKIPMGKNYNKLKNTLRNLNLHTVCEEARCPNIGECWGGGEYATATATIMLMGDTCTRGCRFCSVKTARNPPPLDPSEPDNTARAIAEWGLDYVVLTSVDRDDVVDGGAEHIAKTVSCLKERNPKILVECLTPDFRGDLRAVEKVALSGLDVYAHNVETVPELQRKVRDPRANFDQSLRVLKHAKEVQPDVVSKTSIMLGLGETDEQVYATMKALRAADVDCLTLGQYMQPTKRHLKVEEYVTPEKFKYWEEVGNELGFHYTASGPLVRSSYKAGEFFLKNLVAKRKTKVSKV

SEQ ID NO: 26508 - DNA, 1119 bp, Bos taurus
  CDS (1)..(1119)
atgtctctacgctgcgggggcgcggtccgcaccgtgggcccccgggtatttggaagatatgtattcagccctgtcagagaagtaagtttcctgccagatgaaaaaaaggaatttttacagagtggaccagaccttcaagaatttatatctggtaatctggctgacaagagtacctgggatgaatataaaggaaatttaaaacgccagaaaggagaaaggttaagactacctccatggctaaaaacagagattcctatggggaaaaattataataaactgaaaaacactttgcggaatttaaatcttcacacagtgtgtgaggaagctcgatgtcccaatattggagagtgttggggaggtggagaatatgctaccgccacagccacaatcatgttgatgggtgacacatgtacaagaggttgtagattttgttctgttaagactgcaagaaatccacctccactggatgccaatgagccctacaatactgcaaaggcaattgcagagtggggtctggattatgttgtcctgacatctgtggatcgagatgatatgcctgatggaggagctgagcactttgcaaagactgtatcttacttaaaggaaaggaatccaaaaattcttgtggaatgtctcacccctgatttccgaggagatcttaaagcaatagaaaaagttgccctgtcaggattagatgtatatgcacataatgtagaaacagttccagaattacagaggaaagttcgtgatccccgggccaattttgaccagtctctacgtgtactaaaacatgccaaggaggttcgacctgatgttatttctaaaacatctattatgttgggtttaggtgagaatgatgagcaagtatatgccacgatgaaagcacttcgtgaggcagatgtggactgtttgactttaggacaatatatgcagccaacaaagcgccaccttaaggttgaagaatacattactcctgaaaagttcaaatactgggaaaaagtaggaaatgaacttggatttcattatactgcaagtggccccctggtgcgttcttcatacaaagcaggtgaatttttcctgaaaaatctagtggctaaaagaaaaacaaaagccctgtaa

SEQ ID NO: 26509 - protein, 372 aa, Bos taurus
MSLRCGGAVRTVGPRVFGRYVFSPVREVSFLPDEKKEFLQSGPDLQEFISGNLADKSTWDEYKGNLKRQKGERLRLPPWLKTEIPMGKNYNKLKNTLRNLNLHTVCEEARCPNIGECWGGGEYATATATIMLMGDTCTRGCRFCSVKTARNPPPLDANEPYNTAKAIAEWGLDYVVLTSVDRDDMPDGGAEHFAKTVSYLKERNPKILVECLTPDFRGDLKAIEKVALSGLDVYAHNVETVPELQRKVRDPRANFDQSLRVLKHAKEVRPDVISKTSIMLGLGENDEQVYATMKALREADVDCLTLGQYMQPTKRHLKVEEYITPEKFKYWEKVGNELGFHYTASGPLVRSSYKAGEFFLKNLVAKRKTKAL

SEQ ID NO: 26510 - DNA, 1119 bp, Homo sapiens
  CDS (1)..(1119)
atgtctctacgctgcggggatgcagcccgcaccctggggccccgggtatttgggagatatttttgcagcccagtcagaccgttaagctccttgccagataaaaaaaaggaactcctacagaatggaccagaccttcaagattttgtatctggtgatcttgcagacaggagcacctgggatgaatataaaggaaacctaaaacgccagaaaggagaaaggttaagactacctccatggctaaagacagagattcccatggggaaaaattacaataaactgaaaaatactttgcggaatttaaatctccatacagtatgtgaggaagctcgatgtcccaatattggagagtgttggggaggtggagaatatgccaccgccacagccacgatcatgttgatgggtgacacatgtacaagaggttgcagattttgttctgttaagactgcaagaaatcctcctccactggatgccagtgagccctacaatactgcaaaggcaattgcagaatggggtctggattatgttgtcctgacatctgtggatcgagatgatatgcctgatgggggagctgaacacattgcaaagaccgtatcatatttaaaggaaaggaatccaaaaatccttgtggagtgtcttactcctgattttcgaggtgatctcaaagcaatagaaaaagttgctctgtcaggattagatgtgtatgcacataatgtagaaacagtcccggaattacagagtaaggttcgtgatcctcgggccaattttgatcagtccctacgtgtactgaaacatgccaagaaggttcagcctgatgttatttctaaaacatctataatgttgggtttaggcgagaatgatgagcaagtatatgcaacaatgaaagcacttcgtgaggcagatgtagactgcttgactttaggacaatatatgcagccaacaaggcgtcaccttaaggttgaagaatatattactcctgaaaaattcaaatactgggaaaaagtaggaaatgaacttggatttcattatactgcaagtggccctttggtgcgttcttcatataaagcaggtgaatttttcctgaaaaatctagtggctaaaagaaaaacaaaagacctctaa

SEQ ID NO: 26511 - protein, 372 aa, Homo sapiens
MSLRCGDAARTLGPRVFGRYFCSPVRPLSSLPDKKKELLQNGPDLQDFVSGDLADRSTWDEYKGNLKRQKGERLRLPPWLKTEIPMGKNYNKLKNTLRNLNLHTVCEEARCPNIGECWGGGEYATATATIMLMGDTCTRGCRFCSVKTARNPPPLDASEPYNTAKAIAEWGLDYVVLTSVDRDDMPDGGAEHIAKTVSYLKERNPKILVECLTPDFRGDLKAIEKVALSGLDVYAHNVETVPELQSKVRDPRANFDQSLRVLKHAKKVQPDVISKTSIMLGLGENDEQVYATMKALREADVDCLTLGQYMQPTRRHLKVEEYITPEKFKYWEKVGNELGFHYTASGPLVRSSYKAGEFFLKNLVAKRKTKDL

SEQ ID NO: 26512 - DNA, 1125 bp, Arabidopsis thaliana
  CDS (1)..(1125)
atgcattcgcgctccgccttgctctatagattcctccgtccggcgtcgagatgcttctcctcttcctcggctgtaactccggtcaccgtaacgcaatctcccaagagtctcgaggctcttcgagctcggctggcgaatgagtcgccttccctaaccgatttcatccacggcgatacctattcggtggaagttggaaccaaaaagaaacctctcccgaaacctaaatggatgaaggaatcaattcccggcggcgagagatatgtccagatcaagaagaaattgagagaccttaagcttcacaccgtctgcgaggaagcgaaatgtcccaatctcggtgagtgctggtctggtggtgaaactggaaccgccaccgctacgattatgatccttggggatacatgtacacgcggctgcaggttttgtaatgtgaagacatcgcgtacacctccaccgcctgatccaaatgaacctaacaatgtggctgaagcaattgcttcctggggggttgattatgttgtgatcaccagtgtagatcgagatgatttacctgatcaagggagtggtcattttgctgaaactgttcagagattgaaattcttgaagccggagatgttgattgaagcactagttcctgatttccgcggagatggtggatgtgttgagaaggtttccaagtcagggcttgatgtcttagctcacaacattgagacagttgaagagcttcagagttttgtgcgggaccatcgtgctaactttaagcagtcattggatgtgcttaggatggctaaggagtatgcacctgcaggcaccttaacaaagacttctgtaatgctgggatgtggagagacccctgatcaagtggttaagacaatggagaaggtgagagcagcaggggttgacgttatgacatttggccaatatatgcgaccatctaaacgccacatgccagtagctgagtacgtgacaccagatgccttcgagaggtatcgccttcttggcatggaaatgggattcagatacgtagcatcaggaccaatggtgaggtcgtcgtacaaagcgggagagtactacataaagtcgatgatagaagccgatcgagtggcttctccttctacatccccgtag

SEQ ID NO: 26513 - protein, 374 aa, Arabidopsis thaliana
MHSRSALLYRFLRPASRCFSSSSAVTPVTVTQSPKSLEALRARLANESPSLTDFIHGDTYSVEVGTKKKPLPKPKWMKESIPGGERYVQIKKKLRDLKLHTVCEEAKCPNLGECWSGGETGTATATIMILGDTCTRGCRFCNVKTSRTPPPPDPNEPNNVAEAIASWGVDYVVITSVDRDDLPDQGSGHFAETVQRLKFLKPEMLIEALVPDFRGDGGCVEKVSKSGLDVLAHNIETVEELQSFVRDHRANFKQSLDVLRMAKEYAPAGTLTKTSVMLGCGETPDQVVKTMEKVRAAGVDVMTFGQYMRPSKRHMPVAEYVTPDAFERYRLLGMEMGFRYVASGPMVRSSYKAGEYYIKSMIEADRVASPSTSP

SEQ ID NO: 26514 - DNA, 909 bp, Rickettsia conorii str. Malish 7
  CDS (1)..(909): transl_table=11
ttgaattatttccgttttatggctaatttaaataaacgacctgattggataaaagtaaaagctcctaattctacagagtactataatacaaaagatttaataaagaatctgagattaaatactgtgtgcgaggaagctgcttgtcctaatattggtgagtgctggtcaaaaaaacatacaactgtgatgattttaggttcggtttgtactagagcttgtaggttttgtaacgttaaaacgggtagaccggatttacttgatccgtatgaaccgcaaaggttagcggaggcggtacaaaagctaaatcttaagcatgtagtaattacttccgtcgatcgtgatgatcttgaggatggcggagcgtcacattttgcggagtgtattagcgaaatccgaaaatcatcgccaaatactactattgagattctaacacccgattttttaagaaaagaaggagcagctgaaataatagcaaacgcaaaacctgacgtttttaaccataatgtcgaaacagtaccgtctttatacaaaacgattagaccgggggctagatattataattctttaagtttactgcataatattaaaaaattatctcctgaaatttttacaaaatccggtatgatggtaggacttggggaagaaataaatgaagtagtacaggttatagatgatttaagagaagcaaaggttgatttcctaactatcgggcagtatctgcagcctaccaaaaatcatgctgaggtcgcaaaatatgttacgccggaagagtttaaatatctagagcgagtagcaaaaacaaaaggattcttgatggtttcggcaagcccgctgacccgttcttcataccatgctgatgaggattttcaaaaattaaaagagaattaccaacaaaaactggtgtcttaa

SEQ ID NO: 26515 - protein, 302 aa, Rickettsia conorii str. Malish 7
MNYFRFMANLNKRPDWIKVKAPNSTEYYNTKDLIKNLRLNTVCEEAACPNIGECWSKKHTTVMILGSVCTRACRFCNVKTGRPDLLDPYEPQRLAEAVQKLNLKHVVITSVDRDDLEDGGASHFAECISEIRKSSPNTTIEILTPDFLRKEGAAEIIANAKPDVFNHNVETVPSLYKTIRPGARYYNSLSLLHNIKKLSPEIFTKSGMMVGLGEEINEVVQVIDDLREAKVDFLTIGQYLQPTKNHAEVAKYVTPEEFKYLERVAKTKGFLMVSASPLTRSSYHADEDFQKLKENYQQKLVS

SEQ ID NO: 26516 - DNA, 1065 bp, Caenorhabditis elegans
  CDS (1)..(1065)
atgctagctcgggtatgggtccgtggacttgcagccacaaagaaaaaaccgcaagttctcgtcaaagatggaccatcgcttcaggattttatttcatcagcatccgtggcagaggctgttgagaagtacgaaggaaaactgaagctggagaaaggggacagacgtttgcgacttccaccatggctcaagaaagaaaagattcttccatcggaaaacgaaaatgtcagtcgtctaaaaaagcagttgaaacatctcaaactagcgactgtttgtcaggaagcacggtgcccaaatcttggagaatgctggggaggatcagatgacagtctagcaacagcgacaatcatgttgatgggagatacctgcactcggggttgtaaattctgttcggtcaaaactgctcgagctcctccaccattggatcctatggaaccggaaaatacgtcgaccgccgttgcttcatggggtgtcgaatacattgttttaacatcagttgacagggatgatttgccagacggtggagccgatcatcttcgcaagacagtacagctgatgaagctcaagaagcctgaacttctcatcgaatgcttattgcccgatttcgctggagataagatcagtgtggagaaaatggctaccagtggactcgatgtatatgcacataacattgaaacggttgaaagactgactccatgggtcagagatccacgagctaaatatcggcagtctttggacgctcttcgatacgcaaaggaagtcagcccaaagctaatcacgaagacatcgattatgctaggactgggcgaagctgaagacgagataaagcagtgcttggccgatcttcgagctagcaatgttgacgttgtcactttcggtcaatacatgcagccgacaaaacgtcatttgcttgtcaaagaatgggtgacccccgagaaattcgaccagtgggcagaatattcgaaaaaactgggattcctttacgttgcatctggccctcttgttcgctcttcgtacaaagccggagaattctatttgaaaaatgtgttgagaaatagacaaaattaa

SEQ ID NO: 26517 - protein, 354 aa, Caenorhabditis elegans
MLARVWVRGLAATKKKPQVLVKDGPSLQDFISSASVAEAVEKYEGKLKLEKGDRRLRLPPWLKKEKILPSENENVSRLKKQLKHLKLATVCQEARCPNLGECWGGSDDSLATATIMLMGDTCTRGCKFCSVKTARAPPPLDPMEPENTSTAVASWGVEYIVLTSVDRDDLPDGGADHLRKTVQLMKLKKPELLIECLLPDFAGDKISVEKMATSGLDVYAHNIETVERLTPWVRDPRAKYRQSLDALRYAKEVSPKLITKTSIMLGLGEAEDEIKQCLADLRASNVDVVTFGQYMQPTKRHLLVKEWVTPEKFDQWAEYSKKLGFLYVASGPLVRSSYKAGEFYLKNVLRNRQN

SEQ ID NO: 26518 - DNA, 1143 bp, Drosophila melanogaster
  CDS (1)..(1143)
atgtatgtcatgttgcgagctttaaaaactcacgcggaggcccccattgtagttgccacccgtgcggcatcaacgaatgcggagaagcttgaggagattcgtgaacgtctggcaaagggtccgaatttccatgactttgtgcagaatccggacaacaccagaaacgagtgggaacagtacgatggaaagctacgccgcgaaaagggcgaggagcagcgactgcgattgccgccttggttaaagaccaccattcccgtgggcaaaaactacgccaaaatcaaggcccagatgcgcgagctcaagctgtccaccgtctgcgaggaggcccggtgtcccaacatcggcgagtgctggggcggcggcgagcatggcacccagacagccacgattatgcttatgggcgacacttgcaccagaggctgtagattttgttcggtgaaaacggcacgcaaaccaccaccgctggatgtaaacgaacccgtgaacacagccacggcaattgcctcctggggattggattacattgttctgacctcagttgatcgagatgatttgccagacggtggctcggagcacattgccgaaactgttcgcgaaattaaggcgcgcaactcaaacatctttgtggagtgcctagtacctgatttccgaggaaatctggagtgtgtgaagacgatcgccaacagcgggctggatgtttatgcgcacaacatagagacggttgagaagctcactccctatgtgcgcgaccggcgcgcccactaccgccagaccctgcaagtgctaaccgaagcgaagagattcaaccccaatctcatcaccaagagttcaattatgctgggacttggcgagaccgacgaggagatcgagaacaccttgaaggatctgcgggaggccggcgtagattgcgtgaccctgggtcagtacatgcagcccacgaataagcacctcaaggtcatcgaatacgtcacgcccgagaagttcaagcactgggaagagcgcggcaacgaactgggtttcctgtacacagccagtggaccgctggtgcgcagctcctacaaagccggcgagttcttcatcacaagtatattggagaatcgcaagaagaggcaaaacgacactgaagttcccaagaagcagtaa

SEQ ID NO: 26519 - protein, 380 aa, Drosophila melanogaster
MYVMLRALKTHAEAPIVVATRAASTNAEKLEEIRERLAKGPNFHDFVQNPDNTRNEWEQYDGKLRREKGEEQRLRLPPWLKTTIPVGKNYAKIKAQMRELKLSTVCEEARCPNIGECWGGGEHGTQTATIMLMGDTCTRGCRFCSVKTARKPPPLDVNEPVNTATAIASWGLDYIVLTSVDRDDLPDGGSEHIAETVREIKARNSNIFVECLVPDFRGNLECVKTIANSGLDVYAHNIETVEKLTPYVRDRRAHYRQTLQVLTEAKRFNPNLITKSSIMLGLGETDEEIENTLKDLREAGVDCVTLGQYMQPTNKHLKVIEYVTPEKFKHWEERGNELGFLYTASGPLVRSSYKAGEFFITSILENRKKRQNDTEVPKKQ

SEQ ID NO: 26520 - DNA, 909 bp, Thermosynechococcus elongatus BP-1
  CDS (1)..(909): transl_table=11
atggagttagccgtggttgttaagccagagtggttacgggtcaaagcaccccagtggcagcgggtgggttccgtcaaggaactgttgcgggacttaaacctcaatactgtttgcgaagaggcctcttgccccaatattggtgaatgtttctatcagggaacggccacatttttaatgatgggtccagcttgcacccgggcttgcccctactgcgatattgattttgagaaaaagccattgcctctggatcccactgaaccccagcgactagctgaagcagtggtgcggatgcgtctcaatcacgttgtcattacctcggtgaatcgggatgatttggccgacgggggtgcctctcagtttgtcgccacgattgaggctgtgcggcagcgatcgccccaaacaacaattgaagtcctgattcccgatctctgcggcaactggcaggccttggatcaaattcttgctgccggtccggaagtactcaaccacaacaccgagaccgtgccccgtctctatcggcgggtgcgtccccaaggcaactatcagcgcagtctggaactgctgcagcgggtgcgcgatcgcgccccttggatttactcaaaatcgggcattatggtgggtctaggggaaaccagcgaggaagtggtggccctcatgcaggatttgcgccaagtgggttgtgacattctcaccattggtcagtatctgcaacccagtcccaaacatctagcggtacaggcctttattccaccagagcaatttgaggaatggcgccgcctgggggaatcgatgggctttttgcaggtggtttcctctcccctcacccgtagttcctaccatgctgagcaggtgcgggctctgatgcaacagtacccacgtcagcgtcctgccccaagtcctcttggatag

SEQ ID NO: 26521 - protein, 302 aa, Thermosynechococcus elongatus BP-1
MELAVVVKPEWLRVKAPQWQRVGSVKELLRDLNLNTVCEEASCPNIGECFYQGTATFLMMGPACTRACPYCDIDFEKKPLPLDPTEPQRLAEAVVRMRLNHVVITSVNRDDLADGGASQFVATIEAVRQRSPQTTIEVLIPDLCGNWQALDQILAAGPEVLNHNTETVPRLYRRVRPQGNYQRSLELLQRVRDRAPWIYSKSGIMVGLGETSEEVVALMQDLRQVGCDILTIGQYLQPSPKHLAVQAFIPPEQFEEWRRLGESMGFLQVVSSPLTRSSYHAEQVRALMQQYPRQRPAPSPLG

SEQ ID NO: 26522 - DNA, 1248 bp, Plasmodium falciparum 3D7
  CDS (1)..(1248)
atgcattttggtatcccatcccttttttacttgtatatccttttttccattattatgaggataaaatgtgtcataacgaaaaatttgaaaaaaacaaagaaacgaacctgttcatacatacctcatggaaatatggaaaaaggtatcattttaaattatattgaaaaaccaaaccctgcatatttgaaaagaggaaagaataaaaataaaaataaaaataaaaaaggagatatatataaattaagaaatgtagaaatattgttatacgcaaacagatatgtacatgaaggaaatgaaaatttttctagcactacaaaaaaattattattaacaccaaaagttggaaataaaatgcctgaaggaaagaaaccagactggtttcatgtagctgctcctactgttgcaaaatataataaattaaaagatgatataaaaaaattaaacttacataccgtatgtgaagaagcacaatgtcctaatattggagaatgctggaatataggtacagcaactattatgttattgggtgatacatgtacaaggggttgtaaattttgctcaattaaaacatcatcaaacccattacctcctgatattaatgaacctttcaatacagctaaagctatatgtgaatggaatattgattatgttgttttaacttctgttgatagagatgatttaccagatggtggagctagtcattttgctaaaacagtagaattagtaaaattttcaagaccagatattttaattgaatgtttagtttctgattttcaaggaaacatcgattctgtacgaaaattagcttttagtggattggatgtatatgcacataatatagagacagttaaaagattacagaaatatgttagagataaaagagcaaattatgatcaatcactatttgtattaaaaacagctaaagaaatcaatcctcagttatacacaaaaacaagtattatgttaggattgggagagacaaaagaagaagttatacaaactatgtatgatgcaagaaaaaataatatagatgttataacatttggtcaatacttaagacctacaaaaaatcatttaagtattgttcaatatatatcaccacaaatgttcgaatattataaagaagaaggattaaaaatgggatttaaatatatagccagcggccctttagttcgttcttcttataaagcaggtgaatattttataaaaaatttagttaaccaacgaaacaaagataaaaaaaattaa

SEQ ID NO: 26523 - protein, 415 aa, Plasmodium falciparum 3D7
MHFGIPSLFYLYILFSIIMRIKCVITKNLKKTKKRTCSYIPHGNMEKGIILNYIEKPNPAYLKRGKNKNKNKNKKGDIYKLRNVEILLYANRYVHEGNENFSSTTKKLLLTPKVGNKMPEGKKPDWFHVAAPTVAKYNKLKDDIKKLNLHTVCEEAQCPNIGECWNIGTATIMLLGDTCTRGCKFCSIKTSSNPLPPDINEPFNTAKAICEWNIDYVVLTSVDRDDLPDGGASHFAKTVELVKFSRPDILIECLVSDFQGNIDSVRKLAFSGLDVYAHNIETVKRLQKYVRDKRANYDQSLFVLKTAKEINPQLYTKTSIMLGLGETKEEVIQTMYDARKNNIDVITFGQYLRPTKNHLSIVQYISPQMFEYYKEEGLKMGFKYIASGPLVRSSYKAGEYFIKNLVNQRNKDKKN

SEQ ID NO: 26524 - DNA, 1065 bp, Tropheryma whipplei str. Twist
  CDS (1)..(1065): transl_table=11
gtgcaaaatatgaacgattctggcaattcaagcaaagttaatgtaaggcccccttcagccggtttgggagcaccctccccgggcaagcgtaagatgctccgcctggaggtacgaaattcgcaggttcctatagaacggaagccctcatggataagggctcgtgcaactattggtacagagtacagaaaggttcaggaacgtgttaagaaacagaatttgcggactgtttgtcaagaagccggatgtccgaatatctacgaatgctgggaggatagagaggcaactttcctgatcggaggatcgcagtgtactcgcaggtgtgatttttgtcagatagacacgggaaaacctgcagagctcgacctggatgagccaaaacgggttggacagtccgtggcgcaaatgaagttacgctatgccaccgtaaccggagtagcacgcgacgacctgcccgatgggggtgtctggctctatgcagaaacaatccgagaaatacacaaacagtgccctggaagtggggttgaaatactcataccagattttaacggtaagccagagttgctccagcaaatcttcgaagcacaaccggaagtgtacgcacacaatatagaaactgttccacggatattcaggcgcattagaccggcattcagatacgacagatcgctggatgttatatcacaaggtcaaaaggctgggatgataacaaaatcaaatcttattcttggaatgggcgagaccggtgaagaggtaacacaggcattgagagacctcaaaagtgccggttgtgacattgtaacaataactcagtatctaagaccatcgcccaggcatttacccgtggcaagatgggtaaaaccacaagagttcatagaatataaagagcaagccaaagagatcggattctcaggcgttttggccggacctttagttagatcatcataccgtgccggaaaactgtgggcacaatctgtgaaagctaagatggttgaaatacccgagcgcgtacggaaactcataaacgaaatcgagatgcaggaaacgtcctttaggcaagcagtctag

SEQ ID NO: 26525 - protein, 354 aa, Tropheryma whipplei str. Twist
MQNMNDSGNSSKVNVRPPSAGLGAPSPGKRKMLRLEVRNSQVPIERKPSWIRARATIGTEYRKVQERVKKQNLRTVCQEAGCPNIYECWEDREATFLIGGSQCTRRCDFCQIDTGKPAELDLDEPKRVGQSVAQMKLRYATVTGVARDDLPDGGVWLYAETIREIHKQCPGSGVEILIPDFNGKPELLQQIFEAQPEVYAHNIETVPRIFRRIRPAFRYDRSLDVISQGQKAGMITKSNLILGMGETGEEVTQALRDLKSAGCDIVTITQYLRPSPRHLPVARWVKPQEFIEYKEQAKEIGFSGVLAGPLVRSSYRAGKLWAQSVKAKMVEIPERVRKLINEIEMQETSFRQAV

SEQ ID NO: 26526 - DNA, 1098 bp, Oryza sativa (japonica cultivar-group)
  CDS (1)..(1098)
atgatgcagagctcgctcgcgcggccgttgccgcggcccccgatccggccggcctgcgggaaccctgtctgccggagccggcccggctcggtctccgtggcccggtgccgcgcggaggctgcgccgccggctccggcgccggcggcgcgtagggcggcggggccgtacaccgggagggacccggaggtgaagaagccggcgtggctgcggcagcgtgcggcgcagggggagaagtacgcgcggctgcgggagtcgatcggcgagctcaagctcaacaccgtctgcgtcgaggcccagtgccccaacatcggcgagtgctggaacggtgggggaggggcgggcggggaaggcgacggcatcgccacggcgaccatcatggtgctcggtgatacctgtacgcgcggctgccgtttctgtgccgtgaagactagcaacaagcctccaccaccggatcccctggagcctctgaacacggccttggcagttgcaagctggggagtggactatgttgtactgaccagtgttgacagagatgacttgcctgatggtggtagcagccattttgcgcagacagagctcaaacctgggatactggtggagtgcttgacctcagattttcgaggtgacctggaggctgtttcagctttggccaactctggtctggatgtatttgcgcacaacatcgagactgtgaggagcctgcaaagaattgttagggatcctcgagcaggatatgatcagagcttagctgttctgaagcatgcaaaaagttgcaaagagggtatgataactaagtcctctatcatgcttggtcttggagagactgacgaggaggtgaaacaagccatgattgacttaagggccattggtgttgatatcttgacactgggccagtatttgcagcccactgaaagacatttgacagtaagggagtatgtaactcctgagaagttccaattttggaaggagtatggagaatcggtgggtttccgctatgttgctagtggacccctggttcggtcttcatatcgtgcaggagagctctttgtccaaaatttggtcaggaataacaaacctaagctacctgcttcatcttag

SEQ ID NO: 26527 - protein, 365 aa, Oryza sativa (japonica cultivar-group)
MMQSSLARPLPRPPIRPACGNPVCRSRPGSVSVARCRAEAAPPAPAPAARRAAGPYTGRDPEVKKPAWLRQRAAQGEKYARLRESIGELKLNTVCVEAQCPNIGECWNGGGGAGGEGDGIATATIMVLGDTCTRGCRFCAVKTSNKPPPPDPLEPLNTALAVASWGVDYVVLTSVDRDDLPDGGSSHFAQTELKPGILVECLTSDFRGDLEAVSALANSGLDVFAHNIETVRSLQRIVRDPRAGYDQSLAVLKHAKSCKEGMITKSSIMLGLGETDEEVKQAMIDLRAIGVDILTLGQYLQPTERHLTVREYVTPEKFQFWKEYGESVGFRYVASGPLVRSSYRAGELFVQNLVRNNKPKLPASS

SEQ ID NO: 26528 - DNA, 969 bp, Homo sapiens
  CDS (1)..(969)
atgtctctacgctgcggggatgcagcccgcaccctggggccccgggtatttgggagatatttttgcagcccagtcagaccgttaagctccttgccagataaaaaaaaggaactcctacagaatggaccagaccttcaagattttgtatctggtgatcttgcagacaggagcacctgggatgaatataaaggaaacctaaaacgccagaaaggagaaaggttaagactacctccatggctaaagacagagattcccatggggaaaaattacaataaactgaaaaatactttgcggaatttaaatctccatacagtatgtgaggaagctcgatgtcccaatattggagagtgttggggaggtggagaatatgccaccgccacagccacgatcatgttgatgggtgacacatgtacaagaggttgcagattttgttctgttaagactgcaagaaatcctcctccactggatgccagtgagccctacaatactgcaaaggcaattgcagaatggggtctggattatgttgtcctgacatctgtggatcgagatgatatgcctgatgggggagctgaacacattgcaaagaccgtatcatatttaaaggaaaggaatccaaaaatccttgtggagtgtcttactcctgattttcgaggtgatctcaaagcaatagaaaaagttgctctgtcaggattagatgtgtatgcacataatgtagaaacagtcccggaattacagagtaaggttcgtgatcctcgggccaattttgatcagtccctacgtgtactgaaacatgccaagaaggttcagcctgatgttatttctaaaacatctataatgttgggtttaggcgagaatgatgagcaagtatatgcaacaatgaaagcacttcgtgaggcagatgtagactgcttgactttaggacaatatatgcagccaacaaggcgtcaccttaaggtgaatttttcctga

SEQ ID NO: 26529 - protein, 322 aa, Homo sapiens
MSLRCGDAARTLGPRVFGRYFCSPVRPLSSLPDKKKELLQNGPDLQDFVSGDLADRSTWDEYKGNLKRQKGERLRLPPWLKTEIPMGKNYNKLKNTLRNLNLHTVCEEARCPNIGECWGGGEYATATATIMLMGDTCTRGCRFCSVKTARNPPPLDASEPYNTAKAIAEWGLDYVVLTSVDRDDMPDGGAEHIAKTVSYLKERNPKILVECLTPDFRGDLKAIEKVALSGLDVYAHNVETVPELQSKVRDPRANFDQSLRVLKHAKKVQPDVISKTSIMLGLGENDEQVYATMKALREADVDCLTLGQYMQPTRRHLKVNFS

SEQ ID NO: 26530 - DNA, 1089 bp, Corynebacterium diphtheriae NCTC 13129
  CDS (1)..(1089): transl_table=11
gtgtcgacgaccacagcaatcacgagtactctgcaaagggtgactaaagcacccgaaggacgcagaatgctcagagttgaggcgcgcaactcgcagacccccatcgagagcaaaccacgttggatccgcaccgctgttaaaaccggccctgaatatcaggacatgaaaaagaaagtgtcgggtgcaagcctgcacaccgtatgccaagaagccggctgccctaatatccacgaatgctgggagtcgcgtgaggctaccttcttgattggtggcgctaactgctcgcgccgttgcgatttctgccagattaattctgctaagcccgaaccactcgatcgcgacgagccacgtcgcgttgcagaatcagtacgcgaaatgcagctgaattactcgaccatcactggtgtgacccgtgacgatcttgaagatgaaggcgcttggctatatgcagaagttgttcgcaagattcatgagctcaatccccacaccggcgtagaaaacctcacccctgatttctccggcaagcctgacttgttgcaagaggttttcgaggctcgccccgaagtttttgctcacaacctcgaaacggttcctcgcatcttcaagcggatccgccccgctttccgttacgagcgctccttagacgtgatccgccaagcccgcgattttggattggttaccaaatccaacctgatcttgggcatgggagaaaccgtcgacgaaatccgtgatgccttggttgacctgcactcggcaggttgtgacatcatcacgattacccaatatcttcgtcccggcccgatgtaccatcccatcgatcgttgggtaaaacctgaggaatttatcgatcacgctgattttgcgcgtgaacttggatttggtgctgttatgtcggggccattggtacgttcttcttatcgtgccggaaagctttatgccgaggctctcgcggctcgcggtgagtccttgccagaaaacttggctcatttggccacgactgccgatggcagtactgcgcaagaagcaaataccttgttggaaaagtacggtccttcccaagacacccctgtagtgtcgtcgaaggcttaa

SEQ ID NO: 26531 - protein, 362 aa, Corynebacterium diphtheriae NCTC 13129
MSTTTAITSTLQRVTKAPEGRRMLRVEARNSQTPIESKPRWIRTAVKTGPEYQDMKKKVSGASLHTVCQEAGCPNIHECWESREATFLIGGANCSRRCDFCQINSAKPEPLDRDEPRRVAESVREMQLNYSTITGVTRDDLEDEGAWLYAEVVRKIHELNPHTGVENLTPDFSGKPDLLQEVFEARPEVFAHNLETVPRIFKRIRPAFRYERSLDVIRQARDFGLVTKSNLILGMGETVDEIRDALVDLHSAGCDIITITQYLRPGPMYHPIDRWVKPEEFIDHADFARELGFGAVMSGPLVRSSYRAGKLYAEALAARGESLPENLAHLATTADGSTAQEANTLLEKYGPSQDTPVVSSKA

SEQ ID NO: 26532 - DNA, 1200 bp, Danio rerio
  CDS (1)..(1200)
atggcgttgatcagtagaagttgtggagctgcgagccgatattcttcaagtcatctgtttttaccatctaaaggcgccgaggcggctaatgtgtactgtaacagactgagcactgctgccagcacatcatcatcatcatcaccatcaccatccacacacaatgacaggaagaaagacctgagggaggatggactgaacctgcaggacttcatatctggagagctgtcagaaaagagcaagtgggaggaatacagaggcaacctaaagagagaaaaaggagaaaggttaaggctaccaccatggctgaagacagagattcctatagggaaaaactacaacaaattgaagaatacacttagagaattaaacctccacacagtctgcgaagaagcccgttgtccaaatattggtgaatgttggggtggaggagagtacgccacggccacagccaccattatgttaatgggggacacatgcacacgtggctgtaggttttgttcagttaagacagcgagacgtcctccacctcttgaccccgatgagccatataacaccgctaaagccattgcagcatggggtctggactatgtagtactcacatcagtggaccgagatgacattcctgatggtggcgctgaacactttgcaaagactgtctccaacattaaagaaaggaactctaaaatcttggtagagtgtttgactcctgatttccgtggcgatctggcagcggtggagaaaattgctttgtctggccttgatgtttatgctcacaatgtagagacggtcagagaattacagaggcatgtacgtgacccccgggcaaactttgaccaatcactgagtgttttacgacatgctaaaaaggtgaaatccagtgtgctcacaaaaacttctatcatgctggggctcggagaaacagatgcacaaatacaagccactttaacagaattgagggactctggtgtggattgtctaaccctggggcagtacatgcaaccaaccaaacgccatcttaaggtggaagaatatgtcacccctgaaaagtttgcgttttgggagaaggttggccaggagatgggcttcatctacactgccagtggaccacttgtgcgctcgtcttataaagcaggggagttctttttgaagaatctgctggaaaagaggaagactgaagaaaccacagcaacagcagagtaa

SEQ ID NO: 26533 - protein, 399 aa, Danio rerio
MALISRSCGAASRYSSSHLFLPSKGAEAANVYCNRLSTAASTSSSSSPSPSTHNDRKKDLREDGLNLQDFISGELSEKSKWEEYRGNLKREKGERLRLPPWLKTEIPIGKNYNKLKNTLRELNLHTVCEEARCPNIGECWGGGEYATATATIMLMGDTCTRGCRFCSVKTARRPPPLDPDEPYNTAKAIAAWGLDYVVLTSVDRDDIPDGGAEHFAKTVSNIKERNSKILVECLTPDFRGDLAAVEKIALSGLDVYAHNVETVRELQRHVRDPRANFDQSLSVLRHAKKVKSSVLTKTSIMLGLGETDAQIQATLTELRDSGVDCLTLGQYMQPTKRHLKVEEYVTPEKFAFWEKVGQEMGFIYTASGPLVRSSYKAGEFFLKNLLEKRKTEETTATAE

SEQ ID NO: 26534 - DNA, 1110 bp, Eremothecium gossypii
  CDS (1)..(1110)
atgctgactaagggtgtgcgtgcgttggcatggtcgcccaggagatatatcactctggatgccgaagctgcgaagccggtggtcgccaagcggaggagaatgacggagttcactgacaaactcaacaaaggcccatcgttcgaggactttctcaccggcaaagccgcgcaaatgacgttggatccactggaggaggcgaggcagaacgcagaggagtcaaagaagcttcctgcgtggctcaaggtgccgattcccaagggcaagaactttcacaagttgaaggaggacgtgcgagatctgaagctcagtaccgtgtgcgaggaagcaaagtgcccgaacatcggtgagtgctggggcggcaacaagggcagtgccactgcaacgatcatgctgcttggggatacttgcacgcgggggtgccgcttctgctctgtgaaaacgaaccggacaccagcgaagcctgaccccaaggagccggagaacactgcagaggccatctcgcgctgggggcttggatatgttgtgctgacgatggtggacagggacgatctgcccgatggcggcgcacaccatcttgctgagacggtgcagcgcatcaagcaaaaggcgccacatattttggtggaaacacttgcgggagacttccggggcaacctagagatggtggatgtgatggcccgttcaggacttgacgtttacgcccacaatgtggagacggttgaggcgctaacgccacatgttcgagaccgcagggcgacttaccagcagtcgctcagtgtgttgaagagggcgaagcagacggttccaaccctagttacaaagacatctatcatgcttgggatgggcgagacagacgagcaggtgctacaaactatgaaggatctcagggctgtggactgtgatgtcgttacatttggccaatacatgcggccaaccagaagacatatgaaggtagttgaatacgttaaacccgagaagttcgactactggaaggagaaggccttggaacttggctttctgtactgtgcatctggtccactggtcagatcttcgtataaggccggcgaagcatacatagagaacgttctgcggaatcgacgccaagcatag

SEQ ID NO: 26535 - protein, 369 aa, Eremothecium gossypii
MLTKGVRALAWSPRRYITLDAEAAKPVVAKRRRMTEFTDKLNKGPSFEDFLTGKAAQMTLDPLEEARQNAEESKKLPAWLKVPIPKGKNFHKLKEDVRDLKLSTVCEEAKCPNIGECWGGNKGSATATIMLLGDTCTRGCRFCSVKTNRTPAKPDPKEPENTAEAISRWGLGYVVLTMVDRDDLPDGGAHHLAETVQRIKQKAPHILVETLAGDFRGNLEMVDVMARSGLDVYAHNVETVEALTPHVRDRRATYQQSLSVLKRAKQTVPTLVTKTSIMLGMGETDEQVLQTMKDLRAVDCDVVTFGQYMRPTRRHMKVVEYVKPEKFDYWKEKALELGFLYCASGPLVRSSYKAGEAYIENVLRNRRQA

SEQ ID NO: 26536 - DNA, 948 bp, Yersinia pestis biovar Medievalis str. 91001
  CDS (1)..(948): transl_table=11
atggaacgcggcgtaaaataccgtgatgcagacaaaatggcgttaatcccggtaaaaaacgtggtgaccgaacgtcaggagctgttgcgtaaacccgagtggctaaaaatcaagcttccgactgattccagccgcattcagggtatcaaagctgcaatgcgtaagaatggtctgcattcggtttgtgaagaggcctcctgccctaacctgtctgagtgctttaaccacggtacggcaacatttatgatccttggtgcaatttgtacccgccgttgcccattctgtgacgttgcccatggtcgcccagtcacaccggatgctaatgagccagagaagctggcacagacgatccaagacatgggtctgcgctatgttgttatcacgtccgttgaccgtgatgacctacgtgatggtggtgctcagcattttgccgattgtatttcagcgatccgcgccaagaatccaaccatcaaaattgaaacgttagtccctgatttccgtggtcgtatggatcgcgcactcgatattctgaccgcaaccccaccagatgtatttaaccataatttggaaaacgtaccacgtgtttatcggcaggttcgtccaggggcgaactacgattggtcactgaaattacttgagcgcttcaaagaagcacatccagatatcccaactaaatccggcttaatggtcggcttgggcgaaaccaatgccgagattgtcgaggtcatgcatgatttacgccgccacggggtcacgatgttgacgctggggcaatacttgcaaccaagccgccatcatttacccgtacaacgttatgtcagcccggccgagtttgacgaaatgaaagcagaagccatggctatgggctttacccatgcagcctgtggcccatttgttcgctcttcttaccatgcagacctgcaagcgaaaggtatggaagtgaagtaa

SEQ ID NO: 26537 - protein, 315 aa, Yersinia pestis biovar Medievalis str. 91001
MERGVKYRDADKMALIPVKNVVTERQELLRKPEWLKIKLPTDSSRIQGIKAAMRKNGLHSVCEEASCPNLSECFNHGTATFMILGAICTRRCPFCDVAHGRPVTPDANEPEKLAQTIQDMGLRYVVITSVDRDDLRDGGAQHFADCISAIRAKNPTIKIETLVPDFRGRMDRALDILTATPPDVFNHNLENVPRVYRQVRPGANYDWSLKLLERFKEAHPDIPTKSGLMVGLGETNAEIVEVMHDLRRHGVTMLTLGQYLQPSRHHLPVQRYVSPAEFDEMKAEAMAMGFTHAACGPFVRSSYHADLQAKGMEVK

SEQ ID NO: 26538 - DNA, 972 bp, Thermus thermophilus HB27
  CDS (1)..(972): transl_table=11
atgaagcctaagtttgagacggtggagctcctctcccccacgggggaggtcgttgagctcaaggtggtgaagcggggcctggcccaggcccggcccgagcccgtggaccggaacaagcccgcctggatcaaggcccctttgcccaccgggcccagataccaggccctgaaggccatggtgcgggagcttaggctccacaccgtctgccaggaggccctctgccccaacatcggggagtgctggacccacgggacccttacggtgatgatcctgggggacatctgcacccgggcctgcaagttctgcgccgtccacaccgggaaccccaagggcctcgtggacccggaggaaccaaggagggtggccgaggccatcgcccgcatgggggtgcggtacgtggtcttgaccagcgtggaccgggatgaccttccggatggcggcgcctcccacttcgccgccaccatccgggccatcaaggagagggcccccggggtcttggtggaggccctgacccccgacttccagggggacctgaaggccgtggagacggtcctcgccgcgaaccccgaggtctacgcccagaacctggagacggtgcgccgcctcacccccaaggtccgcgacccccgggcggggtacgagcagaccctgaaggttctcgcccacgccaagaaggtccggcccgacatcctcaccaagtctagcctcatgctgggcttgggggagacggaggaggagatcctcgaggccatgcgggacctcagggccgcgggggtggacatcctcaccttgggccagtacctgaggcccacccccgcccacctccccgtggcccgctacgtcccccccgaggacttcaagcggtacgaggcctgggggtacgagctgggctttagggaggtcttcgccgggcccttggtgcggagctcctaccgggcggaccgggtcttcctggaggccacccaaagatga

SEQ ID NO: 26539 - protein, 323 aa, Thermus thermophilus HB27
MKPKFETVELLSPTGEVVELKVVKRGLAQARPEPVDRNKPAWIKAPLPTGPRYQALKAMVRELRLHTVCQEALCPNIGECWTHGTLTVMILGDICTRACKFCAVHTGNPKGLVDPEEPRRVAEAIARMGVRYVVLTSVDRDDLPDGGASHFAATIRAIKERAPGVLVEALTPDFQGDLKAVETVLAANPEVYAQNLETVRRLTPKVRDPRAGYEQTLKVLAHAKKVRPDILTKSSLMLGLGETEEEILEAMRDLRAAGVDILTLGQYLRPTPAHLPVARYVPPEDFKRYEAWGYELGFREVFAGPLVRSSYRADRVFLEATQR

SEQ ID NO: 26540 - DNA, 972 bp, Parachlamydia sp. UWE25
  CDS (1)..(972): transl_table=11
gtgatggaaaactctccaaaaactcgtcgcttaaatatcctaccagataatcctgaaaatactggagatggtgtggtagggcttggccgctttccttcatggttgcaccggccacttcctaaaggaaaccaacttcaaattactgggcaagtcatcaaccaaaatcgcttacacactgtttgcgaagaggctaaatgtcccaatctcttagaatgttggactaaaaaaactgccacatttcttgtaatgggtaaagagtgttcacgtaactgtggtttttgtgatatagacttttcaaaaaatcctaaacccctagatcgaagtgaaccgtcgagagttgctttatctgtccaacagttaggattaaagcacgttgtaatcacaatggtagcacgagatgatttgtctgatggaggaagttctcatctcgtcgaggtcattgaggcgattaggcaaactaatgaagatgtaactattgaggtcttaacttcggattttgaaggaaatcgaaaggctctaagctttgttttacaagctaaacctgaaatttttaatcataatattgaaacagttcgccgtttaactccacgtgttagacataaagccacttatgaaagaactttaagtgtacttgaacaagctgcccaaaagaaatatcactcccaacttaaggttaaatcagggataatggtggggttaggtgagactgaagaagaaatttttgaaacattattagatttaaaaagggtaggatgtgaaattgtcaccattggacagtatttacaacctaatcggcaaaaactccttgtaaaatcttttgttcatcctgatatatttaaaaaatatgaacaatatggattgagtataggaatacctcatctttattgtggaccttttgttagatctagctataacgcaaatttagttcttatgcgtgcaaatcaaaaagaagcaattgttaacagcgaatag

SEQ ID NO: 26541 - protein, 323 aa, Parachlamydia sp. UWE25
MMENSPKTRRLNILPDNPENTGDGVVGLGRFPSWLHRPLPKGNQLQITGQVINQNRLHTVCEEAKCPNLLECWTKKTATFLVMGKECSRNCGFCDIDFSKNPKPLDRSEPSRVALSVQQLGLKHVVITMVARDDLSDGGSSHLVEVIEAIRQTNEDVTIEVLTSDFEGNRKALSFVLQAKPEIFNHNIETVRRLTPRVRHKATYERTLSVLEQAAQKKYHSQLKVKSGIMVGLGETEEEIFETLLDLKRVGCEIVTIGQYLQPNRQKLLVKSFVHPDIFKKYEQYGLSIGIPHLYCGPFVRSSYNANLVLMRANQKEAIVNSE

SEQ ID NO: 26542 - DNA, 897 bp, Desulfovibrio vulgaris subsp. vulgaris str. Hildenborough
  CDS (1)..(897): transl_table=11
atgtcctcacccgacaattcctcgccatctttacgcatcccgccgtggctgcgggtgaagctgccctgtagccacacctttgccgacacccgcgcactggtcgaagggctcgggctgaacaccgtatgcaacagcgccaagtgcccgaacatgttcgagtgcttctcgtcgggcacggccaccttcctcatcctcggcaacgtctgtacccgcaactgcgcgttctgcaacatcacgccgggccatgtgtccccgccagaccccgatgaaccccggcgcgtcgccgaggctgcggcacgactcgccctgcggcatgtggtcgtcacgtccgtgacgcgcgacgacctcgacgatggcggggcggcacacttcgccgccaccatcacacggcttcgcgcagcgttgcccgccgccacggtcgaagtcctcattcccgacttcaggggcgaccatgcagccttgcgcactgtcatggcggctgcaccgcatatcgtgaaccacaatgtggagaccccccccgcacactacgcccgcatccgcccgcaggccgactacaggcaaagcctcgaactgctgcgacgtgtgaaggctgcaggtggcgtggccaagagtggactcatggtcggccttggcgagaatgacacagaggtcgagggggttctcgccgacctcgccgattgcggctgtgacatcgtcaccatcgggcagtacatgcgcccttcgcgccagcatccccccgtcgaacgctacgtgcatcctgatactttcgaaagcttcgccgcgtgtggccggggcatgggcattcccttcgtgttctccgcaccgctggtgcgtagcagctacaacgccgaaagcgcctataacgccctgtgcaccctccgcacggaacctgcctga

SEQ ID NO: 26543 - protein, 298 aa, Desulfovibrio vulgaris subsp. vulgaris str. Hildenborough
MSSPDNSSPSLRIPPWLRVKLPCSHTFADTRALVEGLGLNTVCNSAKCPNMFECFSSGTATFLILGNVCTRNCAFCNITPGHVSPPDPDEPRRVAEAAARLALRHVVVTSVTRDDLDDGGAAHFAATITRLRAALPAATVEVLIPDFRGDHAALRTVMAAAPHIVNHNVETPPAHYARIRPQADYRQSLELLRRVKAAGGVAKSGLMVGLGENDTEVEGVLADLADCGCDIVTIGQYMRPSRQHPPVERYVHPDTFESFAACGRGMGIPFVFSAPLVRSSYNAESAYNALCTLRTEPA

SEQ ID NO: 26544 - DNA, 963 bp, Bartonella quintana str. Toulouse
  CDS (1)..(963): transl_table=11
atggttacggttgttgatagagttacgagtagacgtttgcgtcatcctgaaaagatgcatcgtccggatacaagcattcagaaaaaaccagattggattcgtgtgaaagcgccaacatcaaagatatataaggagacgtatgatattgtacgcgctcataaattagtgacggtatgtgaagaagcgggttgtccaaatgttggcgaatgttggagccagcggcatgccagttttatgattttgggtgaaatatgtacacgggcttgtgctttttgcaacgttgcaacaggtattccgcttgcagtcgatgataatgagccagaacgtgtggcggatgctgttgcacagatggaattaaaacatgttgtgattacatctgttgatcgtgatgaccttgctgatggtggtgcacaacattttgcaaaagttatttatgctattcgtcgaaaagctcccaagacaacaattgaagtcctcacacctgattttcgccataaggatggagctttagaaattgttgttgctgctaagcctgatgtctttaatcataatttggaaacagttccatctaaatatttaaaagttcgtccaggggcgcgttattttcattcgattcggctcttacaacgtgttaaggaacttgatccgacgatcttcacaaaatcaggaattatggttggacttggggaagaacgaaatgaaattcttcagttgatggatgatttacgctctgctgatgttgactttatgacaattgggcaatatttgcaacctacacgaaaacatcatccggttattcgtttttttcctcctgaagagtttgagtcttttgccaagattggtaaagtaaagggttttttgcatatggcttccaatcctctaacgcgttcatctcatcatgcaggggatgatttcgcaattttgcaaaaagcacgtgatgaaaaatttgctttacagagataa

SEQ ID NO: 26545 - protein, 320 aa, Bartonella quintana str. Toulouse
MVTVVDRVTSRRLRHPEKMHRPDTSIQKKPDWIRVKAPTSKIYKETYDIVRAHKLVTVCEEAGCPNVGECWSQRHASFMILGEICTRACAFCNVATGIPLAVDDNEPERVADAVAQMELKHVVITSVDRDDLADGGAQHFAKVIYAIRRKAPKTTIEVLTPDFRHKDGALEIVVAAKPDVFNHNLETVPSKYLKVRPGARYFHSIRLLQRVKELDPTIFTKSGIMVGLGEERNEILQLMDDLRSADVDFMTIGQYLQPTRKHHPVIRFFPPEEFESFAKIGKVKGFLHMASNPLTRSSHHAGDDFAILQKARDEKFALQR

SEQ ID NO: 26546 - DNA, 963 bp, Bartonella henselae str. Houston-1
  CDS (1)..(963): transl_table=11
atggttacggttgttgatagagttacagatagacgtttgcgtcaccctgaaaaggcacatcgtcctgatacaagtgttcaaaaaaaaccggattggattcgtgtaaaagcgccaacatcacaggtctataaggaaacgcatggtattgtacgtgctcataaattagtaaccgtatgtgaagaagcgggttgcccaaatattggtgaatgttggagccagcgtcatgccagttttatgattttgggtgaaatatgtacgcgggcatgtgcattttgcaacgttgcaacaggtataccatttgccgttgatgagaacgagccagaacgtgtggcagatgctgttgcacggatggaattaaaacatgttgtcattacatcagttgatcgtgatgatcttgctgatggtggtgctgagcattttgcgaaagtgatttatgcgattcgtcgaaaagctcctaaaacaacaattgaagttctcacacctgattttcgccataaggatggagctttagaaattgttgttgctgctaaacctgatgtttttaatcataatttagaaacggttccttctaaatatttaaaggttcgtccaggggcacgttattttcattcgattcggttattacaacgtgttaaagaactggatccgacaatctttacaaaatcaggaattatggttggtcttggagaagaacgaaatgaaattctccaattgatggatgatttacgctctgcagatgttgactttatgacaattgggcaatatttgcagcctacgcgaaagcatcatccagttattcgttttgtgcctcccgaagagtttgagtcttttgccaaaattggtaaagtgaaaggttttttacatatggcttccaatcctctgacgcgttcatctcatcatgcgggtgatgattttgcaattttgcaaaaagcgcgtgatgaaaaatttgctttacagagatag

SEQ ID NO: 26547 - protein, 320 aa, Bartonella henselae str. Houston-1
MVTVVDRVTDRRLRHPEKAHRPDTSVQKKPDWIRVKAPTSQVYKETHGIVRAHKLVTVCEEAGCPNIGECWSQRHASFMILGEICTRACAFCNVATGIPFAVDENEPERVADAVARMELKHVVITSVDRDDLADGGAEHFAKVIYAIRRKAPKTTIEVLTPDFRHKDGALEIVVAAKPDVFNHNLETVPSKYLKVRPGARYFHSIRLLQRVKELDPTIFTKSGIMVGLGEERNEILQLMDDLRSADVDFMTIGQYLQPTRKHHPVIRFVPPEEFESFAKIGKVKGFLHMASNPLTRSSHHAGDDFAILQKARDEKFALQR

SEQ ID NO: 26548 - DNA, 1032 bp, Acinetobacter sp. ADP1
  CDS (1)..(1032): transl_table=11
atggatttaaaaataaatgaccaacccgataaaaatatttatcttggtgaaaaactacgtgggcaggaaaagctcgagcgtattcctgttaaaattattcctagtactgaaatagcagaaaaaccagattggattcgtaccaaaatcagtgatcccaaagaaatcaaacgtattcagactttattacgtcaacaaaaattgcatacggtgtgcgaagaagctgcttgtcctaacttgccacaatgttttggaagtggcacagccacttttatgattatgggcgatatctgcactcggcgctgccctttttgcgatgtcgcacatggtcggcccaatacactcgacccattagaaccccaacatttagcagaagcagtatccaatcttcagcttcaatatgtggttatcacctcggtagatcgagatgatcttaaggatggaggagcgcagcattttgttgattgcataaaagcaattcgtgcaaccaatcctcatacattaatcgaaattttagtgcctgattttcgtggtcgactcgaaatagctttaaaaattctagccagctctccgcctgatgtttttaatcacaatatcgaaactgttccacgtttgtatcgcgccctgcgaccaggttctgattaccaacattcattaaagcttttacagcaatttaaaaaatattgtccagatgtcgtcaccaaatgtggtctgatggttggacttggtgaagtagaagctgaagtcattaccttactcaatgatctgcgcgatcatgatattgagctggtcaccattggacaatacttacaaccctccaaagcgcatgcacctgtacatcgatttgtttcaccaacagaatttgaacattatgaacagcatggcaaacgtctaggttttaaaaatatctggagtgcaccgctggttcgctccagttatcatgcagatcgtcaataccgaggcgaagctgtaccgaagccttttacacgagaagatttaaaacaactaaaacataccacatctgatattgcttaa

SEQ ID NO: 26549 - protein, 343 aa, Acinetobacter sp. ADP1
MDLKINDQPDKNIYLGEKLRGQEKLERIPVKIIPSTEIAEKPDWIRTKISDPKEIKRIQTLLRQQKLHTVCEEAACPNLPQCFGSGTATFMIMGDICTRRCPFCDVAHGRPNTLDPLEPQHLAEAVSNLQLQYVVITSVDRDDLKDGGAQHFVDCIKAIRATNPHTLIEILVPDFRGRLEIALKILASSPPDVFNHNIETVPRLYRALRPGSDYQHSLKLLQQFKKYCPDVVTKCGLMVGLGEVEAEVITLLNDLRDHDIELVTIGQYLQPSKAHAPVHRFVSPTEFEHYEQHGKRLGFKNIWSAPLVRSSYHADRQYRGEAVPKPFTREDLKQLKHTTSDIA

SEQ ID NO: 26550 - DNA, 966 bp, Erwinia carotovora subsp. atroseptica SCRI1043
  CDS (1)..(966): transl_table=11
atgagtaaaccgattcagatcgaacgtggtgtcaaataccgcgatgccgataagatggccctaattccggtacgtactgtcgttaccgaacgccaagagcttctgcgcaaacctgaatggatgaagattaaacttccggcggattcgagccgtattcagggaatcaaagcggcaatgcgcaaaaatgggttgcactcagtttgcgaagaagcgtcctgtccgaatctggccgagtgtttcaaccacggcaccgccacctttatgattctgggcgccatttgtacgcgtcgctgtccgttctgtgacgttgcccacggccgaccgcttacgccggatgccaacgaaccagagaaactggcacagactatccatgacatgggcttacgctatgtcgtgatcacctccgttgaccgtgatgacctgcgcgacggtggagctcaacactttgcggactgcattagcgccattcgtcgcaaaaacccgcatattcgtatcgaaacgctggtgccagacttccgtggtcgtatggatcgcgcgttggaaatattgaccgccacgccaccagacgtgttcaaccataatctggaaaacgtgccgcgtgtttaccgacaggtacgccctggcgcgaactatgaatggtccctgaagttgctggaaaacttcaagaacgcgcatcccgatatcacgaccaaatcaggcctgatggttggtctgggggaaaccaatgctgaaatcgtggaagtcatgcgcgatcttcgccgccacggtgtgacaatgctgacgctgggacaatatttacagccgagccgccatcatctgccggtacagcgctacgtcagcccagatgagttcgatgagatgaaagccgaagcgatggcgatgggctttacccatgccgcctgcggcccgtttgttcgctcgtcctaccatgccgacttacaggccaagggcatcgaagtaaaataa

SEQ ID NO: 26551 - protein, 321 aa, Erwinia carotovora subsp. atroseptica SCRI1043
MSKPIQIERGVKYRDADKMALIPVRTVVTERQELLRKPEWMKIKLPADSSRIQGIKAAMRKNGLHSVCEEASCPNLAECFNHGTATFMILGAICTRRCPFCDVAHGRPLTPDANEPEKLAQTIHDMGLRYVVITSVDRDDLRDGGAQHFADCISAIRRKNPHIRIETLVPDFRGRMDRALEILTATPPDVFNHNLENVPRVYRQVRPGANYEWSLKLLENFKNAHPDITTKSGLMVGLGETNAEIVEVMRDLRRHGVTMLTLGQYLQPSRHHLPVQRYVSPDEFDEMKAEAMAMGFTHAACGPFVRSSYHADLQAKGIEVK

SEQ ID NO: 26552 - DNA, 993 bp, Propionibacterium acnes KPA171202
  CDS (1)..(993): transl_table=11
gtgagtgtcgaagcagacggtagaaagctcctccgagtcgaggtcaagaattctcagacgcccatcgagaacaaaccccactggatcaagactcgggccacaatgggtccggagtaccgcgacatgcgtcgccgaatgatcgacggagatctgcacaccgtgtgtcaagaggctggctgccccaatattttcgagtgttgggaggatcgcgaggccactttcctcatcggcggcgaccactgcacccgccgttgtgacttctgccagatcgagtcggccaagccggaaggctacgacaaagacgagccgcgtcgcgtcgcagagtccgtcaagcagatggggctgcgctacgctaccgttacgtcggtatgccgagacgacctcgaggacgaaggtgcctggctgtgcgccgagacgattcgtcaaatccaccaggtaactcccggcgtcggcgtcgagatgttagcccaagatttttccggcaaacaggacctgctcgacatcgtcttcgaagcacgcccggaggtcttcggtcacaaccttgagacggtcccccgcatcttcaagcgcattcgacccggattccgctacgaccgttctttggccgtcctggactctgcacatgaggccggtctgatcaccaagtcaaatctcattcttggcatgggcgagacccgtgaagaaatttcacaggccatgcgggcgctccatgacgccaacaccgacctgctgacgatcacccagtacctgcgcccgaactcctacctacaccccatcgaccgttgggtgacgcctcaggagttcgatgagttagccgaagaggcccgcgaaattggatttgtcggtgtgatgagcggaccgcttgtgcgatcctcctaccgggctggccgcctctatcggcaagctatggaagcacgcggcgagcgtccggtgatgatcgtgaccgggtaccgcgacggtgcgaaacctgcaccattcgcggccaaggagtga

SEQ ID NO: 26553 - protein, 330 aa, Propionibacterium acnes KPA171202
MSVEADGRKLLRVEVKNSQTPIENKPHWIKTRATMGPEYRDMRRRMIDGDLHTVCQEAGCPNIFECWEDREATFLIGGDHCTRRCDFCQIESAKPEGYDKDEPRRVAESVKQMGLRYATVTSVCRDDLEDEGAWLCAETIRQIHQVTPGVGVEMLAQDFSGKQDLLDIVFEARPEVFGHNLETVPRIFKRIRPGFRYDRSLAVLDSAHEAGLITKSNLILGMGETREEISQAMRALHDANTDLLTITQYLRPNSYLHPIDRWVTPQEFDELAEEAREIGFVGVMSGPLVRSSYRAGRLYRQAMEARGERPVMIVTGYRDGAKPAPFAAKE

SEQ ID NO: 26554 - DNA, 900 bp, Desulfotalea psychrophila LSv54
  CDS (1)..(900): transl_table=11
atggcttgttcccatcagaagaatgagcagatgcgcgttggtaaaccaaaatggcttcgtcgcagtctgcctaccggtcctgaatacgaaaaaatcagaacattgctcaagggcagtggtttgaccaccgtatgtcaggaggcgcagtgccccaatcaatttgaatgttactccaagggaacggcaacatttatgattatgggcgatcactgtacccgtaactgccgtttttgtgccgtggcccatggacccaaggccctgcccgatgaggatgaggcagagcgggtggcggatgcggtctctctcttgggcctgcgctatgccgttatcacctcggtgacccgggatgatctggccgatggtggagcatcctgttttgtcagggtcatagaggccatccgcaagaaaaaccccaagaccttgattgaggtgctgattcccgatcttgccggtaattggggggccctgcagactattctcgatgctcgtcccgatgtccttaaccacaatattgaaacagtgccccgactctactccgtagcccgtcctggtgctgagtatagacgttctctggaactcctgcgggaggtacgtcgtcgtgcccctcagatggtgactaagacgggtatgatgttgggccttggtgaagagacagaagagctctatgccacctggcaggacctgcgtgagtccgactgtgatatccttaccatgggccagtacctgcaacccacggtggatcatctgctggtgcaacgttttgttgagccgacagagtttgatcgtctgggcgatgtggctctggcaaaagattttctggctgtggcttccggcccctttgtccgtagctcctatgaggcggagaaactttttcgtaaggccgagctggcccgaaaatag

SEQ ID NO: 26555 - protein, 299 aa, Desulfotalea psychrophila LSv54
MACSHQKNEQMRVGKPKWLRRSLPTGPEYEKIRTLLKGSGLTTVCQEAQCPNQFECYSKGTATFMIMGDHCTRNCRFCAVAHGPKALPDEDEAERVADAVSLLGLRYAVITSVTRDDLADGGASCFVRVIEAIRKKNPKTLIEVLIPDLAGNWGALQTILDARPDVLNHNIETVPRLYSVARPGAEYRRSLELLREVRRRAPQMVTKTGMMLGLGEETEELYATWQDLRESDCDILTMGQYLQPTVDHLLVQRFVEPTEFDRLGDVALAKDFLAVASGPFVRSSYEAEKLFRKAELARK

SEQ ID NO: 26556 - DNA, 894 bp, Rickettsia typhi str. Wilmington
  CDS (1)..(894): transl_table=11
atgactaatgtaaacagaagaccagattggataaaagtaaaagctcctaattctgcagagtattataatacaaaagatttaataaagaatttgagattaaatactgtgtgtgaagaagctgcttgtcctaatattggtgagtgttggtcgaggaaacatgccaccgtgatgattttaggttcagtttgtactagagcttgtagattttgtaatgtcaaaacgggtagaccggatttacttgatccacacgaaccgcgaaggttagcagaagcagtacaaaagttaaatttgaatcatgtagtaattacttctgttgatcgtgatgatcttgaagacggtggagcttcacattttgctgagtgtattaatgaaattagaaggtcatcaccaaatactactatagagattcttacacctgattttttaagaaaagcaggagcagtcgaagtaatagcaaattcaaagcctgatgtttttaatcataatgtcgaaacagtaccatctttatataaaacgattagacctggagctaggtattataattctttaagcttacttcacaatattaaaaaattatctcctgaaatttttacaaaatctggtatgatggtagggcttggtgaagaaataaatgaagtagtgcaggttatggatgatttaagagaagcaaatgttgattttttaactattgggcagtatcttcaacctactaaaagtcatgctgaggtcataaaatacgttactcctgaagaatttaaatatttagagcgaatagcaaaaacaaaaggattcttaatggtgtctgcaactccgttaacacgttcttcataccatgcagataaggattttcaaaaattaaaagagaattataatataaggcttgcatcaatgtaa

SEQ ID NO: 26557 - protein, 297 aa, Rickettsia typhi str. Wilmington
MTNVNRRPDWIKVKAPNSAEYYNTKDLIKNLRLNTVCEEAACPNIGECWSRKHATVMILGSVCTRACRFCNVKTGRPDLLDPHEPRRLAEAVQKLNLNHVVITSVDRDDLEDGGASHFAECINEIRRSSPNTTIEILTPDFLRKAGAVEVIANSKPDVFNHNVETVPSLYKTIRPGARYYNSLSLLHNIKKLSPEIFTKSGMMVGLGEEINEVVQVMDDLREANVDFLTIGQYLQPTKSHAEVIKYVTPEEFKYLERIAKTKGFLMVSATPLTRSSYHADKDFQKLKENYNIRLASM

SEQ ID NO: 26558 - DNA, 963 bp, Symbiobacterium thermophilum IAM 14863
  CDS (1)..(963): transl_table=11
atggccgagttccggatcgaccccgagatggagctgcccgtcctgcccagccgcgcccgggcggacgtgagccggaaacccgagtggctgaagatcaacctgcgtacggatgcggagttcgtcgagctgaagcggctgatgcgcggccaggggctgcacacggtctgcgaggaggcccgctgccccaacatcttcgagtgctggaaccggcggacggcgacgttcatgatcctgggcgacatctgcacccgcaactgcgggttctgcgccgtgcggtcgggcgtgcccaccgggctggacctggcggagcctgaacgggtggcggacgcctgcgtgcagctgggcctgcggcacgtggtggtcacctcggtggcccgggacgacctgagcgacggcggtgcgtccatcttcgccgagaccatccgggccatccggcgcaagaaccccttcaccggcgtggaggtgctcatccccgacttcggcggcaactgggacgccctggccgtcgtcatggacgcggagcccgacgtcctcaaccacaacatcgagacggtgcgccggctttcggaccgggtgcggtcccgggcgaagtacgaccggtcgctggagctgctccgccgggcgaaggagatgaagccccacgtcagcacgaagtcctcgatcatggtcggcctgggcgagaccatgcaggagctgtacgaggcgatggacgacctgcgcgcggcgggcgtcgacatcgtgaccttcggccagtacctgcggcccacggcccgccatctggcggtggagaagttctacaccccggccgagttcgaacacctgcgggaggaggccctgaagcgggggttcgcccattgcgagtcgggtcccctggtacgttcctcctaccacgccgacgagcagtcggcgcaggccgtcgcccggcgcacgggtgccgggcgcgcggcgcagaccggggactga

SEQ ID NO: 26559 - protein, 320 aa, Symbiobacterium thermophilum IAM 14863
MAEFRIDPEMELPVLPSRARADVSRKPEWLKINLRTDAEFVELKRLMRGQGLHTVCEEARCPNIFECWNRRTATFMILGDICTRNCGFCAVRSGVPTGLDLAEPERVADACVQLGLRHVVVTSVARDDLSDGGASIFAETIRAIRRKNPFTGVEVLIPDFGGNWDALAVVMDAEPDVLNHNIETVRRLSDRVRSRAKYDRSLELLRRAKEMKPHVSTKSSIMVGLGETMQELYEAMDDLRAAGVDIVTFGQYLRPTARHLAVEKFYTPAEFEHLREEALKRGFAHCESGPLVRSSYHADEQSAQAVARRTGAGRAAQTGD

SEQ ID NO: 26560 - DNA, 897 bp, Bacillus licheniformis ATCC 14580
  CDS (1)..(897): transl_table=11
ttggcaaagaaagacgagcacctaagaaagcccgaatggcttaaaatcaagctgaacacgaatgaaaactatacgggcttaaaaaaattaatgcgggaaaacaacctccatacggtctgcgaagaggcaaaatgcccgaacatccacgaatgctgggccgtcagacgtaccgcgacctttatgattctcggatctgtctgtacgagagcctgccgcttctgtgcggtgaagacggggctgccgacagagcttgacttgaatgagccggaaagagtcgcagattctgtgagcatcatgaacctgaaacacgcggtcattacagccgttgcccgtgacgatttaaaagacggaggagcgggggtattcgccgaaaccgtacgcgccgtccggagaaaaagcccatttacaacaatcgaagttctgccgtccgatatgggcggagactataataatttgaaaacgctgatggatacgcgtccggacattttaaaccataatattgaaacggtccgccgcctgacgccgagagtccgtgcgagagctacatatgaaagatcattggaatttttgcgccgcgccaaagagatgcagccggacatcccgacgaaatccagcatcatgatcggtcttggcgaaacaaaagaagaaatcatcgaaacaatggacgaccttcttgcgaacaacgtcgacatcatggcaatcggccagtatctgcagccgtccaaaaaacacattaaagtacagaaatattaccatcctgacgagtttgccgaactgaaagaaatcgccatggaaaagggcttcagccactgtgaagcaggaccgctcgtccgttcttcataccatgccgacgaacaggtgaatgaagcgtctaaaaaacgccaggcgcaggcataa

SEQ ID NO: 26561 - protein, 298 aa, Bacillus licheniformis ATCC 14580
MAKKDEHLRKPEWLKIKLNTNENYTGLKKLMRENNLHTVCEEAKCPNIHECWAVRRTATFMILGSVCTRACRFCAVKTGLPTELDLNEPERVADSVSIMNLKHAVITAVARDDLKDGGAGVFAETVRAVRRKSPFTTIEVLPSDMGGDYNNLKTLMDTRPDILNHNIETVRRLTPRVRARATYERSLEFLRRAKEMQPDIPTKSSIMIGLGETKEEIIETMDDLLANNVDIMAIGQYLQPSKKHIKVQKYYHPDEFAELKEIAMEKGFSHCEAGPLVRSSYHADEQVNEASKKRQAQA

SEQ ID NO: 26562 - DNA, 897 bp, Bacillus cereus E33L
  CDS (1)..(897): transl_table=11
atgacaaaacaaacagaatataagcgcaagcccgaatggttgaaaattaagttaaacacgaatgaaaactatacaggcttaaagaaaatgatgcgttctaagaatcttcatacagtttgtgaagaagcgaaatgtccgaatattcatgaatgctgggctgtaagaaaaacagcaacatttatgattttaggagcagtatgtacacgtgcttgtcgtttttgtgcggttaaaacaggcttaccaacagagcttgatttacaagagccagaacgcgtagcagattctgtagtacaaatgggcttaaagcacgttgttataacagcggttgcacgtgatgatttaaaagacgggggagcagctgtttttgctgaaacagtacgcgctgttcgtcgtaaaaatccatttacgtcaatcgaagtattaccatctgatatgggtggagtagaagaaaacttaaaaatgttaatggatgcaaaaccagatattttaaaccataacattgaaacagtacgtcgattatctgaccgagttcgcgctagagcaaaatatgatcgttcattagagtttttacgtcgagcgaaagaaatgcagcctgatattccaactaaatcgagcattatggtgggcttaggtgaaacgagagaagatttaattgaagcaatggatgacttacgtgcaaacaatgtggatattttaactcttggacaatacctacaaccatctaagaagcatttaccagttcttaaatattacccaccagcagaatttgcagaacttaaagaaattgcacttagcaaaggatttagccactgtgaagctggcccacttgtgcgttcttcttatcatgcggacgagcaagttcgttctgcaaaagaaaacacagcagaagcaaaataa

SEQ ID NO: 26563 - protein, 298 aa, Bacillus cereus E33L
MTKQTEYKRKPEWLKIKLNTNENYTGLKKMMRSKNLHTVCEEAKCPNIHECWAVRKTATFMILGAVCTRACRFCAVKTGLPTELDLQEPERVADSVVQMGLKHVVITAVARDDLKDGGAAVFAETVRAVRRKNPFTSIEVLPSDMGGVEENLKMLMDAKPDILNHNIETVRRLSDRVRARAKYDRSLEFLRRAKEMQPDIPTKSSIMVGLGETREDLIEAMDDLRANNVDILTLGQYLQPSKKHLPVLKYYPPAEFAELKEIALSKGFSHCEAGPLVRSSYHADEQVRSAKENTAEAK

SEQ ID NO: 26564 - DNA, 963 bp, Mannheimia succiniciproducens MBEL55E
  CDS (1)..(963): transl_table=11
gtgagtaccgcatttaaaatggaacgaggggtaaaataccgcgatgcagcgaaaacctcgatcattcaagttaaaaatattgatcccgaccaggagttactgcaaaaaccttcctggatgaagataaaacttcccgccaattcggctaaaatccaaagtattaaaaacggtatgcgtcgtcacgggttaaattccgtttgtgaagaagcttcatgccctaatttgcacgaatgttttaatcatggcacggcgacatttatgatcctcggggcaatttgtacgcgccgttgcccgttctgtgacgttgcgcacggtaaaccgttgccgccggatcctgaagaaccgaaaaaattagcggaaactattcaggatatgaaattgaaatatgtggtgattacttccgttgaccgcgacgacttgcctgatcgcggtgcggggcattttgccgaatgtatcaaggaaatccgcaaaattaacccgaatacccaaattgaaattttggtgcctgatttccgcggacgtattgaacaggcgttggataaattaaaagacaatccgccggatgtgtttaatcataatctggaaaatgtacctcgtttgtatcgcgatattcgtccgggtgcggattatcaatggtcgctgaaattattacgtgaatttaaagcattattcccgcatattccaaccaaatcaggcttaatggtaggattgggcgagacaaacgaagaaattttaaacgtgatgcaagacctgagaaataacggggtaaccatgctgaccttagggcaatatttgcagccaagccgtttccatttaccggtcgcccgttatgtgccgcctgaagaatttgacgaattccgcaccaaagcagaagtcatgggctttgaacacgcagcctgcggtccgtttgtgcgttcttcttaccatgcggatttacaagccagcggcggattggtgaagtaa

SEQ ID NO: 26565 - protein, 320 aa, Mannheimia succiniciproducens MBEL55E
MSTAFKMERGVKYRDAAKTSIIQVKNIDPDQELLQKPSWMKIKLPANSAKIQSIKNGMRRHGLNSVCEEASCPNLHECFNHGTATFMILGAICTRRCPFCDVAHGKPLPPDPEEPKKLAETIQDMKLKYVVITSVDRDDLPDRGAGHFAECIKEIRKINPNTQIEILVPDFRGRIEQALDKLKDNPPDVFNHNLENVPRLYRDIRPGADYQWSLKLLREFKALFPHIPTKSGLMVGLGETNEEILNVMQDLRNNGVTMLTLGQYLQPSRFHLPVARYVPPEEFDEFRTKAEVMGFEHAACGPFVRSSYHADLQASGGLVK

SEQ ID NO: 26566 - DNA, 912 bp, Bacillus licheniformis ATCC 14580
  CDS (1)..(912): transl_table=11
atggagatgatggaattggcaaagaaagacgagcacctaagaaagcccgaatggcttaaaatcaagctgaacacgaatgaaaactatacgggcttaaaaaaattaatgcgggaaaacaacctccatacggtctgcgaagaggcaaaatgcccgaacatccacgaatgctgggccgtcagacgtaccgcgacctttatgattctcggatctgtctgtacgagagcctgccgcttctgtgcggtgaagacggggctgccgacagagcttgacttgaatgagccggaaagagtcgcagattctgtgagcatcatgaacctgaaacacgcggtcattacagccgttgcccgtgacgatttaaaagacggaggagcgggggtattcgccgaaaccgtacgcgccgtccggagaaaaagcccatttacaacaatcgaagttctgccgtccgatatgggcggagactataataatttgaaaacgctgatggatacgcgtccggacattttaaaccataatattgaaacggtccgccgcctgacgccgagagtccgtgcgagagctacatatgaaagatcattggaatttttgcgccgcgccaaagagatgcagccggacatcccgacgaaatccagcatcatgatcggtcttggcgaaacaaaagaagaaatcatcgaaacaatggacgaccttcttgcgaacaacgtcgacatcatggcaatcggccagtatctgcagccgtccaaaaaacacattaaagtacagaaatattaccatcctgacgagtttgccgaactgaaagaaatcgccatggaaaagggcttcagccactgtgaagcaggaccgctcgtccgttcttcataccatgccgacgaacaggtgaatgaagcgtctaaaaaacgccaggcgcaggcataa

SEQ ID NO: 26567 - protein, 303 aa, Bacillus licheniformis ATCC 14580
MEMMELAKKDEHLRKPEWLKIKLNTNENYTGLKKLMRENNLHTVCEEAKCPNIHECWAVRRTATFMILGSVCTRACRFCAVKTGLPTELDLNEPERVADSVSIMNLKHAVITAVARDDLKDGGAGVFAETVRAVRRKSPFTTIEVLPSDMGGDYNNLKTLMDTRPDILNHNIETVRRLTPRVRARATYERSLEFLRRAKEMQPDIPTKSSIMIGLGETKEEIIETMDDLLANNVDIMAIGQYLQPSKKHIKVQKYYHPDEFAELKEIAMEKGFSHCEAGPLVRSSYHADEQVNEASKKRQAQA

SEQ ID NO: 26568 - DNA, 990 bp, Legionella pneumophila subsp. pneumophila str. Philadelphia 1
  CDS (1)..(990): transl_table=11
atgggcaaattgatcgatattccaatcgttgtggaaagtggacaaaaatataagacatctcagggtgtgacagctattaaagatggaataaaatcatcaggtcaagatcatgagcgattgccaaaaccgaagtggcttcgtatagtcaatcatacaactccagcctatagccaagttaaagagcaagtgcaaaaacatcgtttggcaacagtttgtgaagaagcgaaatgccccaacatctcagaatgttggtctcatggaactgcaactattatgttaatgggagcagtatgtacccgggcttgccgattttgttctgtggatacaggaaatccgcatggttggcttgatgcagaagaacctgagaataccgcagaaactgtggccttaatgaatctggattatgtggttttaacctcagttaaccgtgatgatttacctgatgggggggcgaatcattatgccaaaaccattagagcaatcaaaaaacgatctccccgaaccaaagtcgaagcgctaacccccgattttcaaggaagtgaaagagatgttgctgtattgttagatagtggcgttgatgtgtttgcgcaaaatgtagaaacggttgagcgcctgacacacccggtaagagataatcgagcgggttatcagcaaaccttgaatgtactggcttttgctaagaaatatcgaccggatgttctgaccaaaaccagtttgatgttgggtttgggtgaaaccgatgaggaaattatacagactatggatgaccttcgaactcatcacgtggatattttgactttgggacaatatttgcaaccaactaaaaatcatttacctatagcacgttacgtaactcctgaaactttttctgaattaaggcaaattggtctaaaaaagggcttttttgaagtggcttcaggcccattagttcgatcaagctatagggctgaccgagtgttcaaacgggataatttagggcttgatgtttga

SEQ ID NO: 26569 - protein, 329 aa, Legionella pneumophila subsp. pneumophila str. Philadelphia 1
MGKLIDIPIVVESGQKYKTSQGVTAIKDGIKSSGQDHERLPKPKWLRIVNHTTPAYSQVKEQVQKHRLATVCEEAKCPNISECWSHGTATIMLMGAVCTRACRFCSVDTGNPHGWLDAEEPENTAETVALMNLDYVVLTSVNRDDLPDGGANHYAKTIRAIKKRSPRTKVEALTPDFQGSERDVAVLLDSGVDVFAQNVETVERLTHPVRDNRAGYQQTLNVLAFAKKYRPDVLTKTSLMLGLGETDEEIIQTMDDLRTHHVDILTLGQYLQPTKNHLPIARYVTPETFSELRQIGLKKGFFEVASGPLVRSSYRADRVFKRDNLGLDV

SEQ ID NO: 26570 - DNA, 867 bp, Bacteroides fragilis YCH46
  CDS (1)..(867): transl_table=11
atgggaaacgataaacgggtgcgcaaacccgaatggcttaaaatcagcattggagccaatgaacgctataccgagaccaaacgcattgtcgaatcgcactgcctgcacaccatctgtagcagtgggcgttgccccaacatgggcgaatgctggggaaaagggacagctacgttcatgattgccggtgacatctgtacccgcagttgtaaattctgtaatacccagaccggacgacctctgcctttggatcccgacgaaccggcccacgttgcagaatcgattgccctgatgaaactctcacacgcagttatcacatctgtagaccgcgatgatctgcctgatttgggtgcagcccattgggcacaaacaattcgtgaaatcaaacgactaaatccggaaacaactaccgaagtactgattcccgatttccaaggacgcaaagagcttattgaccaagtgataaaagcctgtcccgaaatcatctcccataacatggagactgtgaaacgcatcagtccacaggtgcgtagtgccgccaactatcacaccagcctggaagtgatccgccaaatagccgaaagcggtattacggcaaaatcgggcattatggttggtctgggtgaaactcctgctgaagtagaagagttaatggacgacctgatttccgtcggttgcaaaatcctcaccatcgggcaatatctgcagccaacccacaaacacttcccggttgcagcatacattactccggaacagtttgctgtttataaagaaacaggactgaagaaagggttcgaacaagtggaaagcgcaccattagtacgctcctcgtatcatgcagaaaaacatatccgatttaataataagtag

SEQ ID NO: 26571 - protein, 288 aa, Bacteroides fragilis YCH46
MGNDKRVRKPEWLKISIGANERYTETKRIVESHCLHTICSSGRCPNMGECWGKGTATFMIAGDICTRSCKFCNTQTGRPLPLDPDEPAHVAESIALMKLSHAVITSVDRDDLPDLGAAHWAQTIREIKRLNPETTTEVLIPDFQGRKELIDQVIKACPEIISHNMETVKRISPQVRSAANYHTSLEVIRQIAESGITAKSGIMVGLGETPAEVEELMDDLISVGCKILTIGQYLQPTHKHFPVAAYITPEQFAVYKETGLKKGFEQVESAPLVRSSYHAEKHIRFNNK

SEQ ID NO: 26572 - DNA, 990 bp, Burkholderia mallei ATCC 23344
  CDS (1)..(990): transl_table=11
atgactgaccttaccgctacccccgcacccgccgaaccggccgcttccgcctacgatccgaccgccaagcagaaggcgcaggcgaagaccgcgcgcattccgatcaagatcgtcccgatcgagaagctgaagaagcccgaatggatccgcgtgaaggcggccaccagcagctcgcgcttcaacgagatcaagacgatcctgcgcgagcacaacctgcatacggtgtgcgaggaagcgagctgcccgaacatcggcgaatgcttcggcaagggcaccgcgacgttcatgatcatgggcgacaagtgcacgcgccgctgcccgttctgcgacgtcggccacggccggcccgatccgctcgacgcagacgagccgaagaacctcgcgcgcacgatcgcggcgctcaagctcaagtacgtggtgatcacgagcgtcgaccgcgacgatctgcgcgacggcggcgccggccacttcgtcgagtgcatccgcgaagtgcgcgagcagtcgcccgcgacgcgcatcgagatcctgacgccggacttccgtggccgcctcgaccgtgcgctcgcgatcctgaacgcggcgccgcccgacgtgatgaaccacaatctcgaaacggtgccgcgcctgtacaaggaggcgcgccccggctcggactatgcgcattcgctgaagctcctgaaggatttcaaggcgctgcatccggacgtcgcgacgaaatcgggcctgatggtcggcctgggcgagacgaccgacgagatcctgcaggtgatgcgcgacctgcgcgcgcacgacgtcgacatgctgacgatcggccaatacctgcagccgtccgagcaccatctgccggtgcgcgagtacgtgcatccggacacgttcaagatgtacgaggaagaggcgtacaagatgggcttcacgcacgcggccgtcggcgcgatggtgcgctcgagctatcacgccgatctgcaggcgcacggcgccggggtggtttga

SEQ ID NO: 26573 - protein, 329 aa, Burkholderia mallei ATCC 23344
MTDLTATPAPAEPAASAYDPTAKQKAQAKTARIPIKIVPIEKLKKPEWIRVKAATSSSRFNEIKTILREHNLHTVCEEASCPNIGECFGKGTATFMIMGDKCTRRCPFCDVGHGRPDPLDADEPKNLARTIAALKLKYVVITSVDRDDLRDGGAGHFVECIREVREQSPATRIEILTPDFRGRLDRALAILNAAPPDVMNHNLETVPRLYKEARPGSDYAHSLKLLKDFKALHPDVATKSGLMVGLGETTDEILQVMRDLRAHDVDMLTIGQYLQPSEHHLPVREYVHPDTFKMYEEEAYKMGFTHAAVGAMVRSSYHADLQAHGAGVV

SEQ ID NO: 26574 - DNA, 969 bp, Methylococcus capsulatus str. Bath
  CDS (1)..(969): transl_table=11
atgaaaaccctggatgaaaatcaggcgccgtcgcgccagacgccggagtcccatcggcggggcgcggaaaaactctcgcgcatccccgtcaaggtcgaacccggcgcgcctctacgcaagcccgactggattcgggtccgggccgggtcgggcgacgaagttcggcgcgtgaagcggctgctgcgcgagcgcggtctgcacagcgtctgcgaagaagcggcctgtcccaatctggcggaatgtttcggccacggcaccgccaccttcatgatcctcggcgacatctgcacccgccgctgccccttctgcgacgtcgcccacggccgcccggcgccgcccgacccggccgaacccgagcgtctcgcggaaaccatcgccctgctgagactgcgctacgtggtgatcacctcggtcgaccgggacgatctgcgcgacggcggcgcggcccatttcgccgcctgcatccgggccttgcgcacacgctcccccgcgctgtccgtcgagattctgaccccggatttccgtggacggatggagattgccctcgatttgctcgccgccgatccgccggacgtgttcaaccacaacatcgaaaccgtgccccgcctgtaccgccaggcgcggcccggcgccgactaccgccagtcgctggagctcctggcgcggttccgcgacaaggtgccgggcgtgccgaccaagtcggggctgatgctcggcctgggcgagaccctggacgaggtgcgcgaggcgctgcgcgatctccgcggccatggctgcgagatgctcacgctgggacagtatttgcagcccagtcgggaccacctgcccgtggtgcgctacgttccgccggcggaatttgatgaactcgcggggtatgcgcgggagctgggattcgccagcgtcgccagcgctcccctggtgcgttcgtcgtatcatgccgaccagcaggccgcgatcatcggacgctga

SEQ ID NO: 26575 - protein, 322 aa, Methylococcus capsulatus str. Bath
MKTLDENQAPSRQTPESHRRGAEKLSRIPVKVEPGAPLRKPDWIRVRAGSGDEVRRVKRLLRERGLHSVCEEAACPNLAECFGHGTATFMILGDICTRRCPFCDVAHGRPAPPDPAEPERLAETIALLRLRYVVITSVDRDDLRDGGAAHFAACIRALRTRSPALSVEILTPDFRGRMEIALDLLAADPPDVFNHNIETVPRLYRQARPGADYRQSLELLARFRDKVPGVPTKSGLMLGLGETLDEVREALRDLRGHGCEMLTLGQYLQPSRDHLPVVRYVPPAEFDELAGYARELGFASVASAPLVRSSYHADQQAAIIGR

SEQ ID NO: 26576 - DNA, 1059 bp, Nocardia farcinica IFM 10152
  CDS (1)..(1059): transl_table=11
gtgacctcagtcgacaccccgacaccgcacggcggcacccccgccccggcccccgccaccgcgaacggccgcaagctcctgcgcatcgaggcgcgcaacgcgcagaccccgatcgagcgcaaacccaagtggatccgcacgcgcgccaccatgggcccggagtactccgagctcaagggcttggtcaaacgcgaaggcctgcacaccgtctgcgaggaagcgggctgccccaacatcttcgaatgctgggaagaccgcgaggcgacgttcctcatcggcggcgagcagtgcacccggcgctgcgatttctgccagatcgacaccggcaaaccggccgccctcgaccgtgacgagccccgccgcgtcgccgagtccgtccaggcgatggggctgcgctactccaccatcaccggcgtcgcccgcgacgacctggaggacggcggcgcctggctctacgccgagaccgtgcgtgccatcaagcgcctcaaccccgccaccggtgtcgagctgctcatccccgacttcaacgccgatcccgaccagctcgccgaggtgttctccgcccgccccgaggtgctcgcgcacaatctcgagacggtgccgcgcatcttcaagcgcatccgccccgccttccgctacgagcgctcgctctcggtgctcaccgccgcccgcgaggcgggcctggtcaccaagtcgaacctgatcctcggcatgggcgagacccccgaagaggtcaccgaggcgatgcgcgacctgcacgaggcggggtgcgacatcctcaccatcacccagtacctgcgcccgtcgccccggcaccaccccgtcgaccgctgggtcaagccggaggagttcgtcgagcactcccgcgtcgccgaggagatcggtttcgccggcgtcatggcgggcccgctggtgcgctcctcctaccgcgccggccgtctctacgcccaggcgatggcgcaccacggccgtgagatcccgcccgcgatggcacatctcgcggaggaaggcacggcctcgcaggaagcctcggcggtactggcccggttcggtagctga

SEQ ID NO: 26577 - protein, 352 aa, Nocardia farcinica IFM 10152
MTSVDTPTPHGGTPAPAPATANGRKLLRIEARNAQTPIERKPKWIRTRATMGPEYSELKGLVKREGLHTVCEEAGCPNIFECWEDREATFLIGGEQCTRRCDFCQIDTGKPAALDRDEPRRVAESVQAMGLRYSTITGVARDDLEDGGAWLYAETVRAIKRLNPATGVELLIPDFNADPDQLAEVFSARPEVLAHNLETVPRIFKRIRPAFRYERSLSVLTAAREAGLVTKSNLILGMGETPEEVTEAMRDLHEAGCDILTITQYLRPSPRHHPVDRWVKPEEFVEHSRVAEEIGFAGVMAGPLVRSSYRAGRLYAQAMAHHGREIPPAMAHLAEEGTASQEASAVLARFGS

SEQ ID NO: 26578 - DNA, 990 bp, Legionella pneumophila str. Lens
  CDS (1)..(990): transl_table=11
atgggcaaattgatcgatattccaatcgttgtggaaagtggacaaaaatataagacatctcaaggtgtgacagctattaaagatggaataaaatcatcaggtcaagatcatgagcgattgccaaaaccgaagtggctccgtatagtcaatcatacaactccagcctatagccaagttaaagagcaagtgcaaaaacatcgtttggcaacagtttgtgaagaagcgaaatgccccaacatctcagaatgttggtctcatgggactgcaactattatgttaatgggagcagtatgtacccgggcttgccgattttgttctgttgatacaggaaatccgcatggttggcttgatgcagaagaacctgagaataccgcggaaactgtagctttaatgaatctggattatgtggttttaacttcagttaaccgtgatgatttacctgatggaggggcgaatcattatgccaaaaccattagagcaatcaaaaaacgatctccccgaaccaaagtcgaagcgctaactcccgattttcaaggaagtgaaagagatgtcgctgtattgttagatagtggccttgatgtgtttgcgcaaaatgtagaaacggttgagcgtctgacacacccggtaagagataatcgagcgggttatcagcaaaccttgaatgtactggcttttgccaagaaatatcgacctgatgttctgaccaaaaccagtttgatgttaggattgggtgaaaccgatgaagaaattatacggactatggatgacctccgagctcatcacgtggatattttgactttgggacaatatttgcaaccaactaaaaatcatttacctatagcacgttacgtaactcctgaaactttttctgaattaaggcaaattggtctgaaaaaagggttttttgaagtcgcttctggcccactggttcgatcaagttatagggctgaccgagtgttcaaacgggataatttagggcttgatgtttga

SEQ ID NO: 26579 - protein, 329 aa, Legionella pneumophila str. Lens
MGKLIDIPIVVESGQKYKTSQGVTAIKDGIKSSGQDHERLPKPKWLRIVNHTTPAYSQVKEQVQKHRLATVCEEAKCPNISECWSHGTATIMLMGAVCTRACRFCSVDTGNPHGWLDAEEPENTAETVALMNLDYVVLTSVNRDDLPDGGANHYAKTIRAIKKRSPRTKVEALTPDFQGSERDVAVLLDSGLDVFAQNVETVERLTHPVRDNRAGYQQTLNVLAFAKKYRPDVLTKTSLMLGLGETDEEIIRTMDDLRAHHVDILTLGQYLQPTKNHLPIARYVTPETFSELRQIGLKKGFFEVASGPLVRSSYRADRVFKRDNLGLDV

SEQ ID NO: 26580 - DNA, 969 bp, Photobacterium profundum SS9
  CDS (1)..(969): transl_table=11
atgagcaaaccaattaagatcgaacaaggtatcaaataccgtgatgccgacaaaatggcgctaattcctgtacgcaatgttgcagaagaagcacctaaagaagtcttacgaaagccagcttggatgaagattaaacttccgtctgacagcaaacgtattcaagaaatcaaatcagcactgcgtaagaataagcttcactcggtttgtgaagaagcatcttgccctaaccttgctgagtgctttaaccacggtactgctaccttcatgattttaggtgcgatttgtactcgtcgttgcccgttctgtgatgttgctcatggtcgtcccctaccaccaaatgcagaagagccaagccatttagctcaaacaatcgcagacatgaagctgaaatacgttgttatcacttcagttgaccgtgatgacctacgtgatggtggcgcacaacactttgttgattgtatccgtgaaattcgcgagaaaagcccagaaatccatatcgaaacattagtgcccgacttccgcggtcgtatggatcgtgcgctggatattcttcaaggtacgccacctaatgtgttcaatcacaaccttgaaacagcacctcgtttgtaccgtaaagctcgccctggcgcgaactaccagtggtcacttgatctgctgaaaaacttcaaagagatccatcctgaagtgccgactaagtctggtgttatgatggggcttggtgaaacaaaagaagaaattattcaagtattgaaagatcttcgcgcacatggtgtaacaatgctaacactcggtcagtacttagcacctagtcgtcaccatttacctgttgaacgttatgtaccaccagcagagtttgatgaactaaaagagatcgcacttgaattaggtttcacacatgctgcatgtggtccttttgttcgctcatcttatcatgctgatcttcaggctcagggtcttgaaattaagtaa

SEQ ID NO: 26581 - protein, 322 aa, Photobacterium profundum SS9
MSKPIKIEQGIKYRDADKMALIPVRNVAEEAPKEVLRKPAWMKIKLPSDSKRIQEIKSALRKNKLHSVCEEASCPNLAECFNHGTATFMILGAICTRRCPFCDVAHGRPLPPNAEEPSHLAQTIADMKLKYVVITSVDRDDLRDGGAQHFVDCIREIREKSPEIHIETLVPDFRGRMDRALDILQGTPPNVFNHNLETAPRLYRKARPGANYQWSLDLLKNFKEIHPEVPTKSGVMMGLGETKEEIIQVLKDLRAHGVTMLTLGQYLAPSRHHLPVERYVPPAEFDELKEIALELGFTHAACGPFVRSSYHADLQAQGLEIK

SEQ ID NO: 26582 - DNA, 930 bp, Haloarcula marismortui ATCC 43049
  CDS (1)..(930): transl_table=11
atgagtcgttcgcgcaagcctgactggctgaagatgcggccaccgtcgggcgagcggttcaccgatatcaagcagacgctccgggaccgaaacctcaatacggtctgtgaggaagccaactgccccaacctcggggagtgctggagcgggcgcgacggaccgggaacggcgacgttcatgttgatgggcgaccgctgttcgcggggctgtaacttctgtgacgtggagacgggcgggatggacccgctggaccccgacgagccacagcaggtggccgacgccgtcgcggagatcgggctggactacgtggtactgaccagcgtcgaccgcgacgacctgcccgaccagggcgcgagccacttcgccgagacgatccgggccatcaaagagcgtgacccgtcgattctggtcgagtgtctcatccccgattttcagggtgagccggaccttgtacggaaaatcatcgacgccgacccggacgtcatcgcgcacaacatcgagacggtcgaccggctccagtggccggtccgggaccgccgggcgggctacgagcagtccctctcagtgcttcggcaggtcaaccgcgaaagcgactgctacagcaagaccagcctgatgctgggcgtcggcgagtacgctcacgaagtgtaccagacgctgtcggacctccggcaggccggcgtcgacgtggtcacgttcggccagtacctccagccctcccggtcacatctggaggtctcagagtacgttcatccggacgccttcgacacctggcagcaggtcgctgaagcggagttcgacttcctgtactgtgcctcgggaccgatggtccggtcgtcctatcgtgccggcgaactgtttgtcgagagcgtcctgcgcgaggggcgaagtgccgacgaggcgcgggcggaagtgcgtgcgaacgactga

SEQ ID NO: 26583 - protein, 309 aa, Haloarcula marismortui ATCC 43049
MSRSRKPDWLKMRPPSGERFTDIKQTLRDRNLNTVCEEANCPNLGECWSGRDGPGTATFMLMGDRCSRGCNFCDVETGGMDPLDPDEPQQVADAVAEIGLDYVVLTSVDRDDLPDQGASHFAETIRAIKERDPSILVECLIPDFQGEPDLVRKIIDADPDVIAHNIETVDRLQWPVRDRRAGYEQSLSVLRQVNRESDCYSKTSLMLGVGEYAHEVYQTLSDLRQAGVDVVTFGQYLQPSRSHLEVSEYVHPDAFDTWQQVAEAEFDFLYCASGPMVRSSYRAGELFVESVLREGRSADEARAEVRAND

SEQ ID NO: 26584 - DNA, 936 bp, Geobacillus kaustophilus HTA426
  CDS (1)..(936): transl_table=11
atgagaaatgaacaatcatcgacaagtggagtgagaacgatggcgacgaaagaagaacacgtccgcaagccggactggttgaaaatcaagttgaacacgaacgagaattatatcggtttaaagaagctgatgcgggaaaaccgtttacataccgtttgcgaggaagcgaagtgcccaaacattcacgaatgctgggccgtacggcggacggcgacgtttatgattttaggcagcgtctgcacgcgcgcctgccgcttctgcgccgtcaaaaccgggctgccgaccgagctcgattggcaggagccggaacgcgtcgcggaatcggtgcgcatcatgaacttgaaacacgtcgtcgtcaccgccgtcgcccgcgatgacctaaaagacggcggggcggcggtattcgccgaaacggtgcgcgccatccgccggaaaaacccgtttacgacgatcgaggtgctgccgtcggatatgggcggggtgtatgaaaacttgaaaattttgatggatgcccgccctgacattttaaaccataacatcgaaacggtgcgccgcttgactccaagggtgcgcgcccgcgcgacgtacgaacgttcgcttgagtttttgcggcgcgcgaaagaattgcagccggacattccgacgaaatcgagcatcatggtcggccttggggaaacgaaagaggaaatcattgaagcgatggatgacttgcgcgccaaccatgtcgacattttgacgatcggccagtatttgcagccgacgaaaaagcatttgaaggtcgtgaaatattaccatccggacgagtttcaagagctgaaagaaatcgcgttgagcaaagggttcagccattgtgaagcggggccgctcgtccgctcgtcgtaccatgccgatgagcaggtgagcgaggcggcgaaagcgcggcagttgaaagcgtaa

SEQ ID NO: 26585 - protein, 311 aa, Geobacillus kaustophilus HTA426
MRNEQSSTSGVRTMATKEEHVRKPDWLKIKLNTNENYIGLKKLMRENRLHTVCEEAKCPNIHECWAVRRTATFMILGSVCTRACRFCAVKTGLPTELDWQEPERVAESVRIMNLKHVVVTAVARDDLKDGGAAVFAETVRAIRRKNPFTTIEVLPSDMGGVYENLKILMDARPDILNHNIETVRRLTPRVRARATYERSLEFLRRAKELQPDIPTKSSIMVGLGETKEEIIEAMDDLRANHVDILTIGQYLQPTKKHLKVVKYYHPDEFQELKEIALSKGFSHCEAGPLVRSSYHADEQVSEAAKARQLKA

SEQ ID NO: 26586 - DNA, 942 bp, Anaplasma marginale str. St. Maries
  CDS (1)..(942): transl_table=11
ttgacaagcgttgcagtttttactacgctactcggtagtttgttgctggtcagtatggaaaacaagcccgattggttgagggtgcggatgccgggcggtgcggtctttgatgaggttaccgaactcgtgcgtcgctacgagctcaatacagtctgcgaggaagctgcgtgtcctaatataggtgagtgttggaacaaacgccacgctaccatcatgataatgggttccgtgtgtacaagggcgtgcgcattctgtaacgtgaaggttggtgtgccgaacgctctcgatcctgatgagcctgagagggtcggcgctgcgatcagtaagcttggcctaaaacacgtggtaataacttctgtggatagggacgaccttccagatgggggggcgagccacttcgctaagtgcgttcgggagataagaaagcgtgatagctctgtaacggtggagattctcactccggactttctaggtaagccgtgcgcgattgatattatcgcctctgcgcgcccagatgtttataaccacaacttggaaaccgtacccaggttgtattctagagtcaggcccagggcgaagtattttaattcgctcaatctgcttaaggaggtaaaggacaaaagccctggggtatttaccaagtctgggtttatgctagggctgggggagtctaaggaagaagtgtaccaagttatggatgacctaaggtgtgctggggtggactttatagtgatggggcagtatttgcagcctacaaagaacaacattgaagtacatcgctatgtccccccttcggaatttgagcagtataaactcatggcgtatgcaaaggggttttccatggttgctgcaagtccgcttgcgcggtcttcctaccacgctgaggatgactttcgaaagcttaaggagcttaggttcgcacgcgctaaagtgaacgaatag

SEQ ID NO: 26587 - protein, 313 aa, Anaplasma marginale str. St. Maries
MTSVAVFTTLLGSLLLVSMENKPDWLRVRMPGGAVFDEVTELVRRYELNTVCEEAACPNIGECWNKRHATIMIMGSVCTRACAFCNVKVGVPNALDPDEPERVGAAISKLGLKHVVITSVDRDDLPDGGASHFAKCVREIRKRDSSVTVEILTPDFLGKPCAIDIIASARPDVYNHNLETVPRLYSRVRPRAKYFNSLNLLKEVKDKSPGVFTKSGFMLGLGESKEEVYQVMDDLRCAGVDFIVMGQYLQPTKNNIEVHRYVPPSEFEQYKLMAYAKGFSMVAASPLARSSYHAEDDFRKLKELRFARAKVNE

SEQ ID NO: 26588 - DNA, 933 bp, Idiomarina loihiensis L2TR
  CDS (1)..(933): transl_table=11
atgcgtgacgccgataaaatggcactgataccagtacaaattattcccaccgaacgcgatcagatgttgcgtaagccgtcgtggctgaaggtgaagttaccttcttcaactgagcgtattgatgaaattaagcaagcaatgcgcagccatggtttgcactctgtttgtgaggaagcatcctgtccaaatttaccggaatgttttaatcacggtacagccagttttatgatcctgggcgacatttgtacacgtcgttgcccattctgtgacgttgctcacggtcgccctcttcctcccgatccggaagaagctgaaaagctgggcaaaaccatccgcgacatgaaagtgaagtatgtcgtaattacatcggttgaccgtgatgatttacgcgacggcggtgctcagcactttgcggactgtattcgtgaaattcgtgagcacagtgagaacaacattcaggtagaagtgctggtaccggattttcgtggtcgtatgcaggttgcgatcgatattctcaaaggcgaggcgcctgacgtatttaaccacaaccttgagaccgtgccacgcctgtataaggcagctcgtcctggtgcaaattaccagtggtctttagacttgctgcaaaaatacaaagaagttcggccggatatccggactaagtcgggacttatggtcggccttggcgaaaccaaagaagaaatactggaagtcatgaaagatcttcgtgcgcacgatgtcgacatgttgactatcggacagtatttgcagcctagccgccaccatattccggtagcacgctacgtgcaccccgacgagtttgaagagctgcgtgttgctggtgttgaaatgggctttagccacattgccagtgggccactcgtacgctcgtcttatcatgctgatttacaggcagcaggcgaaaccgtacgttaa

SEQ ID NO: 26589 - protein, 310 aa, Idiomarina loihiensis L2TR
MRDADKMALIPVQIIPTERDQMLRKPSWLKVKLPSSTERIDEIKQAMRSHGLHSVCEEASCPNLPECFNHGTASFMILGDICTRRCPFCDVAHGRPLPPDPEEAEKLGKTIRDMKVKYVVITSVDRDDLRDGGAQHFADCIREIREHSENNIQVEVLVPDFRGRMQVAIDILKGEAPDVFNHNLETVPRLYKAARPGANYQWSLDLLQKYKEVRPDIRTKSGLMVGLGETKEEILEVMKDLRAHDVDMLTIGQYLQPSRHHIPVARYVHPDEFEELRVAGVEMGFSHIASGPLVRSSYHADLQAAGETVR

SEQ ID NO: 26590 - DNA, 948 bp, Azoarcus sp. EbN1
  CDS (1)..(948): transl_table=11
atggacagcacggcacgcaagcaacgcggcgcagacaagaccgcgcgcatcccgatcaagatcgtccccgccgaacgcctgaagaagcccgagtggatccgcatccggctcggcgccggccacgaagccgagcgcttcaacgaaatcaaggcgagcctgcgcgagcacaagctgcacaccgtatgcgaggaagcgtcgtgcccgaacatccacgaatgcttcggcaaaggtaccgcgacgttcatgatcatgggcgacatctgcacgcgtcgctgcccgttctgcgatgtcggccacggccggcccgagccgctgaacgcgaacgaaccgcaggagctcgcggcgacgatcggcgcgatgcggctcaactacgtcgtcatcaccagcgtcgaccgcgacgacctgcgtgacggcggcgcgcagcacttcgtcgactgcattcgcgagacgcgcgcggcgtcaccgaagacgcgcatcgaagtgctcgtgccggacttccgcggccggctcgacgtcgcgctcgaaatcttcgaccaggcgccgccggacgtcatgaaccacaacctcgagacagtgccgcggctctacaaacaggcgcgcccgggcgcggactacgcgtattcgcttcggctgctgaaggaattcaaggcgcgccatcccgacgtgccgacgaagtccggcctgatggtcggcctcggcgagaccgacgacgagatcctcgacgtgctgcgcgacctgcgcgcgcacgacgtcgagatgctgacgatcggccagtatctgcaaccgtcgaccggacacctgccggtgctgcgctatgtgcatccggacacgttcaagatgttcgagaccgaggcgctcgcgatgggcttcaagaacgcggcctgcggcccgatggtgcgctcgagctactgggccgaccagcaggcgtacggcgcgggcgtcgtctga

SEQ ID NO: 26591 - protein, 315 aa, Azoarcus sp. EbN1
MDSTARKQRGADKTARIPIKIVPAERLKKPEWIRIRLGAGHEAERFNEIKASLREHKLHTVCEEASCPNIHECFGKGTATFMIMGDICTRRCPFCDVGHGRPEPLNANEPQELAATIGAMRLNYVVITSVDRDDLRDGGAQHFVDCIRETRAASPKTRIEVLVPDFRGRLDVALEIFDQAPPDVMNHNLETVPRLYKQARPGADYAYSLRLLKEFKARHPDVPTKSGLMVGLGETDDEILDVLRDLRAHDVEMLTIGQYLQPSTGHLPVLRYVHPDTFKMFETEALAMGFKNAACGPMVRSSYWADQQAYGAGVV

SEQ ID NO: 26592 - DNA, 951 bp, Silicibacter pomeroyi DSS-3
  CDS (1)..(951): transl_table=11
gtgcgtgacctgaagatccccgagcagcgccaccccgaaaaggcgcatcgccccgaccaggcgcaacccaagaaaccggactggatccgggtcaaggcgccggggggcaagggctatgccgatacccgccggatcatgcgcgacaacaacctggtcaccgtctgtgaagaggccggatgcccgaacgtcggcgaatgctggagccagggccacgccaccatgatgatcatgggcgagatctgtacccgtggctgcaccttctgcaacatcgccaccgggcgccccgacgcgctggacgcgttcgagccgggccgggtggcccatgcggtggagaagctggggctgaaccatgtggtgatcacgagcgtcgaccgcgacgacctggccgatggcggggccgagcattttgcccagaccatccgtgccatccgccatcgcagcccctcgaccacgatcgagatcctgacgcccgatttcctgaaatgcgcgcccgaggtgctggaagtcgtggttgcgtccaagcccgacgtgttcaaccacaatctggaaaccgtgccgggcctgtaccccgaggtgcgccccggcgcgcgctatttccactcgctgcgtctgctccagcgggtcaaggagctggatccgtcgatctttaccaaatccggcatcatggtcggcctgggtgagaccgaacagcaggtgcgccaggtgatggacgacatgcgcgccgccgatatcgatttcctgaccatcggccagtatctgcaaccgacaccgaaacatcaccgggtcgatcgtttcgtgcatcccgatgaattcgcctcttatgagaaagccgcctatggcaagggcttcctgatggtctcggcaacgccgctgacgcgctcgtcctaccacgcgggcgacgactttgcgcgcctgcgggacgcccggcagaagaagctcggcctggcatga

SEQ ID NO: 26593 - protein, 316 aa, Silicibacter pomeroyi DSS-3
MRDLKIPEQRHPEKAHRPDQAQPKKPDWIRVKAPGGKGYADTRRIMRDNNLVTVCEEAGCPNVGECWSQGHATMMIMGEICTRGCTFCNIATGRPDALDAFEPGRVAHAVEKLGLNHVVITSVDRDDLADGGAEHFAQTIRAIRHRSPSTTIEILTPDFLKCAPEVLEVVVASKPDVFNHNLETVPGLYPEVRPGARYFHSLRLLQRVKELDPSIFTKSGIMVGLGETEQQVRQVMDDMRAADIDFLTIGQYLQPTPKHHRVDRFVHPDEFASYEKAAYGKGFLMVSATPLTRSSYHAGDDFARLRDARQKKLGLA

SEQ ID NO: 26594 - DNA, 984 bp, Francisella tularensis subsp. tularensis SCHU S4
  CDS (1)..(984): transl_table=11
atgaaagaaatatctggtataaaagttaaagttgaaagtggctctaagtacactaccgatcatggttttcatgctgtcaaagatggtattagaaataagaaagaaaatgctgtgcatgtacgtaaaccagattggttgaaagtgcaaaaacaagattctaaagaatacctaaaagttaaatccattacaaaaaaacataaactttcaacagtttgtgaagaagcaaggtgccctaatattaatgagtgctggtctcatggtacagcaacaattatgttaatggggagtgtatgtactagagcttgtaaattttgttctgtagatacaggtaatccaaaaggttggttagataaagatgaacctatgaatgctgctgaaagtgtaaagctcatgggacttgaatatgttgtattgacatctgtagatcgtgatgatttagaagatggtggtgctggacactatgcagcgactattacagctatcaaaaatcttgatgagaatattaaagtagaagcattgactccggattttgctggtattaacgaaaatattgataaaatcataaatacaaaagtagatgtaattgcacaaaatatcgagactgtagagcgcttgactcatccagtacgtgatccacgtgcagggtactggcaaacattaaatttcttaaaatatgttaaacaaaaatcaccaaatgtgcttactaaaactagtattatggtaggtttaggtgagactgatgaagaaatttacaaaactatggatgatgcgcgaagtgttggagttgatataataacgcttgggcaatatatgcaaccaacaaagcatcatttgagtgttgagaggtttgtgacaccacaacaattcgaagagtatcgcaaagtgggtctcgaaaaaggcttcttagaagtggcatcagggcctatggtaagatcaagctatagagctgatagagttttcaaaaggaataatttagatttgtaa

SEQ ID NO: 26595 - protein, 327 aa, Francisella tularensis subsp. tularensis SCHU S4
MKEISGIKVKVESGSKYTTDHGFHAVKDGIRNKKENAVHVRKPDWLKVQKQDSKEYLKVKSITKKHKLSTVCEEARCPNINECWSHGTATIMLMGSVCTRACKFCSVDTGNPKGWLDKDEPMNAAESVKLMGLEYVVLTSVDRDDLEDGGAGHYAATITAIKNLDENIKVEALTPDFAGINENIDKIINTKVDVIAQNIETVERLTHPVRDPRAGYWQTLNFLKYVKQKSPNVLTKTSIMVGLGETDEEIYKTMDDARSVGVDIITLGQYMQPTKHHLSVERFVTPQQFEEYRKVGLEKGFLEVASGPMVRSSYRADRVFKRNNLDL

SEQ ID NO: 26596 - DNA, 894 bp, Synechococcus elongatus PCC 6301
  CDS (1)..(894): transl_table=11
ttggtcgtcaaaccggaatggctgcgagtcaaagcaccgcagtggcaacgcgtcggtaacgtcaagcaagtcttggcggatctggggctgaataccgtttgcgaagaggcatcctgtcccaatattggtgagtgttttaacgctgggacggccacctttttgatcatgggtccggcttgcacgcgggcttgcccctactgcgatatcgacttcgaaaagaaacccaaagcgctcgatccgacggagccgcaacgactcacagaagctgtgggccgactgaatctcaatcacgtcgtgatcacgtcagtcaatcgtgatgacttgccggatggtggtgctgagcaattcaaacgctgtattgaagcggtgcgatcgcgatcgcctcagaccacgattgaggttctgattcccgatctctgcggcaactgggaagcgctggaaattattttgtccgcagcgcccgaggtgctgaaccacaacatcgaaacggtctcacgactctaccgacgcgtgcgaccccaaggtgactatcagcgatcgctggaactattgcgccgcagtcgggaacaagcgccgtggatctataccaagtctggcttgatggtgggtcttggtgaaactgcggaagaagtgcagcaggtcctggtggacctccgtagcgtcgactgcgacatcgtcacgatcggtcagtacctgcagccgacccaaaaacatttaggcgtcgatcgctttgtcacgccggcggaatttgatgcttggcaacagcaaggcagtcagctcggcttcctgcaagtcgtggcttcacccctgacccgcagttcctatcacgccgaagaagtgcgccgactgatgcaggaatatccgcgtcagcgaccggcgatcgccctgaattaa

SEQ ID NO: 26597 - protein, 297 aa, Synechococcus elongatus PCC 6301
MVVKPEWLRVKAPQWQRVGNVKQVLADLGLNTVCEEASCPNIGECFNAGTATFLIMGPACTRACPYCDIDFEKKPKALDPTEPQRLTEAVGRLNLNHVVITSVNRDDLPDGGAEQFKRCIEAVRSRSPQTTIEVLIPDLCGNWEALEIILSAAPEVLNHNIETVSRLYRRVRPQGDYQRSLELLRRSREQAPWIYTKSGLMVGLGETAEEVQQVLVDLRSVDCDIVTIGQYLQPTQKHLGVDRFVTPAEFDAWQQQGSQLGFLQVVASPLTRSSYHAEEVRRLMQEYPRQRPAIALN

SEQ ID NO: 26598 - DNA, 930 bp, Bacillus clausii KSM-K16
  CDS (1)..(930): transl_table=11
atgccagaaaaagatgaaaaagagcagcatatgcgcaaaccggactggctaaaaatcaagctaaatacaaacgagtcttatacaggcttgaaaaaaatgatgcgtgagaaaaaactacataccgtatgtgaagaagcacgctgcccgaacatccatgaatgttgggcggttcgaaaaacggctacttttatgatccttggcgatatttgtacacgaggttgccgtttttgtgcagtcaagacaggcttgccaacggagcttgacttgcaagagccagagcgcgtggcggaatccgtggagaccatggggttaaaacatgtcgttattactgctgttgcccgtgatgatttaaaagacggcggcgccgcagtgtttgccgaaacggtacgagccgtacgccggaaaaacccattttgcacaattgaagttttgccttctgacatgcttggcaatgaatcaagcttgcaaacattaatggatgcgcgcccgaatataatgaatcataatatcgaaaccgtaagaaggctgacgccaaaagttagagcacgagcaaaatatgaccgcacactcgagtttttgcggagagccaaagaaatgcatcctgatattccgactaaatcgagcctaatggtaggcctaggggaaacaaaggaagaaattttagaaacaatggatgatttgcgggctaataatgttgacattttgacaattggccaatatttacaacctacaaagaaacatttaaaagtcattaagtattaccatccagacgaatttgccgagttaaaggaaatcgctatgcaaaaaggctttagccattgcgaggcgggaccgcttgtccgttcgtcataccatgcagacgaacaagtgaaccaagcgcaagtgaacatggaagcaagaaaagcacaaggggagcaacagcgcgtataa

SEQ ID NO: 26599 - protein, 309 aa, Bacillus clausii KSM-K16
MPEKDEKEQHMRKPDWLKIKLNTNESYTGLKKMMREKKLHTVCEEARCPNIHECWAVRKTATFMILGDICTRGCRFCAVKTGLPTELDLQEPERVAESVETMGLKHVVITAVARDDLKDGGAAVFAETVRAVRRKNPFCTIEVLPSDMLGNESSLQTLMDARPNIMNHNIETVRRLTPKVRARAKYDRTLEFLRRAKEMHPDIPTKSSLMVGLGETKEEILETMDDLRANNVDILTIGQYLQPTKKHLKVIKYYHPDEFAELKEIAMQKGFSHCEAGPLVRSSYHADEQVNQAQVNMEARKAQGEQQRV

SEQ ID NO: 26600 - DNA, 969 bp, Gluconobacter oxydans 621H
  CDS (1)..(969): transl_table=11
atgtcccagcgcatcaccatcgatcaccgttcggcgcctgcccttcgccatccggagaaggcgcatcggcctgataacccgatccagcgcaagccgtcctggatccgggtcaaggcgccgaaccatccagtctatcacgagacccgtgcgctcatgcgggatgccgggctggtgacggtctgcgaggaggcggcgtgccccaatatcggggaatgctggtcgcagcgtcatgccacgatgatgatcatgggcgagatctgcacccgggcgtgtgcattctgcaatgtcacgaccggactgccgaagcatctcgatgaggacgagccacggcgggtcggagaagcggtggcgaagcttgggctcaagcatgtcgtcatcacttcggtggaccgtgacgatctggaagacgggggggcgatgcacttcgcgcgggtcattcatgcgatccgcgagacctctccacagaccacgatcgagattctgacgcctgatttcctgcgcaaggatggcgcgctggaggtcgtggtggcggctcggccggacgttttcaatcacaatatcgagaccataccccggctttaccccaccatcagaccgggtgcgcgttactatcagtccgtccgtctcctggacggagtaaagaaactcgatccttccatttttaccaagtccggcctgatgcttgggcttggcgaggagcggatggaagtggcccaggtgatggatgatttccggatcgcggacgtcgatttcctgacgcttggacagtatctccagccgtccgcgaaacatgcggcggtggaaaagtttgttacccccgacgagtttgacggctatgctgctgctgcccgttcaaaaggatttcttcaggtcagtgccagtccgctgacccggtcctcctaccatgcggacagtgatttcgcgaagcttcaggctgcgcggaacagccgtctgaaagaaagtctctga

SEQ ID NO: 26601 - protein, 322 aa, Gluconobacter oxydans 621H
MSQRITIDHRSAPALRHPEKAHRPDNPIQRKPSWIRVKAPNHPVYHETRALMRDAGLVTVCEEAACPNIGECWSQRHATMMIMGEICTRACAFCNVTTGLPKHLDEDEPRRVGEAVAKLGLKHVVITSVDRDDLEDGGAMHFARVIHAIRETSPQTTIEILTPDFLRKDGALEVVVAARPDVFNHNIETIPRLYPTIRPGARYYQSVRLLDGVKKLDPSIFTKSGLMLGLGEERMEVAQVMDDFRIADVDFLTLGQYLQPSAKHAAVEKFVTPDEFDGYAAAARSKGFLQVSASPLTRSSYHADSDFAKLQAARNSRLKESL

SEQ ID NO: 26602 - DNA, 864 bp, Wolbachia endosymbiont strain TRS of Brugia malayi
  CDS (1)..(864): transl_table=11
atgcatagcaagcctccatggctcagagcaaaagctccgactggtgaaatattcaatgagaccttaaatactgttaaactgcatggtctacatacagtgtgcgaagaggctgcatgtccaaatattggtgaatgttggaacaaacgtcatgctactgtgatgattcttggttctgtttgcactcgtgcttgtgcattttgcaacgttgcaactggtatccctaataagttagatcctcacgaaccagaaaatttagcaaaagcaataaaaaagttaaacttaaaatatgttgtcattacctccgtcgaccgtgatgatttaccagatggcggagcaagtcagtttataaagtgtatagaagaaattagaaaaataactccagaaacaacagtagaaattttaactcctgattttttaaataagaaaggagcgtttgaagcaatcgctgttgcatcacctgatgtctataaccacaatattgaaatggtgccaagattatatgcaagaataagaccgcgtgctcgttattttcattcactatatttgttgaagatggtgaagcaaattaatcctaaactcctcacaaagtcagggctcatggttggtcttggagaaacgaaagaagaagtacttcaagttatggacgatttacgaagtgctgaagttgactttatcacaatcggtcaatatcttcaaccaactccaaagcatgcaaagattgataggtatgttaccccagaagaatttgagcattataaatatattgcttattctaaaggtttcttagtggttgcatctagtccactaactagatcatcataccatgctgaagaggattttaataggctcaaggcttgtcgttaa

SEQ ID NO: 26603 - protein, 287 aa, Wolbachia endosymbiont strain TRS of Brugia malayi
MHSKPPWLRAKAPTGEIFNETLNTVKLHGLHTVCEEAACPNIGECWNKRHATVMILGSVCTRACAFCNVATGIPNKLDPHEPENLAKAIKKLNLKYVVITSVDRDDLPDGGASQFIKCIEEIRKITPETTVEILTPDFLNKKGAFEAIAVASPDVYNHNIEMVPRLYARIRPRARYFHSLYLLKMVKQINPKLLTKSGLMVGLGETKEEVLQVMDDLRSAEVDFITIGQYLQPTPKHAKIDRYVTPEEFEHYKYIAYSKGFLVVASSPLTRSSYHAEEDFNRLKACR

SEQ ID NO: 26604 - DNA, 1014 bp, Xanthomonas oryzae pv. oryzae KACC10331
  CDS (1)..(1014): transl_table=11
atgacccagcctaccgcccgttccatccccttgcaggtcgtctccggcgacaccgccgcgcctgcgccgttgcagaccggcgtcaagcagatcggtggcgacaagatccatcgctcgccagtgcagttcgtcgatgcgccggtattgcgcaagccgtcgtggatccgcgtgcggattccgtccggcaatgccgtgcagaacctcaaggccaagctgcgcgaaaatcgcttggtcaccgtctgcgaagaagccagttgcccgaacatccacgagtgcttcagccacggcaccgcgaccttcatgatcttgggcgaggtgtgcacacggcgctgctcgttctgcgatgtggcgcatggccggccgaagccgcctgacgcaaacgagccggccagcctggccatcaccgtggccgacatgggcctgaaatacgtggtggtgaccagcgtggaccgcgatgatctgcgcgacggtggcgcgcaacatttcgtcgactgcatctcggcgatccggaccagttcgccgaatacccgcatcgaaattctgacgccggatttccgtggcaagggccgcatggaccgcgcgctggacatcctggcgctgagcccgccggacgtgttcaaccacaacatcgaaaccgtgccggatctgtacccgaacgtgcgccccggcgcggattaccagtggtcgctgacgctgctgcagcgcttcaaggcgcagcatccgtcaattgctaccaagtccggcatcatgctcggcctgggcgaaacgatggagcaggtgcaggccaccttgcgcgatctgcgcgcgcacgatgtggatatgatcaccatcggccagtatctgcagccgacgccgcaccatcacccggtgatgcgttactggacgccggaggaatacaaggcgctggaggagtacggcaatgcgctgggcttcagtcatgtcgcctccggcccgatggtgcgttcgtcgtatcacgccgaccgccaggccgctggcgctggtgttgctgcctga

SEQ ID NO: 26605 - protein, 337 aa, Xanthomonas oryzae pv. oryzae KACC10331
MTQPTARSIPLQVVSGDTAAPAPLQTGVKQIGGDKIHRSPVQFVDAPVLRKPSWIRVRIPSGNAVQNLKAKLRENRLVTVCEEASCPNIHECFSHGTATFMILGEVCTRRCSFCDVAHGRPKPPDANEPASLAITVADMGLKYVVVTSVDRDDLRDGGAQHFVDCISAIRTSSPNTRIEILTPDFRGKGRMDRALDILALSPPDVFNHNIETVPDLYPNVRPGADYQWSLTLLQRFKAQHPSIATKSGIMLGLGETMEQVQATLRDLRAHDVDMITIGQYLQPTPHHHPVMRYWTPEEYKALEEYGNALGFSHVASGPMVRSSYHADRQAAGAGVAA

SEQ ID NO: 26606 - DNA, 984 bp, Neisseria gonorrhoeae FA 1090
  CDS (1)..(984): transl_table=11
atgagtgaaatcaaaaccgacgaccccaaacgcggcatcaaactcagaggcgcggacaaaaccgcccgcatccccatcaaagtcgtcccccttcaggaaaaactgaaaaagcccgaatggatacgcgccaaactcccatcgcgcaaattctttgaaatcaaagacattttgcgcgaacaaaagatgcacaccgtttgcgaggaagcctcctgccccaacatcggcgaatgcttcagcaaaggcacggcgaccttcatgattatgggcgacatctgcacccgccgctgcccgttctgcgacgtgggacacggccgtccgaatatgctcgaccccgacgagccgaaaaacctcgcagaatccgtcaaagccatgaacctgcgttacgtcgtcatcacctcggttgaccgcgacgacctgcgcgacggcggcgcccaacacttcgccgactgcatcaaagccatccgcgaaaccagcccgaacaccaaaatcgaaatcctcgtccccgacttccgaggccgcttggacatcgcactgaaaatccttgccgaaaccccgcccgacgtgatgaaccacaacttggaaacccatccgagcctgtacagaaaagcccgtcccggtgccaattatcaacattctttagacttattaaaacgttataaagaaatgatgccgcatatcccgaccaaatccggcattatggtaggcttgggcgaaacagacgaagacgtgcgtgaaattatgcgcgatatgcgggcgcacaatatcgagatgattaccatcggacagtacctccagccttcagacggacacttgcctgtcttgcgctacgttacacccgaacaattcaaaatatttgaaaaagaagcatacgaactgggctttaccaatgccgccatcggcgcgatggtacgttcaagttaccatgccgacgaacaggcggcggaagccttacgcgaaagccacggcggttgcgggcatcattaa

SEQ ID NO: 26607 - protein, 327 aa, Neisseria gonorrhoeae FA 1090
MSEIKTDDPKRGIKLRGADKTARIPIKVVPLQEKLKKPEWIRAKLPSRKFFEIKDILREQKMHTVCEEASCPNIGECFSKGTATFMIMGDICTRRCPFCDVGHGRPNMLDPDEPKNLAESVKAMNLRYVVITSVDRDDLRDGGAQHFADCIKAIRETSPNTKIEILVPDFRGRLDIALKILAETPPDVMNHNLETHPSLYRKARPGANYQHSLDLLKRYKEMMPHIPTKSGIMVGLGETDEDVREIMRDMRAHNIEMITIGQYLQPSDGHLPVLRYVTPEQFKIFEKEAYELGFTNAAIGAMVRSSYHADEQAAEALRESHGGCGHH

SEQ ID NO: 26608 - DNA, 867 bp, Bacteroides fragilis NCTC 9343
  CDS (1)..(867): transl_table=11
atgggaaacgataaacgggtgcgcaaacccgaatggcttaaaatcagcattggagccaatgaacgctataccgagaccaaacgcattgtcgaatcgcactgcctgcacaccatctgtagcagtgggcgttgccccaacatgggcgaatgctggggaaaagggacagctacgttcatgattgccggtgacatctgtacccgcagttgtaaattctgtaatacccagaccggacgacctctgcctttggatcccgacgaaccgacccacgttgcagaatcgattgccctgatgaaactctcacacgcagttatcacatctgtagaccgcgacgatctgcctgatttgggtgcagcccattgggcacaaacaattcgtgaaatcaaacgactaaatccggaaacaactaccgaagtactgattcccgatttccagggacgcaaagagcttgttgaccaagtgataaaagcctgtcccgaaatcatctcccataacatggagactgtgaaacgcatcagtccacaggtgcgtagtgccgccaactatcacaccagcctggaagtgatccgccaaatagccgaaagcggtattacggcaaaatcgggcattatggttggtctgggtgaaactcctgctgaagtagaagagttaatggacgacctgatttccgtcggttgcaaaatcctcaccatcgggcaatatctgcagccaacccacaaacacttcccggttgcagcatacattactccggaacagtttgctgtttataaagaaacaggactgaagaaagggttcgaacaagtggaaagcgcaccgttagtacgctcctcgtatcatgcagaaaaacatatccgatttaataataagtag

SEQ ID NO: 26609 - protein, 288 aa, Bacteroides fragilis NCTC 9343
MGNDKRVRKPEWLKISIGANERYTETKRIVESHCLHTICSSGRCPNMGECWGKGTATFMIAGDICTRSCKFCNTQTGRPLPLDPDEPTHVAESIALMKLSHAVITSVDRDDLPDLGAAHWAQTIREIKRLNPETTTEVLIPDFQGRKELVDQVIKACPEIISHNMETVKRISPQVRSAANYHTSLEVIRQIAESGITAKSGIMVGLGETPAEVEELMDDLISVGCKILTIGQYLQPTHKHFPVAAYITPEQFAVYKETGLKKGFEQVESAPLVRSSYHAEKHIRFNNK

SEQ ID NO: 26610 - DNA, 933 bp, Chlamydophila abortus S26/3
  CDS (1)..(933): transl_table=11
atgaatgacactcctaatgacatacaaaaacccaaacaagggaaacgtttttcagaacgtctccctcactggctaaggcaagctttacccaaaggctcagtctttgactttaccgacaaaactataaaacgtactggcatggctacagtatgtgaggaagcgctctgccctaatcgtacgcgctgttggtcaagaaagacagcaacatacttagctttaggagatgcctgctctcgacgttgtggattttgtaacattgatttcacaaaaaaacccctacctccagatcctgatgaaccaagaaaaatagcagaatccgcaaagatccttcagcttaagcatatcgtattaactatggtcgctcgcgacgacttagaagatggaggggcgagttgtttggtacgtattatcgatactcttcacaaagagctccccgaatctactgtagaaatgcttgcttccgactttcaaggaaatgtcgatgccttgcataccctgctagattcaggattaaccatttataatcacaacgtggaaacagttgaacgtctcacccctgtagttcgacataaagccacataccggcgttctttatttatgttggagcaagccgcgttatacctccccgatcttaaaatcaaatccggcatcatggtggggttaggagaacaagaaagcgaggtaaaacaaacactcaaagatcttgcagatcatggtgtacgtattgtcacaataggacagtatttacgtccttcacgattgcacatacctgtaaagagctacgttactcctgagacttttgattactaccggagagtaggagaatccttaggcctctttgtttatgcagggcctttcgtaagatccagcttcaacgcagatattgttttacaagatatggaaaataaacaatctaaaatggcaaaaacgtag

SEQ ID NO: 26611 - protein, 310 aa, Chlamydophila abortus S26/3
MNDTPNDIQKPKQGKRFSERLPHWLRQALPKGSVFDFTDKTIKRTGMATVCEEALCPNRTRCWSRKTATYLALGDACSRRCGFCNIDFTKKPLPPDPDEPRKIAESAKILQLKHIVLTMVARDDLEDGGASCLVRIIDTLHKELPESTVEMLASDFQGNVDALHTLLDSGLTIYNHNVETVERLTPVVRHKATYRRSLFMLEQAALYLPDLKIKSGIMVGLGEQESEVKQTLKDLADHGVRIVTIGQYLRPSRLHIPVKSYVTPETFDYYRRVGESLGLFVYAGPFVRSSFNADIVLQDMENKQSKMAKT

SEQ ID NO: 26612 - DNA, 1047 bp, Rickettsia felis URRWXCal2
  CDS (1)..(1047): transl_table=11
gtgaatttcaaaaattggcgttgtcgttctataagagtgcaggtagccacgtattattatacgctccgctccttgccttgtgaactcctcgctctttttgaaattgaccttcgtatacaactattcatttcacaggagtatatgtctaatttaaacaaaagaccggattggataaaagtaaaagctccgaattccgcagaatattataatacaaaagatttaataaagaatctgagattaaatactgtgtgcgaggaagctgcttgtcctaatatcggtgagtgctggtcgaaaaaacatgcaaccgtgatgattttaggttcggtttgtactagagcctgtaggttttgtaatgtcaaaactggtagaccggatttgcttgacccgcacgaaccgcaaaggttagcggaagcggtacaaaagttaaatcttaagcatgtagtaattacttccgtcgatcgtgatgatcttgatgatggcggagctacgcattttgcggagtgtattagcgaaattagaaaatcatcgccaaatactactattgagattctaactcctgattttttaagaaaagaaggagcagctgaaataatagcaaatgcaaaacctgacgtctttaaccataatgtcgaaacagtcccgtctttatacaaaacgattagaccaggagctagatattataattctttaagcttacttcacaatatcaaaaaattatctcctgaaatttttacaaaatccggtatgatggtagggcttggagaagaaataagtgaagtaatacaggttatggatgatttaagagaagcaaaggttgattttctaactatagggcagtatctgcaacctactaaaaatcatgctgaggtcgcaaaatatgttactcccgaagagtttaaatatttagagcgaatagcaagaacaaaaggattcttgatggtttcggcaaccccgctaacccgttcttcataccatgccgatgaggattttcaaaaattaaaagagaattaccagcagcgtcattgcgaggaggcatggcctgcgtga

SEQ ID NO: 26613 - protein, 348 aa, Rickettsia felis URRWXCal2
MNFKNWRCRSIRVQVATYYYTLRSLPCELLALFEIDLRIQLFISQEYMSNLNKRPDWIKVKAPNSAEYYNTKDLIKNLRLNTVCEEAACPNIGECWSKKHATVMILGSVCTRACRFCNVKTGRPDLLDPHEPQRLAEAVQKLNLKHVVITSVDRDDLDDGGATHFAECISEIRKSSPNTTIEILTPDFLRKEGAAEIIANAKPDVFNHNVETVPSLYKTIRPGARYYNSLSLLHNIKKLSPEIFTKSGMMVGLGEEISEVIQVMDDLREAKVDFLTIGQYLQPTKNHAEVAKYVTPEEFKYLERIARTKGFLMVSATPLTRSSYHADEDFQKLKENYQQRHCEEAWPA

SEQ ID NO: 26614 - DNA, 963 bp, Haemophilus influenzae 86-028NP
  CDS (1)..(963): transl_table=11
atgtctacgcctttcaaaatggaacgcggtgtaaaatatcgcgatgcggcaaaaacctcaattattcccgtaaaaaatatcgatcctaatcaagagttattaaaaaaaccagaatggatgaaaattaaacttccagcaagttcagctaaaattgaaagcattaaaaatggaatgcgccgtcacggattacattctgtttgtgaggaagcgtcttgtccaaatttacacgaatgttttaatcatggcacagccacttttatgattttaggtgcaatttgtacgcgccgttgcccattctgtgatgtggctcacggtaaaccattaccgcctgatcctgaagagccacaaaaattggcagaaacgattcaagatatgaaacttaaatatgtggtaatcacatcggtggatcgtgatgacttgcctgatcgtggtgctggtcatttttctgaatgtgtaaaagctgtgcgcgagcttaatcctaacattaagattgaaattttagtgcctgattttcgtggtcgcattacacaggctttagagaaattaaaagataatccgccagatgtctttaaccataatttagaaaacgtaccgcgcttatataaagaaattcgtccaggtgcggattacgaatggtcacttaaattattgcgtgaattcaaagaaatattcccaaatatcccaaccaaatctggtttaatggttgggttaggcgaaaccaacgaggaaattttgcaagtgatgcaagatttacgtgataacggtgtgactatgctcacgttgggtcaatatcttcaacctagccgccatcatttgcctgttgcccgttatgtgccgccaactgaatttgatgaattccgtgataaagccaatgaaatgggctttgaacatgcggcttgtgggccatttgttcgttcttcttatcacgctgatttacaagccagtggcggattagtgaaataa

SEQ ID NO: 26615 - protein, 320 aa, Haemophilus influenzae 86-028NP
MSTPFKMERGVKYRDAAKTSIIPVKNIDPNQELLKKPEWMKIKLPASSAKIESIKNGMRRHGLHSVCEEASCPNLHECFNHGTATFMILGAICTRRCPFCDVAHGKPLPPDPEEPQKLAETIQDMKLKYVVITSVDRDDLPDRGAGHFSECVKAVRELNPNIKIEILVPDFRGRITQALEKLKDNPPDVFNHNLENVPRLYKEIRPGADYEWSLKLLREFKEIFPNIPTKSGLMVGLGETNEEILQVMQDLRDNGVTMLTLGQYLQPSRHHLPVARYVPPTEFDEFRDKANEMGFEHAACGPFVRSSYHADLQASGGLVK

SEQ ID NO: 26616 - DNA, 1050 bp, Corynebacterium jeikeium K411
  CDS (1)..(1050): transl_table=11
atgagtgtgaccgcagatggacgccggatgctacgcatcgaggcgaagaatgccgaaacccccatcgagtcgaagcctcggtggatccgcacgaccgcgaaggtcggcccggagtatcgggatattaagaatcgcgtgaagggcgctggcctgcacaccgtgtgccaagaggctggctgcccgaatatcaacgagtgctgggaggaccgcgaggcgacgttcctcatcggcggtgatacgtgttcccgccgttgcgacttctgccagattaagtccggccgcccgtccccgctggatatggacgagccacgccgcgtggcggagaatgtccgcgagatgggtctgcgctacgccaccatcaccggcgtgacgcgcgatgacctggatgatgagggcgcgtggctgtatgccgaggttgtgaagaagattcacgagctgaacccgaacacgggtgtggagaatctgacgccagatttttccaaccgcccggagctgctgaaggtcgtcttcgattcccagccggaggtgtttgcccacaacctggagacagttccgcgcatctttaagcgcatccgcccggcctttaagtacgaccgttccctggaggtcattcaggcagctcacgattacggcctggtgacgaagtccaacctgatcctgggcatgggtgagaagaaggaagaggtccgcgcggctatcaaggacctggcagacgccggcaccgacattctgacgattacccagtacctgcgcccgtcttccatgcaccacccgattgagcgttgggtgaagccggaggagttcatggagcactccgacgcagcctacgagctgggcatcaaggctgttatgtccggcccgttggtgcgttcctcttaccgcgccggccgcctgtacgcgcaggccaagcaggcgcgcggcgaggctattccggagaacctgaagcacttggaggagactctcgattccaccacgtcgcaggaggcctctacactgctggagcgctacggcgcttcggaggacacgccggtcactgcgtcgcgccgctag

SEQ ID NO: 26617 - protein, 349 aa, Corynebacterium jeikeium K411
MSVTADGRRMLRIEAKNAETPIESKPRWIRTTAKVGPEYRDIKNRVKGAGLHTVCQEAGCPNINECWEDREATFLIGGDTCSRRCDFCQIKSGRPSPLDMDEPRRVAENVREMGLRYATITGVTRDDLDDEGAWLYAEVVKKIHELNPNTGVENLTPDFSNRPELLKVVFDSQPEVFAHNLETVPRIFKRIRPAFKYDRSLEVIQAAHDYGLVTKSNLILGMGEKKEEVRAAIKDLADAGTDILTITQYLRPSSMHHPIERWVKPEEFMEHSDAAYELGIKAVMSGPLVRSSYRAGRLYAQAKQARGEAIPENLKHLEETLDSTTSQEASTLLERYGASEDTPVTASRR

SEQ ID NO: 26618 - DNA, 927 bp, Staphylococcus haemolyticus JCSC1435
  CDS (1)..(927): transl_table=11
gtggttatggctactaaaaatgaagaaatcttacgtaaaccagattggttgaaaattaagcttaacacgaacgaaaactatattggcctcaagaagatgatgcgtgaaaagaacttacacactgtttgcgaagaagcaaagtgtccaaatatacatgaatgttggggtgctagacgtactgctacatttatgattttaggtgcagtatgtacaagagcatgtcgtttctgtgcagttaaaactggattacctaatgaactagacttaaatgaaccagaacgtgttgcagaatcagttgagttaatgaatttaaaacacgttgttatcactgcagttgcacgtgatgacttaagagatgcaggttctaacgtatatgctgaaacagtacgtaaagtacgtgaacgtaatccattcactacaattgaaatcttaccatcagacatgggtggtgactatgaagcacttgaaacattaatggcttctaaacctgatatcttaaaccataatatcgaaacagtacgtcgtttaacaccaagagttcgtgcacgtgcaacatatgaaagaacattagagttcttacgtcgttctaaagaattgcaaccagatattcctactaaatcaagcttaatggttggtttaggagaaacgattgaagagatttatgaaacaatggatgatcttcgtgcaaatgatgtagacattttaacaattggtcaatatttacaaccatcacgtaagcatttaaaagttgaaaaatactatacaccattagaatttggtaaattaagaaaagtagctatggacaaaggttttaaacactgtgaagctggcccaatggtacgtagttcttatcatgccgacgaacaagtaaatgaagcggctaaagaaaaacaccgtctaggtgaagaaaaattacaacaaaattaa

SEQ ID NO: 26619 - protein, 308 aa, Staphylococcus haemolyticus JCSC1435
MVMATKNEEILRKPDWLKIKLNTNENYIGLKKMMREKNLHTVCEEAKCPNIHECWGARRTATFMILGAVCTRACRFCAVKTGLPNELDLNEPERVAESVELMNLKHVVITAVARDDLRDAGSNVYAETVRKVRERNPFTTIEILPSDMGGDYEALETLMASKPDILNHNIETVRRLTPRVRARATYERTLEFLRRSKELQPDIPTKSSLMVGLGETIEEIYETMDDLRANDVDILTIGQYLQPSRKHLKVEKYYTPLEFGKLRKVAMDKGFKHCEAGPMVRSSYHADEQVNEAAKEKHRLGEEKLQQN

SEQ ID NO: 26620 - DNA, 1044 bp, Psychrobacter arcticum 273-4
  CDS (1)..(1044): transl_table=11
atgacaaacgccgtacaaacgcacatgcctgctgcccgtgcaaaacccaaaaaagccatccaaggcgaaaaattacgtggctacgataaagttgcacgtattccaattaaaatcatcccgactgtcgaggcaaagaaaaagccagattggattcgggtaaagctgtcttcacctgctgaagtcgcacgtatcaaatctaccttgcgtgagcaaaagctttacaccgtttgtgaagaagctgcctgccctaacctgccgcagtgttttgccgatggtaccgccacctttatgattatgggtgatatctgtacgcgtcgttgcccgttctgtgatgtcggacatggtcgccccaatgagttagataaagatgagccgcgccatactgctgagaccattcaaggtttgggtcttaaatatgccgtcattacctctgttgaccgtgatgatttaaaagatggcggcgccgcgcatttcgttgaagtattgaacgaatctcgcgcactcagcccaaattgcttaatcgagattttggtgccagatttccgtggccgtatggatatagcgttagacttattgactgaaactgcgcctgacgtctttaaccacaatatcgaaacggtgcctcgtttatataaagccttccgtccaggctctgattatcagcattcattagacttgctcaagatctataaagagcgtcgccctgatattgccaccaaatgcggctttatggttgggcttggtgaaacagaagaagaaatctataagctacttgatgatctaaaagcgcataacgtcgatatgattaccgttggtcagtacttacaaccaagtaaagaccatgcgccagtcgatcgctatgtgcatcctgatgaattccagcgttatatggactatggcaaaaagattggcttctttaacatttgggcaggtcctatggtgcgctcaagctattttgctgatcgtcaatactacggcgaagattgcccagcacctatccgtagcaaaaaagccttagcagcagaaggtaagcttggctgttaa

SEQ ID NO: 26621 - protein, 347 aa, Psychrobacter arcticum 273-4
MTNAVQTHMPAARAKPKKAIQGEKLRGYDKVARIPIKIIPTVEAKKKPDWIRVKLSSPAEVARIKSTLREQKLYTVCEEAACPNLPQCFADGTATFMIMGDICTRRCPFCDVGHGRPNELDKDEPRHTAETIQGLGLKYAVITSVDRDDLKDGGAAHFVEVLNESRALSPNCLIEILVPDFRGRMDIALDLLTETAPDVFNHNIETVPRLYKAFRPGSDYQHSLDLLKIYKERRPDIATKCGFMVGLGETEEEIYKLLDDLKAHNVDMITVGQYLQPSKDHAPVDRYVHPDEFQRYMDYGKKIGFFNIWAGPMVRSSYFADRQYYGEDCPAPIRSKKALAAEGKLGC

SEQ ID NO: 26622 - DNA, 927 bp, Candidatus Pelagibacter ubique HTCC1062
  CDS (1)..(927): transl_table=11
atgacaactaagccaagacatccagaaaaagttaacaaacctttaaatccaatcaaaaaaaaacctgattggataagatctaaacttgttaatagtaaagagttttttctaacaaaaacaattgttaataataataatttagtaacggtatgtcaggaagctaactgtccaaatatcacagaatgttggagcaaaagacatgcaacatttatgataatgggtgatacttgcacaagagcatgtgctttttgcgatgtaaaaacaggtaggcctggaaaactagactcattagaacccgttaaaatagctgaagccgtaaaaaaattaaatttaaaacatgtcgtaatcacttctgttgatagagatgatctcgacgatggaggatcaaatcatttttttgaggtaattgatcaaacaagaaaaagaaatcctaatacatcaattgaggttttaacacctgattttctaagaaaaggagatgcttataaaaaagtactagaagctaatcctgatgtttttaatcataacattgaaactgtgcctagactttatttaaaagtaagaccaggctctagatatttttcatcattagaactcttaaagaatgcaaaattagttaataaaaatgttttcacaaaatcaggattaatggttggattaggtgagaataaagaggagatcattcaagtgatggatgatctaaaagcagctgatgtagattttttaactattggtcaatacttacaaccctctgtaagacaccaccccttagatcgttattaccatccagatgaatttaaagagttagaaactattgcaaaatcaaaaggatttttattagtttcatcgacacctttaactagatcttcatatcatgcagatgaagattttgctaaacttcaactaaatagaattaacaatcattaa

SEQ ID NO: 26623 - protein, 308 aa, Candidatus Pelagibacter ubique HTCC1062
MTTKPRHPEKVNKPLNPIKKKPDWIRSKLVNSKEFFLTKTIVNNNNLVTVCQEANCPNITECWSKRHATFMIMGDTCTRACAFCDVKTGRPGKLDSLEPVKIAEAVKKLNLKHVVITSVDRDDLDDGGSNHFFEVIDQTRKRNPNTSIEVLTPDFLRKGDAYKKVLEANPDVFNHNIETVPRLYLKVRPGSRYFSSLELLKNAKLVNKNVFTKSGLMVGLGENKEEIIQVMDDLKAADVDFLTIGQYLQPSVRHHPLDRYYHPDEFKELETIAKSKGFLLVSSTPLTRSSYHADEDFAKLQLNRINNH

SEQ ID NO: 26624 - DNA, 987 bp, Colwellia psychrerythraea 34H
  CDS (1)..(987): transl_table=11
atgagtaacgacttaacatcagaatcaaaaacagccaaccgtgctgctggcgaaaaatttcgcgatgcagataaattagctcacatccctattaaagttgttagttcaacaaaagcgaccatgttacgtaaaccaagttggttacgtatcaagttaccaaaatctagtgaacgtattgataacatcaaagctaatttacgaaaaaatgaccttcattctgtttgtgaagaagcatcatgccctaatttatctgagtgttttaaccatggtactgccacctttatgattttaggtgatatttgtacgcgtcgttgccctttctgtgatgttggccatggtcgtccactggctccaaaaagtgatgaaccaaaaaagttagccaatagccttaaagatatgggcttaaagtacgtcgttattacttcagttgatagagatgatttacgtgatggtggcgcacagcaatttgcagattgtgtgaaagaaattggtgaacaagcgccaaatactaaagtcgaaatattagtacctgacttccgtggtcgtatggaccgtgcgcttgaaatactgaatcaaaaccctccacacgttttcaaccataatatggaaacagcaccacgtctttatactaaagttcgtccaggcgctaactatcaatggtcattagacttacttaaacgttttggtgaagcaaacccagacgtaaccactaaatctggtttgatggttggtttaggtgaaactaacgaagaaattttagaagtaatgcaagacttacgcgatcatggtgtaactatgcttaccgttggtcagtaccttcaaccaagtaaagatcaccttgccgttgagcgctacgttcaccctgatgactttgctatgtttgaacgtgaagcaaagaaaatgggctatgaacacgctgcttgtggtccacttgttcgttcgagctaccatgctgacaaacaagctgctggtgaagaagttaagtaa

SEQ ID NO: 26625 - protein, 328 aa, Colwellia psychrerythraea 34H
MSNDLTSESKTANRAAGEKFRDADKLAHIPIKVVSSTKATMLRKPSWLRIKLPKSSERIDNIKANLRKNDLHSVCEEASCPNLSECFNHGTATFMILGDICTRRCPFCDVGHGRPLAPKSDEPKKLANSLKDMGLKYVVITSVDRDDLRDGGAQQFADCVKEIGEQAPNTKVEILVPDFRGRMDRALEILNQNPPHVFNHNMETAPRLYTKVRPGANYQWSLDLLKRFGEANPDVTTKSGLMVGLGETNEEILEVMQDLRDHGVTMLTVGQYLQPSKDHLAVERYVHPDDFAMFEREAKKMGYEHAACGPLVRSSYHADKQAAGEEVK

SEQ ID NO: 26626 - DNA, 1008 bp, Pseudomonas syringae pv. phaseolicola 1448A
  CDS (1)..(1008): transl_table=11
atgactgacaccgtgcaaaccctgatcccgacgctggatgtttccgagcgagtggcccgtccgaaagtcgaagcgggcgttaagcttcgcggagcggaaaaggttgcgcgcatcccggtcaagatcattccaacggtagatctgccgaagaaacccgactggattcgtgtgcgcatcccggtttctccggaagtcgaccgtatcaagcaattgctgcgcaagcacaagctgcacagtgtctgtgaagaggcgtcctgcccgaacctgggcgaatgcttctccggtggcaccgcaacgttcatgatcatgggcgacatctgcacccgtcgctgcccattctgcgacgtgggccatggtcgtccgaagccgctcgacgtcaacgaaccgaagagcctcgccatcgcaattgccgacctgcgtctgaagtacgtagtgatcacctcggtggaccgtgacgacttgcgtgacggcggtgctcagcactttgccgactgcatccgcgaaatccgcctgctgtcgccgggcgtacagcttgaaacactggttcccgactaccgtggccgcatggacgtagcgctggaaatcaccgctgccgagccaccggatgtgttcaaccacaacctggaaaccgttccgcgtctgtacaaggccgcgcgtccgggttcggactaccagtggtcgttgaccctgctgcagcgcttcaaacagatggtcccgcatgtaccgaccaaatcagggctgatgctgggccttggcgagaccgacgaagaggttatcgaagtcatgcagcgcatgcgcgagcacgacatcgacatgctgacgctgggtcagtacctgcagccatcgcgcaaccaccttccggtgcagcgctttgtccaccctgacacctttgcctggtttgccgaggaaggttacaagatgggcttcaagaacgtcgcatccgggccgctggtacgctcttcgtatcatgccgacgagcaggccaagatcgccaaggcaatgctctga

SEQ ID NO: 26627 - protein, 335 aa, Pseudomonas syringae pv. phaseolicola 1448A
MTDTVQTLIPTLDVSERVARPKVEAGVKLRGAEKVARIPVKIIPTVDLPKKPDWIRVRIPVSPEVDRIKQLLRKHKLHSVCEEASCPNLGECFSGGTATFMIMGDICTRRCPFCDVGHGRPKPLDVNEPKSLAIAIADLRLKYVVITSVDRDDLRDGGAQHFADCIREIRLLSPGVQLETLVPDYRGRMDVALEITAAEPPDVFNHNLETVPRLYKAARPGSDYQWSLTLLQRFKQMVPHVPTKSGLMLGLGETDEEVIEVMQRMREHDIDMLTLGQYLQPSRNHLPVQRFVHPDTFAWFAEEGYKMGFKNVASGPLVRSSYHADEQAKIAKAML

SEQ ID NO: 26628 - DNA, 945 bp, Dechloromonas aromatica RCB
  CDS (1)..(945): transl_table=11
atggctgaaaaaggcgtcaaacaaaaaggcgaactgaaaaccgcgcgcatccccatcaagatcgtgccggtcgatacgccgctacgcaaaccggagtggattcgcgtcaaggccggcaacagcgccgggcgattcggcgagatcaagtccatgctgcgcgagaaaaagctgcacaccgtctgcgaagaagcggcctgccccaacatcggcgaatgcttcggccgcggcacggcgaccttcatgatccttggcgacatctgcacccgccgctgccctttctgcgacgttggccacggccagccgctgccgcccaacccgaacgaaccggccgagctggctgattcggtgtcgtcgctaaagctgcagtacgtggtaatcaccagcgtcgaccgcgacgacctgcgcgatggcggcgcccagcatttcgtcgatgtcgtccgtgccgtacgcgaggcctcgcccaagacgaccatcgaaaccctggtccccgacttccgtggccgcatggacatcgccatcgacattctcggcaatggcctgcccgatgtgctgaaccacaacatggaaaccgtgccccgcctgtacaagcaagcccgtcccggtgccgactacgcccattcgctggccctgatgaagcagttcaaggcacgctaccccgacgtcaagaccaagtccggcctgatggtcggcctcggcgagaccgacgaggaaatcctcgaagtcatgcgtgacctgcgggccaacgatgtcgaaatgctgactatcggccaatacctggccccgtcaggccaccacctgccggtcagccgctacgtccatcccgacactttcaaaatgttcgaggaagaagccaaaaagatgggcttctccggtgcggcctgcgccccgatggtgcgctcgagctactgggctgaccagcaggcccatagcgctggcgtcgcctga

SEQ ID NO: 26629 - protein, 314 aa, Dechloromonas aromatica RCB
MAEKGVKQKGELKTARIPIKIVPVDTPLRKPEWIRVKAGNSAGRFGEIKSMLREKKLHTVCEEAACPNIGECFGRGTATFMILGDICTRRCPFCDVGHGQPLPPNPNEPAELADSVSSLKLQYVVITSVDRDDLRDGGAQHFVDVVRAVREASPKTTIETLVPDFRGRMDIAIDILGNGLPDVLNHNMETVPRLYKQARPGADYAHSLALMKQFKARYPDVKTKSGLMVGLGETDEEILEVMRDLRANDVEMLTIGQYLAPSGHHLPVSRYVHPDTFKMFEEEAKKMGFSGAACAPMVRSSYWADQQAHSAGVA

SEQ ID NO: 26630 - DNA, 939 bp, Thermobifida fusca YX
  CDS (1)..(939): transl_table=11
gtgagcatcgctcccgagggccgccgcctgttgcggatcgaagcccgcaacagcactaccccgattgagaagaagccgccgtggatcaagatcagggcgaagatgggctcggagtacaccgagctgcacgccctggtcaaacgcgagggcctgcacacggtgtgccaggaggccgggtgccccaacatctacgagtgctgggaggaccgggaggccacgttcctcatcggcggcgaccagtgcacgcgacgctgcgacttctgccagatcgctaccgggaagccggcggcgttggaccggggggagccgctgcgggtcgccgagtcggtgcgcacgatgggtctcaagtatgcgacggtcaccggggtggcccgcgacgacttggacgacgggggcgcgtggctgtacgcggaaacggtccgcaagatccacgagttgaaccccggcaccggcgtggagctgctgatccccgacttcaacgccgacccggacctgctggccgaggtgttcagctcccggccggaggtgctggcgcacaacattgagacggtgccgcggatcttcaagcgcatccgtcccgggttccgctacgagcgttctttggaggtgatcacccgggcccgcgaggcggggctggtcaccaagtcgaatctgatcctgggcatgggcgagacccgggaggagatcagccaggcgatgcgggacctgtacgaggccgggtgcgacttgttgacgatcacccagtacctgcggccgtcccgcttgcaccacccggtggaccggtgggtgaagccggaggagttcgtggagctgggccgggaggccgaggagatcggtttcgccggggtgatgtcgggtccgctggtgcggtcgtcgtaccgggcgggccggttgtaccgccaggcgatcgagcgtcgcaaggcggacgcgaaatcgtaa

SEQ ID NO: 26631 - protein, 312 aa, Thermobifida fusca YX
MSIAPEGRRLLRIEARNSTTPIEKKPPWIKIRAKMGSEYTELHALVKREGLHTVCQEAGCPNIYECWEDREATFLIGGDQCTRRCDFCQIATGKPAALDRGEPLRVAESVRTMGLKYATVTGVARDDLDDGGAWLYAETVRKIHELNPGTGVELLIPDFNADPDLLAEVFSSRPEVLAHNIETVPRIFKRIRPGFRYERSLEVITRAREAGLVTKSNLILGMGETREEISQAMRDLYEAGCDLLTITQYLRPSRLHHPVDRWVKPEEFVELGREAEEIGFAGVMSGPLVRSSYRAGRLYRQAIERRKADAKS

SEQ ID NO: 26632 - DNA, 924 bp, Prochlorococcus marinus str. NATL2A
  CDS (1)..(924): transl_table=11
atgacaacaacaacaagaaaaacaacaaaatacagtagcttcctcccagaagagcgtttacctaattggatcaaaccatcgataggtaacgcaactcaactagagaaagttcaaaagctcgtaaaggaaaacagattacatacgatctgtgaagaaggcagatgcccgaacagaggtgaatgttatgccgctggtacggctacttttttattgggcggctcaatatgtacaaggagctgtgccttttgccaagtagaaaaaggaaagtcgccagagaaagtaaatatttttgaggcagagaaagtagcaaatgctgttcaggtattgaatcttaaatatgtggtactaacagcagtcgcaagagatgatttgccggatcacggtgcaagtctattcacgacaacaatggatgcaattagatccttgaatccaggtgtcgcaatagaggtactaacaccagatttctggggtggcaacaacaaggacaatgtcgaaaagcaaagagagcgccttaagctagttctttcggctaatccgatttgtttcaaccataatcttgaaactgtcaaaagacttcaaagagaagtcaggagaggtgctacttaccaacactcactcaatcttctcaaatttgctagagaaatcgatccaaaaattcctacaaaatcaggaataatgcttggactgggagaaaaatttcatgaaataattcaaacccttaaagaccttaggaaagtagactgtcaatatttgactatcggtcaatatttacgaccttcacttgctcacatcccagtttctcattattggtcaccaacaaagttcaatgattttgcagaaatagcaaacggattaggttttaagaaagtaaacagcggtcctttagtaagaagcagctaccatgcgaaggagaccttagattag

SEQ ID NO: 26633 - protein, 307 aa, Prochlorococcus marinus str. NATL2A
MTTTTRKTTKYSSFLPEERLPNWIKPSIGNATQLEKVQKLVKENRLHTICEEGRCPNRGECYAAGTATFLLGGSICTRSCAFCQVEKGKSPEKVNIFEAEKVANAVQVLNLKYVVLTAVARDDLPDHGASLFTTTMDAIRSLNPGVAIEVLTPDFWGGNNKDNVEKQRERLKLVLSANPICFNHNLETVKRLQREVRRGATYQHSLNLLKFAREIDPKIPTKSGIMLGLGEKFHEIIQTLKDLRKVDCQYLTIGQYLRPSLAHIPVSHYWSPTKFNDFAEIANGLGFKKVNSGPLVRSSYHAKETLD

SEQ ID NO: 26634 - DNA, 870 bp, Prochlorococcus marinus str. NATL2A
  CDS (1)..(870): transl_table=11
ttgcttaaaccagactggctacgtgttaaagcaccacagcaagagaggattggtaatgttgctgatttattagttgatttaaaactcaatacagtttgtcaggaagcaagttgtccaaatattggagagtgttttgcaggaggtactgctactttcttaataatgggacctgcttgcacgagaaaatgtccttattgcgatatttcatttgataattcaaaaaggcttttagacccatcagaacctgatcgtctaggtgaagctgtttacagaatgggcttaacgcatgtcgtcataacttccgttaatcgtgatgatttagaagatggaggcgctagtcaatttttgaaatgtattaaggctgtgcaaagtaaatctccttttacttctattgaagtcttaatcccagatctttgcggaaattgggatgctttgaaagttatcttggatgctgcgccaaatgtccttaatcacaatatcgagacagttccgaggctatatccaagagttagacctcaagggaaatatgaaaggtctttagaattattaaaaagagttcgggaaggttggccaagagtctatacaaaatcaggtttaatggctggattaggggagacagatgatgagattttgagtgttctaagtgatctccatttaaataaagttgatatagtaactattgggcaatatttatcaccaggaccaaaacatttacctgttaatagatttgtttccccttcgcaatttgatagttatcgtgttgagggagaaaataaattaggatttttacaggtcattagttcaccattaactagaagtagttatcacgctggagaagttaaaaaattaatgatgtctcatccaagataa

SEQ ID NO: 26635 - protein, 289 aa, Prochlorococcus marinus str. NATL2A
MLKPDWLRVKAPQQERIGNVADLLVDLKLNTVCQEASCPNIGECFAGGTATFLIMGPACTRKCPYCDISFDNSKRLLDPSEPDRLGEAVYRMGLTHVVITSVNRDDLEDGGASQFLKCIKAVQSKSPFTSIEVLIPDLCGNWDALKVILDAAPNVLNHNIETVPRLYPRVRPQGKYERSLELLKRVREGWPRVYTKSGLMAGLGETDDEILSVLSDLHLNKVDIVTIGQYLSPGPKHLPVNRFVSPSQFDSYRVEGENKLGFLQVISSPLTRSSYHAGEVKKLMMSHPR

SEQ ID NO: 26636 - DNA, 996 bp, Ralstonia eutropha JMP134
  CDS (1)..(996): transl_table=11
atgagcgacgccctgatcgcctcctccagcgaagccccccaatcccccgcggagcagtacgatccgacccgcaagcagaaatcggccgacaagaccgcgcgcatccccatcaagatcgtgccggccgaaaagctcaagaagccggactggatccgcgtgaaggccgccaccggcaattcgcgtttctacgagatcaaggacatcctgcgcgcgaacaacctcgtcacggtgtgcgaggaagcaagctgcccgaacatcggcgaatgcttcggcaagggcacggcgacgttcatgatcatgggcgacaagtgcacgcgccggtgcccgttctgcgacgtcggccacggccgccccgatccgctcgatgtgaacgagcccggcaacctggcccgcaccatcgcccaactcaagctcaactacgtggtcatcaccagcgttgaccgtgacgacctgcgcgacggcggtgcccagcactacgtggactgcatcagccagacgcgcgagctgtcgcccgccacccgcatcgaagtgctggtgcccgacttccgcggccgcctggacaaggcgctggacatcctgcaggcctgcccgccggacgtcatgaaccacaacatggaaacggtgccgcgcctgtacaagcaggcccgcccgggtgccgactacgcgcactcgctcaagctgctgcaggaattcaagcgccgcaacccgaacgtgccgaccaagtccggcctgatggtcggcctgggcgagaccgacgaggaaatcctcgaagtcatgcgcgacatgcgcgcgcacgatatcgacatgctgaccatcggccagtacctcgcaccgtcgaaccaccacctgccggtgctgcgctacgtgcatcccgatacgttcaagatgttcgaggaagaggcctacaagatgggcttcacccacgccgccgtgggcgcgatggtgcgcagctcgtaccacgccgaccagcaggcgcatcaggcggggtttgcctga

SEQ ID NO: 26637 - protein, 331 aa, Ralstonia eutropha JMP134
MSDALIASSSEAPQSPAEQYDPTRKQKSADKTARIPIKIVPAEKLKKPDWIRVKAATGNSRFYEIKDILRANNLVTVCEEASCPNIGECFGKGTATFMIMGDKCTRRCPFCDVGHGRPDPLDVNEPGNLARTIAQLKLNYVVITSVDRDDLRDGGAQHYVDCISQTRELSPATRIEVLVPDFRGRLDKALDILQACPPDVMNHNMETVPRLYKQARPGADYAHSLKLLQEFKRRNPNVPTKSGLMVGLGETDEEILEVMRDMRAHDIDMLTIGQYLAPSNHHLPVLRYVHPDTFKMFEEEAYKMGFTHAAVGAMVRSSYHADQQAHQAGFA

SEQ ID NO: 26638 - DNA, 942 bp, Staphylococcus saprophyticus subsp. saprophyticus ATCC 15305
  CDS (1)..(942): transl_table=11
atggctactaaaaatgaagaaattttacgtaaaccagattggttaaaaataaaactaaatactaacgaaaattatactggtcttaagaaaatgatgcgcgaaaagaatttacatacagtttgtgaagaagcaaagtgtcctaatatacacgagtgttggggtgagcgtcgtactgcaacatttatgattcttggtgcagtttgtacacgagcttgtcgtttctgtgcagttaagactggtttacctaacgaattagatttagatgagccagaacgcgtggcagaatctgtagagttaatgaatttaaaacatgttgttattactgcagttgcgcgtgatgatttaagagatgcaggttcaaatgtatacgctgaaacagtgcgtaaagtacgtgaacgtaatccatttacatcaattgaaatcttaccttcagatatgggcggagattatgatgcattagaaacattaatggcatcaaaaccggatatcttaaaccataacatcgagacagttcgccgtttgacaccgagagttcgtgctagagcgacttacgatcgtacattagagttcttgagacgttctaaagaattacaacctgatattcctacaaaatcaagtttaatggtgggattaggtgaaacacacgaggaaatttatgaaacaatggatgaccttcgtgctaatgatgtggatattttgacaataggtcaatatttacaaccttcacgtaaacacttaaaagttgaaaaatattacacacctttagaatttggtaaattaagaaaagtagcaatggataaaggttttaaacattgccaagctggtccacttgtaagaagttcttatcatgcagatgaacaagtaaatgaagctgcaaaagaaagacaccgcatcggagaagaaaaacttggtaatgaaattggtacagatacgaataactaa

SEQ ID NO: 26639 - protein, 313 aa, Staphylococcus saprophyticus subsp. saprophyticus ATCC 15305
MATKNEEILRKPDWLKIKLNTNENYTGLKKMMREKNLHTVCEEAKCPNIHECWGERRTATFMILGAVCTRACRFCAVKTGLPNELDLDEPERVAESVELMNLKHVVITAVARDDLRDAGSNVYAETVRKVRERNPFTSIEILPSDMGGDYDALETLMASKPDILNHNIETVRRLTPRVRARATYDRTLEFLRRSKELQPDIPTKSSLMVGLGETHEEIYETMDDLRANDVDILTIGQYLQPSRKHLKVEKYYTPLEFGKLRKVAMDKGFKHCQAGPLVRSSYHADEQVNEAAKERHRIGEEKLGNEIGTDTNN

SEQ ID NO: 26640 - DNA, 900 bp, Ehrlichia canis str. Jake
  CDS (1)..(900): transl_table=11
atgagaagtaagcctgattggttaaaagtgaaaatgcctacaggtgatactttttatcagatgcgtaatttgatgaagttgtacaagctaaacacggtgtgtgaggaagctgcttgcccaaatgttggtgaatgttggaataaaaaacatgcaacagtaatgattttaggttctacttgtactagagcatgtgccttttgtaatgttgctactgggattccagataagttggatcctcatgagcctcaaaacttggctaaagctatcaactcacttaaacttcatcatgttgttattacatctgttgatagggatgatttaccagatggtggagctgggcattttgttgagtgtatagaagaaatacgaaagagagatgataacattactattgaaatattaactccagattttttaaataaacatggtgcaattgataagattgctgcagtagctcctgatgtttataatcataatgtagaaactgtaccaagattatatgcaaggattaggccaaaagcacgttattttcattctctgtatttgcttaaagcagtgaaatataagaatcctaaaatatttactaaatctggaataatggtagggttaggtgaaacaaaggaagaaatatatcaggtgatggatgatttaagatcagcagatgttgattttataacaattggtcaatatttacagcctactcctaaacatgctgtagttgatagatatgtaactcctgaggaatttgatcattacaaatatgttgcatattctaaagggtttttgatggttgcttcaggtcctttagttaggtcttcatatcatgctgaagaagattttcaaaaattaaaacaaaatcgtactgctatgttaatgcgtgctgaaagtaattcgatatag

SEQ ID NO: 26641 - protein, 299 aa, Ehrlichia canis str. Jake
MRSKPDWLKVKMPTGDTFYQMRNLMKLYKLNTVCEEAACPNVGECWNKKHATVMILGSTCTRACAFCNVATGIPDKLDPHEPQNLAKAINSLKLHHVVITSVDRDDLPDGGAGHFVECIEEIRKRDDNITIEILTPDFLNKHGAIDKIAAVAPDVYNHNVETVPRLYARIRPKARYFHSLYLLKAVKYKNPKIFTKSGIMVGLGETKEEIYQVMDDLRSADVDFITIGQYLQPTPKHAVVDRYVTPEEFDHYKYVAYSKGFLMVASGPLVRSSYHAEEDFQKLKQNRTAMLMRAESNSI

SEQ ID NO: 26642 - DNA, 936 bp, Thiobacillus denitrificans ATCC 25259
  CDS (1)..(936): transl_table=11
atggcagaccccctccagcacaaaggcgcggcgaagacgtcgcgcatcccgatcaagatcgtgccgcaagagcggcaacgcctgccgccgtggatccgggcgaaggcgccgagcctaccgaacgtcggacggctcaagggcatcctgcgcgaagccaagctgcacacggtgtgcgaggaggcgtcgtgcccgaatctcggcgagtgcttcggccacggcacggcgactttcatgatccttggcgacctctgcacgcggcgttgcccgttctgtgacgtcggccacggcacgcccttgccgccggacgccgacgagccgcgtcatctcgccgaaacgatcgcgctgatggccttgaagtacgttgtcatcacgagcgtcgaccgcgacgacctgcgtgacggcggcgccgggcattttgccgagtgcatcgcggccgtgcgcgaaaaatcgccggcgacgcggatcgagatactgactcccgattttcgtggccgcctcgacaaggcgctcgcggcgctcgaccgtgccccgcccgacgtcatgaaccacaacctcgaaaccgtgccgcgcctctacaaggccgcgcgcccgggcgccgactacgcgcattcgctcaaactgctgcaggatttcaggacgcgccaccccgacatcccgaccaagtcgggcctgatgctcgggctgggcgaaaccgacgacgagatcctcgaggtcatgcgcgacctgcgcgcgcacggcgtagacatgctgaccctaggccagtacctgcagccctcgcggcaccatctggcggtgctgcgcttcgtcacccccgagcgctttgcgcagttcgagcaggaagcattggcgatgggtttccggcacgcggcctgcgggccgatggtgcgctcgagctaccacgccgaccagcaggccgccgcggcagcggcaggttag

SEQ ID NO: 26643 - protein, 311 aa, Thiobacillus denitrificans ATCC 25259
MADPLQHKGAAKTSRIPIKIVPQERQRLPPWIRAKAPSLPNVGRLKGILREAKLHTVCEEASCPNLGECFGHGTATFMILGDLCTRRCPFCDVGHGTPLPPDADEPRHLAETIALMALKYVVITSVDRDDLRDGGAGHFAECIAAVREKSPATRIEILTPDFRGRLDKALAALDRAPPDVMNHNLETVPRLYKAARPGADYAHSLKLLQDFRTRHPDIPTKSGLMLGLGETDDEILEVMRDLRAHGVDMLTLGQYLQPSRHHLAVLRFVTPERFAQFEQEALAMGFRHAACGPMVRSSYHADQQAAAAAAG

SEQ ID NO: 26644 - DNA, 963 bp, Haemophilus somnus 129PT
  CDS (1)..(963)
atgacaaccccttttaaaatggaacgtggtgtcaaatatcgtgatgctgcaaaaacgtcaatcattccggttaaaaatatcgatcccaatcaggagttattaaaaaaacctgaatggatgaaaatcaagcttcctgcaaattctgcgaaaattaacagtattaaaaacggaatgcgtcgtcatggattacattccgtatgtgaagaagcgtcttgtccaaatttacatgaatgcttcaatcacggcacagcaacatttatgattttaggtgcaatttgtacacgccgatgtccattctgcgatgttgcccatggaaaaccattacccccagatccggatgaaccaaaaaaattggcggaaactattcaagatatgaaattacgttatgtcgttattacatcagtggatcgtgatgatttaccggatcgtggtgcgggacattttgctgaatgtgttaaagaaattcgtaaacttaatccaggtattaaaattgaaattttggtgcctgattttcgtggacgcattgagcaagcattagaaaaattaaaagataatccccctgatgtttttaaccataatttagaaaatgtacctcgtttatatcgtgaaatcagaccaggtgcggactataattggtcgttaaaattactcaaagaatttaaaaccatttttccacatatccctaccaaatcaggcattatggttggcttgggagaaaccaatgaagaaattttacaggtaatgcaggacttacgggataacggtgtaaccatgttgactctaggtcaatatttgcaaccaagtcgccaccacttacctgttgcccgatacgttccacctgaggaatttgatgatttccgtgataaagccgaaaaaatgggatttgagcatgccgcttgcggaccttttgtgcgttcttcgtatcatgctgacttacaagcaagtggcgggctagtcaaataa

SEQ ID NO: 26645 - protein, 320 aa, Haemophilus somnus 129PT
MTTPFKMERGVKYRDAAKTSIIPVKNIDPNQELLKKPEWMKIKLPANSAKINSIKNGMRRHGLHSVCEEASCPNLHECFNHGTATFMILGAICTRRCPFCDVAHGKPLPPDPDEPKKLAETIQDMKLRYVVITSVDRDDLPDRGAGHFAECVKEIRKLNPGIKIEILVPDFRGRIEQALEKLKDNPPDVFNHNLENVPRLYREIRPGADYNWSLKLLKEFKTIFPHIPTKSGIMVGLGETNEEILQVMQDLRDNGVTMLTLGQYLQPSRHHLPVARYVPPEEFDDFRDKAEKMGFEHAACGPFVRSSYHADLQASGGLVK

SEQ ID NO: 26646 - DNA, 972 bp, Pseudomonas aeruginosa UCBPP-PA14
  CDS (1)..(972)
atggagaagtccggagaagccaagccgggcaaggtggaagtcggcgtgaagctgcgcggcgcggaaaaggtcgcgcggattccggtgaagatcattcccaccgaggaactgccgaagaaacccgactggatccgcgtgcgcatcccggtttcccccgaggtcgaccgcatcaagcaactgctgcgcaagcacaagctgcacagcgtctgcgaagaggcgtcctgcccgaacctgggcgagtgcttctccggcggcaccgcgaccttcatgatcatgggcgatatctgcacccgacgctgcccgttctgcgacgtcggtcatggccggccgaagccgctggacgtcgacgagccgaccaacctggccatcgccatcgccgacctgcggctgaagtacgtggtgatcacctcggtggaccgcgacgacctgcgcgacggcggcgcccagcacttcgccgactgcctgcgcgagatccgcaagctgtcgccggggatccagctggaaaccctggtgcccgactatcgcggtcgcatggacatcgccctggagatcaccgccaacgagccgccggacgtgttcaaccataacctggagacggtaccgcgcctgtaccgctcctcgcggccgggctcggacttcgagtggtcgctggacctgctgcagaagttcaagcagatggttccgcacgtaccgaccaagtccgggctgatgctcggcctgggcgagaccgacgacgaggtcatcgaggtcatgcagcggatgcgcgagcacgacatcgacatgctgaccctcggccagtacctgcagccgtcgcgcaaccacctgccggtgcagcgcttcgtgcatccggacaccttcgcctggttcgccgaggaaggcgagaagatgggcttcaagaacgtcgcgtccggcccgctggtgcgttcgtcctaccatgccgaccagcaggcgcacggcaacaagatcggctga

SEQ ID NO: 26647 - protein, 323 aa, Pseudomonas aeruginosa UCBPP-PA14
MEKSGEAKPGKVEVGVKLRGAEKVARIPVKIIPTEELPKKPDWIRVRIPVSPEVDRIKQLLRKHKLHSVCEEASCPNLGECFSGGTATFMIMGDICTRRCPFCDVGHGRPKPLDVDEPTNLAIAIADLRLKYVVITSVDRDDLRDGGAQHFADCLREIRKLSPGIQLETLVPDYRGRMDIALEITANEPPDVFNHNLETVPRLYRSSRPGSDFEWSLDLLQKFKQMVPHVPTKSGLMLGLGETDDEVIEVMQRMREHDIDMLTLGQYLQPSRNHLPVQRFVHPDTFAWFAEEGEKMGFKNVASGPLVRSSYHADQQAHGNKIG

SEQ ID NO: 26648 - DNA, 999 bp, Pseudomonas fluorescens PfO-1
  CDS (1)..(999)
atgatcccgacgctcgacgtgaccgagcgcccggccccgcgtcccaaggttgaagccggcgtcaagctgcgcggcgccgagaaggttgcacgcatcccggtgaagatcattccgaccaccgaactgccgaagaaacccgactggatccgcgtgcgcatcccggtttcgccggaagtcgaccgcatcaagagcctgctgcgcaagcacaagctgcacagcgtctgcgaagaggcgtcctgcccgaacctgggcgagtgcttctccggcggcaccgcgaccttcatgatcatgggtgacatctgcacccgtcgttgcccgttctgcgacgttggccacggtcgtccgaaaccactggacgtcaatgagccggaaagcctggccatcgccatcgccgacctgaaactcaagtacgtggtgatcacctcggttgaccgcgacgacctgcgtgacggcggtgcccagcactttgccgactgcatccgcgaaatccgcaaactgtcgccgaacgtgcagctcgagaccctggtcccggactatcgtggccgcatggacatcgccctggaaatcaccgcggccgagccgccggacgtgttcaaccacaacctggaaaccgtaccgcgcctgtacaaggctgcgcgtccgggttcggactaccagtggtcgctgactctgttgcaacgcttcaagcagatgatgccgcacatcccgaccaaatccggcctgatgctgggtctgggcgagaccgacgacgaagtcatcgaagtcatgaagcgcatgcgcgaacacgatatcgacatgctgaccctgggccagtacctgcaaccgtcccgcagccacttgccggtgcagcgtttcgtgcacccggacaccttcgcctggttcgccgaggaaggttacaagatgggcttcaagaacgtcgcgtccggcccattggtgcgttcttcgtaccacgctgacgagcaagcgaaactggtcaaggccgagctgctcggttcctga

SEQ ID NO: 26649 - protein, 332 aa, Pseudomonas fluorescens PfO-1
MIPTLDVTERPAPRPKVEAGVKLRGAEKVARIPVKIIPTTELPKKPDWIRVRIPVSPEVDRIKSLLRKHKLHSVCEEASCPNLGECFSGGTATFMIMGDICTRRCPFCDVGHGRPKPLDVNEPESLAIAIADLKLKYVVITSVDRDDLRDGGAQHFADCIREIRKLSPNVQLETLVPDYRGRMDIALEITAAEPPDVFNHNLETVPRLYKAARPGSDYQWSLTLLQRFKQMMPHIPTKSGLMLGLGETDDEVIEVMKRMREHDIDMLTLGQYLQPSRSHLPVQRFVHPDTFAWFAEEGYKMGFKNVASGPLVRSSYHADEQAKLVKAELLGS

SEQ ID NO: 26650 - DNA, 1068 bp, Microbulbifer degradans 2-40
  CDS (1)..(1068)
atgagcgaatcctcagagaacaacactggcgtacaaagccatgaacccaacgcggccacaagccaagaaagcgtaatgatgtccgatgcaatagcaaccgacggcgtgcctgttaaacgcacccgccgcattaaacagggcgaaaaactgcgcgatgccgataaggtagagcgtatccccgtaaaagtaattgcaacggatagcatgctgcgcaaacccgattggattcgcattcgcgtaaaagccgaccccgaagtggatcgtattaaaaaactactgcgcaaaaacaaactgtctacggtttgtgaagaagccaactgccctaacctaagcgaatgctttggcggcggtactgctacctttatgatcatgggcgatatctgtactcgtcgctgccctttttgcgacgtgggccacggcaagcccaacccgttagacgagaatgagccaaaacacttggccgaagctatcgccgatatgggcctcaaatacgtggtggttacctcggtggaccgcgacgacttgcgcgatggcggtgctcagcattttgccgactgtatccgtgaatcccgtgcgctttcgcccaacctgcaggtagaaattctcaccccagattttcgtggccgcatggatatagcgttagatattctcgccaacgagccgcccgatgtatttaaccacaacctagaaaccgtgccgcgtttgtaccgcgaggcgcgcccaggtgccaattacaaatggtcgctcgagctgcttaaaaagtacaaagcgcttaggccagaagtgcttactaaatctggcttgatggtaggtttaggggaaaccaaagaagaaatctttgaaaccctgaaagatatgcgcgaacacgatatagacatgttaaccatcggtcagtacctacagccgtcgcgcgatcacttgccggttaaacgctatgtagagcctgcagagtttgacgagtacaccgcaatggcagagcagctaggctttaagcacgccgcttgtggcccgcttgtgcgctcgtcctaccatgccgataaacaagctcacggtgaagaagttaagtaa

SEQ ID NO: 26651 - protein, 355 aa, Microbulbifer degradans 2-40
MSESSENNTGVQSHEPNAATSQESVMMSDAIATDGVPVKRTRRIKQGEKLRDADKVERIPVKVIATDSMLRKPDWIRIRVKADPEVDRIKKLLRKNKLSTVCEEANCPNLSECFGGGTATFMIMGDICTRRCPFCDVGHGKPNPLDENEPKHLAEAIADMGLKYVVVTSVDRDDLRDGGAQHFADCIRESRALSPNLQVEILTPDFRGRMDIALDILANEPPDVFNHNLETVPRLYREARPGANYKWSLELLKKYKALRPEVLTKSGLMVGLGETKEEIFETLKDMREHDIDMLTIGQYLQPSRDHLPVKRYVEPAEFDEYTAMAEQLGFKHAACGPLVRSSYHADKQAHGEEVK

SEQ ID NO: 26652 - DNA, 978 bp, Methylobacillus flagellatus KT
  CDS (1)..(978): transl_table=11
atgacagaaattaccgaacgtatcgtcccgccgccccgcaaggtcgcgggcgtcaaggaatccagcgccgagaagatggcgcgcatcccgatcaagatcattcccatgccggctatgcgcaagccggaatggatacgcatgaaagtgccggatagcgcacgtttccgcgaaatcaagcaggtgctgcgcgagaataatctacatactgtctgtgaagaagcatcctgtcccaatatcggggaatgcttcagtggcggcaccgccacgttcatgatccttggcgacatttgcacccgccgttgcccgttttgcgatgtatctcatggcaaaccattgccacccgatgccaacgagcctgaaaacctgggccgtaccattgcccagatgcgcctcaagtatgtcgtcatcaccagtgtggaccgcgacgacttgcgtgacggtggcgcgcagcattttgtcgattgcatcgcagcagtacgcgcccactcaccacagatcaaggtggaaatcctcgtgcctgacttccgcggccgcctggatcgcgccatccatattctcaaggccgctcctcccgacgtcatgaaccacaatctggaaactgtgccgcgactatacaaggaggcgcgccctggctccgattaccagaactcgctggatttgctcaaggaattcggcaagctgcaccccgaagtgccaaccaagtccggcctgatgctggggttgggcgaaaccgacgaggaaattttggatgtcatgcgcgacctgcgggcgcacaatgtcaccatgttgaccctcggccaatatctgcagcccagcccgcaccatttgccggtcaagcgtttcgtcacgccgcaacgctttgccgagttcgagcggcaagcccttgccatggggttcacccatgccgcctgcggccccatggtgcgctcctcctaccatgccgatcatcaggcacaacaagcaggtgtcaatttctaa

SEQ ID NO: 26653 - protein, 325 aa, Methylobacillus flagellatus KT
MTEITERIVPPPRKVAGVKESSAEKMARIPIKIIPMPAMRKPEWIRMKVPDSARFREIKQVLRENNLHTVCEEASCPNIGECFSGGTATFMILGDICTRRCPFCDVSHGKPLPPDANEPENLGRTIAQMRLKYVVITSVDRDDLRDGGAQHFVDCIAAVRAHSPQIKVEILVPDFRGRLDRAIHILKAAPPDVMNHNLETVPRLYKEARPGSDYQNSLDLLKEFGKLHPEVPTKSGLMLGLGETDEEILDVMRDLRAHNVTMLTLGQYLQPSPHHLPVKRFVTPQRFAEFERQALAMGFTHAACGPMVRSSYHADHQAQQAGVNF

SEQ ID NO: 26654 - DNA, 966 bp, Shewanella baltica OS155
  CDS (1)..(966): transl_table=11
atgaataggcctgaacgtttacaacccggagtaaaattaagagatgccgataaagtgtctcgtattccggtcaaaatcgtcccctcagagcgcgacactatgttgcgtaaacccgattggttacgggttaaactgccggcatcgaatcaacgcattttagagatcaagcaagcgctgcgtaaaaatggcctgcactctgtctgtgaagaggcatcttgccctaacctcgcagaatgctttaaccacggcactgcgacctttatgattttgggtgcgatttgtacacgtcgttgcccattctgcgacgtagcccatggtcgtccgcttaagcctgacgctgaagagccggttaaattggcgcaaacaatccgcgatatgaagctgaaatacgtggtcattacctcggtagatcgtgacgatttacgtgatggtggcgcccagcattttgccgattgtatccgcgaaattcgtaaactgaatccagacatcaagatcgaaaccttagtacctgatttccgtggtcgtatcgatgctgccttagatattttatcgactgagccgcctgatgtgttcaaccacaacttagaaacggcgccaatgcattatcgtaaagcgcgcccaggtgcgaattaccaatggtcgctcgatctgctaaaacgctttaaagaacgtcatccaaatgtgccaactaagtcaggcctgatgatgggactgggtgagaccaacgaagaaatcgctcaagtattacgtgacttgcgcgcccacaacgttgaaatgctgaccttaggccaatacctacagccgtctaagttccacttgccggttgaacgttatgtgccaccagcagagtttgacgagcttaaagccttagccgatgagctaggttttacccatgcagcctgtggcccattagtgcgctcaagctaccatgcagacttgcaggcccaaggtaaagaagtgaaataa

SEQ ID NO: 26655 - protein, 321 aa, Shewanella baltica OS155
MNRPERLQPGVKLRDADKVSRIPVKIVPSERDTMLRKPDWLRVKLPASNQRILEIKQALRKNGLHSVCEEASCPNLAECFNHGTATFMILGAICTRRCPFCDVAHGRPLKPDAEEPVKLAQTIRDMKLKYVVITSVDRDDLRDGGAQHFADCIREIRKLNPDIKIETLVPDFRGRIDAALDILSTEPPDVFNHNLETAPMHYRKARPGANYQWSLDLLKRFKERHPNVPTKSGLMMGLGETNEEIAQVLRDLRAHNVEMLTLGQYLQPSKFHLPVERYVPPAEFDELKALADELGFTHAACGPLVRSSYHADLQAQGKEVK

SEQ ID NO: 26656 - DNA, 879 bp, Prosthecochloris aestuarii DSM 271
  CDS (1)..(879): transl_table=11
atgaagattcaacgaaaacccgattggctgaaactcaggctttcgggaacggctcaatttgcatcaaccaggaaactgattgccgggtatggtctcaataccgtctgccgctcggcgcagtgcccgaacctgcacgaatgctggtcatcgggaacggctacctttctgctgcttggcaatacctgtacacgaagctgcaggttctgcgctgtaggcacaaaaaaggatcttcctcccccagacccgaacgaaccggaaaacgtcgcgcaagctgtccggaaaatgaaactcacccacgtcgtcctgacaagcgtcacccgagatgatctctccgatttcggttccggggcctgggctgaaacgatcagaaaaattcgcgaatccaatcccgataccaccatagaatgcctgattcctgatttcaggggaaatctggacgccctcgatagcgtgatgcaactccgtccggaggtgctcaatcacaatgtggaaaccgttccttcctgctacgcctcagtgcgccctgaagccgagtaccgtcaatcactcggggtacttcgtctggctgcatcaacctatggactgcaggcaaaatcaggccttatggtcggtctgggcgagacccctgaagaggtatacgaggtgcttgacgatcttctggcctacggctgccgtcacatcaccatcggtcagtacctgcagccatccaaacaccactatccggttcaacgatacgtcccaccggaagagtttgaccaataccgaacttacgcactcgaaaaaggatgcacaacggtccagtcaggcccctatgttcgaagttcctatcacgctgcagaatgcgtagagaacaagcataatacacttaccacaacgtaa

SEQ ID NO: 26657 - protein, 292 aa, Prosthecochloris aestuarii DSM 271
MKIQRKPDWLKLRLSGTAQFASTRKLIAGYGLNTVCRSAQCPNLHECWSSGTATFLLLGNTCTRSCRFCAVGTKKDLPPPDPNEPENVAQAVRKMKLTHVVLTSVTRDDLSDFGSGAWAETIRKIRESNPDTTIECLIPDFRGNLDALDSVMQLRPEVLNHNVETVPSCYASVRPEAEYRQSLGVLRLAASTYGLQAKSGLMVGLGETPEEVYEVLDDLLAYGCRHITIGQYLQPSKHHYPVQRYVPPEEFDQYRTYALEKGCTTVQSGPYVRSSYHAAECVENKHNTLTTT

SEQ ID NO: 26658 - DNA, 960 bp, Nitrobacter winogradskyi Nb
  CDS (1)..(960): transl_table=11
atggtcgtcatcctcgatacgatttccgccaatcctgtccggccgcggcatccggagaaggccaaccggccggatgcgttgtcgccgccgaaacccgactggattcgcgtgcgcgcgccgaacacgcgcggctatgcgaatacgcgccggatcgtcaaggagaacggactggtcaccgtatgcgaggaggcgggctgcccgaacatcggcgagtgctgggacaagaaacacgccaccttcatgatcatgggcgacacctgcacccgcgcctgcgccttctgcaatgtcaagacgggaatgcccggtgcgatcgagtcgtccgagcccgaatacgtggctgaagcgacgcgcaagctggggttggcgcacgtcgtcgtcacatccgtcgatcgcgacgatctcgatgacggaggcgcggaacatttcgcgcagacgatacgcgctatccgtgagcgttgtccggcgacgacgatcgagatcctgacgcccgattttcttcgcaaggacggcgcgctggaaaaggtggtggcggcgaagcccgatgtcttcaaccacaatctcgaaaccgttccgtcgcgttacctgactgtgcggcccggcgcgcgctatttccactcgatccgcctgttgcaacgggtgaaggagatcgacccggcgatcttcaccaagtccggcatcatggtcgggcttggcgaggagcgtcacgaggtcttgcaggtgatggacgatctgcggtcggcggatgtcgactttcttaccatcgggcaatacctgcagccgacccgcaagcatcacgccgtgatacgttacgtcacgccggaggagttttcgagctatgagactgtcgcttacaccaagggttttctgatggtatcggcaagcccgctgacgcgctcgtcgcatcacgccggcgaggactttgcaaagttgcaggccgcccgcgccacgttgtcgcggtaa

SEQ ID NO: 26659 - protein, 319 aa, Nitrobacter winogradskyi Nb
MVVILDTISANPVRPRHPEKANRPDALSPPKPDWIRVRAPNTRGYANTRRIVKENGLVTVCEEAGCPNIGECWDKKHATFMIMGDTCTRACAFCNVKTGMPGAIESSEPEYVAEATRKLGLAHVVVTSVDRDDLDDGGAEHFAQTIRAIRERCPATTIEILTPDFLRKDGALEKVVAAKPDVFNHNLETVPSRYLTVRPGARYFHSIRLLQRVKEIDPAIFTKSGIMVGLGEERHEVLQVMDDLRSADVDFLTIGQYLQPTRKHHAVIRYVTPEEFSSYETVAYTKGFLMVSASPLTRSSHHAGEDFAKLQAARATLSR

SEQ ID NO: 26660 - DNA, 1233 bp, Leishmania major
  CDS (1)..(1233)
atgtgcccgacggctgtgccgagccgcgtctcgccggttgctgctgctgccgccgccgatatcgcgggttcctcagaatcgacagtcagcctcgtggcagatgtggacaagaaaaactcgcaatacaagcagatctttctggagcgctttcgcaagaagcttcagtcggacaagacgggcatgaacaacttggagagttttgtggagctgcccgagggtgtcgcgccgtcggcggcgtcgattggtcctatcaagcggggaagtgagccactcccgccgtggataaagctaaaggtgccaaagggcatgacgcaccgtccgcgattcaaccgcatccgccgcagcatgcgcgagaagaatctgtcgaccgtgtgcgaggaggccaaatgccccaatattggtgagtgctggggcggcagcgacgaggagggcacggcgacggccaccatcatggtgatgggctcgcactgcacccgcgggtgccggttttgctcggtgctgacaagccgccgcccgcctccgttggacccggaggagccagagaaggtcgcggccgcggtgcacgagatgggcgtggactacatcgtaatgacgatggttgaccgtgacgacttgccagacggcggtgcctcgcatgtgtgctgctgcatccataccattaagaagaagaatccggagctgatgctggaggctctcgtcggcgacttccacggtgatctgaagctggtggagcagttggcggttaccccgctgagtgtgtacgcgcacaacatcgagtgcgtggagcgcattacgccgcgcgtgcgtgaccggcgagcctcgtacaggcagtcgctgcaaacgctcgagcacgttacgaagtggaccaatggcaacatgctcacaaagagcagtatcatgctgggcctcggcgaggaagaagcggaagtgcggcagacgctgcgcgatctgcgcacggctggtgtgtcggcggtgacccttggccagtacctgcaaccctcacacacccgtctgaaggtgtcccgctacgcccacccgaaagagttcgagatgtgggagaaggaagcgatggacatggggttcctctactgtgcctcgggcccgatggtgcgcagctcctacagggctggcgagtactacatcaagaacattctgaagcaacgtcagagcgccgagggtggaaaggctgcggcggccgccaccgctgtcaacgcaggtactgcgattgcgtga

SEQ ID NO: 26661 - protein, 410 aa, Leishmania major
MCPTAVPSRVSPVAAAAAADIAGSSESTVSLVADVDKKNSQYKQIFLERFRKKLQSDKTGMNNLESFVELPEGVAPSAASIGPIKRGSEPLPPWIKLKVPKGMTHRPRFNRIRRSMREKNLSTVCEEAKCPNIGECWGGSDEEGTATATIMVMGSHCTRGCRFCSVLTSRRPPPLDPEEPEKVAAAVHEMGVDYIVMTMVDRDDLPDGGASHVCCCIHTIKKKNPELMLEALVGDFHGDLKLVEQLAVTPLSVYAHNIECVERITPRVRDRRASYRQSLQTLEHVTKWTNGNMLTKSSIMLGLGEEEAEVRQTLRDLRTAGVSAVTLGQYLQPSHTRLKVSRYAHPKEFEMWEKEAMDMGFLYCASGPMVRSSYRAGEYYIKNILKQRQSAEGGKAAAAATAVNAGTAIA

SEQ ID NO: 26662 - DNA, 1113 bp, Oryza sativa
  CDS (1)..(1113)
atgatgcagagctcgctcgcgcggccgttgccgcggcccccgatccggccggcctgcgggaaccctgtctgccggagccggcccggctcggtctccgtggcccggtgccgcgcggaggctgcgccgccggctccggcgccggcggcgcgtagggcggcggggccgtacaccgggagggacccggaggtgaagaagccggcgtggctgcggcagcgtgcggcgcagggggagaagtacgcgcggctgcgggagtcgatcggcgagctcaagctcaacaccgtctgcgtcgaggcccagtgccccaacatcggcgagtgctggaacggtgggggaggggcgggcggggaaggcgacggcatcgccacggcgaccatcatggtgctcggtgatacctgtacgcgcggctgccgtttctgtgccgtgaagactagcaacaagcctccaccaccggatcccctggagcctctgaacacggccttggcagttgcaagctggggagtggactatgttgtactgaccagtgttgacagagatgacttgcctgatggtggtagcagccattttgcgcagacagtgagagctttaaaggagctcaaacctgggatactggtggagtgcttgacctcagattttcgaggtgacctggaggctgtttcagctttggccaactctggtctggatgtatttgcgcacaacatcgagactgtgaggagcctgcaaagaattgttagggatcctcgagcaggatatgatcagagcttagctgttctgaagcatgcaaaaagttgcaaagagggtatgataactaagtcctctatcatgcttggtcttggagagactgacgaggaggtgaaacaagccatgattgacttaagggccattggtgttgatatcttgacactgggccagtatttgcagcccactgaaagacatttgacagtaagggagtatgtaactcctgagaagttccaattttggaaggagtatggagaatcggtgggtttccgctatgttgctagtggacccctggttcggtcttcatatcgtgcaggagagctctttgtccaaaatttggtcaggaataacaaacctaagctacctgcttcatcttag

SEQ ID NO: 26663 - protein, 370 aa, Oryza sativa
MMQSSLARPLPRPPIRPACGNPVCRSRPGSVSVARCRAEAAPPAPAPAARRAAGPYTGRDPEVKKPAWLRQRAAQGEKYARLRESIGELKLNTVCVEAQCPNIGECWNGGGGAGGEGDGIATATIMVLGDTCTRGCRFCAVKTSNKPPPPDPLEPLNTALAVASWGVDYVVLTSVDRDDLPDGGSSHFAQTVRALKELKPGILVECLTSDFRGDLEAVSALANSGLDVFAHNIETVRSLQRIVRDPRAGYDQSLAVLKHAKSCKEGMITKSSIMLGLGETDEEVKQAMIDLRAIGVDILTLGQYLQPTERHLTVREYVTPEKFQFWKEYGESVGFRYVASGPLVRSSYRAGELFVQNLVRNNKPKLPASS

SEQ ID NO: 26664 - DNA, 1119 bp, Xenopus laevis
  CDS (1)..(1119)
atgaggcaatgcgggcttgtcagagcggcacaacttctgcggacttgcgggttagctgaatggcataccccttacagagcattaagcagtctgccagatgagaagaaggaactcattaagaatggacctgaccttcaagactttctgtcgggagagctggttgataagagttcctgggctgcatacaaaggagacttaaagagacagaaaggagagagattaagacttccaccttgggtgaagactgaaattccaatgggtaaaaattataacaaactgaaaaacaccttgcgaaaccttaatcttcacactgtgtgtgaagaagctcgctgtcctaatattggggagtgctgggggggaggagaatatggcacggccacagcaaccataatgttaatgggtgacacgtgtacccgaggttgccgtttctgttcagtgaaaactgcaaggaaccctcctcccctggacccagatgagccatataatacctcaaaagcaattgcagagtggggcctggattatgtggtgctgacatcagtagaccgagatgatatttcagatgggggcgctgaacacattgcacaaacagtatcgatgttaaaagagagaaacaagaccattcttattgaatgcctcaccccagatttccgagggaacatgaaggcagtggagactgtagctaagtctggattggatgtttatgctcacaatgtggagactgtgccagcactgcagaggcatgtacgtgatccaagagctaattttgaccagtcccttaatgttctgaaacacgccaaaaatgtacggccggatcttgtatccaaaacgtccatcatgcttggcttaggggaaacagacgagcaaatctactccacaatgaaagcactgagagaagcgggcgtggactgtttgacccttggtcagtacatgcagccaacaaaacgtcatctcaaggtagaggagtacatcactccagagaaatttaagtactgggaaaaagcaggcaatgaattaggattcctttacacggctagtggtcctctagttcgctcttcttacaaagcaggtgaattctttttgaagaacttgattgaaaaaaggaaaacaaaagctatttaa

SEQ ID NO: 26665 - protein, 372 aa, Xenopus laevis
MRQCGLVRAAQLLRTCGLAEWHTPYRALSSLPDEKKELIKNGPDLQDFLSGELVDKSSWAAYKGDLKRQKGERLRLPPWVKTEIPMGKNYNKLKNTLRNLNLHTVCEEARCPNIGECWGGGEYGTATATIMLMGDTCTRGCRFCSVKTARNPPPLDPDEPYNTSKAIAEWGLDYVVLTSVDRDDISDGGAEHIAQTVSMLKERNKTILIECLTPDFRGNMKAVETVAKSGLDVYAHNVETVPALQRHVRDPRANFDQSLNVLKHAKNVRPDLVSKTSIMLGLGETDEQIYSTMKALREAGVDCLTLGQYMQPTKRHLKVEEYITPEKFKYWEKAGNELGFLYTASGPLVRSSYKAGEFFLKNLIEKRKTKAI

SEQ ID NO: 26666 - DNA, 1632 bp, Toxoplasma gondii
  CDS (1)..(1632)
atggcgtatttctttgacttcccaacggacacttgggtcgaagacgcgtcgccgggtgggccgccgaaacgagctttcgggcacggcttagccgcaggtagttcccatttcgcttcccctgtttctcggaggcgactgccgacgatcacggcgcttctcctgttttcgctcttgtctgcgtctcaatcaggagctctgagtgtttctcagtgttcccggagagtgtcgctcggcccgcttctttcgcgcgtctcgtcagtttcgtgtaccccttctgccgctgcttcggctctcgcttcttctctctatcccaccgacagcctgtcgtccgtggaaggttctgtcgcgcctcgcccgcctccttctagtctggctttcgtgttgcgtcgggtgcctcccgcggcctattcttcttctctgtctccctctgtcctgcgcttcaagcactcacttccccgtccccttcaggggtcgcttgtgtgcgctcctggaattttgggcggggcagccggctctgcgcgtttcgccgggtgttgcggatctcagggccggtcttgcgggtctggaaaaaaccccgagttgccgctaaagggaagcaaagacgaggtcattccccgggtcgggacaagcaccgctggaccccgtcccgattggttccacgtgccagctccacaggccgcctctcgcggagctgaggagtcgcgctaccagcaactgcagaaacaaatccgtggccttgacctccatacggtctgtgaagaggccaagtgtccgaacatcggagagtgctggaatggaggcactgcaacgcttattctgctgggtgacacgtgcacgcgaggctgtcgtttttgtgcaattaaaacttcgagcaagccgcctcctcccgaccccctggaaccggagaaagtggcggacgcagtggccaagtgggacatcgactacgtggtcatgacaagcgttgacagagatgacatgcccgacggaggtgcaggtcacttcgctcgaacagtccagttggtcaagaaggctaaaccttcgatgctcatcgaatgccttgtctccgactttcaaggaatggaagagtccgtccgaacactcgcccaatcggggttggatgtgtacgcgcataacatcgagacagttcggaggttgacgccctatgttcgcgacaagagagcgaagtacgaccagtccctgcgtgtccttcacctagcgaaacagttcaacccgtcgctgttcacaaagtcatccataatgcttggcctgggtgaaacctcagaagaggtggttcggactctccgggatcttcgagatcacgacgtcgacgttgttaccctcggacagtatctccgaccaacaaaacaacagcttggggtcgtggagtatgtcactccagaaaccttcaaaaaatatcaagacatagcggaggagatgggattcaagtatgtggctagtggcccgctggtgcgctcatcttacaaggcaggggagtactacatgaagcaccttattgatgatgcaaggaagcacggccgacgtgaaacagtgaaacaggttaagctggaagctgatgtcggcacactgaaagggacaacaacaacatttcaagtaaacgagaaagaggcgtga

SEQ ID NO: 26667 - protein, 543 aa, Toxoplasma gondii
MAYFFDFPTDTWVEDASPGGPPKRAFGHGLAAGSSHFASPVSRRRLPTITALLLFSLLSASQSGALSVSQCSRRVSLGPLLSRVSSVSCTPSAAASALASSLYPTDSLSSVEGSVAPRPPPSSLAFVLRRVPPAAYSSSLSPSVLRFKHSLPRPLQGSLVCAPGILGGAAGSARFAGCCGSQGRSCGSGKNPELPLKGSKDEVIPRVGTSTAGPRPDWFHVPAPQAASRGAEESRYQQLQKQIRGLDLHTVCEEAKCPNIGECWNGGTATLILLGDTCTRGCRFCAIKTSSKPPPPDPLEPEKVADAVAKWDIDYVVMTSVDRDDMPDGGAGHFARTVQLVKKAKPSMLIECLVSDFQGMEESVRTLAQSGLDVYAHNIETVRRLTPYVRDKRAKYDQSLRVLHLAKQFNPSLFTKSSIMLGLGETSEEVVRTLRDLRDHDVDVVTLGQYLRPTKQQLGVVEYVTPETFKKYQDIAEEMGFKYVASGPLVRSSYKAGEYYMKHLIDDARKHGRRETVKQVKLEADVGTLKGTTTTFQVNEKEA

SEQ ID NO: 26668 - DNA, 1386 bp, Mus musculus
  CDS (105)..(1226)
ggacgtatcgcgtcatgactcaagcgacgagttgttggacgcgtccggtgccgggggtgctgttccctcgatcccttgacactcctgagacctaaaagagggggatggctctacgctgctgggatacagctcgcagcctggggtcccggatatttggaagatatgcgttcacggttagagcattaagttctttgccagataagaaaaaggaatttttgcataatggaccagaccttcaagattttgtatctggtgatcttgcagacaagagtacatgggatgaatataaaggaaacttaaagcgccagaaaggagaaaggctaagactacctccatggctaaagacaaagatacccatgggtaaaaactacaataaactgaaaaatacattgcggaatttaagtctccacacagtgtgtgaggaagcccggtgccccaacattggagagtgttggggaggtggggaatatgccacagccacagccacgatcatgttgatgggggacacatgcacaagaggttgcagattttgttccgttaagaccgcaagaaatccccctccattggatgccaatgagcccgacaatacggccaaagcaattgcagagtggggtctggattatgttgtcctgacgtcggtggatcgagatgatgtggccgacgggggagctgagcacatcgccaagaccgtgtcatgcttgaaggaaaggaatccaaaaatcctcgtggaatgcctcaccccagacttccgaggtgatctgagagcagtggagaaggtggctctgtctggattagatgtgtatgcacacaatgtggagactgtccccgagttacagaggaaagttcgtgttccccgggccaattttgaccagtctcttcgtgtactgaggcatgccaaggaggtccagcctgatgttgtttccaaaacatcgataatgctgggccttggtgagacagacgagcaagtctatgccacactgaaagctctccgtgcggccgacgtggactgtttaactctagggcagtacatgcagccaacgaagcgccaccttaaggttgaagaatatgttactcctgagaagttcaaatactgggaaaaagtagggaatgaacttggatttctctatacggcaagtggtcctttggtgcgatcttcatataaagcaggtgaatttttcctgaaaaatctagtggctagaagaaaaacaaaagcttctaaagtgtagccaagcccttcaagatcacaggagtgttgcgattttgcttccagttggtgtgaggatggtgtcaccctgtcaggattcctgtgagtgcaaggcagcaccgttctgaagggtctgatggctgatcgaagcggaatggtgtatacctgtaattccacccagg

SEQ ID NO: 26669 - protein, 373 aa, Mus musculus
MALRCWDTARSLGSRIFGRYAFTVRALSSLPDKKKEFLHNGPDLQDFVSGDLADKSTWDEYKGNLKRQKGERLRLPPWLKTKIPMGKNYNKLKNTLRNLSLHTVCEEARCPNIGECWGGGEYATATATIMLMGDTCTRGCRFCSVKTARNPPPLDANEPDNTAKAIAEWGLDYVVLTSVDRDDVADGGAEHIAKTVSCLKERNPKILVECLTPDFRGDLRAVEKVALSGLDVYAHNVETVPELQRKVRVPRANFDQSLRVLRHAKEVQPDVVSKTSIMLGLGETDEQVYATLKALRAADVDCLTLGQYMQPTKRHLKVEEYVTPEKFKYWEKVGNELGFLYTASGPLVRSSYKAGEFFLKNLVARRKTKASKV

SEQ ID NO: 26670 - DNA, 1182 bp, Arabidopsis thaliana
  CDS (1)..(1182)
atgcatcattgctcaattacgaaacccactttctcaatttcgatctcgacccagaagcttcatcatcattccagtaaattcttgaatttgggtttcagaatccgatgcgaatccggggatgtttcgtcgccattgcggaccaaggcggtgtctttgtcgtcggagatggaggattcgtcgtccttgaagaagagtttgatggagttagaagggaagaagagtgagccttacccaggaggaatgccgaagatgggtccattcacagggagagatccgaatgtgaagaaacctgcttggttgagacagaaggcaccacaaggcgaaaggtttcaggaggtgaaagagtccctttctcgtctcaatctcaatactgtttgtgaagaagctcagtgtcctaatatcggcgagtgttggaatggaggtggtgatggtgtagcaactgcaaccatcatggttcttggtgatacttgtactcgtggctgtagattctgtgctgttaaaacaagtagaaatcctcctcctcctgacccaatggaaccagagaacactgccaaggccatagccagttggggtgtagactacatagttattaccagcgtagaccgtgacgatatacctgatggtggaagtggacattttgcgcagactgtcaaagctatgaagagacataagccggatataatgatagaatgcttaacttctgattttcgtggggatttggaggctgtcgacactcttgtgcactcgggattggatgtttttgctcacaatgtcgagactgtgaaaaggctccagcgacttgtgagggatcctagggctggatatgagcagagcatgtcagttttgaaacatgcaaagatcagcaaacctggaatgatcacaaagacatccataatgcttggtcttggagaaacagacgaagagttgaaggaagcaatggctgatctaagagctatagatgttgatattctaacacttggccagtatctacagccaactccattgcatctgactgtgaaagagtatgtcacacctgagaagtttgatttctggaaaacatacggagaatcaataggatttcgttatgttgcaagtggtccactggtaagatcttcatatagagcaggagagctttttgttaagacaatggtgaaagaaagctactctaaatccttgtcttaa

SEQ ID NO: 26671 - protein, 393 aa, Arabidopsis thaliana
MHHCSITKPTFSISISTQKLHHHSSKFLNLGFRIRCESGDVSSPLRTKAVSLSSEMEDSSSLKKSLMELEGKKSEPYPGGMPKMGPFTGRDPNVKKPAWLRQKAPQGERFQEVKESLSRLNLNTVCEEAQCPNIGECWNGGGDGVATATIMVLGDTCTRGCRFCAVKTSRNPPPPDPMEPENTAKAIASWGVDYIVITSVDRDDIPDGGSGHFAQTVKAMKRHKPDIMIECLTSDFRGDLEAVDTLVHSGLDVFAHNVETVKRLQRLVRDPRAGYEQSMSVLKHAKISKPGMITKTSIMLGLGETDEELKEAMADLRAIDVDILTLGQYLQPTPLHLTVKEYVTPEKFDFWKTYGESIGFRYVASGPLVRSSYRAGELFVKTMVKESYSKSLS

SEQ ID NO: 26672 - DNA, 1128 bp, Bruguiera gymnorrhiza
  CDS (1)..(1128)
atgcagtcccgtgtgccctccttgttggctcgcaccctccggtcccgatgcttctccgccaccgtggagcctaccaagagcgatgccaccgctgcatccctggcggctctccgggcccgattggctgacgaatcgccgtctctaggcgacttcatgaacctccagtccggttactccgtggaagtcggcaacaagaagaagcccatgcctaagcctaagtggatgagggaggctattcccggaggggacaagtacgtgcacatcaagaagaagctcagggaattgaagctccacaccgtctgtgaggaggccaagtgccctaatttgggcgagtgctggtctggcggcgagaccggtaccgcgaccgccaccattatgattcttggcgatacctgtacccgtggttgcaggttctgtaacgtgaagacatcgcgcactcctcctccgccggacccgaacgagccagccaacgttgctgaagcaattgcttcgtggggtttggattatgtggtgcttactagcgtcgatcgtgacgatttggccgatcaaggaagcaaccacttccgggagactgtgcagagattgaaggcactgaagccaaacatgttgattgaagctctgactcctgattttcaaggagacaaatcctgcgtggagaaggttgctacggcaggattagatgtgtttgcccacaacattgagacagtagaagaactccagagcgtggtgcgcgataatcgtgctaacttcaagcaatctttggaggttttgatggcagctagggaattttctcctcctgggacactcaccaagacttccatcatgttgggctgtggagagacacccgaccaggttgtgaaatcaatggagaaggtgagggcagctggtgttgatgtcattacctttggtcagtacatgagaccctcaaaacgccacatgcccgtgtctgaatacatcacccctgaggccttcgagaagtataaagttcttggcgatgaaatgggattccgttatgtagcatctggtcccatggtaaggtcatcatacaaagctggggagttctacatcaagaacatgatagaacgtgatagggctgcagccgcccaacagaaactctctgttgcttga

SEQ ID NO: 26673 - protein, 375 aa, Bruguiera gymnorrhiza
MQSRVPSLLARTLRSRCFSATVEPTKSDATAASLAALRARLADESPSLGDFMNLQSGYSVEVGNKKKPMPKPKWMREAIPGGDKYVHIKKKLRELKLHTVCEEAKCPNLGECWSGGETGTATATIMILGDTCTRGCRFCNVKTSRTPPPPDPNEPANVAEAIASWGLDYVVLTSVDRDDLADQGSNHFRETVQRLKALKPNMLIEALTPDFQGDKSCVEKVATAGLDVFAHNIETVEELQSVVRDNRANFKQSLEVLMAAREFSPPGTLTKTSIMLGCGETPDQVVKSMEKVRAAGVDVITFGQYMRPSKRHMPVSEYITPEAFEKYKVLGDEMGFRYVASGPMVRSSYKAGEFYIKNMIERDRAAAAQQKLSVA

SEQ ID NO: 26674 - DNA, 1434 bp, Arabidopsis thaliana
  CDS (1)..(1434)
atggaggattcgtcgtccttgaagaagagtttgatggagttagaagggaagaagagtgagccttacccaggaggaatgccgaagatgggtccattcacagggagagatccgaatgtgaagaaacctgcttggttgagacagaaggcaccacaaggcgaaaggtttcaggaggtgaaagagtccctttctcgtctcaatctcaatactgtttgtgaagaagctcagtgtcctaatatcggcgagtgttggaatggaggtggtgatggtgtagcaactgcaaccatcatggttcttggtgatacttgtactcgtggctgtagattctgtgctgttaaaacaagtagaaatcctcctcctcctgacccaatggaaccagagaacactgccaaggccatagccagttggggtgtagactacatagttattaccagcgtagaccgtgacgatatacctgatggtggaagtggacattttgcgcagactgtcaaagctatgaaggctgtcgacactcttgtgcactcgggattggatgtttttgctcacaatgtcgagactgtgaaaaggctccagcgacttgtgagggatcctagggctggatatgagcagagcatgtcagttttgaaacatgcaaagatcagcaaacctggaatgatcacaaagacatccataatgcttggtcttggagaaacagacgaagagttgaaggaagcaatggctgatctaagagctatagatgttgatattctaacacttggccagtatctacagccaactccattgcatctgactgtgaaagagtatgtcacacctgagaagtttgatttctggaaaacatacggagaatcaataggatttcgttatgttgcaagtggtccactgatgactaacagttacgctctgtcaccggcgattatcgccgccgttcgtcctccggcatctcaagactatctagttgctgcttctcttagtggacgcaaatcgatcaactcttcatcttcgtccattttcgtacctatctcattatctacttcctacggtcgaagcaaatgcgccttctcaatctcgcggaagaatccaaaatcgacgattcgttgcgatattgctgtgaaatcggcggcttctgtagacgcggacgctgatctatcgtcatctacgtcgttggagacggaggaagacgagaaagcgaaggagaagattggagctagggttagggttacggttccgttgaaagtttaccatgtggttcgtgtaccggaggttgaattgatgggaatggaaggttttatcaaagattacgtcgttctttggaaaggaaagaaaatctcagctaatctgccgtttaaggtacagttcgtgaaagagatcgaaggtcgtggtcctgtcaaattcttcacgcatcttaaggaagacgagttcgagttaattgatccgtga

SEQ ID NO: 26675 - protein, 477 aa, Arabidopsis thaliana
MEDSSSLKKSLMELEGKKSEPYPGGMPKMGPFTGRDPNVKKPAWLRQKAPQGERFQEVKESLSRLNLNTVCEEAQCPNIGECWNGGGDGVATATIMVLGDTCTRGCRFCAVKTSRNPPPPDPMEPENTAKAIASWGVDYIVITSVDRDDIPDGGSGHFAQTVKAMKAVDTLVHSGLDVFAHNVETVKRLQRLVRDPRAGYEQSMSVLKHAKISKPGMITKTSIMLGLGETDEELKEAMADLRAIDVDILTLGQYLQPTPLHLTVKEYVTPEKFDFWKTYGESIGFRYVASGPLMTNSYALSPAIIAAVRPPASQDYLVAASLSGRKSINSSSSSIFVPISLSTSYGRSKCAFSISRKNPKSTIRCDIAVKSAASVDADADLSSSTSLETEEDEKAKEKIGARVRVTVPLKVYHVVRVPEVELMGMEGFIKDYVVLWKGKKISANLPFKVQFVKEIEGRGPVKFFTHLKEDEFELIDP

SEQ ID NO: 26676 - DNA, 1119 bp, Homo sapiens
  CDS (1)..(1119)
atgtctctacgctgcggggatgcagcccgcaccctggggccccgggtatttgggagatatttttgcagcccagtcagaccgttaagctccttgccagataaaaaaaaggaactcctacagaatggaccagaccttcaagattttgtatctggtgatcttgcagacaggagcacctgggatgaatataaaggaaacctaaaacgccagaaaggagaaaggttaagactacctccatggctaaagacagagattcccatggggaaaaattacaataaactgaaaaatactttgcggaatttaaatctccatacagtatgtgaggaagctcgatgtcccaatattggagagtgttggggaggtggagaatatgccaccgccacagccacgatcatgttgatgggtgacacatgtacaagaggttgcagattttgttctgttaagactgcaagaaatcctcctccactggatgccagtgagccctacaatactgcaaaggcaattgcagaatggggtctggattatgttgtcctgacatctgtggatcgagatgatatgcctgatgggggagctgaacacattgcaaagaccgtatcatatttaaaggaaaggaatccaaaaatccttgtggagtgtcttactcctgattttcgaggtgatctcaaagcaatagaaaaagttgctctgtcaggattagatgtgtatgcacataatgtagaaacagtcccggaattacagagtaaggttcgtgatcctcgggtcaattttgatcagtccctacgtgtactgaaacatgccaagaaggttcagcctgatgttatttctaaaacatctataatgttgggtttaggcgagaatgatgagcaagtatatgcaacaatgaaagcacttcgtgaggcagatgtagactgcttgactttaggacaatatatgcagccaacaaggcgtcaccttaaggttgaagaatatattactcctgaaaaattcaaatactgggaaaaagtaggaaatgaacttggatttcattatactgcaagtggccctttggtgcgttcttcatataaagcaggtgaatttttcctgaaaaatctagtggctaaaagaaaaacaaaagacctctaa

SEQ ID NO: 26677 - protein, 372 aa, Homo sapiens
MSLRCGDAARTLGPRVFGRYFCSPVRPLSSLPDKKKELLQNGPDLQDFVSGDLADRSTWDEYKGNLKRQKGERLRLPPWLKTEIPMGKNYNKLKNTLRNLNLHTVCEEARCPNIGECWGGGEYATATATIMLMGDTCTRGCRFCSVKTARNPPPLDASEPYNTAKAIAEWGLDYVVLTSVDRDDMPDGGAEHIAKTVSYLKERNPKILVECLTPDFRGDLKAIEKVALSGLDVYAHNVETVPELQSKVRDPRVNFDQSLRVLKHAKKVQPDVISKTSIMLGLGENDEQVYATMKALREADVDCLTLGQYMQPTRRHLKVEEYITPEKFKYWEKVGNELGFHYTASGPLVRSSYKAGEFFLKNLVAKRKTKDL

SEQ ID NO: 26678 - DNA, 1122 bp, Mus musculus
  CDS (1)..(1122)
atggctctacgctgctgggatacagctcgcagcctggggtcccggatatttggaagatatgcgttcacggttagagcattaagttctttgccagataagaaaaaggaatttttgcataatggaccagaccttcaagattttgtatctggtgatcttgcagacaagagtacatgggatgaatataaaggaaacttaaagcgccagaaaggagaaaggctaagactacctccatggctaaagacaaagatacccatgggtaaaaactacaataaactgaaaaatacattgcggaatttaagtctccacacagtgtgtgaggaagcccggtgccccaacattggagagtgttggggaggtggggaatatgccacagccacagccacgatcatgttgatgggggacacatgcacaagaggttgcagattttgttccgttaagaccgcaagaaatccccctccattggatgccaatgagcccgacaatacggccaaagcaattgcagagtggggtctggattatgttgtcctgacgtcggtggatcgagatgatgtggccgacgggggagctgagcacatcgccaagaccgtgtcatgcttgaaggaaaggaatccaaaaatcctcgtggaatgcctcaccccagacttccgaggtgatctgagagcagtggagaaggtggctctgtctggattagatgtgtatgcacacaatgtggagactgtccccgagttacagaggaaagttcgtgatccccgggccaattttgaccagtctcttcgtgtactgagacatgccaaggaggtccagcctgatgttgtttccaaaacatcgataatgctgggccttggtgagacagacgagcaagtctatgccacactgaaagctctccgtgcggccgacgtggactgtttaactctagggcagtacatgcagccaacgaagcgccaccttaaggttgaagaatatgttactcctgagaagttcaaatactgggaaaaagtagggaatgaacttggatttctctatacggcaagtggtcctttggtgcgatcttcatataaagcaggtgaatttttcctgaaaaatctagtggctagaagaaaaacaaaagcttctaaagtgtag

SEQ ID NO: 26679 - protein, 373 aa, Mus musculus
MALRCWDTARSLGSRIFGRYAFTVRALSSLPDKKKEFLHNGPDLQDFVSGDLADKSTWDEYKGNLKRQKGERLRLPPWLKTKIPMGKNYNKLKNTLRNLSLHTVCEEARCPNIGECWGGGEYATATATIMLMGDTCTRGCRFCSVKTARNPPPLDANEPDNTAKAIAEWGLDYVVLTSVDRDDVADGGAEHIAKTVSCLKERNPKILVECLTPDFRGDLRAVEKVALSGLDVYAHNVETVPELQRKVRDPRANFDQSLRVLRHAKEVQPDVVSKTSIMLGLGETDEQVYATLKALRAADVDCLTLGQYMQPTKRHLKVEEYVTPEKFKYWEKVGNELGFLYTASGPLVRSSYKAGEFFLKNLVARRKTKASKV

SEQ ID NO: 26680 - DNA, 1245 bp, Saccharomyces cerevisiae
  CDS (1)..(1245)
atgtatagacgatctgttggagtactatttgttgggagaaatacaagatggatttcgtccactattaggtgtggaacgagcgcaactcggccaataagatccaatgcattgaatactgattcagataacgctagcgttagggtaccagttggaaattcaactgaggttgaaaatgcaaccagtcagttaacagggacttcgggaaaaagacgcaaggggaacagaaaaagaattacagagttcaaagatgctcttaatttgggtccatcttttgcagattttgtttcaggtaaagcttcgaaaatgatcttggaccctctggagaaggcaaggcaaaatacagaggaagctaaaaaactacctcgttggcttaaggttcctattcctaagggtaccaattaccataaattgaaaggcgacgtaaaagaattaggcctgagtactgtttgtgaggaggcaagatgtcccaatattggtgaatgttggggaggcaaagataaatctaaggcaacggcaacaattatgctgcttggtgatacttgcactcgtggatgtaggttttgttctgtgaagaccaatagaacgcctagtaagccggacccaatggagcccgaaaatactgccgaagctatcaaaagatgggggttgggttatgttgttttaactaccgttgatagggacgatttagtcgatggtggtgctaatcacctggccgagacggttcgcaaaatcaaacagaaggcaccaaatactcttgtagagactctttctggtgatttcagaggtgatttgaagatggtggacattatggcacaatgtgggcttgatgtttacgcacataatttggaaacagttgaatcactaacaccacatgtcagagacagaagagctacttatagacagtctttgagtgttttagaaagggcaaaagctacggttccgtcactgattactaaaacatcaataatgctgggtctaggagaaactgatgagcaaattactcaaactttgaaggatttgcgcaatattcaatgtgatgttgttacatttggtcaatatatgaggccaaccaagagacatatgaaagtcgtagaatatgtgaaacccgaaaagtttgactactggaaagagagagctttagagatgggattcttgtattgtgcatctggacccctagtaagatcgtcatataaggctggtgaagcatttattgagaacgttttgaagaaaagaaacatgaaataa

SEQ ID NO: 26681 - protein, 414 aa, Saccharomyces cerevisiae
MYRRSVGVLFVGRNTRWISSTIRCGTSATRPIRSNALNTDSDNASVRVPVGNSTEVENATSQLTGTSGKRRKGNRKRITEFKDALNLGPSFADFVSGKASKMILDPLEKARQNTEEAKKLPRWLKVPIPKGTNYHKLKGDVKELGLSTVCEEARCPNIGECWGGKDKSKATATIMLLGDTCTRGCRFCSVKTNRTPSKPDPMEPENTAEAIKRWGLGYVVLTTVDRDDLVDGGANHLAETVRKIKQKAPNTLVETLSGDFRGDLKMVDIMAQCGLDVYAHNLETVESLTPHVRDRRATYRQSLSVLERAKATVPSLITKTSIMLGLGETDEQITQTLKDLRNIQCDVVTFGQYMRPTKRHMKVVEYVKPEKFDYWKERALEMGFLYCASGPLVRSSYKAGEAFIENVLKKRNMK

SEQ ID NO: 26682 - DNA, 876 bp, Anabaena sp
  CDS (1)..(876): transl_table=11
gtgactgtaaaaccagactggttgcgggtaaaagcgcctcaatgggagcgcgttggtaacgttaaagaaattttgcgggatttagcgctaaatacagtttgtgaggaagcgtcatgtccaaacattggtgaatgcttccaagctggtacagccacatttttgattatggggccagcctgcacccgtgcttgtccttattgtgatattgattttgagaaaaaacccaaagcgctcgaccccacagaacccacacgattagccgaagctgtgcggcggatgagactgaatcatgtggtcatcacttctgtgaaccgagatgatttaccagatggtggtgcatcacagtttgtcaagtgtattgcagaggtgcgcgcggtttcgcctcaaaccacaattgaggtgctaatccctgatttgtgcggtaattgggaggcgttaaggatcattctccaagcatcaccagaggtattaaaccataacacagaaacgattcctcgcctttatcgacgagtccgaccccaaggtaactacgatcgcaccctagaattattgcagcgatcgcgtcaaattgctccctggctttacaccaaatccggtatcatggtcggcttaggcgaaactaatgccgaagttcgccaagtgatgcaagacctacgtgctgtggattgcgatatcctaacaatcgggcagtatctccaacccagtcaaaagcacttgcaagtcaacgatttcgttactccagagcaatttgctgcttggcaagtttatggtgaagaactcggatttttacaagttgtctcctcacctttgacgagaagttcttaccacgccgaacaagtacgacaattaatggagcgttacccacggaacaagtag

SEQ ID NO: 26683 - protein, 291 aa, Anabaena sp
MTVKPDWLRVKAPQWERVGNVKEILRDLALNTVCEEASCPNIGECFQAGTATFLIMGPACTRACPYCDIDFEKKPKALDPTEPTRLAEAVRRMRLNHVVITSVNRDDLPDGGASQFVKCIAEVRAVSPQTTIEVLIPDLCGNWEALRIILQASPEVLNHNTETIPRLYRRVRPQGNYDRTLELLQRSRQIAPWLYTKSGIMVGLGETNAEVRQVMQDLRAVDCDILTIGQYLQPSQKHLQVNDFVTPEQFAAWQVYGEELGFLQVVSSPLTRSSYHAEQVRQLMERYPRNK

SEQ ID NO: 26684 - DNA, 957 bp, Bradyrhizobium japonicum
  CDS (1)..(957): transl_table=11
atggtcgttattgtcgataccatctcgaacccgctgcgcccgcgccaccccgaaaaggtgaatcgccccgattccgcttcaccgccgaagccggactggatccgcgtgcgcgcgcccaacacccgcggctatgccgacacccgcaacatcgtgagggcgaacggcctgcacacggtgtgcgaggaggcgggctgcccgaatatcggcgagtgctgggacaagaagcacgcgaccttcatgatcatgggtgacacgtgcacccgtgcctgcgccttctgcaacgtcaagaccggcctgcccaacgcgctggatgcggacgagccgcagaacgtcgccgaggccgtggccaagctgggcctcgcccacgtcgtcatcacctcggtcgaccgcgacgacctcgccgatggcggcgccgagcatttcgcccagaccatccgcgccatccgcgccgcatgcccctcgaccacgatcgagatcctgacgcctgacttcctgcgcaaggaaggcgcgctggaggtcgtcgtcgcggcgaggcccgacgtcttcaaccacaatctcgagaccgtgccgtcgcgctatctcacggtacggccaggcgcgcgctacttccattcgatccggctgttgcagcgggtcaaggagctcgatgcgtccatcttcaccaagtccggcatcatggtgggcctgggtgaagagcgccacgaggtgcagcaggtgatggacgatctgcgctcggccgatgtcgacttcctgaccatcgggcaatatctccagccgacccgtaagcatcacgcggtgatgcgctacgtgccgccggacgagttttcgtcctatgaaaaggtcgcctacaccaagggcttcctgatggtgtcggcgagcccgctcacccgctcgtcgcatcatgccggcgaggatttcgcgagactgaaggctgcgcgggcagctcacgcccgctga

SEQ ID NO: 26685 - protein, 318 aa, Bradyrhizobium japonicum
MVVIVDTISNPLRPRHPEKVNRPDSASPPKPDWIRVRAPNTRGYADTRNIVRANGLHTVCEEAGCPNIGECWDKKHATFMIMGDTCTRACAFCNVKTGLPNALDADEPQNVAEAVAKLGLAHVVITSVDRDDLADGGAEHFAQTIRAIRAACPSTTIEILTPDFLRKEGALEVVVAARPDVFNHNLETVPSRYLTVRPGARYFHSIRLLQRVKELDASIFTKSGIMVGLGEERHEVQQVMDDLRSADVDFLTIGQYLQPTRKHHAVMRYVPPDEFSSYEKVAYTKGFLMVSASPLTRSSHHAGEDFARLKAARAAHAR

SEQ ID NO: 26686 - DNA, 870 bp, Gloeobacter violaceus
  CDS (1)..(870): transl_table=11
gtgctcgccatgtcccaccagactgccagctcccgcctgcccgagtgggcgcgccgcaccatcggcactgcctcgcaagtctcgacggtcgagaagatcgtcaagcagcgctcgctgcacaccatctgcgaggaggggcgctgcccgaaccgggcggagtgctacgcccagaagacagcgacgtttttgttgatgggaccggtgtgcacccgcgcctgcggcttctgccaggttgccggcggcaaggctcttcccctcgacccgcaggagcctgaaaaagtcgccgaggcggtggcgctgttgggactcaagtacgtggtgctcacttcggtggcccgcgacgacctgccggatcagggggcgggctggtttgtgcgcacgatggaatctattcgcgcgcgcaactgcgcggtcgagatcgaagtactcaccccggattttcgcggcgaagaggcgtgcatcgccaccgtggtcgccgcgcgacccgtttgctttaatcacaacatcgagacggtgcggcgcctgcaaagctacgcccgccgcgccgccacctacgcgcgcagtctggcggtccttgccgccgtcaagcgtctggatgcggagatcttcaccaagtcggggctgatgctgggccacggcgagacgcgcgaagaagtgctcgagacgttgctcgacctgcgcaaggtgggttgcgaccgggtcaccctcggccagtacctccagccttccaaagaccacctgccggtgcacaagtactggaccccggccgaatttgccgaactgggcgccgtcgcccgcgatttgggctttgcccacgtgcgctccggaccgctggtgcgcagttcctaccacgccggcgagcctgaatag

SEQ ID NO: 26687 - protein, 289 aa, Gloeobacter violaceus
MLAMSHQTASSRLPEWARRTIGTASQVSTVEKIVKQRSLHTICEEGRCPNRAECYAQKTATFLLMGPVCTRACGFCQVAGGKALPLDPQEPEKVAEAVALLGLKYVVLTSVARDDLPDQGAGWFVRTMESIRARNCAVEIEVLTPDFRGEEACIATVVAARPVCFNHNIETVRRLQSYARRAATYARSLAVLAAVKRLDAEIFTKSGLMLGHGETREEVLETLLDLRKVGCDRVTLGQYLQPSKDHLPVHKYWTPAEFAELGAVARDLGFAHVRSGPLVRSSYHAGEPE

SEQ ID NO: 26688 - DNA, 885 bp, Prochlorococcus marinus
  CDS (1)..(885): transl_table=11
atgactggaaaagccttactgaaaccccactggttgcgcgtcaaggctccacaacagcaacgcatcggcgaggtagccgagctgctgaagggcctcaatctcaagacggtgtgtcaagaagccagctgcccgaatatcggggagtgcttcgcaggaggaactgccaccttcttgatcatggggccgggctgcacccgcgcttgcccttactgcgacatcgactttgacaaaagcccacgctccctagaccccactgagccagagcgcctaagcgaagcggtggctcagatgaaccttcgtcatgttgtcatcacttcagttaaccgtgatgacctcagcgacgggggagccagtcaattcgtcgcatgcatcgaggccattcgccaacgttctcccctaaccacaattgagctgctaattcctgatttcaacggcaattgggatgccctcgccaaggtaatgggagcagctccggaggtgctcaaccacaacattgagaccgtcccccggctctacaaacgggctcgtccacaagctgactacatgcgatctcttgagctgttgtatcaagtgcggcaaggctggccgaaggtctatagcaagtccggcctgatggtggggctaggtgaaacagatgctgaggtaattgaggtcctagaggatctacgccgtcaccgagtcgacatagtgaccatcggccaatacctatcgccaagcccaaaacatcttccagtcgatcgctttgtgacaccagaacagttcgaatatttccgctctatgggggaaactgagctggggttcctgcaagtggttagtacccctctcacacgcagcagctaccacgccggcgaggtccagcggctgatggccgcccacccacgctga

SEQ ID NO: 26689 - protein, 294 aa, Prochlorococcus marinus
MTGKALLKPHWLRVKAPQQQRIGEVAELLKGLNLKTVCQEASCPNIGECFAGGTATFLIMGPGCTRACPYCDIDFDKSPRSLDPTEPERLSEAVAQMNLRHVVITSVNRDDLSDGGASQFVACIEAIRQRSPLTTIELLIPDFNGNWDALAKVMGAAPEVLNHNIETVPRLYKRARPQADYMRSLELLYQVRQGWPKVYSKSGLMVGLGETDAEVIEVLEDLRRHRVDIVTIGQYLSPSPKHLPVDRFVTPEQFEYFRSMGETELGFLQVVSTPLTRSSYHAGEVQRLMAAHPR

SEQ ID NO: 26690 - DNA, 894 bp, Prochlorococcus marinus subsp
  CDS (1)..(894): transl_table=11
ttgactaatatttccaaaaatgcagttacgaagcctgactggttaagagtaaaagcacctcaagttgagagaatagggaatactgcaaatttattgagtgatttaaaattaaatactgtatgccaagaagcaagctgtcctaatattggcgaatgttttgctagcgggactgcaacttttttaattatgggaccaggttgtactagagcatgtccatattgtgatattgattttgatagatccaagagagatttagacccaacagaaccagatcgtttagcagaggctgtttttagattaaaacttaaacatgttgtgattacctcagttaatagagatgatctagatgatggtggagcttctcagttttataaatgtgtttctgaagttagaaaaaaatctcctgaaacaactattgaattattaattccagatttatgtggtaactggtcagcacttgaaaagattttagattctagaccaaatgttttaaatcataatattgaaactgtctcagctttgtataggaaagtaaggccacaaggaaactatcaaagaactttagagttactaaaaagaacaagagaatatttcccaagtgtttatactaaatctggattcatgttgggattaggagaaaaggatgatgaagttcttactcttctaatggatttaagaaaaaatgatgtagatatagttactattggtcaatatttatctccaggcccaaaacatcttcaggtccaaagatttgttaccccttcaaaatttaattattttaaattatttggagaaaatgaattagggtttatgcaagttgtcagttctcctttaactcgtagtagttatcatgctgaagagattcagaaactcatgaaaaagtttccaagataa

SEQ ID NO: 26691 - protein, 297 aa, Prochlorococcus marinus subsp
MTNISKNAVTKPDWLRVKAPQVERIGNTANLLSDLKLNTVCQEASCPNIGECFASGTATFLIMGPGCTRACPYCDIDFDRSKRDLDPTEPDRLAEAVFRLKLKHVVITSVNRDDLDDGGASQFYKCVSEVRKKSPETTIELLIPDLCGNWSALEKILDSRPNVLNHNIETVSALYRKVRPQGNYQRTLELLKRTREYFPSVYTKSGFMLGLGEKDDEVLTLLMDLRKNDVDIVTIGQYLSPGPKHLQVQRFVTPSKFNYFKLFGENELGFMQVVSSPLTRSSYHAEEIQKLMKKFPR

SEQ ID NO: 26692 - DNA, 870 bp, Synechocystis sp
  CDS (1)..(870): transl_table=11
gtgaccgtcaaaccggattggctccgagtcaaagcgccccaatggcagagggtgggcagtgttaaggatattctgcgagatttacaattaaataccgtctgtgaagaagcttcctgtcccaatattggcgagtgttttcaggccgggacggctacttttttgattatgggtcctgcttgcaccagggcttgcccctattgtgatattgattttgagaaaaagcctcaacccttagactccacagagccggaaagattggcgatcgccgtgaaaaggctcaatcttaagcatgtggtgattaccgcagtcaaccgggatgatttacccgatggaggagcctcccagtttgttagttgcatagaggctatccgcaaaatttctccaggcaccaccattgaggttttgattccagatttgtgcggcaattggcaagccttagcggcgctgttggaagctgccccagaggttttgaatcacaatatggaaacagtgcccaggctttataaacgggtgcggccccaggcggattatgatcaatccctagaattattcaaccaggcgaaacggattctgcccaaggtttacactaagtccggcattatggtggggctgggggaaacagatgcggaagtaagacaggtgatggaagatctacgccgggtggattgcgatattttgactattggccagtatctacaacctagccaaaaacatttgggagtcaaggaatttgtcaccccggaacagttcgacgtttggcgaatttatggtgaatccattggctttttacaagtggtatcctcccctttaacccgcagttcctaccatgcggaacaggtgcaggctttgatgacccgtttcccccgttaa

SEQ ID NO: 26693 - protein, 289 aa, Synechocystis sp
MTVKPDWLRVKAPQWQRVGSVKDILRDLQLNTVCEEASCPNIGECFQAGTATFLIMGPACTRACPYCDIDFEKKPQPLDSTEPERLAIAVKRLNLKHVVITAVNRDDLPDGGASQFVSCIEAIRKISPGTTIEVLIPDLCGNWQALAALLEAAPEVLNHNMETVPRLYKRVRPQADYDQSLELFNQAKRILPKVYTKSGIMVGLGETDAEVRQVMEDLRRVDCDILTIGQYLQPSQKHLGVKEFVTPEQFDVWRIYGESIGFLQVVSSPLTRSSYHAEQVQALMTRFPR

SEQ ID NO: 26694 - DNA, 903 bp, Anabaena sp
  CDS (1)..(903): transl_table=11
atgactgcctcacaatctgctcagtttaagtcggaaattacggcaatgcccagttggttgcgccgtcccattggcaaagctagcgaactgtcaacagtacagcgcattattaagcagcgtcaaattcatacaatttgtgaagaaggtcgctgcccgaatcggggtgagtgctatgcccaaaaaacggctacattcttacttatggggcctacctgcacccgtgtctgtgctttttgtcaagtcgataaaggtcatgcaccgatgccacttgacccagaggaagggcaaaaggtggcagaagcggtacaacttttgggactgcgttatgtagtacttacgtctgtagctcgtgatgatttacaagaccagggagcaagccactttgtccaaactatggaggcaatccgtcaattaaatccaggtactcaaattgaagttttgacaccggatttttggggtggtgcaggtgcgggggaatccggacaacgccagcgcataaaaatgattgtagaggcacaaccggcttgttttaaccataacattgagacagtgcgccgcttaaccgggccagtacgccggggtgcgaaatacgatcgctctttgcgagttctttctctggtcaaagaactcaacccccgtattcccaccaaatcaggcttaatggtgggatatggcgagacggttgctgaactagttgaagcaatgacagacttaaggaacataggatgcgatcgcctaactattggtcagtatatgcgcccatccctagaacatctaccagtccaaaaatattggacaccagaagaatttgagcatctaggcaaactagccagagaaatgggctttagccatgtccgttcggctccactagttcgcagttcctatcatgctggagaggagtga

SEQ ID NO: 26695 - protein, 300 aa, Anabaena sp
MTASQSAQFKSEITAMPSWLRRPIGKASELSTVQRIIKQRQIHTICEEGRCPNRGECYAQKTATFLLMGPTCTRVCAFCQVDKGHAPMPLDPEEGQKVAEAVQLLGLRYVVLTSVARDDLQDQGASHFVQTMEAIRQLNPGTQIEVLTPDFWGGAGAGESGQRQRIKMIVEAQPACFNHNIETVRRLTGPVRRGAKYDRSLRVLSLVKELNPRIPTKSGLMVGYGETVAELVEAMTDLRNIGCDRLTIGQYMRPSLEHLPVQKYWTPEEFEHLGKLAREMGFSHVRSAPLVRSSYHAGEE

SEQ ID NO: 26696 - DNA, 969 bp, Bradyrhizobium japonicum
  CDS (1)..(969): transl_table=11
atgaaagtgatacttgatctcctcaacaacgatccgcgcacgacgcagcggaccgaaaggccgcgccatcccgaaaaggccaaccgcccggacacaccgatggaaagcaggcccgcatggatccgcgtgaaagcccccggctccgcccaatggactgagacgcaacgtatcgtgcgcgaaaacaagctcgtgaccgtctgcgaggaagccagctgccccaacatcggcgagtgctgggcgaagaagcacgcgaccttcatgatcatgggtgacacctgcacgcgcgcctgcgcgttctgcaacgtgcgcaccggcctgcccggcccgctcgatgccgacgagcccggcaaggtcgccgacgccgtggccaagctcgggctcgagcacgtggtcgtgacatcggtcgatcgcgacgacctcgccgacggcggcgccgcccatttcgcagccacaattgcggcgatccgcgcaatgagcccggcaacgtcaatcgaaatcctcacgcctgatttcctgcgcaagcacggcgcgctcgaaacggtcgttgcggcaaggccagacgtgctcaatcacaatctggaaacggtgccgtcaaaatatctcgcggtacgcccaggtgcccgctatttccattcggtgcgacttctgcaacgcgcgaaggagctcgacccgcgcatcttcaccaaatcgggaatcatggtcggcctcggcgaggatcgtagcgaggtgctgcagttgatggacgatctgcgttccgccgacgtcgacttcctgaccatcggccagtatctccagccgacgcgcaagcaccatgccgtgatgcgcttcgtgccccctgatgaattcgaggcctatgagaagaccgcctatgccaagggatttctcatggtctcggccacgccactgacgcgatcctcacaccacgccggtgacgacttccgcaagctgcgcgagcgccgacgcgcgtag

SEQ ID NO: 26697 - protein, 322 aa, Bradyrhizobium japonicum
MKVILDLLNNDPRTTQRTERPRHPEKANRPDTPMESRPAWIRVKAPGSAQWTETQRIVRENKLVTVCEEASCPNIGECWAKKHATFMIMGDTCTRACAFCNVRTGLPGPLDADEPGKVADAVAKLGLEHVVVTSVDRDDLADGGAAHFAATIAAIRAMSPATSIEILTPDFLRKHGALETVVAARPDVLNHNLETVPSKYLAVRPGARYFHSVRLLQRAKELDPRIFTKSGIMVGLGEDRSEVLQLMDDLRSADVDFLTIGQYLQPTRKHHAVMRFVPPDEFEAYEKTAYAKGFLMVSATPLTRSSHHAGDDFRKLRERRRA

SEQ ID NO: 26698 - DNA, 897 bp, Gloeobacter violaceus
  CDS (1)..(897): transl_table=11
atggtcaccaagccggactggctcagggtcaaagcgccgcagcgcgagcgggtgggagcagttaaagacatcctgcgcgacctggcgctcaacaccgtctgtgaggaagcttcttgcccaaatatcggcgaatgtttcaaagccgggacggcaacgtttctgatcatgggaccggcctgcacgcgggcttgcccttactgcgacatcgattttgagaaatatcccaaggccctcgatccgaccgaacccgagcggctcgcacaggccgtgcggcggatgggcctgcgccatgtggtgattacctcggtcaaccgcgacgatctggccgacggcggcgctctgcagtttgcccgctgcatcgaagcggtgcgccgggtcatgccccaaacgaccatcgaagtgttgatccccgatttttgcggctccgaagcggccctcgatatcgtgattgccgcccatccacaagtaatcaatcacaataccgagaccgtccctcggctctaccggcgggtcagaccccagggcgactacggacgcactttgcaattgctcgagcgcgttcgcgccaaagcatcccacatctacaccaagtcgggcctgatggcgggccttggcgagagcgaagcggaagtgctcgcggtcatggcagatctgcgggccgtctactgcgacatcctgaccatcggccagtacctgcagcccacccccaaacacctcaaagtcgaagcctttgtcgaaccggcgctttttgagcgctggcggcgggcgggcgaagggatgggcttcttgcagatggtctcctcgcccctgacgcgcagttcctaccacgccgagcaggtgcagcgactgatgcgctcccacccccggacccccaaaaatcagcactcgccggagtaa

SEQ ID NO: 26699 - protein, 298 aa, Gloeobacter violaceus
MVTKPDWLRVKAPQRERVGAVKDILRDLALNTVCEEASCPNIGECFKAGTATFLIMGPACTRACPYCDIDFEKYPKALDPTEPERLAQAVRRMGLRHVVITSVNRDDLADGGALQFARCIEAVRRVMPQTTIEVLIPDFCGSEAALDIVIAAHPQVINHNTETVPRLYRRVRPQGDYGRTLQLLERVRAKASHIYTKSGLMAGLGESEAEVLAVMADLRAVYCDILTIGQYLQPTPKHLKVEAFVEPALFERWRRAGEGMGFLQMVSSPLTRSSYHAEQVQRLMRSHPRTPKNQHSPE

SEQ ID NO: 26700 - DNA, 927 bp, Prochlorococcus marinus
  CDS (1)..(927): transl_table=11
atgacaaccacaaacaaaaaaactcgttacagtgcaattaagccaagcgaaaggctacctgaatggataaaaccctctttaggtacggcctcacaattagaaaaagtacagaacctagttaaagaatatcgattaaatacaatatgcgaagaaggacgctgcccaaacagaggtgagtgctatgcatcaggaacagctactttcctattaggtggttcaatctgcactcgaagctgcgctttttgccaagtagaaaaaggaatgccaccacaaaacattgatccaaatgaatcaatccgtgtagcaaaagcagttttaaaattacaactcaaatacgttgtcttaacttctgtcgcaagagacgatcttgatgatcatggagcaattcatttttcaagaacaattcatgccataagaaaaacttctcccacgacatctattgaagttctaactcctgacttttggggtggatgtattgacaaaataaaagcaacaaaaattcaaagggagcgcttaaaaatagttcttaaagcaaagccagtttgctttaaccacaaccttgaaactgtagaacgtctacaaaaagaagtgcgcagaggtgctacctaccacaggtctcttgaactattaaaagcttctagagaaattgacaacgaaatcccaacaaaatcaggattaatgttaggcctaggtgaacgaagtgatgaaataatccaaactcttaaagaccttcgctcagtcaactgtcaacaggtaacaattggtcaatacctacgtccttcgctagcgcatatacctgttcaaaaatattggcttccaaaagactttgaacactttaagagaatagccgaaggacttggtttcaaaaaagtcaatagtggtccattagtaagaagtagttatcatgctgaacttccacaaacctaa

SEQ ID NO: 26701 - protein, 308 aa, Prochlorococcus marinus
MTTTNKKTRYSAIKPSERLPEWIKPSLGTASQLEKVQNLVKEYRLNTICEEGRCPNRGECYASGTATFLLGGSICTRSCAFCQVEKGMPPQNIDPNESIRVAKAVLKLQLKYVVLTSVARDDLDDHGAIHFSRTIHAIRKTSPTTSIEVLTPDFWGGCIDKIKATKIQRERLKIVLKAKPVCFNHNLETVERLQKEVRRGATYHRSLELLKASREIDNEIPTKSGLMLGLGERSDEIIQTLKDLRSVNCQQVTIGQYLRPSLAHIPVQKYWLPKDFEHFKRIAEGLGFKKVNSGPLVRSSYHAELPQT

SEQ ID NO: 26702 - DNA, 921 bp, Prochlorococcus marinus
  CDS (1)..(921): transl_table=11
atgtcttccacccatcgcccaacccaatacagctccattttgcctgcggagcgccttccggaatggttgcggcgccccatcggcagcgtctcccaattggagcagatgcagcagctggtgaaggggaatcatcttcacaccatttgtgaggaagggcgttgtcccaatcgcggcgagtgttacgcagccggtacagcaacttttctcctaggcggatcgatctgtacgcgtagttgtgctttttgccaggtcatgaaaggccaatctcctcaggcaatcgatccactcgaagcagagcgagttgcagatgcggtgcagcagatgggtcttcgttatgtggttcttacttcagtagcaagggatgatttgcccgaccatggcgtcagtatttttactgagaccatggcggccattcgccagcgcaatcctcttattgagatagaagtgctgacgccggatttttggggcggagtcgctgatctggccaaggcattagaggcccagagagaacgactcacgcagttgctcatggctgcaccagtttgtttcaaccacaacctcgaaaccgttgaaaggcttcagagcaaggttcgacggggagctacgtatcaccattctctcagtctgctggctgcagcgcgggaacttgctcccaacatccctactaaatcaggcttgatgttgggactaggagaagagcaagaagaggtggttcagactcttgaggatctccgttctgttgactgtcaacgggtcacattgggtcagtatctgcgcccttcattggcacatattccggtgcatcgttattggcatcctgaggatttcaagaacttggctgaagttgcttgcaagcttggatttgctcaggtgcgtagcgggcctctagtgcgtagtagttatcacgctggtgaagaatga

SEQ ID NO: 26703 - protein, 306 aa, Prochlorococcus marinus
MSSTHRPTQYSSILPAERLPEWLRRPIGSVSQLEQMQQLVKGNHLHTICEEGRCPNRGECYAAGTATFLLGGSICTRSCAFCQVMKGQSPQAIDPLEAERVADAVQQMGLRYVVLTSVARDDLPDHGVSIFTETMAAIRQRNPLIEIEVLTPDFWGGVADLAKALEAQRERLTQLLMAAPVCFNHNLETVERLQSKVRRGATYHHSLSLLAAARELAPNIPTKSGLMLGLGEEQEEVVQTLEDLRSVDCQRVTLGQYLRPSLAHIPVHRYWHPEDFKNLAEVACKLGFAQVRSGPLVRSSYHAGEE

SEQ ID NO: 26704 - DNA, 900 bp, Prochlorococcus marinus subsp
  CDS (1)..(900): transl_table=11
atgaaaaataaaaatcagatgaaagtagaaaaaattttaaggcttccttcttggataaagtttcctattagcaaagcttcggaatttgagaaaatgcaaagacttattagaaagtcaaatatacatacaatttgtgaagaagggagatgtcctaatagggccgaatgttatgcctcaggtactgctacttttttacttggaggatcaatttgttctcgtgcctgcgctttctgccaggtaaacaaaggtaaacctagtgaaataaataaatatgaaagtattcaagtcgcagaagcagtaaaaattctaaacttaaaatatgttgtacttacatcagtagccagagacgaccttcccgatcatggagctaatttatttgtctcaacgattaatcagattagaaaaattgatccaaagattcaaatagaagttcttactcctgatttatggggaggtggaaaatcttttgaagataaagataaacttcaaaaagatagacttaaaaaaattctagaacaaaggccaatttgttttaatcataatcttgagacagttgaaaggcttcaaaaagaagttcgaagaggtgctaactataaaaattcaataggcttattagaaaaagcaaagtctattgctcctaatattcaaacaaaatcaggaataatgttgggtttaggagaaacgttaaaagaaatagaaactacgattctcgatctaaaaaaagtggattgtaatcaaatcacaattggacaatatctaagaccttcattaaagcatttatctgttaagaaatattgggcaccaaaggagtttgaatacctaaaaagtttttgtagtaaattagggtttaaaaaagtatcttgtggccctttagttagaagtagttatcacgctggttag

SEQ ID NO: 26705 - protein, 299 aa, Prochlorococcus marinus subsp
MKNKNQMKVEKILRLPSWIKFPISKASEFEKMQRLIRKSNIHTICEEGRCPNRAECYASGTATFLLGGSICSRACAFCQVNKGKPSEINKYESIQVAEAVKILNLKYVVLTSVARDDLPDHGANLFVSTINQIRKIDPKIQIEVLTPDLWGGGKSFEDKDKLQKDRLKKILEQRPICFNHNLETVERLQKEVRRGANYKNSIGLLEKAKSIAPNIQTKSGIMLGLGETLKEIETTILDLKKVDCNQITIGQYLRPSLKHLSVKKYWAPKEFEYLKSFCSKLGFKKVSCGPLVRSSYHAG

SEQ ID NO: 26706 - DNA, 897 bp, Synechococcus elongatus
  CDS (1)..(897)
atggttgttaagccagagtggttacgggtcaaagcaccccagtggcagcgggtgggttccgtcaaggaactgttgcgggacttaaacctcaatactgtttgcgaagaggcctcttgccccaatattggtgaatgtttctatcagggaacggccacatttttaatgatgggtccagcttgcacccgggcttgcccctactgcgatattgattttgagaaaaagccattgcctctggatcccactgaaccccagcgactagctgaagcagtggtgcggatgcgtctcaatcacgttgtcattacctcggtgaatcgggatgatttggccgacgggggtgcctctcagtttgtcgccacgattgaggctgtgcggcagcgatcgccccaaacaacaattgaagtcctgattcccgatctctgcggcaactggcaggccttggatcaaattcttgctgccggtccggaagtactcaaccacaacaccgagaccgtgccccgtctctatcggcgggtgcgtccccaaggcaactatcagcgcagtctggaactgctgcagcgggtgcgcgatcgcgccccttggatttactcaaaatcgggcattatggtgggtctaggggaaaccagcgaggaagtggtggccctcatgcaggatttgcgccaagtgggttgtgacattctcaccattggtcagtatctgcaacccagtcccaaacatctagcggtacaggcctttattccaccagagcaatttgaggaatggcgccgcctgggggaatcgatgggctttttgcaggtggtttcctctcccctcacccgtagttcctaccatgctgagcaggtgcgggctctgatgcaacagtacccacgtcagcgtcctgccccaagtcctcttggatag

SEQ ID NO: 26707 - protein, 298 aa, Synechococcus elongatus
MVVKPEWLRVKAPQWQRVGSVKELLRDLNLNTVCEEASCPNIGECFYQGTATFLMMGPACTRACPYCDIDFEKKPLPLDPTEPQRLAEAVVRMRLNHVVITSVNRDDLADGGASQFVATIEAVRQRSPQTTIEVLIPDLCGNWQALDQILAAGPEVLNHNTETVPRLYRRVRPQGNYQRSLELLQRVRDRAPWIYSKSGIMVGLGETSEEVVALMQDLRQVGCDILTIGQYLQPSPKHLAVQAFIPPEQFEEWRRLGESMGFLQVVSSPLTRSSYHAEQVRALMQQYPRQRPAPSPLG

SEQ ID NO: 26708 - DNA, 900 bp, Synechococcus sp
  CDS (1)..(900): transl_table=11
atgagcaaatacagcaccattgctccgacggaacgactgccggagtggctgcggcgaccgatcggcgatgcatctgcgctcgagcgggtgcagggattggtcaagcagaaccggttgcacaccatctgcgaggaggggcgttgccccaaccgcggtgagtgttatgcagctggcacagccacgtttttgctgggtggttcgatctgcacccgcagctgtgccttctgccaggtggagaagggccaagcacccatggcggtggaccctgctgaggcgcagcgggtggctgatgcggtggaggcgatgcagctgcgttatgtggtgctcacggccgtcgcccgtgatgacctggctgatcacggtgcagctctcttcactacaacgatggaggcgatccgcgcccgcaatccgctgattgccatcgaggtgttgacgccggatttctggggtggctgtcccgatccacaacaggctgttgccgcgcagcgtgagcggctgtccaccgtgctcgcggctgaccccgtgtgcttcaaccacaacctggaaaccgtccaacgcctgcaaggtgaggtacggcgcggtgccacctacgagcgatccctcgggctgctggcggcgtgccgggagctggctccaacgattcccaccaaatcagggttgatgctgggccttggcgagagccgtgatgaggtgattgctgcgatgcgggatctgcgggctgtggattgtcagcgcctcaccctcggccagtacctgcgtccgtccttggctcacatcccagtggatcgctattggacgccggaggagtttgacgaactcggtgctgtggcccgcgatcttgggttcgcccaggtgcgcagtggtccgctggtgcgcagcagttatcacgctgccgattga

SEQ ID NO: 26709 - protein, 299 aa, Synechococcus sp
MSKYSTIAPTERLPEWLRRPIGDASALERVQGLVKQNRLHTICEEGRCPNRGECYAAGTATFLLGGSICTRSCAFCQVEKGQAPMAVDPAEAQRVADAVEAMQLRYVVLTAVARDDLADHGAALFTTTMEAIRARNPLIAIEVLTPDFWGGCPDPQQAVAAQRERLSTVLAADPVCFNHNLETVQRLQGEVRRGATYERSLGLLAACRELAPTIPTKSGLMLGLGESRDEVIAAMRDLRAVDCQRLTLGQYLRPSLAHIPVDRYWTPEEFDELGAVARDLGFAQVRSGPLVRSSYHAAD

SEQ ID NO: 26710 - DNA, 912 bp, Synechocystis sp
  CDS (1)..(912): transl_table=11
gtgccccaacaatcatttatgaatggctcttccttgccccgtgagttccccccacgcttacccagttggttgaaacggcccattggtagagctagtgaattatctacggttcagcagattattaaacagcgccaaattcataccatttgcgaagaaggccgctgtcccaatcggggggaatgttacgccaaccgaacggcaacttttttattaatgggtcaaatttgtactagggcatgtggtttttgtcaggtggaaaagggccaggctcccatgatgttggatcaggatgagccgagaaaagtagcggaagcagtgcaattgttgggtctaaaatatgtggtattaacttccgttgctagggatgatttaaccgatggcggtgcaggctggtttgtagcggtaatggagcgtattcgccaggataatcctgctactcaaatagaggttttaacaccggatttttggggcggtatgggtagggaaagaagccaaaaagagcgagtactgacggtgactaaagccaaaccggtttgctataaccacaacttggaaacggtggctagattacagggtaaagtacgacggggggcaaaatatcaacgctccttagatgtgttgcgctggataaaggaatttgatcccgacattttcaccaaatctgggttgatgttgggccacggggaaacggtggatgaagtggtggaaaccctcaaggatttgcgctctgtaggttgcgatcgcctgacgttgggacaatatatgcaaccatccctagaccatctgcccgtgcaaaaatattggactccagaggagtttgatcagttgggggaaattgccaaggatttgggttttagccatgtgcgatcaggaccattggtgcggagttcctaccatgccggggaagattag

SEQ ID NO: 26711 - protein, 303 aa, Synechocystis sp
MPQQSFMNGSSLPREFPPRLPSWLKRPIGRASELSTVQQIIKQRQIHTICEEGRCPNRGECYANRTATFLLMGQICTRACGFCQVEKGQAPMMLDQDEPRKVAEAVQLLGLKYVVLTSVARDDLTDGGAGWFVAVMERIRQDNPATQIEVLTPDFWGGMGRERSQKERVLTVTKAKPVCYNHNLETVARLQGKVRRGAKYQRSLDVLRWIKEFDPDIFTKSGLMLGHGETVDEVVETLKDLRSVGCDRLTLGQYMQPSLDHLPVQKYWTPEEFDQLGEIAKDLGFSHVRSGPLVRSSYHAGED

SEQ ID NO: 26712 - DNA, 888 bp, Aeropyrum pernix
  CDS (1)..(888): transl_table=11
atggcgatggaggcggcgaagccgaggcttagggtcaggataaacgactcgtacgttaaggtagccaggcttgtggcaggcctgggtgtagccacggtatgcgagggagcgttgtgccccaacatatttacctgctggggggagggtacggccaccttcatgataatgggcgacacctgcacgcggggctgtaggttctgctatgtgaagaagggtgttcccgagcccctggacccccttgagccgtataaggttgctctagccgtggacgccctgggcctggactacgtgaccctcaccagcgttgacagggatgacctgcctgacggcggggccagccacttcgccgcgaccgtcagggcgataaagaggctgaggcctgacaccatagttgaggccctcatacccgacttccagggtgtggaggagcatgtgaggcttgtcgcggccagcgggctcgaggtcctcgcccacaatatagagacggtggagaggctgacgcccctggtgagggataggagggcagggtacaggcagagcctcagggttctcgagatcgctaaggaggagggggtagttaccaagtccagcatactactgggcctgggcgaggataagagcgaggttatcgaggctatgagggatttgaggagcgtaggggtagacattctggtgctcagccagtactacaggccgagtaggaagcagctgccggttgcgaagaggtatagcctctccgagttccgcgagctggctgagaagggccttcgaatggggttcgcctacgtcgtggcccaccccctggccaggacctcgttcaaggcgaaggaggcgtacttggccgcggtgaggagagttgaagctgagggtggtggtagacgggcctag

SEQ ID NO: 26713 - protein, 295 aa, Aeropyrum pernix
MAMEAAKPRLRVRINDSYVKVARLVAGLGVATVCEGALCPNIFTCWGEGTATFMIMGDTCTRGCRFCYVKKGVPEPLDPLEPYKVALAVDALGLDYVTLTSVDRDDLPDGGASHFAATVRAIKRLRPDTIVEALIPDFQGVEEHVRLVAASGLEVLAHNIETVERLTPLVRDRRAGYRQSLRVLEIAKEEGVVTKSSILLGLGEDKSEVIEAMRDLRSVGVDILVLSQYYRPSRKQLPVAKRYSLSEFRELAEKGLRMGFAYVVAHPLARTSFKAKEAYLAAVRRVEAEGGGRRA

SEQ ID NO: 26714 - DNA, 972 bp, Agrobacterium tumefaciens
  CDS (1)..(972): transl_table=11
atggtcactattctcgacaggacgtcgtccgacgaaaagcgcatccgccacccggaaaaggcgcatcggcccgataccgaggtcatgcgcaagccggaatggatccgcgtcaaggcgccgacttccaagggttatcacgagacgcgcgaactggtgcgcagccacaagctggtaacggtgtgcgaggaagccggctgtccgaatatcggcgagtgctgggaaaagaaacacgcgaccttcatgatcatgggtgaaatctgcacccgtgcctgcgccttctgtaacgtcgcgaccggcaagcccaatgcgcttgacatggacgagcccgaaaacgtcgccaaggccgtcaagcagatgggcctttcacatgtcgttatcacctcggttgaccgtgacgatctcgccgacggcggtgctgaacatttcgagaaggtcatctgggcgatccgtgccgcgtctccgacgacgaccatcgaaatcctcacccccgacttcctgaagaagcccggcgcgctggagcgcgtcgtcgccgccaagcctgatgtcttcaaccacaacatggaaactgttccgggcaattacctcacggttcgtccgggcgcgcgttatttccattccgtgcgtctcttgcagcgtgtcaaggaactggaccccaccatgttcaccaagtccggcatcatggtcggcttgggtgaagagcgcaacgaagtgctgcagctgatggacgatctgcgcagcgccgacgtggatttcctgaccatcggccaatatctgcagccgacccgcaaacaccacaaggttgaggccttcgtcacaccggaagaattcaagtcctacgagactgtggcctatgccaagggcttcctgatggtctcttccagcccgctgacgcgttcttcccaccatgccggcgacgattttgagcgcctgcgtgcggcccgcgagaagaagctgctggctgctgctgagtaa

SEQ ID NO: 26715 - protein, 323 aa, Agrobacterium tumefaciens
MVTILDRTSSDEKRIRHPEKAHRPDTEVMRKPEWIRVKAPTSKGYHETRELVRSHKLVTVCEEAGCPNIGECWEKKHATFMIMGEICTRACAFCNVATGKPNALDMDEPENVAKAVKQMGLSHVVITSVDRDDLADGGAEHFEKVIWAIRAASPTTTIEILTPDFLKKPGALERVVAAKPDVFNHNMETVPGNYLTVRPGARYFHSVRLLQRVKELDPTMFTKSGIMVGLGEERNEVLQLMDDLRSADVDFLTIGQYLQPTRKHHKVEAFVTPEEFKSYETVAYAKGFLMVSSSPLTRSSHHAGDDFERLRAAREKKLLAAAE

SEQ ID NO: 26716 - DNA, 897 bp, Bacillus anthracis
  CDS (1)..(897): transl_table=11
atgacaaaacaaacagaatataagcgcaagcccgaatggttgaaaattaagttaaacacgaatgaaaactatacaggcttaaagaaaatgatgcgttctaagaatcttcatacagtttgtgaagaagcgaaatgtccgaatattcatgaatgctgggctgtaagaaaaacagcaacatttatgattttaggagcagtatgtacacgtgcttgtcgtttctgtgcggttaaaacaggcttaccaacagagcttgatttacaagagccagaacgcgtagcagattctgtagtacaaatgggcttaaagcacgttgttataacagcggttgcacgtgatgatttaaaagacgggggagcagctgtttttgctgaaacagtacgcgctgtacgtcgtaaaaatccatttacgtcaatcgaagtattaccatctgatatgggtggagtagaagaaaacttaaaaatgttaatggatgcaaaaccagatattttaaaccataacattgaaacagtacgtcgattatctaaccgagttcgcgctagagcaaaatatgaccgttcattagagtttttacgtcgagcgaaagaaatgcagcctgatattccaactaaatcgagcattatggtcggcttaggggaaacgagagaagatttaattgaagcaatggatgacttacgtgcaaacaatgtggatattttaactcttggacaatacctacaaccatctaagaagcatttaccagttcttaaatattatccaccagcagaatttgcagagcttaaagaaattgcacttagcaaaggatttagccactgtgaagctggcccacttgtgcgttcttcttaccatgcggacgagcaagttcgttctgcaaaagaaaaaacagcagaagcaaaataa

SEQ ID NO: 26717 - protein, 298 aa, Bacillus anthracis
MTKQTEYKRKPEWLKIKLNTNENYTGLKKMMRSKNLHTVCEEAKCPNIHECWAVRKTATFMILGAVCTRACRFCAVKTGLPTELDLQEPERVADSVVQMGLKHVVITAVARDDLKDGGAAVFAETVRAVRRKNPFTSIEVLPSDMGGVEENLKMLMDAKPDILNHNIETVRRLSNRVRARAKYDRSLEFLRRAKEMQPDIPTKSSIMVGLGETREDLIEAMDDLRANNVDILTLGQYLQPSKKHLPVLKYYPPAEFAELKEIALSKGFSHCEAGPLVRSSYHADEQVRSAKEKTAEAK

SEQ ID NO: 26718 - DNA, 894 bp, Bacillus cereus
  CDS (1)..(894): transl_table=11
atgacaaaacaaacagaatataagcgcaagcccgaatggttgaaaattaagttaaacacgaatgaaaactatacaggcttaaagaaaatgatgcgttctaagaatcttcataccgtttgtgaagaggcaaaatgtccgaatattcatgaatgctgggctgtaagaaaaacagcaacatttatgattttaggtgcggtttgtacacgtgcttgtcgtttttgtgcggttaaaacaggcttaccaactgagcttgatttacaagaaccagaacgcgtagcagattcagtagtacaaatgggcttaaagcacgttgttataacagcggttgcacgtgatgatttaaaggacgggggagcagctgtttttgctgaaacagtacgcgcagtacgtcgtaaaaacccattcacgtctatcgaagtattaccatctgatatgggtggagtagaagaaaacttaaaaatgttaatggatgcaaaaccagatattttaaaccataacattgaaacagtacgtcgattatctgaccgagttcgcgctagagcaaaatatgaacgttcattagagtttttacgtcgagcgaaagaaatgcagcctgatattccaactaaatcgagcattatggtgggcttaggtgaaacgagagaagatttaattgaagcaatggatgacttacgtgcaaacaatgtggatattttaactcttgggcaatacctacaaccatctaagaagcatttaccagttcttaaatattacccaccagcagaatttgcagagcttaaagaaattgcacttagcaaaggatttagccactgtgaagctggcccacttgtgcgttcttcttaccatgcggacgagcaagtacgttctgcaaaagaaaaaacagcaggaagctaa

SEQ ID NO: 26719 - protein, 297 aa, Bacillus cereus
MTKQTEYKRKPEWLKIKLNTNENYTGLKKMMRSKNLHTVCEEAKCPNIHECWAVRKTATFMILGAVCTRACRFCAVKTGLPTELDLQEPERVADSVVQMGLKHVVITAVARDDLKDGGAAVFAETVRAVRRKNPFTSIEVLPSDMGGVEENLKMLMDAKPDILNHNIETVRRLSDRVRARAKYERSLEFLRRAKEMQPDIPTKSSIMVGLGETREDLIEAMDDLRANNVDILTLGQYLQPSKKHLPVLKYYPPAEFAELKEIALSKGFSHCEAGPLVRSSYHADEQVRSAKEKTAGS

SEQ ID NO: 26720 - DNA, 912 bp, Bacillus halodurans
  CDS (1)..(912): transl_table=11
atggcgaagaaagaagagtatgtacgcaagccggattggctaaagataaagctcaatacgaatgagacgtatacaggcctgaaaaaaatgatgcgcgagaaaaatttacatacggtttgtgaagaagcgaaatgtccaaacattcatgagtgctgggctgtgcggaaaacggccacgtttatgattcttggggatgtatgcacgcgcgcgtgtcgattctgcgctgttaaaacagggcttccgaatgaacttgatctacaggaaccagagcgcgtagcagaatcggttgaaattatgggcttaaagcacgctgtcattaccgctgtggctcgtgatgatttgaaggatggtggagcaggtgtattcgcggaaaccgttcgcgcggttcgccgtcgtaatccattttgtacgattgaagtgcttccatcagatatgatggggaatgacgataacttaaaaacattaatggacgcaagaccgaacattttaaaccataacattgaaacggttcgccgtttgactccaagggttcgtgcaagagcaacctatgagcgctccttagaatttttacgtcgcgcaaaggaaatgcagcctgatattccgacaaagtcaagtcttatgattggccttggggaaacgaaggacgagattattgagacgatggatgacctccgtgcgaacaatgtggacattatgacaatcggtcaatatttacagccgacgaaaaagcatttgaaggtgcagaaatattaccatccagacgaatttgctgagttgaaggaaattgcgttaagcaaaggatttagtcattgtgaagcgggtccgctcgtacgctcttcttaccatgccgatgagcaagtgaatgaagcacaagtgcgtgaggaagcgcgcaaggcagcggcgaaatcataa

SEQ ID NO: 26721 - protein, 303 aa, Bacillus halodurans
MAKKEEYVRKPDWLKIKLNTNETYTGLKKMMREKNLHTVCEEAKCPNIHECWAVRKTATFMILGDVCTRACRFCAVKTGLPNELDLQEPERVAESVEIMGLKHAVITAVARDDLKDGGAGVFAETVRAVRRRNPFCTIEVLPSDMMGNDDNLKTLMDARPNILNHNIETVRRLTPRVRARATYERSLEFLRRAKEMQPDIPTKSSLMIGLGETKDEIIETMDDLRANNVDIMTIGQYLQPTKKHLKVQKYYHPDEFAELKEIALSKGFSHCEAGPLVRSSYHADEQVNEAQVREEARKAAAKS

SEQ ID NO: 26722 - DNA, 897 bp, Bacillus subtilis
  CDS (1)..(897): transl_table=11
ttggcaaagaaagacgaacacctcagaaagcccgaatggcttaaaattaaattaaatacaaatgaaaactatacagggctcaaaaaactcatgcgggaaaacaacctgcataccgtatgcgaagaagcaaagtgtccgaatattcatgaatgctgggcggtcagacgtacagcgacatttatgattttaggttctgtttgtacaagagcatgccgtttctgtgctgtcaaaacaggccttccaactgagcttgatctgcaagagccggaacgcgtagcggattcagtcgcgcttatgaatttgaaacacgcggtcattacggctgttgcgcgtgacgatcagaaagatggcggggcaggcattttcgcggaaactgtccgtgcgatccgcagaaaaagcccgttcacaacaattgaggtgctgccgtctgatatgggcggaaactacgataacctaaaaaccttgatggatacacgcccagacatcctgaatcacaatatcgaaacggttcgccgcctgacgccaagagtccgcgcgcgtgcgacgtacgaccgttcattggaatttttgcgccgtgcgaaggaaatgcagcctgacattccgacaaaatcaagtatcatgatcggactcggcgaaacaaaagaagagattattgaagtaatggacgacctcttggcgaacaacgtggatattatggcaatcggccaatatctgcagccgacgaagaaacacttgaaagtccaaaaatactaccatcctgatgaatttgcagaattaaaagaaatcgcgatgcaaaaaggcttcagccattgtgaagccggtccgcttgtccgttcctcttaccatgcggatgaacaagtaaacgaagcatctaaaaagcgtcaagcacaagcataa

SEQ ID NO: 26723 - protein, 298 aa, Bacillus subtilis
MAKKDEHLRKPEWLKIKLNTNENYTGLKKLMRENNLHTVCEEAKCPNIHECWAVRRTATFMILGSVCTRACRFCAVKTGLPTELDLQEPERVADSVALMNLKHAVITAVARDDQKDGGAGIFAETVRAIRRKSPFTTIEVLPSDMGGNYDNLKTLMDTRPDILNHNIETVRRLTPRVRARATYDRSLEFLRRAKEMQPDIPTKSSIMIGLGETKEEIIEVMDDLLANNVDIMAIGQYLQPTKKHLKVQKYYHPDEFAELKEIAMQKGFSHCEAGPLVRSSYHADEQVNEASKKRQAQA

SEQ ID NO: 26724 - DNA, 849 bp, Bacteroides thetaiotaomicron
  CDS (1)..(849): transl_table=11
atggctgacagagtgcgcaagcctgaatggctgaaaataaatatcggtgccaacgaccgttacaccgaaactaaaagaattgtcgactcccactgcctgcatacgatatgcagcagtgggcgttgtcccaacatgggagaatgctggggaaaaggaactgccacatttatgatcggcggtgacatctgtacccgcagctgcaaattctgcaacacacaaaccggacgcccgcatccactggatgccaacgaaccgacacacgtagcggagtctatcgctcttatgaaactagatcatgcggtagttacctcggtagaccgtgacgaccttcccgatctgggagccggacattgggcacataccattcgtgagatcaaacgactgaatccgcagaccacaatcgaagtactgatacccgattttcagggtagaatggaactggtagacctagtgatagaagccaatcccgacatcatttcccataatatggagacggtaagacgcatcagtcccctggttcgcagtgcggccaactatgataccagcctgcaagtgatcggtcacatcgcccgaagcggaacaaaatcaaaaagcggtattatggtggggttgggagaaactccacaggaagtggaaaccattatggacgacctgctggcagtcggctgccagattcttacgataggacaatatttgcagcctacgcaccgtcattatccggttgccgagtatgtgacgccacagcaattcgccacatacaaaaccatcggtttggagaaaggattcagcattgtagagagtgctcctctcgttcgttcgtcttatcatgcagagaaacacattcgatag

SEQ ID NO: 26725 - protein, 282 aa, Bacteroides thetaiotaomicron
MADRVRKPEWLKINIGANDRYTETKRIVDSHCLHTICSSGRCPNMGECWGKGTATFMIGGDICTRSCKFCNTQTGRPHPLDANEPTHVAESIALMKLDHAVVTSVDRDDLPDLGAGHWAHTIREIKRLNPQTTIEVLIPDFQGRMELVDLVIEANPDIISHNMETVRRISPLVRSAANYDTSLQVIGHIARSGTKSKSGIMVGLGETPQEVETIMDDLLAVGCQILTIGQYLQPTHRHYPVAEYVTPQQFATYKTIGLEKGFSIVESAPLVRSSYHAEKHIR

SEQ ID NO: 26726 - DNA, 1002 bp, Bordetella bronchiseptica
  CDS (1)..(1002): transl_table=11
atgtccacgctcgtcgagtcccccgttccctcgaacgactcgcaggccgccgcgccggccgcctacgatcccacccagaagcagaaatcgcaggccaagaccgcgcgcattccgatcaaggtggtcgcggccgagaagctgaagaagccggaatggatccgcgtgcgcgccgccgccccggggtcgcgcttctacgacatcaagcgcatcctgcgcgagcacaacctgcatacggtgtgcgaagaggcatcctgcccgaacatcggcgaatgcttcggcaagggcacggccaccttcatgatcatgggcgacaagtgcacgcgccgttgcccgttctgtgatgtgggccacggccgtcccgatccgctggacacgcaagagcccgaaaacctggcgcgcaccatcgccgcgctcaagctgtcctacgtggtcatcacctcggtcgaccgcgacgacctgcgcgacggtggcgccgcccacttcgtcgaatgcatcgccaaggtgcgcgagtattcgcccgatacccgcatcgaagtgctggtgcccgacttccgcggccgcctggaccgtgcgctgcacatcctcaacagcggcccgccggacgtcatgaaccacaacctggaaaccgtgccgcgcctgtacaagcaggcacgcccgggctcggactacgcgcattcgctcaagctgctggccgagttcaagaagctgcaccccgaggtgcccaccaagtcgggcctgatgctgggcctgggcgagacggacgaggaaatcctgcaggtcatgcgggacatgcgcgagcacaacgtcgacatgctgaccatcggccagtatctccagccgtcggagcaccatctgccggtgctgcgctacgtgcatccggacaccttcgcgatgttcgagcgcgaggcctacgccatgggctttacgcatgcggccgtgggcgccatggtgcgctcgtcgtaccacgccgaccagcaggcgcacgccgccggcgtcaactga

SEQ ID NO: 26727 - protein, 333 aa, Bordetella bronchiseptica
MSTLVESPVPSNDSQAAAPAAYDPTQKQKSQAKTARIPIKVVAAEKLKKPEWIRVRAAAPGSRFYDIKRILREHNLHTVCEEASCPNIGECFGKGTATFMIMGDKCTRRCPFCDVGHGRPDPLDTQEPENLARTIAALKLSYVVITSVDRDDLRDGGAAHFVECIAKVREYSPDTRIEVLVPDFRGRLDRALHILNSGPPDVMNHNLETVPRLYKQARPGSDYAHSLKLLAEFKKLHPEVPTKSGLMLGLGETDEEILQVMRDMREHNVDMLTIGQYLQPSEHHLPVLRYVHPDTFAMFEREAYAMGFTHAAVGAMVRSSYHADQQAHAAGVN

SEQ ID NO: 26728 - DNA, 969 bp, Brucella melitensis
  CDS (1)..(969): transl_table=11
atggttacagttctcaatacggtcaaccagagcggacgtttgcggcacccggaaaaggcacaccgccccgacaatgaggtgctgaaaaagccggactggattcgcgtcaaggcgcctgtttcgcgcggctatggcgaaacgcgcgagattgtccgctcgaacaagcttgtgactgtctgtgaagaagccggttgcccgaatatcggcgagtgctgggaaaagaagcacgcgactttcatgattatgggcgaaatctgcacacgcgcctgcgcgttctgcaatatttcgaccggcattccgaatgcgctcgacccgaacgagccggaaaatattgccaaggccgtgaagcagatggggctgacccatgtggtcattacctcggtggaccgtgacgatctggccgatggcggtgcgcatcattttgccgaagttatcaaggccgtgcgcgaggccgcaccggcgaccacgatcgagattctgacaccggacttcctgcgcaaggaaggcgcgctggagatcgtggtcaaggctcgccctgacgtgttcaaccacaatctcgaaacagtgccgtcgaaatatctcaaggttcgtccgggtgcgcgctatttccactccatccgcctgcttcagcgtgtgaaggaactggatccgaccattttcaccaagtccggcattatggttggcctgggcgaagagcggaacgaaatacttcagcttatggacgatctgcgctctgctgatgttgatttcatgactatcggccaatatcttcagcccacccgcaagcatcatccggttatccgcttcgtcaagcccgatgaattcaagtctttcgagaccatcggcaagacaaagggcttcctgctggtcgcttccagcccgctgacacgctcgtcgcatcatgcgggtgaagattttgccaagctcaaggcggcgcgcgaagcgctttatgcttcaagggcctcgtaa

SEQ ID NO: 26729 - protein, 322 aa, Brucella melitensis
MVTVLNTVNQSGRLRHPEKAHRPDNEVLKKPDWIRVKAPVSRGYGETREIVRSNKLVTVCEEAGCPNIGECWEKKHATFMIMGEICTRACAFCNISTGIPNALDPNEPENIAKAVKQMGLTHVVITSVDRDDLADGGAHHFAEVIKAVREAAPATTIEILTPDFLRKEGALEIVVKARPDVFNHNLETVPSKYLKVRPGARYFHSIRLLQRVKELDPTIFTKSGIMVGLGEERNEILQLMDDLRSADVDFMTIGQYLQPTRKHHPVIRFVKPDEFKSFETIGKTKGFLLVASSPLTRSSHHAGEDFAKLKAAREALYASRAS

SEQ ID NO: 26730 - DNA, 960 bp, Buchnera aphidicola subsp
  CDS (1)..(960): transl_table=11
atgaataaaaaaaaagattctttgttcaaaacaataaaaaaaaataacataataaatgttattactactgaaagtttttctaaaaaaataataaaacttaataaacctgattggataaaaattaaaatacctgtcgatacgtttcgtattcgtgaaataaaaagtgctttacgtaaaaacaatttacattctgtttgtgaagaagctaattgtccaaatctaccagaatgttttaatcgcggaactgcaacgtttatgattcttggatcaagatgtactcgtaattgtccattttgtgctgtatctcatggcaaacctaattctctaaatgtcgaagaaccaaataatttagcaaaaactatatttgatatgggtattgattatgtagtaatcacttcagttgtaagagatgatttgtatgacggaggagcgcaacattttgttaattgtattaaatcaattagaaaaaaaaataaagttaaaattgaaatattagttcctgactttaggggaagagtagaattaattttaaaaatttttaattcaggattgcctgatgtgtttaatcataatgtagaaaatgttcctcgtctttataaaaaagtacgtcctggagctgattataaaaaatcgttgtttctattagaatcctttaaaaaaaaatattctaatattcctacaaaatcaggtttaatgttaggtttaggagaaaaagatacagaaataattcaagtaatgaaagatctgtattcaaatggtgttacattgttaacagtaggacagtatctgcaacctagtattaatcacattccagtacaacgttatataccactttcagaattcaaaaatataaaaaaagaagcattatctatcggttttactaatgcattctgcggaccttttgtacgttcatcgtatcatgctagttttcaagcaaataaattgattaaaaaaatttaa

SEQ ID NO: 26731 - protein, 319 aa, Buchnera aphidicola subsp
MNKKKDSLFKTIKKNNIINVITTESFSKKIIKLNKPDWIKIKIPVDTFRIREIKSALRKNNLHSVCEEANCPNLPECFNRGTATFMILGSRCTRNCPFCAVSHGKPNSLNVEEPNNLAKTIFDMGIDYVVITSVVRDDLYDGGAQHFVNCIKSIRKKNKVKIEILVPDFRGRVELILKIFNSGLPDVFNHNVENVPRLYKKVRPGADYKKSLFLLESFKKKYSNIPTKSGLMLGLGEKDTEIIQVMKDLYSNGVTLLTVGQYLQPSINHIPVQRYIPLSEFKNIKKEALSIGFTNAFCGPFVRSSYHASFQANKLIKKI

SEQ ID NO: 26732 - DNA, 945 bp, Buchnera aphidicola subsp
  CDS (1)..(945): transl_table=11
atgcgtactaaaaattcaaaaattattaattctgaacaagatatatttcgcaacaaagttattccaataaaatttttatctaattataataatgaaatactaaaaaaacctcagtggatgaaaattaaatttcctgttagcaccaataaaataaaaaatttaactctaatattaagacagcataatttaaatactgtttgcgaacaggcattatgtcctaatttagccgaatgttttaatcgaggaacagctacatttatgattttaggttctatttgtacgagacgttgtccattttgcgctgtaagtcatggaaaaccatcgttagttaataaaaacgaaccacagcaattagcacgggtaatatttgatatgaaaattaattatgtagttattacttctgtggtaagagacgatttgaaagatcgaggagcacaacatttttctaattgtatacaggaaattagaaataaaaataatgttaaaattgaaatattagtaccagattttagaggaatgatgcgtgaatcatgcaaaattattagtatgaatccacctaatgtgtttaatcataatttggaaaatgtcccaaggttatataaattaataagaccaggggctagctatataagatccttgaaattattagagttttttaaaaaattgaatccaaatgttccaactaaatctggtttaatcttaggtttaggggaaacatataaagaaatagttcatgttataaatgatttattagatcatggtgtaaccattttaaccataggacaatatcttcaacctagctctaaacattttcccgtacaaaaatatattactcctgatgaatttaaaaaaattaaaaattatgcgttatccattggttttaaaaaagttttttgtgggccactaatacgatcttcttatcatgctgagaaatattttgaataa

SEQ ID NO: 26733 - protein, 314 aa, Buchnera aphidicola subsp
MRTKNSKIINSEQDIFRNKVIPIKFLSNYNNEILKKPQWMKIKFPVSTNKIKNLTLILRQHNLNTVCEQALCPNLAECFNRGTATFMILGSICTRRCPFCAVSHGKPSLVNKNEPQQLARVIFDMKINYVVITSVVRDDLKDRGAQHFSNCIQEIRNKNNVKIEILVPDFRGMMRESCKIISMNPPNVFNHNLENVPRLYKLIRPGASYIRSLKLLEFFKKLNPNVPTKSGLILGLGETYKEIVHVINDLLDHGVTILTIGQYLQPSSKHFPVQKYITPDEFKKIKNYALSIGFKKVFCGPLIRSSYHAEKYFE

SEQ ID NO: 26734 - DNA, 990 bp, Burkholderia pseudomallei
  CDS (1)..(990): transl_table=11
atgactgaccttaccgctacccccgcacccgccgaaccggccgcttccgcctacgatccgaccgccaagcagaaggcgcaggcgaagaccgcgcgcattccgatcaagatcgtcccgatcgagaagctgaagaagcccgaatggatccgcgtgaaggcggccaccggcagctcgcgcttcaacgagatcaagacgatcctgcgcgagcacaacctgcatacggtgtgcgaggaagcgagctgcccgaacatcggcgaatgcttcggcaagggcaccgcgacgttcatgatcatgggcgacaagtgcacgcgccgctgcccgttctgcgacgtcggccacggccggcccgatccgctcgacgcagacgagccgaagaacctcgcgcgcacgatcgcggcgctcaagctcaagtacgtggtgatcacgagcgtcgaccgcgacgatctgcgcgacggcggcgccggccacttcgtcgagtgcatccgcgaagtgcgcgagcagtcgcccgcgacgcgcatcgagatcctgacgccggacttccgtggccgcctcgaccgtgcgctcgcgatcctgaacgcggcgccgcccgacgtgatgaaccacaatctcgaaacggtgccgcgcctgtacaaggaggcgcgccccggctcggactatgcgcattcgctgaagctcctgaaggatttcaaggcgctgcatccggacgtcgcgacgaaatcgggcctgatggtcggcctgggcgagacgaccgacgagatcctgcaggtgatgcgcgacctgcgcgcgcacgacgtcgacatgctgacgatcggccaatacctgcagccgtccgagcaccatctgccggtgcgcgagtacgtgcatccggacacgttcaagatgtacgaggaagaggcgtacaagatgggcttcacgcacgcggccgtcggcgcgatggtgcgctcgagctatcacgccgatctgcaggcgcacggcgccggggtggtttga

SEQ ID NO: 26735 - protein, 329 aa, Burkholderia pseudomallei
MTDLTATPAPAEPAASAYDPTAKQKAQAKTARIPIKIVPIEKLKKPEWIRVKAATGSSRFNEIKTILREHNLHTVCEEASCPNIGECFGKGTATFMIMGDKCTRRCPFCDVGHGRPDPLDADEPKNLARTIAALKLKYVVITSVDRDDLRDGGAGHFVECIREVREQSPATRIEILTPDFRGRLDRALAILNAAPPDVMNHNLETVPRLYKEARPGSDYAHSLKLLKDFKALHPDVATKSGLMVGLGETTDEILQVMRDLRAHDVDMLTIGQYLQPSEHHLPVREYVHPDTFKMYEEEAYKMGFTHAAVGAMVRSSYHADLQAHGAGVV

SEQ ID NO: 26736 - DNA, 978 bp, Caulobacter crescentus
  CDS (1)..(978): transl_table=11
atggccacggtgatcgacaccctgaaggctcgcggctcggaagaccgggcggcgcgccatcctgaaaagcagaaccgaccggacacgccggtgcttcgcaagcctgaatggctgcgtgtgcgcgcgcccggctcggggcagtacaacgagaccaagggcatcgtgcgcgagcacaagctgcacacggtctgcgaagaggcggcctgcccgaacatcggcgagtgctggagccagaagcacgcgaccatgatgatcatgggcgagatctgcacccgcgcctgcgccttctgcaatgtgaccacgggcctgccgacgcaactggatcccgacgagccgcgccgcgtggccgaggctgtcgccaagatgggcctcaaacacgtggtcatcacctcggtggaccgcgacgaccttctggacggcggcgcgcgccatttcgccgaggtggtcacgtccatccgggccgccgccccgggcacgacgatcgagatcctgaccccggatttcctccgcaaggacggcgccgagaacgtcgtcatcgactccaagccggacgtcttcaaccacaatctcgaaaccgtgccgcggctctacctgaagatccgtcccggcgcgcgctactacaactcgctgcgcctgctcgaccgcgtcaagcagcgtgacccttcgcagttcaccaagtcgggcctgatggtcggtctgggtgaaaccaaggaagaggtcatgcaggtgatggacgacatgcgctcggcgggcgtcgatttcatcaccatcggccagtacctgcagccgacgcgcaagcacgcggcgatcgaccgtttcgtgacgcctgaagagttcaaggcctacgaggcgatcgcgcgggctaagggcttcctgatggtgtcgtccagtccgctgacccgctcgtcgcaccacgccggcgaggatttcgccaagttgcaggccgcgcggcgcgccctcgacgctcgtaccgcctaa

SEQ ID NO: 26737 - protein, 325 aa, Caulobacter crescentus
MATVIDTLKARGSEDRAARHPEKQNRPDTPVLRKPEWLRVRAPGSGQYNETKGIVREHKLHTVCEEAACPNIGECWSQKHATMMIMGEICTRACAFCNVTTGLPTQLDPDEPRRVAEAVAKMGLKHVVITSVDRDDLLDGGARHFAEVVTSIRAAAPGTTIEILTPDFLRKDGAENVVIDSKPDVFNHNLETVPRLYLKIRPGARYYNSLRLLDRVKQRDPSQFTKSGLMVGLGETKEEVMQVMDDMRSAGVDFITIGQYLQPTRKHAAIDRFVTPEEFKAYEAIARAKGFLMVSSSPLTRSSHHAGEDFAKLQAARRALDARTA

SEQ ID NO: 26738 - DNA, 939 bp, Chlamydophila caviae
  CDS (1)..(939): transl_table=11
atgaatacaccttccgatgaaacacgaaaacctccacaaggtaaacgtttcgccgagcgtcttcccaaatggctaaggcaagttttacctactggtccagtctttgcccaaacagatacaacgataaagcgcacgggaatggccacggtatgcgaagaagctctatgtcccaatcgggcatgttgctggtcaagaaagacagcaacctatctagctttaggagatgcgtgcacaagacgttgtggtttctgtaacattgacttcacgaaaaagcctatctcccctgatcctgaagaacctcaaaaaattgcagaatcagcaaaaattcttcagcttaagcatattgttttaaccatggtagcccgtgatgatctagaagatggcggtgcaagttttctcgtgcgtattattgatactctacatcaagagcttccagaatctactgtcgaggtattagcttcagactttcaaggaaacattgatgctttacacacactattggattcaggattaaccatttataatcataatgtggaaacggttgaacgtctcacacctgtagtacgtcataaagcaacatatcgtcgttctttatttatgttagagcaagcggctatgtatctccctgatcttaagattaaatcaggaattatggtgggtcttggagagcaggaaagcgaggtaaaacaaacgctaaaagatcttgcagatcacggagtgaaaatcgtcaccataggacagtatttacgtccttcccgatcacatataccagtaaaaagctacgttactcccgagacttttgattactaccgtacaataggaacgtctttagggctttttgtctatgcaggaccttttgttcgttctagtttcaatgcagatatcgtcttgcataatctggagaacaaacaatctgatgtagcaaaaatgcagaattag

SEQ ID NO: 26739 - protein, 312 aa, Chlamydophila caviae
MNTPSDETRKPPQGKRFAERLPKWLRQVLPTGPVFAQTDTTIKRTGMATVCEEALCPNRACCWSRKTATYLALGDACTRRCGFCNIDFTKKPISPDPEEPQKIAESAKILQLKHIVLTMVARDDLEDGGASFLVRIIDTLHQELPESTVEVLASDFQGNIDALHTLLDSGLTIYNHNVETVERLTPVVRHKATYRRSLFMLEQAAMYLPDLKIKSGIMVGLGEQESEVKQTLKDLADHGVKIVTIGQYLRPSRSHIPVKSYVTPETFDYYRTIGTSLGLFVYAGPFVRSSFNADIVLHNLENKQSDVAKMQN

SEQ ID NO: 26740 - DNA, 927 bp, Chlamydia muridarum
  CDS (1)..(927): transl_table=11
atgagtaattccccagaatcctcaactcccaagcagtccatcccagcacgattccccaaatggttgcgacaaaaacttcctctagggaaagtattttctcgaactgatggcactataaaaaataaggggctccccactgtttgtgaagaagcctcttgtcccaatcgcacgcattgttggtccagacataccgctacataccttgcattgggtgatgcatgtacacgtcgctgtggcttttgtgatattgatttcactaaaaaacctcttcccccagatcctcaagaaggagagaaaatcgctgcttccgcaaaagcattgggcctaaaacatatcgtgatcaccatggtttctcgcgatgatttggaggatggcggagcagatgctctagctcgtatcattacaaccttacatatagaacttccagaagctactattgaagttctagcctctgattttgaagggaacattgatgctttacaccatctacttgatgcacgtattgccatctataaccataatgtagaaactgtagaacgactatctccccttgttcgtcataaagcaacctaccgacggtctctgatgatgttagagcaggctgcacaatacctcccagaccttatgattaagtctggtataatggtaggattaggagaacaggaaagcgaaatcaagcaaacgttaaaagatcttgcagatcatggcgttaagatagttactataggacaataccttcgtccttcgcgaagacatattcctgtgaaaagctatgtttctccagaaacatttgattattatcgatccgtaggggaggctttgggtcttttcatttatgcaggacctttcgttcgttctagctttaatgcagatgctgtttttgaagctatgagtcaacgagagcgcctgtccgcttctatacaatag

SEQ ID NO: 26741 - protein, 308 aa, Chlamydia muridarum
MSNSPESSTPKQSIPARFPKWLRQKLPLGKVFSRTDGTIKNKGLPTVCEEASCPNRTHCWSRHTATYLALGDACTRRCGFCDIDFTKKPLPPDPQEGEKIAASAKALGLKHIVITMVSRDDLEDGGADALARIITTLHIELPEATIEVLASDFEGNIDALHHLLDARIAIYNHNVETVERLSPLVRHKATYRRSLMMLEQAAQYLPDLMIKSGIMVGLGEQESEIKQTLKDLADHGVKIVTIGQYLRPSRRHIPVKSYVSPETFDYYRSVGEALGLFIYAGPFVRSSFNADAVFEAMSQRERLSASIQ

SEQ ID NO: 26742 - DNA, 924 bp, Chlamydia pneumoniae
  CDS (1)..(924): transl_table=11
atgaaatgtagaccaactttaaatacagaccaacctagagtgcggaaaaagcttcccgagcgtttccccaagtggttacagaggcccttaccacaaggttctgcatttcatgctacggacgctacaataaaacgctcaggaatgccaacggtatgcgaagaagctctctgccccaatcgagcagaatgttggtctcgtaaaactgccacctaccttgctctcggcgatgtctgtacaagaagttgcggtttttgcaatattgggcattctaaaaccccacccgcgctagatcctacagaacccgagcgcattgctttgtcagcgaaagaactggggttgaagcatgtggtaatcaccatggtggctcgcgatgaccttgaggatggtggtgcacaaggtttagtcgatatcattcaaaagttacgtgaagaactccctcaagcgactacagaagttttagcttctgatttccaagggaatgtttctgctctccacaccctgttagattctggcattactatttataatcataatgtcgaaactgtagcgaggctctcgcctctagtacggcacaaagcaacctatgcccgatctatgttcatgttagaacaagctgccaactacctccccgatcttaaaatcaaatccgggatcatggtaggattaggtgagatggaaggagaagtcaaacaaactctccaagatctggcttccataggagttcgtattgtcactataggtcaatacttacgtccttctcgtaagcatctccaagtcaaaagttatgtgactcccgagacttttgattactatcgtcgagtcggagaagctatgggtctttttgtttacgcaggaccttttgtacgctcgagttttaatgccgatatgatcctagcttctgtacaagacaaagcgtcagcttaa

SEQ ID NO: 26743 - protein, 307 aa, Chlamydia pneumoniae
MKCRPTLNTDQPRVRKKLPERFPKWLQRPLPQGSAFHATDATIKRSGMPTVCEEALCPNRAECWSRKTATYLALGDVCTRSCGFCNIGHSKTPPALDPTEPERIALSAKELGLKHVVITMVARDDLEDGGAQGLVDIIQKLREELPQATTEVLASDFQGNVSALHTLLDSGITIYNHNVETVARLSPLVRHKATYARSMFMLEQAANYLPDLKIKSGIMVGLGEMEGEVKQTLQDLASIGVRIVTIGQYLRPSRKHLQVKSYVTPETFDYYRRVGEAMGLFVYAGPFVRSSFNADMILASVQDKASA

SEQ ID NO: 26744 - DNA, 873 bp, Chlorobium tepidum
  CDS (1)..(873): transl_table=11
atgaactctggtcccggaaagaaacccgactggctcaagatcaagctcgcttcgggctcgtcgtttgcttcgacgcgcaagctgctgaaccggcacagcctccacacggtgtgccgctcggcgatgtgcccgaacctgcacgagtgctggtcgaaaggcacggccaccttcctcttgctcggcaacgtctgcacccgctcctgccgtttttgcgcggtcggaacggaatgccggccggctatgcccgatccggaggagccgtcgaagatcgccgaggcggtgaaaacgatgaagctccgccacgccgtgctaaccagcgtcaaccgtgacgatctcgccgatggcggtgcaacgcactgggttgaaaccatccgcgcgattcgcgaagtgaaccccggcgtgagtctcgaatgtctcattcccgacttcagcggcaatgaacagtcgctcgatttggtgatgcaggagctcccggaggtgctgaatcacaacatcgaaaccgtgccgtcacgctacgccgccgtgcgcccgcaagccttgtacgaacgctcgcttgcggtgatcgagcgggcgaagcgccagttccggctcgccaccaagtccggcatgatggtcggcatgggtgaaacggaggaggagctcgaagcgtcgctgcacgacctgcgaggtcacggctgtgacatggtgactatcggccagtacctgcaaccaaccgccgcgcatctgccggtgagccgctacgtgacgcccgaagagttcgagcgctaccgcgaaatcgcgctcgacgccggattccggcacgttcagtcgggccccttcgtgcgcagttcgtaccacgccgaggcattcgagccagttgaaaaaatttcctga

SEQ ID NO: 26745 - protein, 290 aa, Chlorobium tepidum
MNSGPGKKPDWLKIKLASGSSFASTRKLLNRHSLHTVCRSAMCPNLHECWSKGTATFLLLGNVCTRSCRFCAVGTECRPAMPDPEEPSKIAEAVKTMKLRHAVLTSVNRDDLADGGATHWVETIRAIREVNPGVSLECLIPDFSGNEQSLDLVMQELPEVLNHNIETVPSRYAAVRPQALYERSLAVIERAKRQFRLATKSGMMVGMGETEEELEASLHDLRGHGCDMVTIGQYLQPTAAHLPVSRYVTPEEFERYREIALDAGFRHVQSGPFVRSSYHAEAFEPVEKIS

SEQ ID NO: 26746 - DNA, 936 bp, Chlamydia trachomatis
  CDS (1)..(936): transl_table=11
atgaccgattcagaatctcctattcctaaaaaatctatacccgccagattccctaagtggctacgccagaaactccctttagggcgggtatttgctcaaactgataatactatcaaaaataaagggcttcctacagtctgtgaggaagcctcttgtccgaatcgcacccattgttggtctagacatacagctacctatctagccttaggtgatgcctgtacacgtcgctgcggcttttgtgatattgacttcactagaaatcccttacccccagatcctgaagaaggagctaaaattgctgagtccgcaaaagctttgggactcaagcacattgtcatcactatggtttcccgtgatgatttagaggatggaggagccagcgctcttgtccacattattgaaacgttgcacacagaattaccaacagcaactattgaagtcctagcctctgattttgaaggtaacattgctgccttacatcacttactggatgcgcacattgctatctataatcataatgtagaaacagtagaacgactcactccatttgtccgtcataaagctacctaccgaagatcgcttatgatgttggagaatgcagccaaatacctccctaacctgatgactaaatcaggtatcatggtaggattaggagagcaagaaagcgaggtcaagcaaaccttaaaagatcttgctgatcatggcgttaagatcgtaactataggccagtatcttcgtccttcacgcagacatattcctgtgaaaagctatgtgtctcccgagactttcgattattatcgctcggtaggagagtcgttaggactctttatttatgctggcccattcgttcgttctagctttaatgcggattctgtttttgaagccatgcgccagcgggaaacctcaacctctgcgctacttccgaataaagattag

SEQ ID NO: 26747 - protein, 311 aa, Chlamydia trachomatis
MTDSESPIPKKSIPARFPKWLRQKLPLGRVFAQTDNTIKNKGLPTVCEEASCPNRTHCWSRHTATYLALGDACTRRCGFCDIDFTRNPLPPDPEEGAKIAESAKALGLKHIVITMVSRDDLEDGGASALVHIIETLHTELPTATIEVLASDFEGNIAALHHLLDAHIAIYNHNVETVERLTPFVRHKATYRRSLMMLENAAKYLPNLMTKSGIMVGLGEQESEVKQTLKDLADHGVKIVTIGQYLRPSRRHIPVKSYVSPETFDYYRSVGESLGLFIYAGPFVRSSFNADSVFEAMRQRETSTSALLPNKD

SEQ ID NO: 26748 - DNA, 948 bp, Chromobacterium violaceum
  CDS (1)..(948): transl_table=11
atgaagccggacaaccaggccggggtgaagcacaagggcgcggccaagaccgcccgcatcccgatcaagatcgtgccgctggacgaaaagctgaaaaagccggagtggatccgcgccaagctgcccaatggccagcgtttccacgagatcaagcagatcctgcgcgagcagaagctgcacacggtctgcgaagaggccacctgcccgaacatcggcgagtgcttcagcaagggcaccgccacctttatgatcatgggcgacatctgcacccgccgctgcccgttctgcgacgtcggccacggccgtcccaatccgctggacgagaacgagccgagacacctggccgagagcgtggccgcgatgcgcctgaagtacgtggtggtcacctcggtggaccgcgacgacctgcgcgacggcggcgcccaacacttcgcagactgcatcaacgccgtgcgcgaaatgtcgccggcgacccagatcgagaccctggtgcccgacttccgcggccggctggacatcgccgtcgacatcctgacccagacgccgccggacgtgatgaaccacaacctggaaaccgtgccgcgcctgtacaagcaggcgcgcccgggcgccgactacgcgcactcgctgcagctcctcaaggactacaaggcgaagaatccgaacgtgcgcaccaagtccggcctgatggtgggcttgggcgagaccgacgaggaaatcctggaagtgatgcgcgacctgcgcgcgcacaacgtggacatgctgaccataggccagtacctgcagccgtccgacggccacctgccggtgctgcgctacgtgcatcccgacgtattcaagatgttcgaggaaaaagcctatgaaatgggcttcgtccatgccgcggtcggcgcgatggtgcgctccagctaccatgccgacgtgcaggcgcacgaagccggcgtttaa

SEQ ID NO: 26749 - protein, 315 aa, Chromobacterium violaceum
MKPDNQAGVKHKGAAKTARIPIKIVPLDEKLKKPEWIRAKLPNGQRFHEIKQILREQKLHTVCEEATCPNIGECFSKGTATFMIMGDICTRRCPFCDVGHGRPNPLDENEPRHLAESVAAMRLKYVVVTSVDRDDLRDGGAQHFADCINAVREMSPATQIETLVPDFRGRLDIAVDILTQTPPDVMNHNLETVPRLYKQARPGADYAHSLQLLKDYKAKNPNVRTKSGLMVGLGETDEEILEVMRDLRAHNVDMLTIGQYLQPSDGHLPVLRYVHPDVFKMFEEKAYEMGFVHAAVGAMVRSSYHADVQAHEAGV

SEQ ID NO: 26750 - DNA, 1050 bp, Corynebacterium diphtheriae
  CDS (1)..(1050)
atgactaaagcacccgaaggacgcagaatgctcagagttgaggcgcgcaactcgcagacccccatcgagagcaaaccacgttggatccgcaccgctgttaaaaccggccctgaatatcaggacatgaaaaagaaagtgtcgggtgcaagcctgcacaccgtatgccaagaagccggctgccctaatatccacgaatgctgggagtcgcgtgaggctaccttcttgattggtggcgctaactgctcgcgccgttgcgatttctgccagattaattctgctaagcccgaaccactcgatcgcgacgagccacgtcgcgttgcagaatcagtacgcgaaatgcagctgaattactcgaccatcactggtgtgacccgtgacgatcttgaagatgaaggcgcttggctatatgcagaagttgttcgcaagattcatgagctcaatccccacaccggcgtagaaaacctcacccctgatttctccggcaagcctgacttgttgcaagaggttttcgaggctcgccccgaagtttttgctcacaacctcgaaacggttcctcgcatcttcaagcggatccgccccgctttccgttacgagcgctccttagacgtgatccgccaagcccgcgattttggattggttaccaaatccaacctgatcttgggcatgggagaaaccgtcgacgaaatccgtgatgccttggttgacctgcactcggcaggttgtgacatcatcacgattacccaatatcttcgtcccggcccgatgtaccatcccatcgatcgttgggtaaaacctgaggaatttatcgatcacgctgattttgcgcgtgaacttggatttggtgctgttatgtcggggccattggtacgttcttcttatcgtgccggaaagctttatgccgaggctctcgcggctcgcggtgagtccttgccagaaaacttggctcatttggccacgactgccgatggcagtactgcgcaagaagcaaataccttgttggaaaagtacggtccttcccaagacacccctgtagtgtcgtcgaaggcttaa

SEQ ID NO: 26751 - protein, 349 aa, Corynebacterium diphtheriae
MTKAPEGRRMLRVEARNSQTPIESKPRWIRTAVKTGPEYQDMKKKVSGASLHTVCQEAGCPNIHECWESREATFLIGGANCSRRCDFCQINSAKPEPLDRDEPRRVAESVREMQLNYSTITGVTRDDLEDEGAWLYAEVVRKIHELNPHTGVENLTPDFSGKPDLLQEVFEARPEVFAHNLETVPRIFKRIRPAFRYERSLDVIRQARDFGLVTKSNLILGMGETVDEIRDALVDLHSAGCDIITITQYLRPGPMYHPIDRWVKPEEFIDHADFARELGFGAVMSGPLVRSSYRAGKLYAEALAARGESLPENLAHLATTADGSTAQEANTLLEKYGPSQDTPVVSSKA

SEQ ID NO: 26752 - DNA, 1047 bp, Corynebacterium efficiens
  CDS (1)..(1047): transl_table=11
gtgactatcgcacctgaggggcgtcgtatgctccgcgtcgaggcccggaactcccagaccccgatcgagaccaagccccggtggatcagaaaccaggtcaagaacggccctgagtacaaggacatgaaggagcgcgtcgcaggtgcctccctccacaccgtgtgtcaggaggccggttgccccaacatccacgagtgctgggaatcccgcgaggccaccttcctcatcggtggggccaactgctcacgtcgttgtgatttctgcatgatcaactcggctcgtccggaacccctcgatcgtggtgagcccctccgtgtcgcggagtcggtgcgcgagatgcgtctgaactactccaccatcaccggtgtgacccgtgatgatctcccggatgagggtgcctggctctattccgaggtggtccgcaagatccacgagctcaaccccaacaccggtgtggagaatctggttccggatttctccggcaagagggatctcctgcaggaggtcttcgaatcccgtccggaggtcttcgcccacaacctggagaccgtcccccgtatcttcaaacggatccgcccggcgttccgctacgaccgttccctggatgtcatccgtcaggcccgggacttcggtctggtcaccaagtccaacctgatcctgggcatgggtgagacccgtgaggagatctccgaggctctccgcgatctgcactccgccggcaccgacatcatcaccatcacccagtacctgcgtcccggaccgctcttccaccccattgagcgttgggtgaagccggaggagttcctcgagctctccgatgaggcctatgagatcggttttgcagcggtcatgtccggtcccctggtgcgctcgtcctaccgtgccggcaagctctacgcccaggcactgaagttccgcggtgaggagctgcccgccaacctctcccacctggctgagaccaccgagggcccgaccacgcaggaggcttcctcgctgctggagcgctacggtgcctccgaggatgcgcccgtgatcccccgcggttag

SEQ ID NO: 26753 - protein, 348 aa, Corynebacterium efficiens
MTIAPEGRRMLRVEARNSQTPIETKPRWIRNQVKNGPEYKDMKERVAGASLHTVCQEAGCPNIHECWESREATFLIGGANCSRRCDFCMINSARPEPLDRGEPLRVAESVREMRLNYSTITGVTRDDLPDEGAWLYSEVVRKIHELNPNTGVENLVPDFSGKRDLLQEVFESRPEVFAHNLETVPRIFKRIRPAFRYDRSLDVIRQARDFGLVTKSNLILGMGETREEISEALRDLHSAGTDIITITQYLRPGPLFHPIERWVKPEEFLELSDEAYEIGFAAVMSGPLVRSSYRAGKLYAQALKFRGEELPANLSHLAETTEGPTTQEASSLLERYGASEDAPVIPRG

SEQ ID NO: 26754 - DNA, 1047 bp, Corynebacterium glutamicum
  CDS (1)..(1047): transl_table=11
gtgactatcgcacctgaaggacgacgactgctacgcgtcgaagctcgaaactcagaaaccccgattgagacgaagcctcgatggattagaaaccaggtcaaaaacggacctgagtatcaggatatgaaggaacgtgtcgctggcgcatcactacacactgtgtgtcaggaggctggctgtcctaatatccatgagtgttgggaatcccgtgaggcaaccttcctcattggtggcgccaactgctctcgccgctgtgatttctgcatgatcaactcggctcgccctgagccactcgaccgcggtgagccactgcgtgtcgctgagtctgttcgtgagatgcagctgaattactccaccatcaccggtgttacccgtgatgatctggatgatgaaggcgcatggctgtactcagaagtggttcgtaagatccacgagctgaacccacacaccggtgtggaaaacctggtgcctgatttctccggcaagaaggatctgctgcaggaagtttttgaatcccgcccagaggttttcgctcacaacgtggaaactgtgccacgtattttcaagcgcattcgcccagcattccgctacgagcgttcacttgatgtgatccgtcaggctcgcgatttcggtctggtgaccaagtccaacctgattttgggcatgggtgaaaccaaggaagaaatcaccgaggcgctgcaggatctgcacgacgctggctgtgacatcatcaccatcacccagtacctgcgtcctggtcctttgttccaccccatcgagcgttgggtgaagcctgaggagttcctcgagcacgctgatgctgcaaaggaaatgggcttcgctgctgttatgtccggcccattggttcgttcctcttaccgtgcaggccgtctgtacgcgcaggccatggagttccgtggcgaggaaatcccagcacacctcgcgcacctgaaggatacttccggaggatccaccgcccaggaagcatctacacttctggagcgttacggtgcttccgaagacaccccagtggtgtccttcaactaa

SEQ ID NO: 26755 - protein, 348 aa, Corynebacterium glutamicum
MTIAPEGRRLLRVEARNSETPIETKPRWIRNQVKNGPEYQDMKERVAGASLHTVCQEAGCPNIHECWESREATFLIGGANCSRRCDFCMINSARPEPLDRGEPLRVAESVREMQLNYSTITGVTRDDLDDEGAWLYSEVVRKIHELNPHTGVENLVPDFSGKKDLLQEVFESRPEVFAHNVETVPRIFKRIRPAFRYERSLDVIRQARDFGLVTKSNLILGMGETKEEITEALQDLHDAGCDIITITQYLRPGPLFHPIERWVKPEEFLEHADAAKEMGFAAVMSGPLVRSSYRAGRLYAQAMEFRGEEIPAHLAHLKDTSGGSTAQEASTLLERYGASEDTPVVSFN

SEQ ID NO: 26756 - DNA, 948 bp, Coxiella burnetii
  CDS (1)..(948): transl_table=11
atgaccacctacgatccttctcagaaaagcttggggaaagagaaactgtcacgaattcccgtcaaaattgaagccactcacacgccccttcgcaaacccgattggattcgtattcgcttatcgactgatagtaaagtcagccaattaaaaaaattgctccgggaaaaccacttagtcaccgtctgtgaagaggcctcttgccctaatttaaatgaatgctttgggcatggcaccgctacctttatgatcatgggcgataaatgtacccgtcgatgcagcttttgtgacgtcggccacggccgccctgatcccctcgatccagaagaaccggttaatctcgctaacactgtaagtatcatgtcgttaaggtatgtcgtcatcacttcagtggaccgtgacgatttacgagatggaggcgcgcagcattatgcgcaatgcattaacgccgtgcgagaaaaaaacccaggcattaaagttgaagtattggttcctgattttcgaggacgcatggaaaaagccctcgatcaactcgctcagggcctgcccgacgtttttaatcataacattgaaacggcgccccgtttatataaacaagcgcgtcccggtgctgattatccatggtctttagcgctgttacagacgttcaaaaaacgttttcctggcattcccactaaatcggggatgatgttgggcttgggcgaaacgcgagaggaggtggaaatggtgatgcgcgatctgcgccaacacgaagttgataggctaaccctcgggcaatatttgcagccgacgcgttaccacatgccggtggatcgttacgtaaccccgcaagaatttcaggagttaggcgaactcgctaaaaaactaggattcagcaatgtggccagtggtccgttagtgcgctcttcctaccacgcggatctgcaagcccaaggggaacgcgtttcctaa

SEQ ID NO: 26757 - protein, 315 aa, Coxiella burnetii
MTTYDPSQKSLGKEKLSRIPVKIEATHTPLRKPDWIRIRLSTDSKVSQLKKLLRENHLVTVCEEASCPNLNECFGHGTATFMIMGDKCTRRCSFCDVGHGRPDPLDPEEPVNLANTVSIMSLRYVVITSVDRDDLRDGGAQHYAQCINAVREKNPGIKVEVLVPDFRGRMEKALDQLAQGLPDVFNHNIETAPRLYKQARPGADYPWSLALLQTFKKRFPGIPTKSGMMLGLGETREEVEMVMRDLRQHEVDRLTLGQYLQPTRYHMPVDRYVTPQEFQELGELAKKLGFSNVASGPLVRSSYHADLQAQGERVS

SEQ ID NO: 26758 - DNA, 996 bp, Deinococcus radiodurans
  CDS (1)..(996): transl_table=11
atgacccagcaagacccgtccaccaaggaacctaaattcatcaaaaacggcatctaccgcaaggacagcgtgccggtgcgcgagaagaaacctgagtggctgaaagtcaccatccccaccgggcaggtgtttaccgaagtccgcaaaatcgtgaaggagcaccgcctgcatacggtgtgcgaggaagcgatgtgccccaacatcggcgagtgctggtcgcgtgggacggcgacgttcatgctgatgggccacatctgcacccgcgcctgccgcttttgcgcggtggacactggcaacccgatgggcaaactggacctcgacgagccgcgcagcgtggccgactcggtgcggctgatggacctgaagtacgtggtgctgacctcggtggaccgcgatgacctgcccgacggcggcgcctaccacttcgccaagacggtgaaggccatcaaagaggtcaatccgcagacccgcgtggaagcgctgacgcccgacttcggcggcaacacggcctgcgtggacctcgtgctggacagcggcgtggatacctacgcccagaacctcgaaaccgtgcggcgcctgacccacccggtgcgcgacattcgcgcgagctacgaccgcaccctgagcgtgctggcccacgccaagcaggcccgccccgacgtgattaccaagacgagcctcatgctgggcctgggcgaaacccgcgaggaaatccgcgaggcgatggctgattgccgcgccgccggggtggacgtgctcaccttcgggcagtacctgcgccccaccatgcaccatctaccggtggaacgctacatttcgcccgccgagttcgacgaaatccgcgaagaaggcatgcaacttggtttcctggaagtcgtctccggtccgctggtgcgctcgtcgtacaaggctgagcagatcgtgatggaccggcccggcaacctgcccgagcacctgagccacttagacggcggcagcgaattgaccttgatttga

SEQ ID NO: 26759 - protein, 331 aa, Deinococcus radiodurans
MTQQDPSTKEPKFIKNGIYRKDSVPVREKKPEWLKVTIPTGQVFTEVRKIVKEHRLHTVCEEAMCPNIGECWSRGTATFMLMGHICTRACRFCAVDTGNPMGKLDLDEPRSVADSVRLMDLKYVVLTSVDRDDLPDGGAYHFAKTVKAIKEVNPQTRVEALTPDFGGNTACVDLVLDSGVDTYAQNLETVRRLTHPVRDIRASYDRTLSVLAHAKQARPDVITKTSLMLGLGETREEIREAMADCRAAGVDVLTFGQYLRPTMHHLPVERYISPAEFDEIREEGMQLGFLEVVSGPLVRSSYKAEQIVMDRPGNLPEHLSHLDGGSELTLI

SEQ ID NO: 26760 - DNA, 912 bp, Geobacter sulfurreducens
  CDS (1)..(912): transl_table=11
gtgaacatccaccgcaagccggaatggctccggaaaaaaatcaaccctgccgcccacggcgccatggatgagctgctgggagagttgcggctccacacggtctgccgggaggcgcgctgccccaatatcaccgagtgcttccgggaacgccaggcaacctttctgattctcggcgcggagtgcacccgcctctgctccttctgcaacgtcaccaagggagagccgctgccgcccgacccggacgagccggcacgggtggcccaggccgttgtccgcctgagtctggcccatgtggtgatcacgagccccacccgggacgatcttcccgacggcggagccggccactacgtcgccaccgtggcgaccatcggccgggttgcgcccgcaaccgtcgtggagcttctcatccccgacttcctcggtagtcgcgcggccctggcggatgtcgtggctgccgcgccacggatcatcgggcacaatgtggaaaccgttccccgtctctacgccattcgtgccggcgccgactacggccgttcgctggcggtgctccgcaccctgcgcgaactggcgccggggtgtgccaccaagtcggggctcatgctcggcctgggtgagacggaagaggaagtcctggcggtgatggccgacctgcggcgggtcgactgcacctacctcagcctcggccagtacctggctccgagccggttccaccaccccgtgcgggagttcgtcctccccgagacctttgaccggctgaaggaactggccgaaaagatgggattccgccacgtggagagtggcccctacgtccgcagttcctaccacgctgccggctacggcggcggaacgcgtacagatcaacccgtcgcatccggctgtctgtcggatcaggaaggagtatcagcacaatga

SEQ ID NO: 26761 - protein, 303 aa, Geobacter sulfurreducens
MNIHRKPEWLRKKINPAAHGAMDELLGELRLHTVCREARCPNITECFRERQATFLILGAECTRLCSFCNVTKGEPLPPDPDEPARVAQAVVRLSLAHVVITSPTRDDLPDGGAGHYVATVATIGRVAPATVVELLIPDFLGSRAALADVVAAAPRIIGHNVETVPRLYAIRAGADYGRSLAVLRTLRELAPGCATKSGLMLGLGETEEEVLAVMADLRRVDCTYLSLGQYLAPSRFHHPVREFVLPETFDRLKELAEKMGFRHVESGPYVRSSYHAAGYGGGTRTDQPVASGCLSDQEGVSAQ

SEQ ID NO: 26762 - DNA, 993 bp, Haemophilus ducreyi
  CDS (1)..(993): transl_table=11
atgacaacagcaatcggtaaaaaaacaactaaattagaaccatttaaaatggaacgcggtgtaaaatatcgtgatgcggcaaagacttcagtgattcaagtcaggaatattgacccagaccaagaattattgaaaaaacctgagtggatgaaaatcaagttaccgactaattcagcgaaaattgatagcattaaatatggtatgcgtcgccacgggttacattcagtttgtgaagaagcatcttgtccaaatttacatgaatgttttaatcatggtactgccacttttatgattatgggcgcaatttgtactcgtcgttgtccgttttgtgatgttgcgcatggtaagccattaccacttgatccctatgaaccgcgtaaagttgccgaaacagtgcaagatatgaaattaaaatacgtggtaattacgtcggtcgatcgtgatgatttggccgatcggggggcagcacattttgcggctacagtgcgagaaattaaagcattaaatcctgaatgcaaagtcgagattttagtcccggattttcgtggtcgagtagaacaagcggttgctattttgaaacaaaatccacccgatgtatttaatcataatttagaaaatgtgccacgtttatatcgcgaaattcgcccgggagcggattataaatggtcattagaattgcttaaaattttcaaacaagagttccctaatattcccactaaatcaggcttaatggttggattgggcgaaacaaacgaagaaattttagcggttatgcaagatttacgtgatcatggtgtgacgatgttgaccgttggtcaatatttacaaccaagccgtcatcacttaagagtagaacgttatgttccgcctgctgaatttgaaatgtttcgcagtgaagctgaaaaaatgggatttgaacacgctgcttgcggtccatttgttcgttcttcttatcatgcagatttacaagcgaaaggcgagctagttaaataa

SEQ ID NO: 26763 - protein, 330 aa, Haemophilus ducreyi
MTTAIGKKTTKLEPFKMERGVKYRDAAKTSVIQVRNIDPDQELLKKPEWMKIKLPTNSAKIDSIKYGMRRHGLHSVCEEASCPNLHECFNHGTATFMIMGAICTRRCPFCDVAHGKPLPLDPYEPRKVAETVQDMKLKYVVITSVDRDDLADRGAAHFAATVREIKALNPECKVEILVPDFRGRVEQAVAILKQNPPDVFNHNLENVPRLYREIRPGADYKWSLELLKIFKQEFPNIPTKSGLMVGLGETNEEILAVMQDLRDHGVTMLTVGQYLQPSRHHLRVERYVPPAEFEMFRSEAEKMGFEHAACGPFVRSSYHADLQAKGELVK

SEQ ID NO: 26764 - DNA, 963 bp, Haemophilus influenzae
  CDS (1)..(963): transl_table=11
atgtctacgcctttcaaaatggaacgcggtgtaaaatatcgcgatgcggcaaaaacctcaattattcccgtaaaaaatatcgatcctaatcaagatttattaaaaaaaccagaatggatgaaaattaaacttccagcaagttcagctaaaattgaaagcattaaaaatggaatgcgccgtcacggattacattctgtttgtgaggaagcatcttgtccaaatttacacgaatgttttaatcatggcacagccacttttatgattttaggtgcaatttgtacgcgccgttgcccattctgtgatgtggctcacggtaaaccattaccgccagatcctgaagagccacaaaaattggcagaaacgattcaagatatgaaacttaaatatgtggtaatcacatcggtggatcgtgatgacttgcctgatcgtggtgctggtcatttttctgaatgtgtaaaagctgtgcgcgagcttaatcctaacattaagattgaaattttagtgcctgattttcgtggtcgcattacacaggctttagagaaattaaaagataatccgccagatgtctttaaccataatttagaaaacgtaccgcgcttatataaagaaattcgtccaggtgcggattacgaatggtcacttaaattattgcgtgaattcaaagaaatattcccaaatatcccaaccaaatctggtttaatggttgggttaggcgaaaccaacgaggaaattttgcaagtgatgcaagatttacgtgataacggtgtgactatgctcacgttgggtcaatatcttcaacctagccgccatcatttgcctgttgcccgttatgtgccgccaactgaatttgatgaattccgtgataaagccaatgaaatgggctttgaacatgcggcttgtgggccatttgttcgttcttcttatcacgctgatttacaagccagtggcggattagtgaaataa

SEQ ID NO: 26765 - protein, 320 aa, Haemophilus influenzae
MSTPFKMERGVKYRDAAKTSIIPVKNIDPNQDLLKKPEWMKIKLPASSAKIESIKNGMRRHGLHSVCEEASCPNLHECFNHGTATFMILGAICTRRCPFCDVAHGKPLPPDPEEPQKLAETIQDMKLKYVVITSVDRDDLPDRGAGHFSECVKAVRELNPNIKIEILVPDFRGRITQALEKLKDNPPDVFNHNLENVPRLYKEIRPGADYEWSLKLLREFKEIFPNIPTKSGLMVGLGETNEEILQVMQDLRDNGVTMLTLGQYLQPSRHHLPVARYVPPTEFDEFRDKANEMGFEHAACGPFVRSSYHADLQASGGLVK

SEQ ID NO: 26766 - DNA, 936 bp, Halobacterium salinarium
  CDS (1)..(936): transl_table=11
atgagtagccgccggaagccggagtggctaaagatgcggccgccgtccggggagcggttcacggacatcaaggagacgctccgcgacaacgacctccacacggtctgcgaggaggcgtcgtgtcccaacatgggggagtgttggagcggccgtgacggccccggcacggcgacgttcatgctgatgggggatcgctgctcgcgtggctgcaacttctgtgacgtgaaaaccggcggcatggagcccctagatcccgatgagccggcgaacgtcgcggagtccgtggcggagatcgggctggactacgtggtgttgacgtccgtcgaccgcgacgacctcgacgaccagggggccggccacttcgcgcggacgatccgggagatcaaagagcgcgacccctcgatcctggtggaagtgctgattccggatttccagggcgagaaatcgctggttcagaagatcatcgacgcggggccggacgtgatcgcgcacaacatcgaaaccgtcgcgcgccggcaggtccccgtgcgggaccggcgcgcgggctacgagcagtccctgtcggtgctggagtacgtgacccgggagtcggacatctacaccaagacgagcatcatgctgggagtcggcgagtacgaccacgaggtctatcagacgcttggagacctccgggaggccggcgtggacgtggtgaccctggggcagtatctccagccgtcgcggtcacacctcgacgtcgcggactacgtccacccccagaagttcgagacgtggcagcgcgtggccgaatccgagttcgggttcctgtactgcgcgtcgggaccgatggtgcggtcctcgtacaaggccggcgagctgttcgtggacgccgtgctgcgggagggcaaaagcgtccaggaggcccgccggaacgcgcggcgtgcggcgtcggagtga

SEQ ID NO: 26767 - protein, 311 aa, Halobacterium salinarium
MSSRRKPEWLKMRPPSGERFTDIKETLRDNDLHTVCEEASCPNMGECWSGRDGPGTATFMLMGDRCSRGCNFCDVKTGGMEPLDPDEPANVAESVAEIGLDYVVLTSVDRDDLDDQGAGHFARTIREIKERDPSILVEVLIPDFQGEKSLVQKIIDAGPDVIAHNIETVARRQVPVRDRRAGYEQSLSVLEYVTRESDIYTKTSIMLGVGEYDHEVYQTLGDLREAGVDVVTLGQYLQPSRSHLDVADYVHPQKFETWQRVAESEFGFLYCASGPMVRSSYKAGELFVDAVLREGKSVQEARRNARRAASE

SEQ ID NO: 26768 - DNA, 990 bp, Leifsonia xyli subsp
  CDS (1)..(990): transl_table=11
gtgagcgccgaaccggagggccgccggatgctgcggctcgaggtccggaacgcgcagacaccgatcgagcgcaagccggagtggatcaagacccgcgccacaatggggcccgaataccggcagctgcattccctggtgaagtccgaaggtctgcacacggtctgccaggaggctggctgcccgaacatctacgagtgctgggaggaccgggaggcgaccttcctcatcggcgggtcacagtgtacgcgacgctgcgatttctgccagatcgacacggggaagccggccgagtttgaccgcgacgaaccgcggcgggtcgccgagtcggtcgcgcggatggggctgcgctattcgacggtcacaggggtcgcgcgggacgacctggaggacgagggcgcgtggctgtacgcggagacgatccgggagatccaccggcagagccccggcaccggggtcgaaatcctggtgcccgacttctcgggagaccccgaactcctcggcgaggtgttcggagcgcgaccagaggtcttcgcacacaacgtcgagaccgtgccgcgcatcttcaagcgcatccgcccggctttccgctacgaacgttccctcgacgtgatcgcgcaggggcgcgccgccgggctcatcacgaagtccaacctgattctcgggatgggcgaggaacgccaggagatcagccaggcgctgcaggatctgcacgacgcgggcaccgacatcatcacaatcacgcagtacctgcgcccgagcccgcggcacctcccggtcgcacgctgggttcgtcccgacgagttcgtggagctgagggacgaggccgaggcgatcggcttcctgggggtgctggccgggccgctcgtgcgctcctcgtaccgcgcgggacgcctctgggcgcagtcgatgcgcgcgaagggacgcactgtcccggaggagctgcggcacctggcggatgcgtcgctggggttcgctcaggcggtgtcctga

SEQ ID NO: 26769 - protein, 329 aa, Leifsonia xyli subsp
MSAEPEGRRMLRLEVRNAQTPIERKPEWIKTRATMGPEYRQLHSLVKSEGLHTVCQEAGCPNIYECWEDREATFLIGGSQCTRRCDFCQIDTGKPAEFDRDEPRRVAESVARMGLRYSTVTGVARDDLEDEGAWLYAETIREIHRQSPGTGVEILVPDFSGDPELLGEVFGARPEVFAHNVETVPRIFKRIRPAFRYERSLDVIAQGRAAGLITKSNLILGMGEERQEISQALQDLHDAGTDIITITQYLRPSPRHLPVARWVRPDEFVELRDEAEAIGFLGVLAGPLVRSSYRAGRLWAQSMRAKGRTVPEELRHLADASLGFAQAVS

SEQ ID NO: 26770 - DNA, 906 bp, Leptospira interrogans serogroup Icterohaemorrhagiae serovar
  CDS (1)..(906): transl_table=11
atgaatcctcttaaaaaaaaacctcgtactcattctcttcaaaatgctcctgaaaaaccagattggctcaaagtaaaactcgcctttcctgatccaaaaaataaccctgtcgcaattgtaagaaattctctagaagaaaaaaaactcaatacagtttgcgaaagcgcttcttgccctaacctaaatcactgctggtccagaaaaacagcgacttatatgttaggtggagatatttgtacaagacgttgttcctattgtgacgtagcttctggaaaaccttttcctctggatccagaagaacctaaaaggatagcagaatcttcgatcgctttaggtctcagacacgtagtcattacctcggttaatagagacgatcttgaagacggaggcgcagctcattttgcaaaaaccgtaaaagaaatccgtaaaggacttccagattgtaaaatagaacttttgattccagatctgaaagtaaaacaagaggctttagaaattatttttgaatgtaatcctgatatattcaatcataacttagaaacggtaaaaagactttttccagaagtggctcctcaaaaaagatatgaacgttctttagacgttttgaaaattgcttctgcaagaggatttctgacaaaaagtggtttaattttgggtatgggagaaactttagaagaagtaaaagaatgcatgcaagatcttgcaagtgttggagtttcccttttgacactgggacagtatttacaaccgacttcgactcatcttcccgtaaaagaatacgtagttccccaagtatttaaggatttacgaatatacggaaagtccatcggttttaagggagttttttcaggaccccttgtaagaagttcttatcacgcggacgaacaaatctcatggaacccgtag

SEQ ID NO: 26771 - protein, 301 aa, Leptospira interrogans serogroup Icterohaemorrhagiae serovar
MNPLKKKPRTHSLQNAPEKPDWLKVKLAFPDPKNNPVAIVRNSLEEKKLNTVCESASCPNLNHCWSRKTATYMLGGDICTRRCSYCDVASGKPFPLDPEEPKRIAESSIALGLRHVVITSVNRDDLEDGGAAHFAKTVKEIRKGLPDCKIELLIPDLKVKQEALEIIFECNPDIFNHNLETVKRLFPEVAPQKRYERSLDVLKIASARGFLTKSGLILGMGETLEEVKECMQDLASVGVSLLTLGQYLQPTSTHLPVKEYVVPQVFKDLRIYGKSIGFKGVFSGPLVRSSYHADEQISWNP

SEQ ID NO: 26772 - DNA, 906 bp, Leptospira interrogans
  CDS (1)..(906): transl_table=11
atgaatcctcttaaaaaaaaacctcgtactcattctcttcaaaatgctcctgaaaaaccagattggctcaaagtaaaactcgcctttcctgatccaaaaaataaccctgtcgcaattgtaagaaattccctagaagaaaaaaaactcaatacagtttgcgaaagcgcttcttgccctaacctaaatcactgctggtccagaaaaacagcgacttatatgttaggtggagatatttgtacaagacgttgttcctattgtgacgtagcttctggaaaaccttttcctctggatccagaagaacctaaaaggatagcagaatcttcgatcgctttagatctcagacacgtagtcattacctcggttaatagagacgatcttgaagacggaggcgcagctcattttgcaaaaaccgtaaaagaaatccgtaaaggacttccagattgtaaaatagaacttttgattccagatctgaaagtaaaacaagaggctttagaaattatttttgaatgtaatcctgatatattcaatcataacttagaaacggtaaaaagactttttccagaagtggctcctcaaaaaagatatgaacgttctttagacgttttgaaaattgcttctgcaagagggtttctgacaaaaagtggtttaattttgggtatgggagaaactttagaagaagtaaaagaatgcatgcaagatcttgcaagtgttggagtttcccttttgacactgggacagtatttacaaccgacttcgactcatcttcctgtaaaagaatacgtagttccccaagtatttaaggatttacgaatatacggaaagtccatcggttttaagggagttttttcagggccccttgtaagaagttcttatcacgcggacgaacaaatctcatggaacccgtag

SEQ ID NO: 26773 - protein, 301 aa, Leptospira interrogans
MNPLKKKPRTHSLQNAPEKPDWLKVKLAFPDPKNNPVAIVRNSLEEKKLNTVCESASCPNLNHCWSRKTATYMLGGDICTRRCSYCDVASGKPFPLDPEEPKRIAESSIALDLRHVVITSVNRDDLEDGGAAHFAKTVKEIRKGLPDCKIELLIPDLKVKQEALEIIFECNPDIFNHNLETVKRLFPEVAPQKRYERSLDVLKIASARGFLTKSGLILGMGETLEEVKECMQDLASVGVSLLTLGQYLQPTSTHLPVKEYVVPQVFKDLRIYGKSIGFKGVFSGPLVRSSYHADEQISWNP

SEQ ID NO: 26774 - DNA, 936 bp, Mycobacterium bovis
  CDS (1)..(936): transl_table=11
atgagtgtcgctgccgagggccggcgcctgttacgcctggaggtgcgcaacgcgcagaccccaatcgagcgcaaaccgccgtggatcaagacacgagcccgcatcgggccggagtacaccgagctgaagaacctggtccgccgcgaggggctgcacacggtctgcgaggaggccggctgccccaacatcttcgaatgctgggaggaccgagaagccaccttcctgatcggcggtgaccagtgcacccgccgatgcgatttctgccagatcgacaccggaaagcccgccgagctggaccgcgacgagccacgccgagtcgccgacagcgtgcgcacgatgggcctgcgctatgccaccgtcaccggcgtggctcgcgacgacctgcctgacggcggggcctggctgtacgccgcgaccgtgcgcgccatcaaggaactcaatccgtcgaccggcgtcgaactgctgattcccgacttcaacggcgaaccaacccggctggccgaggtcttcgagtccggcccggaagtcctggcacacaatgtcgaaaccgtgccccgtatcttcaagcggatccggccggcgttcacgtaccggcgcagcctgggtgtgcttaccgctgcgcgcgacgccggcctggtcaccaagagcaacctcatcctcggcctgggcgaaacctccgacgaggtgcgcaccgccctgggcgatctgcgcgacgccggctgcgacatcgttaccatcacccaatacctgcggccgtcggcgcgccaccatccggtcgagcgctgggtgaagcccgaggagttcgtccagttcgcgcgattcgccgaagggctgggcttcgccggggtattggcgggacccctggttaggtcgtcatatcgggcgggccggctctacgaacaggcacgtaactcacgggccttggcatcccgctag

SEQ ID NO: 26775 - protein, 311 aa, Mycobacterium bovis
MSVAAEGRRLLRLEVRNAQTPIERKPPWIKTRARIGPEYTELKNLVRREGLHTVCEEAGCPNIFECWEDREATFLIGGDQCTRRCDFCQIDTGKPAELDRDEPRRVADSVRTMGLRYATVTGVARDDLPDGGAWLYAATVRAIKELNPSTGVELLIPDFNGEPTRLAEVFESGPEVLAHNVETVPRIFKRIRPAFTYRRSLGVLTAARDAGLVTKSNLILGLGETSDEVRTALGDLRDAGCDIVTITQYLRPSARHHPVERWVKPEEFVQFARFAEGLGFAGVLAGPLVRSSYRAGRLYEQARNSRALASR

SEQ ID NO: 26776 - DNA, 945 bp, Mycobacterium leprae
  CDS (1)..(945): transl_table=11
gtgactgttgcgcccgaagactgccgcttactgcgattagaagtgcgcaacgcacagaccccgatcgagcgcaagccgccatggatcaaaacccgggcccgcatgggaccagagtacaccgcgctaaaaaacctggtccgccgtgttgctctgcacacggtctgcgaagaggccggttgccccaacatcttcgaatgctgggaagatcgggaagccacctttctgatcggtggtgatcagtgcacccgccggtgcgacttctgccagatcgacaccgggaagccggctgcgttggaccgcgacgagccccgacgggtcgccgagagcgtgcaaaccatggggctgcggtataccaccgtcactggggtcgcccgcgacgacttgcccgacggcggtgcctggctgtacgccacaaccgtgcgagccattaaagagctcaatccgtcgaccggggtcgaactgttgattccggacttcaacgggcagcccgcgcgactggcggaagtcttcgactcacgcccacaagtgttggcgcacaacgtcgaaaccgtgccacgcatctttaaacggattcggcctgctttcacctaccaacgcagcctggacgtgctcactgcagcgcgcgaggccggcctggtcaccaaaagcaacctgatcctcggcctaggcgaaaccgctgatgaggtgcgcactgccctggccgatttgcgcaaaaccggctgcgacatcgtcaccatcacccaatatctgcgtccgtcgatgcgccaccacccggtcgagcgctgggtcaggcctgaggagttcgtcgagtacacgcaatacgccgaaggtttgggcttctcgggtgtgctgggcgggccgctggtgcggtcatcgtatcgcgccggtcggctctacgagcaggctgcaggcacccggaccgtcggtacctcggtatcccgttaa

SEQ ID NO: 26777 - protein, 314 aa, Mycobacterium leprae
MTVAPEDCRLLRLEVRNAQTPIERKPPWIKTRARMGPEYTALKNLVRRVALHTVCEEAGCPNIFECWEDREATFLIGGDQCTRRCDFCQIDTGKPAALDRDEPRRVAESVQTMGLRYTTVTGVARDDLPDGGAWLYATTVRAIKELNPSTGVELLIPDFNGQPARLAEVFDSRPQVLAHNVETVPRIFKRIRPAFTYQRSLDVLTAAREAGLVTKSNLILGLGETADEVRTALADLRKTGCDIVTITQYLRPSMRHHPVERWVRPEEFVEYTQYAEGLGFSGVLGGPLVRSSYRAGRLYEQAAGTRTVGTSVSR

SEQ ID NO: 26778 - DNA, 924 bp, Mycobacterium paratuberculosis
  CDS (1)..(924): transl_table=11
gtgactgtcgcacccgagggacgcaaactgctgcgcctggaagtgcgcaacgccgagaccccgatcgagcgcaaaccgccgtggatccgggtgcgggcccggatggggccggaatacaccgagctcaagagcctggtccggcgcgaggggctgcacaccgtctgcgaagaggccggctgccccaacatcttcgaatgctgggaggaccgcgaggccaccttcctgatcggcggcgaccagtgcacccgtcgctgcgacttctgccagatcgacaccggcaagccagccgagctggaccgcgacgagccccgccgggtggccgacagcgtgcgcacgatggggctgcgctacgccacggtcaccggggtggcccgcgacgacctgcccgacggcggcgcctggctgtacgccgagacggtgcgcgccatcaaggagctcaacccgtcgaccggtgtcgagctgttgatccccgacttcaacggccggcccgaccggctcgccgaggtgttcgggtcgcgcccggaagtgttggcgcacaacgtcgaaacggtgccgcggatcttcaaacggatccgcccggccttcacctaccggcgcagcctggacgtgctgaccgcggcccgcgaggccgggctggtcaccaagagcaacctcatcctcggcttgggcgaaacccccgacgaggtgcgcaccgcgctggccgacctgcgcggcgccggctgcgacatcatcaccatcacccagtacctgcgcccgtcggcccgccaccacccggtcgagcgctgggtgaagccggaggaattcgtcgagttcgcgcggcatgccgaagagctgggcttctccggggtgctggccgggccgctggtgcgctcgtcgtaccgcgccgggcggctctaccggcagaccgcccgcgcccgcgcctag

SEQ ID NO: 26779 - protein, 307 aa, Mycobacterium paratuberculosis
MTVAPEGRKLLRLEVRNAETPIERKPPWIRVRARMGPEYTELKSLVRREGLHTVCEEAGCPNIFECWEDREATFLIGGDQCTRRCDFCQIDTGKPAELDRDEPRRVADSVRTMGLRYATVTGVARDDLPDGGAWLYAETVRAIKELNPSTGVELLIPDFNGRPDRLAEVFGSRPEVLAHNVETVPRIFKRIRPAFTYRRSLDVLTAAREAGLVTKSNLILGLGETPDEVRTALADLRGAGCDIITITQYLRPSARHHPVERWVKPEEFVEFARHAEELGFSGVLAGPLVRSSYRAGRLYRQTARARA

SEQ ID NO: 26780 - DNA, 984 bp, Neisseria meningitidis serogroup A
  CDS (1)..(984): transl_table=11
atgagtgaaatcaaaaccgacgaccccaaacgcggcatcaaactcagaggcgcggacaaaaccgcccgcatccccatcaaagtcgtcccccttcaggaaaaattaaaaaagcccgaatggatacgcgccaaacttccatcgcgcaaattctttgaaatcaaagacattttgcgcgaacaaaaaatgcacaccgtttgcgaggaagcctcctgccccaacatcggcgaatgcttcagcaaaggcacggcgaccttcatgattatgggcgacatctgcacccgccgctgcccgttctgcgacgtgggacacggccgcccgaatatgctcgaccccgacgaaccgaaaaacctcgccgaatccgtcaaagccatgaacctgcgttacgtcgtcatcacctccgtcgaccgcgacgacctgcgcgacggcggcgcacagcatttcgccgactgcatcaaagccatccgcgaaaccagcccgaacaccaaaatcgaaatcctcgtccccgacttccgaggacgcttggacatcgcactcaaaatccttgccgaaaccccgcccgacgtgatgaaccacaacctagaaacccatccgagcctgtacagaaaagcccgtcccggtgccaattatcaacattctttagacttattaaaacgttataaagaaatgatgccgcacatcccgaccaaatccggcatcatggtcggcttgggcgaaacagacgaagacgtgcgtgaaattatgcgcgatatgcgggcgcacaatatcgaaatgattaccatcggacagtacctccagccttcagacggacacctgcccgtcctgcgctacgttacgcccgagcagttcaaaatctttgaaaaagaagcatacgaactgggcttcagcaatgccgccatcggcgcgatggtacgttccagctaccacgccgacgaacaggctgccgaagccttacgcgaaagccacggcggttgcgggcatcattaa

SEQ ID NO: 26781 - protein, 327 aa, Neisseria meningitidis serogroup A
MSEIKTDDPKRGIKLRGADKTARIPIKVVPLQEKLKKPEWIRAKLPSRKFFEIKDILREQKMHTVCEEASCPNIGECFSKGTATFMIMGDICTRRCPFCDVGHGRPNMLDPDEPKNLAESVKAMNLRYVVITSVDRDDLRDGGAQHFADCIKAIRETSPNTKIEILVPDFRGRLDIALKILAETPPDVMNHNLETHPSLYRKARPGANYQHSLDLLKRYKEMMPHIPTKSGIMVGLGETDEDVREIMRDMRAHNIEMITIGQYLQPSDGHLPVLRYVTPEQFKIFEKEAYELGFSNAAIGAMVRSSYHADEQAAEALRESHGGCGHH

SEQ ID NO: 26782 - DNA, 984 bp, Neisseria meningitidis serogroup B
  CDS (1)..(984): transl_table=11
atgagtgaaatcaaaaccgacgaccccaaacgcggcatcaaactcagaggcgcggacaaaaccgcgcgcatccccatcaaagtcgtcccccttcaggaaaaactgaaaaagcccgaatggatacgcgccaaactcccatcgcgcaaattctttgaaatcaaagacattttgcgcgaacaaaagatgcacaccgtttgcgaggaagcctcctgccccaacatcggcgaatgcttcagcaaaggcacggcgaccttcatgattatgggtgacatctgcacccgccgctgcccgttctgcgacgtgggacacggtcggcccaatatgctcgaccccgacgaaccgagaaacctcgccgaatccgtcaaagccatgaacctgcgttacgtcgtcatcacctccgtcgaccgcgacgacctgcgcgacggcggcgcacagcatttcgccgactgcatcaaagccatccgcgaaaccagcccgaacaccaaaatcgaaatcctcgtccccgacttccgaggacgcttggacatcgcactcaaaatccttgccgaaaccccgcccgacgtgatgaaccacaacctagaaacccatccgagcctgtacagaaaagcccgtcccggtgccaattatcaacattctttagacttattaaaacgttataaagaaatgatgccgcacatcccgaccaaatccggcatcatggtcggcttgggcgaaacagacgaagacgtgcgtgaaattatgcgcgatatgcgggcgcacaatatcgaaatgattaccatcggacagtacctccagccttcagacggacacctgcccgtcctgcgctacgttacgcccgagcagttcaaaatctttgaaaaagaagcatacgaactgggcttcagcaatgccgccatcggcgcgatggtacgttccagctaccacgccgacgaacaggcggcggaagccttgagggaaagccacggcggttgcgggcatcattaa

SEQ ID NO: 26783 - protein, 327 aa, Neisseria meningitidis serogroup B
MSEIKTDDPKRGIKLRGADKTARIPIKVVPLQEKLKKPEWIRAKLPSRKFFEIKDILREQKMHTVCEEASCPNIGECFSKGTATFMIMGDICTRRCPFCDVGHGRPNMLDPDEPRNLAESVKAMNLRYVVITSVDRDDLRDGGAQHFADCIKAIRETSPNTKIEILVPDFRGRLDIALKILAETPPDVMNHNLETHPSLYRKARPGANYQHSLDLLKRYKEMMPHIPTKSGIMVGLGETDEDVREIMRDMRAHNIEMITIGQYLQPSDGHLPVLRYVTPEQFKIFEKEAYELGFSNAAIGAMVRSSYHADEQAAEALRESHGGCGHH

SEQ ID NO: 26784 - DNA, 945 bp, Nitrosomonas europaea
  CDS (1)..(945): transl_table=11
atggccgctgacacccatcaacgaggtgccgccaaaacggcacgcaacccggtcaaaatcgatctggaacaatccggacagttattgcgcaagccttcctggattcgtgtacgttcatccaacagtcagaaatatctggaagtaaaacgtctgctgcgtgaaaacagattacataccgtttgtgaggaagcctcctgcccgaatatcggggaatgcttcggtcgtggcacagcaacattcatgatactcggtgatctgtgcaccagacgctgcccgttttgtgatgtggcacacggccggcctcatgcgcccgatcctgatgagccgatgcacctggccaattccattgcggtactgaagctcaattatgtcgtcattaccagcgtggaccgtgatgacctcagagatggcggtgcgcaacactttgcagactgtatccgcgcaattcgtacccagtctccacaaacacggatcgagattctcgtccccgattttcgcggcagactggaagtggcgctggaaaaactgtctgcctgcccgcctgacgtgatgaaccataatctggagaccgtaccacgcctgtataagcaatgccggccgggcgcagattacatgcattcattacagctgctcaaggatttcaaggcagctttccctcatatcccgaccaagtccggtctgatgcttggactgggagaaaccgatgaagaaatcatcgaggtcatgcgcgatttacgcgcacatcaggttgatatgctgactgttggccaatatctgcagcccagcaaaggacaccaccccgtcatgcgttacgtttcacccgaagatttcaaaaccttcgagcgcatcgctacaaatctgggattcagccatgctgcttgcggtccgatggtgcgttcgagttaccatgctgatcagcaggcgcacgaagctggcattgaataa

SEQ ID NO: 26785 - protein, 314 aa, Nitrosomonas europaea
MAADTHQRGAAKTARNPVKIDLEQSGQLLRKPSWIRVRSSNSQKYLEVKRLLRENRLHTVCEEASCPNIGECFGRGTATFMILGDLCTRRCPFCDVAHGRPHAPDPDEPMHLANSIAVLKLNYVVITSVDRDDLRDGGAQHFADCIRAIRTQSPQTRIEILVPDFRGRLEVALEKLSACPPDVMNHNLETVPRLYKQCRPGADYMHSLQLLKDFKAAFPHIPTKSGLMLGLGETDEEIIEVMRDLRAHQVDMLTVGQYLQPSKGHHPVMRYVSPEDFKTFERIATNLGFSHAACGPMVRSSYHADQQAHEAGIE

SEQ ID NO: 26786 - DNA, 945 bp, Oceanobacillus iheyensis
  CDS (1)..(945): transl_table=11
atgtctaatcaacaaacgcatgtacgtaagccagattggttaaaaacaagaattaatacgaacaaatcgtatcgaaatttaaaaaagttgatgcgtgataatcggttaaacacggtttgtgaagaagcgcgctgtccaaacttacatgaatgctggagcgaacgaaaaacagctacttttatgattttaggagatacatgtacaagaggttgccggttctgtgcagtaaaaacagggttaccaaatgaactagattggggagaaccagaacgtgtggctgattctgtcaccgtaatggggttaaaacatgtggtagtaacagcagtggcgagagatgatttaaatgatggcggtgcagcagtgtttgcggaaactgtccgagctattcgtagaaagaatcctggttgtactattgaaattttgccttcggatatgaaaggagattatgaaagtctccatacattaatggatagtggaccagatatttttaatcataatattgaaaccgtacgaagacttacaaaacgagtgcgagcaagagctatgtacgatcgttctttagagttactacgacgggtaaaagagatagctcctaatacaccgacgaaatcaagtatcatggttggccttggagaagaaaaagatgagattattcaggcgatggatgatttattagcgcataatgtggatattgttacacttggccaatatttacagccaacgaaaaagcatctagaggtagtacgctattaccatccagatgaatttgaagaattgaaaaatatcgccctagaaaaaggcttttctcattgtgaatctggtccattagttcgttcctcataccatgcggatgaacaagtttctaatgcagcagctcaacgaagaattaagtatatgaaaggtgtagaaaagcaagaaaacagtcaattggattttaatttctaa

SEQ ID NO: 26787 - protein, 314 aa, Oceanobacillus iheyensis
MSNQQTHVRKPDWLKTRINTNKSYRNLKKLMRDNRLNTVCEEARCPNLHECWSERKTATFMILGDTCTRGCRFCAVKTGLPNELDWGEPERVADSVTVMGLKHVVVTAVARDDLNDGGAAVFAETVRAIRRKNPGCTIEILPSDMKGDYESLHTLMDSGPDIFNHNIETVRRLTKRVRARAMYDRSLELLRRVKEIAPNTPTKSSIMVGLGEEKDEIIQAMDDLLAHNVDIVTLGQYLQPTKKHLEVVRYYHPDEFEELKNIALEKGFSHCESGPLVRSSYHADEQVSNAAAQRRIKYMKGVEKQENSQLDFNF

SEQ ID NO: 26788 - DNA, 963 bp, Pasteurella multocida
  CDS (1)..(963): transl_table=11
atgggtacaccttttaaaatggaacgtggtgtcaaataccgtgatgctgctaaaacgtccattatcccggtaaaaaatatcgatccaaatcaggaattattaaaaaaaccggaatggatgaaaatcaaactccctgcgaattctgccaaaattgatagcattaaaaacggcatgcgtcgtcatggtttacactcagtgtgtgaagaagcatcgtgcccgaatttacatgaatgttttaatcacggaacagcaaccttcatgattttaggggcaatttgtactcgccgttgtcctttctgtgatgtggcgcatggtaagcctttaccgccagatcctgaagaaccacgtaagttagcggagacaatccaagacatgaaattgcgttatgtggtgattacttctgtggatcgtgatgacttgcctgatcgtggtgcgggtcactttgcagaatgtgtaaaagaaattcgtcagctcaatccaaatatcaaaattgagattttggttcctgattttcgtgggcgaattgagcaagcgttggataaattgaaagacaatccaccagatgtgtttaaccataatttagaaaatgtaccacgtttataccgtgaaattcgtccaggagcagattatcaatggtctttgaaattgcttaaagattttaaagcgatgtttccacatattccgaccaaatcaggtttaatggtggggttaggtgaaactaatgaagagattctgcaagtgatgcaagatctacgcgatcatggtgtgactatgttaaccttaggacaatatttacaaccaagtcgccatcatttacctgttgcacgttatgtacctccggcagagtttgatgagttccgtgataaagcacaagccatgggctttgaacacgctgcttgcggtccgtttgtgcgttcttcttatcatgcagacttgcaagccaaaggcgaaattgtgaaataa

SEQ ID NO: 26789 - protein, 320 aa, Pasteurella multocida
MGTPFKMERGVKYRDAAKTSIIPVKNIDPNQELLKKPEWMKIKLPANSAKIDSIKNGMRRHGLHSVCEEASCPNLHECFNHGTATFMILGAICTRRCPFCDVAHGKPLPPDPEEPRKLAETIQDMKLRYVVITSVDRDDLPDRGAGHFAECVKEIRQLNPNIKIEILVPDFRGRIEQALDKLKDNPPDVFNHNLENVPRLYREIRPGADYQWSLKLLKDFKAMFPHIPTKSGLMVGLGETNEEILQVMQDLRDHGVTMLTLGQYLQPSRHHLPVARYVPPAEFDEFRDKAQAMGFEHAACGPFVRSSYHADLQAKGEIVK

SEQ ID NO: 26790 - DNA, 933 bp, Pelobacter carbinolicus
  CDS (1)..(933): transl_table=11
atggatgttggacaaaaaaaacgtggtgccgataaaacggccctagcgacgactgatgagcaaggcgctttgtccaagccgacctggatccgcgccaaggcgccgatctcgccggaggttggcaggttgacgggaatcctgcgtgatttgcatctgcatacggtgtgcgaagaggccagctgtcccaacctcggcgaatgtttcaagcgtgggacggcaaccttcatgatcatgggcgatgtctgtacgcgtcgttgtcccttttgcgacgtggcacatggccggcctgctgccttggataccgaagagccgggacatctggcggacgccatcggcgccatgaagctcaaatacgtggtgatcacctcggtgaccagggacgatctggaagatggcggcgccgcacatttcgcacagtgtatcgaatccatccgcaagaaaacccgtagggtgtacaaggtggagatcctggtgcctgatttccgggggcatgtcgatgccgccctcaagaacctcggcaactgtctgcccgacgtgtttaaccataatcttgaaacggtaccgcgtctttatgcggagtcacgacctggtgcccgttatcacgaatctttgcggttgttgcagcggtttaaggaaacctatcccggtataccgaccaaatccggcctgatgctgggattgggcgaaacagacgaagagatccttgaagttatgcgggatttgcgggtgcacggttgcgatatgctgaccatcggacagtatctgcgacccagtcgccatcatctgccggttcagcgctatgtaaccccggagcagttcgaggcgtttcgggttgccggtttaaagatgggcttttcccaggtcgcttcagggccgctggtgcgttcttcctatcacgccgatctacaggcaaaagaagttttgcatacatga

SEQ ID NO: 26791 - protein, 310 aa, Pelobacter carbinolicus
MDVGQKKRGADKTALATTDEQGALSKPTWIRAKAPISPEVGRLTGILRDLHLHTVCEEASCPNLGECFKRGTATFMIMGDVCTRRCPFCDVAHGRPAALDTEEPGHLADAIGAMKLKYVVITSVTRDDLEDGGAAHFAQCIESIRKKTRRVYKVEILVPDFRGHVDAALKNLGNCLPDVFNHNLETVPRLYAESRPGARYHESLRLLQRFKETYPGIPTKSGLMLGLGETDEEILEVMRDLRVHGCDMLTIGQYLRPSRHHLPVQRYVTPEQFEAFRVAGLKMGFSQVASGPLVRSSYHADLQAKEVLHT

SEQ ID NO: 26792 - DNA, 966 bp, Photorhabdus luminescens subsp
  CDS (1)..(966): transl_table=11
atgagtaaaccaattcagatggaacgcggagttaagtaccgcgacgcagacaaaatggcgctgatccctgtcaaaacagtgatgaccgaacgtacagaaatcttgcgtaaacctgagtggatgaaaatcaaacttcctgcggattccagccgcattcagggcatcaaatctgccatgcgcaaaaatggcctgcattccgtttgtgaagaagcatcttgccctaacctggcagaatgcttcaatcacggtacagcaacctttatgatccttggcgcaatttgcacccgccgttgccctttctgtgatgttgcgcacggccgcccaatggcacctgacaccaacgaaccggtaaaactggcacaaaccattaaagatatggcactgcgctacgttgtcatcacctccgttgaccgtgatgatctacgtgacggtggtgctcagcactttgctgactgcatctctgctattcgtgaaaaaaatccatccattaagattgaaaccttagttcctgacttccgtggacgtatggatcgtgcacttgaaatactgacagcgacaccgcccgatgtctttaaccataacctggaaaacgtaccccgggtttaccgtcaggtgcgccctggtgcaaactatgagtggtcactaaaattacttgaaaagtttaaagaagcccatcctgatattccaaccaaatcgggtctaatggtcggtcttggtgaaaccaacgaagaaattcttgatgttatgcgtgatctgcgccgccacggtgtgactatgctgactctgggacaatacctacaacctagtcgtcatcatttaccggtacagcgctacgtcagcccacaggaatttgatgaaatgaaagaagaagcgttagctatggggttcacccatgctgcctgtggtccatttgtccgttcttcttatcatgctgacttgcaagccaaaggtgaagaggtcaaataa

SEQ ID NO: 26793 - protein, 321 aa, Photorhabdus luminescens subsp
MSKPIQMERGVKYRDADKMALIPVKTVMTERTEILRKPEWMKIKLPADSSRIQGIKSAMRKNGLHSVCEEASCPNLAECFNHGTATFMILGAICTRRCPFCDVAHGRPMAPDTNEPVKLAQTIKDMALRYVVITSVDRDDLRDGGAQHFADCISAIREKNPSIKIETLVPDFRGRMDRALEILTATPPDVFNHNLENVPRVYRQVRPGANYEWSLKLLEKFKEAHPDIPTKSGLMVGLGETNEEILDVMRDLRRHGVTMLTLGQYLQPSRHHLPVQRYVSPQEFDEMKEEALAMGFTHAACGPFVRSSYHADLQAKGEEVK

SEQ ID NO: 26794 - DNA, 861 bp, Picrophilus torridus
  CDS (1)..(861): transl_table=11
atgaatgcaggtccaataaactacaaggttaaactgccctcgggggaaagatatacttttatcaagagtacattatcggcaagaaatctttacactgtctgcgaggaggcgcactgcccaaacatagccgaatgctgggaaagcggtactgcaacctttatgataatgggttcaaactgctccaggggatgcaggttctgtgccgtcacccatggaaggatgctgcccctggatccaatggagcctgagaaggtttacgagtcagtaaaaatgatgaatcttgattatgttgttattacatcagtagatcgtgatgatcttccggataagggttcatcgcacttcgcagcggtaataagaaggttaaaagaccttaaaataaaaatagaggttttgatcccggacttcagcggcgttcataaatttattgacaaaattatagatgaaaggcctgatgtgatagcacataacattgaaacggttcgcaggcttacaaaaactgtcagggatccaagggccggatatgatcagagtcttaatgttctaaggtatgtaaagtccaggtcaaacatcataacaaaatcgtcgataatgcttggccttggagagaccgatgatgaggttatcgaaacactgcacgacctgcatgatgctggtgttgacattgtaacgattggacaatacctcagaccaacaaagaagcagcttgaggttaaggagtattccccaatggaaagatttaaaaatcttgaggagtccgcctatagcataggtttttcctttgtggcctcgggtccgcttgtaaggacatcttacagggcggctgaggcttttgtcaaggggggttttaaaaatgattga

SEQ ID NO: 26795 - protein, 286 aa, Picrophilus torridus
MNAGPINYKVKLPSGERYTFIKSTLSARNLYTVCEEAHCPNIAECWESGTATFMIMGSNCSRGCRFCAVTHGRMLPLDPMEPEKVYESVKMMNLDYVVITSVDRDDLPDKGSSHFAAVIRRLKDLKIKIEVLIPDFSGVHKFIDKIIDERPDVIAHNIETVRRLTKTVRDPRAGYDQSLNVLRYVKSRSNIITKSSIMLGLGETDDEVIETLHDLHDAGVDIVTIGQYLRPTKKQLEVKEYSPMERFKNLEESAYSIGFSFVASGPLVRTSYRAAEAFVKGGFKND

SEQ ID NO: 26796 - DNA, 849 bp, Porphyromonas gingivalis
  CDS (1)..(849): transl_table=11
atggcgcaacacgtcaagaaacccgaatggttgaaaatacgtcttggtgggaatgagaagtttaccgagactaaaagcattgtcgagggacattgtctgcatacgatctgtacaagtggcaaatgccccaatatgggagagtgctggagtagggggactgctaccttcatgatcggtggtgatatctgtacacgtgcctgtcgattttgcaacactttgacggggcgtcccaaaccgctcaatgaagcagaacctactcacgtcgcattgagtatcaaactgatggggcttaaccatgctgtggtgacgagcgttgaccgcgatgacttgccggattatggtgccgcacactgggttaagaccattcaggaaatcagacggatcaactcgggagtgacactcgaagttctgattcccgacttcaaaggacggatggatttggtggacatgattatcgaggcaagtccggatgttatttcgcataatctggagacggtacgtcggcttacgccatcggtacgcagcgtggctacttacgataccagccttgccgtgcttcgtcacatagctcagtccggaaaaatgcccgcgaaaacaggaatgatgctcggtttgggcgagactgaagaagagatactcgaattgatggatgatgctcttgcggcgggagtctcagttattactataggacagtatctgcaaccgtcgaggaagaatcttcctgtggtggaatacatcacgcccgaacagttcgaacatcttcgactggtgggtatcgaaaaaggcttccgtacgatagagagtgctccgctcgttcgcagttcttaccatgccgaacggcacttataa

SEQ ID NO: 26797 - protein, 282 aa, Porphyromonas gingivalis
MAQHVKKPEWLKIRLGGNEKFTETKSIVEGHCLHTICTSGKCPNMGECWSRGTATFMIGGDICTRACRFCNTLTGRPKPLNEAEPTHVALSIKLMGLNHAVVTSVDRDDLPDYGAAHWVKTIQEIRRINSGVTLEVLIPDFKGRMDLVDMIIEASPDVISHNLETVRRLTPSVRSVATYDTSLAVLRHIAQSGKMPAKTGMMLGLGETEEEILELMDDALAAGVSVITIGQYLQPSRKNLPVVEYITPEQFEHLRLVGIEKGFRTIESAPLVRSSYHAERHL

SEQ ID NO: 26798 - DNA, 1017 bp, Pseudomonas putida
  CDS (1)..(1017): transl_table=11
atgacaactgtgcaagaagccgtgccgaacctgatacctacccaggatgccaccccgcgcccagcgccgaagaaggtggaagctggggtcaagctgcgtggtgccgacaaagtcgcgcgcatcccggtgaagatcatccctaccgatgagctacccaagaagcccgactggattcgcgtgcgtatcccggtgtcgcccgaggtagaccgcatcaaacaactgctgcgcaagcacaaactgcacagcgtgtgcgaagaggcctcctgcccgaacctgggcgagtgcttctcgggtggtaccgccaccttcatgatcatgggtgacatctgcacccgtcgttgcccgttctgcgacgttggtcacggccgaccgaagccgctggatctggacgagccgaaaaacctggctgttgccattgccgacctgcgcctgaagtatgtggtgatcacctcggtggaccgcgacgacctgcgtgacggtggtgcccagcactttgctgactgcatccgggaaatccgcgcgctgtcgccgggcgtgcagttggagaccttggtgcctgactaccgtggccgtatggacgttgccctggagatcaccgcgcaagagccgccggatgtgttcaaccacaacctcgagaccgtaccgcgcctgtacaaggccgcgcgcccgggttcggactatgactggtcgctggacttgctgcagaagttcaagcagttggtgccgcacgtaccgaccaagtcgggcctgatgctcggcctgggcgaaaccgacgaggaagtgatcgaagtgatgcaccgcatgcgcgagcatgacatcgacatgctcaccctcggccagtacctgcagccgtcgcgcagccacttgccggtgcagcgtttcgttcacccggacacctttgcctggttcgccgaggaaggttacaagatgggcttcaagaacgttgcttctggcccgctggtgcgttcttcgtaccacgccgaccagcaggcccacgaagccaagatcaagctctga

SEQ ID NO: 26799 - protein, 338 aa, Pseudomonas putida
MTTVQEAVPNLIPTQDATPRPAPKKVEAGVKLRGADKVARIPVKIIPTDELPKKPDWIRVRIPVSPEVDRIKQLLRKHKLHSVCEEASCPNLGECFSGGTATFMIMGDICTRRCPFCDVGHGRPKPLDLDEPKNLAVAIADLRLKYVVITSVDRDDLRDGGAQHFADCIREIRALSPGVQLETLVPDYRGRMDVALEITAQEPPDVFNHNLETVPRLYKAARPGSDYDWSLDLLQKFKQLVPHVPTKSGLMLGLGETDEEVIEVMHRMREHDIDMLTLGQYLQPSRSHLPVQRFVHPDTFAWFAEEGYKMGFKNVASGPLVRSSYHADQQAHEAKIKL

SEQ ID NO: 26800 - DNA, 957 bp, Pseudomonas syringae pv
  CDS (1)..(957): transl_table=11
gtggcccgtccgaaagtcgaagccggcgtcaagctgcgcggagcggaaaaggttgcgcgcatcccggtcaagatcatcccgactgtagacctgccgaagaagcctgactggattcgcgtgcgcatcccggtttctccggaggtcgaccgtatcaagcaactgctgcgcaagcacaagctgcacagcgtctgcgaagaggcatcctgccccaacctgggcgaatgtttctccggcggcaccgcgacgttcatgatcatgggcgacatctgcacccgtcgctgcccgttctgcgacgtgggccacggccgtccgaaggcgctcgacgccgacgaaccgaagagccttgccatcgcgattgccgatttgcgcttgaaatacgtggtgatcacctcggtagaccgtgatgacctgcgtgacggcggcgctcagcactttgccgactgcatccgcgagatccgcctgctgtcgccgggcattcagctcgaaacactggtgcccgattaccgtgggcgcatggacgtagcgctggaaatcactgcagccgagccgccggatgtgttcaaccacaacctggaaaccgtgccgcgtctgtacaaggccgcgcgtcctggctcggattaccagtggtcgctgaccctgctgcaacgcttcaagcagatggtcccgcacgtaccgaccaaatccggcctgatgctgggtctgggcgagactgacgaagaagtcatcgaagtcatgaagcgcatgcgcgagcacgacatcgacatgctgaccctgggtcagtacctgcagccatcgcgcaatcacctggcggtgcagcgtttcgtccatccggacaccttcgcctggttcgccgaggaaggttacaagatgggcttcaagaacgtcgcttcaggcccgctggtgcgctcgtcgtaccacgccgacgagcaagccaagatcgccaaagcgatgctctga

SEQ ID NO: 26801 - protein, 318 aa, Pseudomonas syringae pv
MARPKVEAGVKLRGAEKVARIPVKIIPTVDLPKKPDWIRVRIPVSPEVDRIKQLLRKHKLHSVCEEASCPNLGECFSGGTATFMIMGDICTRRCPFCDVGHGRPKALDADEPKSLAIAIADLRLKYVVITSVDRDDLRDGGAQHFADCIREIRLLSPGIQLETLVPDYRGRMDVALEITAAEPPDVFNHNLETVPRLYKAARPGSDYQWSLTLLQRFKQMVPHVPTKSGLMLGLGETDEEVIEVMKRMREHDIDMLTLGQYLQPSRNHLAVQRFVHPDTFAWFAEEGYKMGFKNVASGPLVRSSYHADEQAKIAKAML

SEQ ID NO: 26802 - DNA, 873 bp, Pyrobaculum aerophilum
  CDS (1)..(873): transl_table=11
atgattccgtcttgggtttccctaagggccggagattatgaaaaaataattaacgtgaggagggcgttaagcagacacgggatttatacagtgtgcgagggggctaagtgccccaatattttccactgctggggcgaggggacggccaccttcatgattctaggggaggtctgcacaagggcgtgtagattctgcgccgtgcgcactggtaatccgagggggtatgtggactggggcgaggtggataggcttgttgaggctgttagagagctcgggcttaaatacgtcgtggtgacctcagtggctagagacgacctccccgacggaggggcctcggtatttgcggcagttgtgaaaaaactacgcgaggtgggttgcgtcgtggaggttttagtgcccgacttcggcggaagtccggcctcggtaaaaactgtggttagctcgggcccagatgtgttcgcccacaacgtggaaacagtgagacggcttacgccgctagttagagaccgcagggcgggttatgagcgttcgctatctgtgttgaaatacgcaaaagaattcggcgcacccctcactaaatcaggcttgatgttagggcttggggagacgtttgaggaggtggtggagactttagaggatttgaggagggctgatgtggacattgtgactataggccagtatataaaacccagcggctcgcctcgtcatttaaaccccgttaggtacgcgactcccgaagagttcgccaaaattaaagaggtggccgtgtccctgggctttaaggccgttgcctcaggccctttagtgcgtagctcatataaggcttacagtctatatagagaagctttaaaaaatatagtatacttaggttaa

SEQ ID NO: 26803 - protein, 290 aa, Pyrobaculum aerophilum
MIPSWVSLRAGDYEKIINVRRALSRHGIYTVCEGAKCPNIFHCWGEGTATFMILGEVCTRACRFCAVRTGNPRGYVDWGEVDRLVEAVRELGLKYVVVTSVARDDLPDGGASVFAAVVKKLREVGCVVEVLVPDFGGSPASVKTVVSSGPDVFAHNVETVRRLTPLVRDRRAGYERSLSVLKYAKEFGAPLTKSGLMLGLGETFEEVVETLEDLRRADVDIVTIGQYIKPSGSPRHLNPVRYATPEEFAKIKEVAVSLGFKAVASGPLVRSSYKAYSLYREALKNIVYLG

SEQ ID NO: 26804 - DNA, 1002 bp, Ralstonia solanacearum
  CDS (1)..(1002): transl_table=11
atgaccgattccgcctccggcgcctccgcagtcgccaacatcgccaccccgtcgaacgagccgtacgacgcgacccgcaagcagaagtcgctcgacaagaccgcgcgcatccccatcaagatcgtgccggccgagaagctgaagaagccggagtggatccgcgtcaaggccgccaccggcaactcacgcttctacgagatcaaggacatcctgcgcgccaacaacctcgtgacggtgtgcgaggaggcgagctgcccgaacatcggcgagtgcttcggcaagggcacggccaccttcatgatcatgggcgacaagtgcacgcgccgctgcccgttctgcgacgtcggccacggccgccccgacccgctcgatgcgaacgagcccgagaacctggccaagaccatcgcccagctcagactgaactacgtggtcatcaccagcgtggaccgcgacgacctgcgcgacggcggtgcccagcactatgtcgattgcatctcgcgcacgcgcgagctgtcgccggccacgcgcatcgaggtgctggtgccggacttccgcggccggctggaaaaggcgctggacatcctccaggcctgcccgccggacgtgatgaaccacaacatggaaaccgtgccgcgcctgtacaagcaggcccgcccgggcgccgactacgcgcactcgctgaagctgctcaaggacttcaaggcgcgcaacccgaacctcccgaccaagtccggcctgatggtcggcctgggcgagaccgacgaggaaatcctggaggtgatgcgcgacatgcgcgagcacgacatcgacatgctgaccatcggccagtatctcgctccgtcgggccaccatctgccggtgctgcgctacgtgcacccggacaccttcaagatgttcgaggagaaagcctacgagatgggcttcacgcacgccgctgtcggcgccatggtgcgcagctcgtaccacgcggatcagcaggcgcacgaagccggcttcgcctga

SEQ ID NO: 26805 - protein, 333 aa, Ralstonia solanacearum
MTDSASGASAVANIATPSNEPYDATRKQKSLDKTARIPIKIVPAEKLKKPEWIRVKAATGNSRFYEIKDILRANNLVTVCEEASCPNIGECFGKGTATFMIMGDKCTRRCPFCDVGHGRPDPLDANEPENLAKTIAQLRLNYVVITSVDRDDLRDGGAQHYVDCISRTRELSPATRIEVLVPDFRGRLEKALDILQACPPDVMNHNMETVPRLYKQARPGADYAHSLKLLKDFKARNPNLPTKSGLMVGLGETDEEILEVMRDMREHDIDMLTIGQYLAPSGHHLPVLRYVHPDTFKMFEEKAYEMGFTHAAVGAMVRSSYHADQQAHEAGFA

SEQ ID NO: 26806 - DNA, 966 bp, Rhizobium loti
  CDS (1)..(966): transl_table=11
atggttactgtcctcgacgcgatcgccaacgcaccacggttgcggcaccccgagaaggcgcacaagcccgaccaggaggtgttgcgcaagccggactggatccgcgtcaaggcgccggtctcgaagggctatgccgagacgcgcgagatcgtcaaatcccacaagctggtgacggtctgcgaagaggccggttgccccaacatcggcgagtgctgggaaaagaagcacgccaccttcatgatcatgggcgagatctgcacgcgcgcttgcgccttctgcaatgtcgccaccggcattccgaccgcgctggaccccgatgagccggcccgcgtcgcgcatgccgtcaagcagatggggctcagccacgtcgtcatcacctcggtcgaccgcgacgatcttgccgatggcggtgcgcagcattttgccgatgtcatccgggcgatccgcgcggcaacgccgtcgaccacgatcgaaatcctgacgcccgatttcctgcgcaaggacggcgcgcttgagatcgtcgtggcggccaggcccgacgtcttcaaccacaatctcgaaaccgtgccgtcgaactatctgaaggtccggccgggcgcccgctatttccactcgatccggctgttgcagcgggtcaaggaactcgatccgtcgatcttcaccaaatccggcatcatggttggcctgggcgaggagcgaaatgaaatcctgcagctgatggacgatctgcgctcggccaatgtcgacttcatgaccatcggccaatatctgcagccttcgaaaaagcaccatccggtgatccgcttcgtgacgcccgaagagttcaagtccttcgagacgatcggccggaccaagggtttcctgcttgtggcatcgagcccgctgacgcgttcatcgcaccatgccggcgacgatttcgcccggctgcgcgcggcgcgggaagcgcagctccagaaatcggtctag

SEQ ID NO: 26807 - protein, 321 aa, Rhizobium loti
MVTVLDAIANAPRLRHPEKAHKPDQEVLRKPDWIRVKAPVSKGYAETREIVKSHKLVTVCEEAGCPNIGECWEKKHATFMIMGEICTRACAFCNVATGIPTALDPDEPARVAHAVKQMGLSHVVITSVDRDDLADGGAQHFADVIRAIRAATPSTTIEILTPDFLRKDGALEIVVAARPDVFNHNLETVPSNYLKVRPGARYFHSIRLLQRVKELDPSIFTKSGIMVGLGEERNEILQLMDDLRSANVDFMTIGQYLQPSKKHHPVIRFVTPEEFKSFETIGRTKGFLLVASSPLTRSSHHAGDDFARLRAAREAQLQKSV

SEQ ID NO: 26808 - DNA, 969 bp, Rhizobium meliloti
  CDS (1)..(969): transl_table=11
atggtaacggttttcgacgccgtctcggatcgggcgcagcgtgttcgccacccggaaaaggcccaccggcccgacaccgaggtcctgcgcaagccggactggatccgtgtgaaggcaccgacctcgaagggataccaggagacccgctcgatcgtgaagagccacaagctcgttacggtctgcgaggaagccggatgccctaacatcggcgagtgctgggacaagaagcacgcgacgttcatgatcatgggcgagatctgcacgcgtgcctgtgccttctgcaacgtcgcgaccggcaagcccaatgccctcgatctggacgagcccgcaaatgtcgccaaggcggtgaagcagatgggcctgagccatgtcgtcatcacctccgtcgaccgcgacgacctcgacgacggcggcgccgagcatttcgagaaggtcatcttcgcgatccgggaagcctcgccggaaaccacgatcgaaatcctgacgcccgatttcctccgcaagcccggcgcgctggagcgtgtcgtggccgccaagccggacgttatcaaccacaatctcgaaacggttccgtccaactacctgacggtccggccgggcgcgcgctatttccattcgatccggctactgcagcgcgtgaaggaactcgaccccaccatgttcaccaagtcgggcatcatggtcggcctcggcgaggagcgcaacgaagtgctgcagctgatggacgacctgcgtaccgccgatgtcgatttcctgacgatcggccaatatctgcagccgagccgcaagcatcacaaggtcgagaaattcgtcactccggaagaattcaagtcctacgagacggtcgcctacaccaagggcttcctgatggtttcctcaagcccgctgacccgctcgtcccaccatgccggcgacgacttcgcaaggctgaaggcggcgcgcgaaaggaagctggctgcggcggagtag

SEQ ID NO: 26809 - protein, 322 aa, Rhizobium meliloti
MVTVFDAVSDRAQRVRHPEKAHRPDTEVLRKPDWIRVKAPTSKGYQETRSIVKSHKLVTVCEEAGCPNIGECWDKKHATFMIMGEICTRACAFCNVATGKPNALDLDEPANVAKAVKQMGLSHVVITSVDRDDLDDGGAEHFEKVIFAIREASPETTIEILTPDFLRKPGALERVVAAKPDVINHNLETVPSNYLTVRPGARYFHSIRLLQRVKELDPTMFTKSGIMVGLGEERNEVLQLMDDLRTADVDFLTIGQYLQPSRKHHKVEKFVTPEEFKSYETVAYTKGFLMVSSSPLTRSSHHAGDDFARLKAARERKLAAAE

SEQ ID NO: 26810 - DNA, 951 bp, Rhodopirellula baltica
  CDS (1)..(951): transl_table=11
ttgattttttgcctttcatccggacagacgccgatggcttttcgattgccagttgtcgccgaaccagaaatgcctgcgggcaccgacgtcagctcgacgggacggttgccacgttggctcaagcggcccatccccaaatccaactcgaatcatttgaccgattcgttgatggaagaatacgggttggaaaccgtatgcgacaacgccaagtgccccaaccggatggagtgctacagccagcaaacggcgacgttcatggttctggggaatgtttgtacccgcccatgtggtttctgtgccgtcagccgtggacgcccaccggctgcccccgccgtcgatgagccagatcgcatcgccaaagcggccgaacgattggggctgaagcacgttgtcatcaccagcgtcacgcgagatgacttgcccgacggaggtgccgaccatttccacaactgcgtcatcgcagttcgggaacgcaccggggcgaccaccgaagtcctcacgcctgactttgtgcactgcaaggaagcgttggctcgggtcatcgaagcaaaaccgaccgtgttcaatcacaacatggaaaccgtgccacgtctttaccgccgagtccgcggtccaaagagtgactatgcttggacgttggaaatgatgcggcaagtcaaacgctacgacgccgaagtcaaaaccaagagcggtttgatgcttggattgggcgaagaacgaggcgagttgctcgacgctctgtcagatcttcgcgaacacgatgtcgatttcctgacgttgggccagtacctgcaaccgggcgagaaatacttgcccgtcgttcgctatgttccgccagaagaattcgatgaattggccgacatcgccaaatcaatgggattcaaaaaggtcgccagtggcccctttgtgcgaagtagctaccacgcccgtgacatggccgagactgagtga

SEQ ID NO: 26811 - protein, 316 aa, Rhodopirellula baltica
MIFCLSSGQTPMAFRLPVVAEPEMPAGTDVSSTGRLPRWLKRPIPKSNSNHLTDSLMEEYGLETVCDNAKCPNRMECYSQQTATFMVLGNVCTRPCGFCAVSRGRPPAAPAVDEPDRIAKAAERLGLKHVVITSVTRDDLPDGGADHFHNCVIAVRERTGATTEVLTPDFVHCKEALARVIEAKPTVFNHNMETVPRLYRRVRGPKSDYAWTLEMMRQVKRYDAEVKTKSGLMLGLGEERGELLDALSDLREHDVDFLTLGQYLQPGEKYLPVVRYVPPEEFDELADIAKSMGFKKVASGPFVRSSYHARDMAETE

SEQ ID NO: 26812 - DNA, 960 bp, Rhodopseudomonas palustris
  CDS (1)..(960): transl_table=11
atggtcgttctcgtcgatacggtgtccgccaatcccgtccgcccccggcatccggagaaggcggcgcggccggatgcgctgtcgccgaagaagccggactggatccgggtgcgcgcgccgaccacgcgcggctatggcgagacccgcggcatcgtcaaggaaaacggcctgcacacggtgtgcgaggaggccggctgcccgaatatcggcgagtgctgggacaagaagcacgccaccttcatgatcatgggggacacctgcacccgggcgtgcgcgttctgcaacgtcaagaccgggatgccgggcgcactcgacgccaacgagccagcctacgtcgccgaggcgacccgcaagctcgggctgcagcatctggtgattacctcggtcgaccgcgatgatctggccgatggaggcgccgcgcacttcgccgcaacgatccgcgcggtgcgcgaagcctgcccaacgacgacgatcgagatcctgacgccagacttcctgcgcaaggacggcgcgctggaggtggtggtcgccgccaagccggacgtgttcaaccacaatctcgaaaccgtgccgtcgcgctatctgtcggtgcggccgggcgcacgctacttccactcgatccggctgctgcagcgggtcaaggaactcgatcccagcatcttcaccaagtccggcatcatggtcgggctcggcgaggaacgccacgaggtgctgcaggtgatggacgacctgcgctcggcggaggtcgatttcctcaccatcggccagtatctacagccgacccgcaagcaccatgcggtgatgcgctacgtcacgccggacgaatttgccggctatcagaccaccgcctacgctaagggcttcctgatggtgtcggcgagcccgatgacccgctcgtcgcatcacgccggcgacgatttcgccaagctcaaggcggcgcgcgcggcgcgagcccgctaa

SEQ ID NO: 26813 - protein, 319 aa, Rhodopseudomonas palustris
MVVLVDTVSANPVRPRHPEKAARPDALSPKKPDWIRVRAPTTRGYGETRGIVKENGLHTVCEEAGCPNIGECWDKKHATFMIMGDTCTRACAFCNVKTGMPGALDANEPAYVAEATRKLGLQHLVITSVDRDDLADGGAAHFAATIRAVREACPTTTIEILTPDFLRKDGALEVVVAAKPDVFNHNLETVPSRYLSVRPGARYFHSIRLLQRVKELDPSIFTKSGIMVGLGEERHEVLQVMDDLRSAEVDFLTIGQYLQPTRKHHAVMRYVTPDEFAGYQTTAYAKGFLMVSASPMTRSSHHAGDDFAKLKAARAARAR

SEQ ID NO: 26814 - DNA, 891 bp, Rickettsia conorii
  CDS (1)..(891)
atggctaatttaaataaacgacctgattggataaaagtaaaagctcctaattctacagagtactataatacaaaagatttaataaagaatctgagattaaatactgtgtgcgaggaagctgcttgtcctaatattggtgagtgctggtcaaaaaaacatacaactgtgatgattttaggttcggtttgtactagagcttgtaggttttgtaacgttaaaacgggtagaccggatttacttgatccgtatgaaccgcaaaggttagcggaggcggtacaaaagctaaatcttaagcatgtagtaattacttccgtcgatcgtgatgatcttgaggatggcggagcgtcacattttgcggagtgtattagcgaaatccgaaaatcatcgccaaatactactattgagattctaacacccgattttttaagaaaagaaggagcagctgaaataatagcaaacgcaaaacctgacgtttttaaccataatgtcgaaacagtaccgtctttatacaaaacgattagaccgggggctagatattataattctttaagtttactgcataatattaaaaaattatctcctgaaatttttacaaaatccggtatgatggtaggacttggggaagaaataaatgaagtagtacaggttatagatgatttaagagaagcaaaggttgatttcctaactatcgggcagtatctgcagcctaccaaaaatcatgctgaggtcgcaaaatatgttacgccggaagagtttaaatatctagagcgagtagcaaaaacaaaaggattcttgatggtttcggcaagcccgctgacccgttcttcataccatgctgatgaggattttcaaaaattaaaagagaattaccaacaaaaactggtgtcttaa

SEQ ID NO: 26815 - protein, 296 aa, Rickettsia conorii
MANLNKRPDWIKVKAPNSTEYYNTKDLIKNLRLNTVCEEAACPNIGECWSKKHTTVMILGSVCTRACRFCNVKTGRPDLLDPYEPQRLAEAVQKLNLKHVVITSVDRDDLEDGGASHFAECISEIRKSSPNTTIEILTPDFLRKEGAAEIIANAKPDVFNHNVETVPSLYKTIRPGARYYNSLSLLHNIKKLSPEIFTKSGMMVGLGEEINEVVQVIDDLREAKVDFLTIGQYLQPTKNHAEVAKYVTPEEFKYLERVAKTKGFLMVSASPLTRSSYHADEDFQKLKENYQQKLVS

SEQ ID NO: 26816 - DNA, 1113 bp, Schizosaccharomyces pombe
  CDS (1)..(1113)
atgttgaaaataggtcgaaatgctacgatattaaaaaacaatttttggtttgcctccgtgaggtttcaatctggagggttttcagaaaagttggcgaaaggaccatcatttgcagatttcttgaacatggataaaccattgactgctgacgaagctttcgagttagatagaaaagtagagctaccaaatggctctatacacaaaagattgccttcatggcttaaaaccaaagttccactaggaacaaattttaaccgaataaagcatgatttgcggggatctcatctccatacggtttgtgaagaagcgaaatgtccgaatattggagaatgctggggaggtaaagacaaatctcgtgccacagctacgatcatgcttatgggtgatacttgtactcgtggatgtcgcttttgttcggtaaagaccagtcgccgtccaggtcctttagatcccaacgagcctgaaaatacagcagaagccatcaaacaatggaaccttgggtacattgttctcactagtgtcgatagagatgacctgactgaccttggtgccaatcatatagcaaaaacgattcaaaaaattaaagaaaaagccccgcacatcttggtagaagctttgacccccgattttagtggaagaatggatttggttgagattgtagctaaatctggtttggacgtctttgcacacaatgtagaaacggtagaggaacttaccccatttgttcgagatcgacgagccacatatcgacaaagtctgagcgtgctaaaacatgtgaagaaaacatgtcctcaccttatcactaaaaccagtattatgcttggtctaggtgaaaccgatgcggaaattctaacaactcttaaggatctcctggaacataatgtagatgtcgttacctttggtcaatatatgagacctaccaaacgacacctaaaagtgcaagagtatgtacatcctaagaagtttgaatattggaaagaagtggcagagaaattaggattcttatacgtggctagtggtccacttgttcgtagtagctataaggctggcgaatattttatggagaatcttattaaaaagagatcaggaaaccctgcttctatgagtgtttaa

SEQ ID NO: 26817 - protein, 370 aa, Schizosaccharomyces pombe
MLKIGRNATILKNNFWFASVRFQSGGFSEKLAKGPSFADFLNMDKPLTADEAFELDRKVELPNGSIHKRLPSWLKTKVPLGTNFNRIKHDLRGSHLHTVCEEAKCPNIGECWGGKDKSRATATIMLMGDTCTRGCRFCSVKTSRRPGPLDPNEPENTAEAIKQWNLGYIVLTSVDRDDLTDLGANHIAKTIQKIKEKAPHILVEALTPDFSGRMDLVEIVAKSGLDVFAHNVETVEELTPFVRDRRATYRQSLSVLKHVKKTCPHLITKTSIMLGLGETDAEILTTLKDLLEHNVDVVTFGQYMRPTKRHLKVQEYVHPKKFEYWKEVAEKLGFLYVASGPLVRSSYKAGEYFMENLIKKRSGNPASMSV

SEQ ID NO: 26818 - DNA, 966 bp, Shewanella oneidensis
  CDS (1)..(966): transl_table=11
atgaataggcctgaacgtttacaacccggagtcaaattaagagatgccgaaaaggtctcacgtattccggttaaaatcgtgccctctgagcgcgaaaccatgttacgcaaaccagattggttaagggttaaactgcccgcatctaaccaacgcattctcgacattaagcaagcgttacgcgctaacggcctgcactcggtctgtgaagaggcctcctgcccgaacttggcagaatgttttaaccacggcacagcaacctttatgattttgggtgcaatttgtactcgccgttgccccttctgtgacgtggcccatggtcgtcctctcaagcctgatgagcaggaacccgttaagctggcacaaaccatccgcgatatgaagctgaaatacgtggtcatcacctcggttgaccgcgacgacctgcgtgatggcggagcccagcactttgccgactgtatccgcgagatccgcaaactcaatccagaaattaagattgagatcttagtccccgatttccgtggccgtatcgacgccgccctcgacatactgtcgaccgagccgcctgatgtgttcaaccacaacctcgaaaccgcacctatgcactatcgcaaggcgcgtccaggggcgaactatcaatggtccctcgacctactaaaacgctttaaagagcgtcacccaaatgtaccgactaagtcgggactgatgatgggtctaggcgaaaccaacgatgaaatcgcccaagtgctacgcgacttacgtgagcacaaggtcgaaatgctgaccttaggccaatacctgcaaccatctaagttccatctgccggttgagcgttacgtatcacccgcagagtttgatgagctaaaagcccttgccgatgagctgggttttactcacgcagcctgtggtccattagtgcgttcaagctaccatgctgacttacaagcccaaggtaaagaagtgaagtaa

SEQ ID NO: 26819 - protein, 321 aa, Shewanella oneidensis
MNRPERLQPGVKLRDAEKVSRIPVKIVPSERETMLRKPDWLRVKLPASNQRILDIKQALRANGLHSVCEEASCPNLAECFNHGTATFMILGAICTRRCPFCDVAHGRPLKPDEQEPVKLAQTIRDMKLKYVVITSVDRDDLRDGGAQHFADCIREIRKLNPEIKIEILVPDFRGRIDAALDILSTEPPDVFNHNLETAPMHYRKARPGANYQWSLDLLKRFKERHPNVPTKSGLMMGLGETNDEIAQVLRDLREHKVEMLTLGQYLQPSKFHLPVERYVSPAEFDELKALADELGFTHAACGPLVRSSYHADLQAQGKEVK

SEQ ID NO: 26820 - DNA, 918 bp, Staphylococcus aureus
  CDS (1)..(918): transl_table=11
atggcgacaaaaaacgaggaaatattacgtaaaccggattggttgaaaataaaattaaataccaacgaaaactatacaggacttaagaagatgatgagggaaaaaaatcttaatactgtatgtgaagaagctaaatgtcctaatatacatgaatgttggggtgcacgtcgtacagcgacatttatgattttaggtgccgtatgtacaagagcttgtcgtttttgtgcggttaagacaggtttacctaatgaacttgatttaaatgagcctgaacgtgtagctgaatcagttgaattaatgaatttgaaacacgttgttatcactgctgttgcgcgtgatgatttaagagatgctggttcaaatgtttatgctgagacagtacgtaaagttagagaaagaaatccatttacaacgattgaaattttaccatcagatatgggcggggactatgatgcgttagaaacattaatggcgtcaagacctgacattttaaaccataatattgaaactgttcgtcgcttaacaccgagagttcgtgcgcgtgcgacttacgacagaacattagagtttttacgtcgttcaaaagaattacaaccggatatcccaactaaatcaagtattatggttggattaggtgaaactatagaagaaatttatgaaacgatggatgatttacgtgcgaatgatgtagatattttaacgattggtcaatatttacaaccttcacgtaaacatttaaaggttcaaaaatattacacgcctttagagtttggtaaattaagaaaagtggcaatggataaagggtttaaacattgccaagctggacctttagtacgtagttcttatcatgcggatgagcaagtaaatgaagctgctaaagaaaagcaacgccaaggtgaggcacagttaaatagttaa

SEQ ID NO: 26821 - protein, 305 aa, Staphylococcus aureus
MATKNEEILRKPDWLKIKLNTNENYTGLKKMMREKNLNTVCEEAKCPNIHECWGARRTATFMILGAVCTRACRFCAVKTGLPNELDLNEPERVAESVELMNLKHVVITAVARDDLRDAGSNVYAETVRKVRERNPFTTIEILPSDMGGDYDALETLMASRPDILNHNIETVRRLTPRVRARATYDRTLEFLRRSKELQPDIPTKSSIMVGLGETIEEIYETMDDLRANDVDILTIGQYLQPSRKHLKVQKYYTPLEFGKLRKVAMDKGFKHCQAGPLVRSSYHADEQVNEAAKEKQRQGEAQLNS

SEQ ID NO: 26822 - DNA, 915 bp, Staphylococcus epidermidis
  CDS (1)..(915): transl_table=11
atggcgactagaaatgaagaaattttacgtaaaccggattggttaaagattaagcttaacacaaacgataattatactggtcttaagaaaatgatgcgtgagaagaatttacacacagtgtgtgaagaagctaaatgtccaaatattcacgaatgttggggtgcgcgtcgtacagctacatttatgattttaggggcagtatgtacaagagcatgtcgattttgcgcggtaaaaactggtttacctaatgaattagatttaaatgaaccagaacgagttgcagaatcagtagaattaatgaatttaaaacatgttgtaattactgctgttgcacgtgatgatttaagagatcaaggctcaaacgtgtatgcagaaacagtacgtaaagtaagagaaagaaatccatttacaacaatagaaattttaccatctgacatgggtggcgattatgaagcccttgaaacattaatggcttctagaccagacattcttaatcacaacattgaaacggttcgtcgcttaacaccaagagttcgagctcgagcaacttacgatagaactttacaatttttacgtcgttctaaagaattacaacctgatattccaacaaaatcaagtttgatggttgggttaggtgaaacgatggaagaaatttatgaaacgatggatgatttacgcgctaatgatgttgatatcttaactataggtcaatatttacaaccgtctcgaaaacatttgaaagttgagaaatattatacgccattagaatttggtaaaatgagaaagattgcaatggaaaaaggatttaaacattgtcaagcaggacctttagtaagaagctcatatcatgctgatgagcaagtgaatgaagcagctaaagagaaacaacgccaaggtgaagaacaactcaattaa

SEQ ID NO: 26823 - protein, 304 aa, Staphylococcus epidermidis
MATRNEEILRKPDWLKIKLNTNDNYTGLKKMMREKNLHTVCEEAKCPNIHECWGARRTATFMILGAVCTRACRFCAVKTGLPNELDLNEPERVAESVELMNLKHVVITAVARDDLRDQGSNVYAETVRKVRERNPFTTIEILPSDMGGDYEALETLMASRPDILNHNIETVRRLTPRVRARATYDRTLQFLRRSKELQPDIPTKSSLMVGLGETMEEIYETMDDLRANDVDILTIGQYLQPSRKHLKVEKYYTPLEFGKMRKIAMEKGFKHCQAGPLVRSSYHADEQVNEAAKEKQRQGEEQLN

SEQ ID NO: 26824 - DNA, 987 bp, Streptomyces avermitilis
  CDS (1)..(987): transl_table=11
gtgtccgcagtcgcacccgacggacgcaagatgctgcgcctggaggtccggaacgcccagacccccatcgagcgcaagcccgagtggatcaagacccgggcgaaaatgggtcccgaatacacgaagatgcagaacctcgtgaagagcgaggggctgcacacggtctgccaggaggcgggctgtcccaacatctacgagtgctgggaagaccgcgaggccaccttcctcatcggcggcgaccagtgcacccggcgctgcgacttctgccagatcgacaccggcaagcccgaggccctcgaccgcgacgagccgcgccgcgtcggtgagtccgtcgtcacgatggacctgaactacgccacgatcacgggcgtcgcccgcgacgacctcgaggacggcggcgcctggctgtacgcggagacggtccgccagatccacgcgcagacggcgggccgcgaggccggccgcaccaaggtcgagctgctcgcccccgacttcaacgccgagcccgaccagctggccgaggtcttctccgcgcgccccgaggtcttcgcgcacaacgtcgagacggtcccgcggatcttcaagcgcatccgccccggcttccgctacgagcgctccctgaaggtcatcacggaggcccgggactacggtctggtcacgaagtcgaacctcatcctcggcatgggtgagacccgcgaagaggtcagcgaggcgctccggcagctgcacgacgcgggctgcgagctcatcacgatcacgcagtacctgcgcccctccgtgcgccaccaccccgtggagcgctgggtcaagccgcacgagttcgtggaactcaaggaggaggccgaggagatcggcttctccggtgtcatgtcgggcccgctggtccgctcctcgtaccgggccggccgcctgtaccagatggccatggagctgcgtcagtcagccgctccgcagggcggtgcgcaggtcgcctcgcaggcggtctga

SEQ ID NO: 26825 - protein, 328 aa, Streptomyces avermitilis
MSAVAPDGRKMLRLEVRNAQTPIERKPEWIKTRAKMGPEYTKMQNLVKSEGLHTVCQEAGCPNIYECWEDREATFLIGGDQCTRRCDFCQIDTGKPEALDRDEPRRVGESVVTMDLNYATITGVARDDLEDGGAWLYAETVRQIHAQTAGREAGRTKVELLAPDFNAEPDQLAEVFSARPEVFAHNVETVPRIFKRIRPGFRYERSLKVITEARDYGLVTKSNLILGMGETREEVSEALRQLHDAGCELITITQYLRPSVRHHPVERWVKPHEFVELKEEAEEIGFSGVMSGPLVRSSYRAGRLYQMAMELRQSAAPQGGAQVASQAV

SEQ ID NO: 26826 - DNA, 954 bp, Streptomyces coelicolor
  CDS (1)..(954): transl_table=11
gtgtccgcagtcgcacccgacggacgcaagatgctgcgcctggaggtccgcaacagccagacccccatcgagcgcaagcccgagtggatcaagacccgggcgaaaatgggccccgaatacaccaagatgcagaacctcgtgaagagcgagggcctgcacacggtctgccaggaagccggctgtcccaacatctacgagtgctgggaggaccgcgaggcgaccttcctcatcggcggcgaccagtgcacccggcgctgcgacttctgccagatcgacaccggcaagcccgaggcgctcgaccgcgacgagccgcgccgcgtcggcgagtccgtggtcaccatggacctgaactacgccaccatcaccggcgtcgcccgcgacgacctccccgacggcggcgcgtggctgtacgcggagacggtgcgccagatccacgagcagaccgccggccgcgaggccggccgcaccaaggtcgagctgctggccccggacttcaacgccgttccggagctgctccgggaggtcttcgagtcccgccccgaggtcttcgcgcacaacgtcgagaccgtcccgcggatcttcaagcgcatccgcccgggcttccgctacgagcgctccctgaaggtcatcaccgacgcccgcgacttcggcctggtcaccaagtcgaacctgatcctcggcatgggcgagacccgcgaggagatcagcgaggcgctgaagcagctgcacgaggccggctgcgagctgatcaccatcacgcagtacctgcgcccgtccgtgcgccaccacccggtggagcgctgggtcaagccgcaggagttcgtcgagctgaaggaggaggccgagcagatcggcttctccggcgtgatgtcgggcccgctggtccgctcgtcgtaccgggccggacggctctacggaatggccatggagcagcgccggtccgccaccgtgtga

SEQ ID NO: 26827 - protein, 317 aa, Streptomyces coelicolor
MSAVAPDGRKMLRLEVRNSQTPIERKPEWIKTRAKMGPEYTKMQNLVKSEGLHTVCQEAGCPNIYECWEDREATFLIGGDQCTRRCDFCQIDTGKPEALDRDEPRRVGESVVTMDLNYATITGVARDDLPDGGAWLYAETVRQIHEQTAGREAGRTKVELLAPDFNAVPELLREVFESRPEVFAHNVETVPRIFKRIRPGFRYERSLKVITDARDFGLVTKSNLILGMGETREEISEALKQLHEAGCELITITQYLRPSVRHHPVERWVKPQEFVELKEEAEQIGFSGVMSGPLVRSSYRAGRLYGMAMEQRRSATV

SEQ ID NO: 26828 - DNA, 861 bp, Sulfolobus acidocaldarius
  CDS (1)..(861): transl_table=11
atgaaaagcgaagtggtagtaaggattaatgagaacttcaagaaacttagcaggatagtgtctgagaaagggatatccactgtatgcgaggaagctctatgtccaaatatcatggagtgttggggatcaggaactgctacgttcatgataatgggagatatctgcacaagaggttgtaggttttgttatgtaaaaaagggtaaaccagtcctactagaccatgaggagccaataaaagtagcagaggcagtaagggaaatgggtttagactatgttgtcataaccagtgttgacagggatgatttagcagatgggggagcttctcatttttctcaagttgttaaagccgtgaaagagatgaatcctgacgtcatagttgaggtccttacaccagattttatggggaataaagaactagtggagaaagtaatagggtctggcgtagacgtatttgcacacaacgtggaaacggtaagaagcctgactccattagtgagagacgcaagagcatcatacgaacaaagtttaagagtacttagttatgctaagaacgttgtcaaaaaatcctctattcttttaggtcttggggagagcttagaggaagtagttgaaaccatgaaggatttgagaaatgtcggtgtagatattttagtcctttcccagtacatgagacctagcattaaacaactggaagttaagaaacgttataacatggaagagtacaaggaacttgaaaaaatagcttattctttaggtttttcatatgtcgttgcactacctcacgctagaacttcctacagggcaaaagaggcatatttgagggcgatggcaaatgttaagaataataatagatggtcctag

SEQ ID NO: 26829 - protein, 286 aa, Sulfolobus acidocaldarius
MKSEVVVRINENFKKLSRIVSEKGISTVCEEALCPNIMECWGSGTATFMIMGDICTRGCRFCYVKKGKPVLLDHEEPIKVAEAVREMGLDYVVITSVDRDDLADGGASHFSQVVKAVKEMNPDVIVEVLTPDFMGNKELVEKVIGSGVDVFAHNVETVRSLTPLVRDARASYEQSLRVLSYAKNVVKKSSILLGLGESLEEVVETMKDLRNVGVDILVLSQYMRPSIKQLEVKKRYNMEEYKELEKIAYSLGFSYVVALPHARTSYRAKEAYLRAMANVKNNNRWS

SEQ ID NO: 26830 - DNA, 858 bp, Sulfolobus solfataricus
  CDS (1)..(858): transl_table=11
atggagaaaaaagttcaaattgcagtttacgagaatgaaaacttcaaaagagtagcagagattgtaaagaagaaaagtattgctactgtgtgtgaagaggcgctatgcccaaacattatggaatgctggggatctggaactgcaacatttatgatcatggggagcatttgtactagaggttgtaggttttgttatgtgttaaagggaaagccctcaccattggacgatgaagaacctaaaagagttgcagaagcggtaaaggagatggaactggactacgttgtaataaccagtgttgatagagacgacctatccgatgggggagcacaacatttcgctaacgtggtgaaaacagtaaaagaacttaacccgggtataatagttgaagtgttaactccagactttagggggaatattgacgcagttaaaaaagtaattgatgctggagttgacgtatttgcacataacgttgagaccgtaagaagactaacgccaatagtaagggaccctagagcctcatatgagcaaagtctcaatgttttaaaatatgctgaaaacgtgataaaaaaatcctcaatcctcttaggtctcggtgagacttgggatgagatagtagaaacgatgagagatttgagaagtgtaggagttagtatattggtactttcacaatatatgagacctagtcgtaaacaattggaggttaagaagcgttatactttagaagagtttaaggaacttgaggaaatagcctactcaatgggtttctcagctgtgatctccttaccattagctagaacctcttataaggcgaaagaggcctattttagggcgattgaaaatgctaagaatcatagttga

SEQ ID NO: 26831 - protein, 285 aa, Sulfolobus solfataricus
MEKKVQIAVYENENFKRVAEIVKKKSIATVCEEALCPNIMECWGSGTATFMIMGSICTRGCRFCYVLKGKPSPLDDEEPKRVAEAVKEMELDYVVITSVDRDDLSDGGAQHFANVVKTVKELNPGIIVEVLTPDFRGNIDAVKKVIDAGVDVFAHNVETVRRLTPIVRDPRASYEQSLNVLKYAENVIKKSSILLGLGETWDEIVETMRDLRSVGVSILVLSQYMRPSRKQLEVKKRYTLEEFKELEEIAYSMGFSAVISLPLARTSYKAKEAYFRAIENAKNHS

SEQ ID NO: 26832 - DNA, 855 bp, Thermoanaerobacter tengcongensis
  CDS (1)..(855): transl_table=11
ttgacagtgcgaaagcctgaatggcttaaagtgagaattttaagtgaggatttaaacaggatggaagcttttttgaaaaatatggccttaaataccgtatgtcaaagtgcaaactgcccaaacatgggggagtgctttgcaaggagaacagcaacttttatgataatgggcaacatatgtactagaaactgcagattttgtgcagtggaaaaagggcatcctcagccccttgatgaagaagagccgagaagagtggcggaagcagctagaaggttggggttaaggcatgtggtagttacgtctgttacaagggatgatttgccagacggtggggcttcacattttgcgaagacaatatatgagctaaaaaagctgccaggagtcactgttgaagtgcttgtgcctgattttatgggaaatgaagaggcaatcaggactgttgtggaagcaaaacctgatgtaataaatcacaatgtagagacggttccgaggctttactcaagagtgaggccaaaagcggattacattaggtctttaaacctccttaaaaaggtcaaagagctggaccctctaatacttactaaatcagggattatggtgggactgggcgaaacagaagaggaagtaatagaagttatgaaggatttaagagatattgattgcgatatgatgaccataggacagtatctaagaccttctcataagcacatagaagtagctgaatatgtaacccctgaacagtttaaaagatatgaagagataggctacaaattaggatttaagcatgtagcttctgggccgttggttagaagttcttatcatgctgatgtgggtttgagtttagcaagaggatga

SEQ ID NO: 26833 - protein, 284 aa, Thermoanaerobacter tengcongensis
MTVRKPEWLKVRILSEDLNRMEAFLKNMALNTVCQSANCPNMGECFARRTATFMIMGNICTRNCRFCAVEKGHPQPLDEEEPRRVAEAARRLGLRHVVVTSVTRDDLPDGGASHFAKTIYELKKLPGVTVEVLVPDFMGNEEAIRTVVEAKPDVINHNVETVPRLYSRVRPKADYIRSLNLLKKVKELDPLILTKSGIMVGLGETEEEVIEVMKDLRDIDCDMMTIGQYLRPSHKHIEVAEYVTPEQFKRYEEIGYKLGFKHVASGPLVRSSYHADVGLSLARG

SEQ ID NO: 26834 - DNA, 873 bp, Treponema denticola
  CDS (1)..(873): transl_table=11
atgaattttaaggctgggtttatgacttgtaatcaaagaaaacctgattggttaaaaataaaacttcctaccggagaactttcacaggaagtatcgaatacaataaaaatacataaattaaatactatatgtaccagcggcaaatgtcccaatcagggagaatgttggaggtgcggaactgcaacatttatgatttgcggaaatatctgtacgcgtgcatgtaaattctgtaatgtgcctaccggttgcccattgcccctaaatcctaatgagccgatggaaatagctcaatcggttgaggctttaaaattaaaacatgtagttttaacctcggtagatagggacgatataaaagatttcggtgcttcccactgggtaaaggttataagagccgtaaaacaaaaaacaccgaatgttactatggaagttttaattcccgattttcaaggccatgaagatttggtatcgatgattatcgaagcaaaacctgaggtaatttctcataatcttgaaacggtacgcaggctttctccccatgtcaggagcagggctacatatgatacttctctcaaagttttaaaacaaattgcagactccggcttggtatgcaaatcaggtattatgttggggctgggggaaacaagggctgaaattttagaaaccatggacgatttacgcaaaataaactgcaaagttatgaccataggccaatacctcaggccctctataaaaaacattgaggttaaagaatatgtaaggcctgaagtctttgaagaatataaacaaataggtttggagaagggcttttcttttgtggaaagcggtccccttgttcgttccagttatcatgccgaaaagcatgtgttgagctaa

SEQ ID NO: 26835 - protein, 290 aa, Treponema denticola
MNFKAGFMTCNQRKPDWLKIKLPTGELSQEVSNTIKIHKLNTICTSGKCPNQGECWRCGTATFMICGNICTRACKFCNVPTGCPLPLNPNEPMEIAQSVEALKLKHVVLTSVDRDDIKDFGASHWVKVIRAVKQKTPNVTMEVLIPDFQGHEDLVSMIIEAKPEVISHNLETVRRLSPHVRSRATYDTSLKVLKQIADSGLVCKSGIMLGLGETRAEILETMDDLRKINCKVMTIGQYLRPSIKNIEVKEYVRPEVFEEYKQIGLEKGFSFVESGPLVRSSYHAEKHVLS

SEQ ID NO: 26836 - DNA, 1056 bp, Tropheryma whipplei
  CDS (1)..(1056): transl_table=11
atgaacgattctggcaattcaagcaaagttaatgtaaggcccccttcagccggtttgggagcaccctccccgggcaagcgtaagatgctccgcctggaggtacgaaattcgcaggttcctatagaacggaagccctcatggataagggctcgtgcaactattggtacagagtacagaaaggttcaggaacgtgttaagaaacagaatttgcggactgtttgtcaagaagccggatgtccgaatatctacgaatgctgggaggatagagaggcaactttcctgatcggaggatcgcagtgtactcgcaggtgtgatttttgtcagatagacacgggaaaacctgcagagctcgacctggatgagccaaaacgggttggacagtccgtggcgcaaatgaagttacgctatgccaccgtaaccggagtagcacgcgacgacctgcccgatgggggtgtctggctctatgcagaaacaatccgagaaatacacaaacagtgccctggaagtggggttgaaatactcataccagattttaacggtaagccagagttgctccagcaaatcttcgaagcacaaccggaagtgtacgcacacaatatagaaactgttccacggatattcaggcgcattagaccggcattcagatacgacagatcgctggatgttatatcacaaggtcaaaaagctgggatgataacaaaatcaaatcttattcttggaatgggcgagaccggtgaagaggtaacacaggcattgagagacctcaaaagtgccggttgtgacattgtaacaataactcagtatctaagaccatcgcccaggcatttacccgtggcaagatgggtaaaaccacaagagttcatagaatataaagagcaagccaaagagatcggattctcaggcgttttggccggacctttagttagatcatcataccgtgccggaaaactgtgggcacaatctgtgaaagctaagatggttgaaatacccgagcgcgtacggaaactcataaacgaaatcgagatgcaggaaacgtcctttaggcaagcagtctag

SEQ ID NO: 26837 - protein, 351 aa, Tropheryma whipplei
MNDSGNSSKVNVRPPSAGLGAPSPGKRKMLRLEVRNSQVPIERKPSWIRARATIGTEYRKVQERVKKQNLRTVCQEAGCPNIYECWEDREATFLIGGSQCTRRCDFCQIDTGKPAELDLDEPKRVGQSVAQMKLRYATVTGVARDDLPDGGVWLYAETIREIHKQCPGSGVEILIPDFNGKPELLQQIFEAQPEVYAHNIETVPRIFRRIRPAFRYDRSLDVISQGQKAGMITKSNLILGMGETGEEVTQALRDLKSAGCDIVTITQYLRPSPRHLPVARWVKPQEFIEYKEQAKEIGFSGVLAGPLVRSSYRAGKLWAQSVKAKMVEIPERVRKLINEIEMQETSFRQAV

SEQ ID NO: 26838 - DNA, 966 bp, Vibrio cholerae
  CDS (1)..(966): transl_table=11
atgagtaaaccaattcagatggaacgcggcgttaaatatcgtgacgccgacaaaatggctttgattcctatcaagaacatgccgacagagcagaaagaagttctgcgcaaaccagaatggatgaagataaagctacctgcggatagccagcgcattcaagacatcaaggccgccatgcgtaaaaataatcttcactcagtctgtgaagaagcctcctgccctaacttggctgagtgttttaaccatggtacggcgacctttatgattttaggtgctatctgtacccgtcgctgcccattctgtgacgttgcccatggccgccccaatgcaccagaagcggaagagccgaaaaagctcgcacaaaccattcatgatatgaagctcaagtacgtggtaattacttcggtggaccgcgatgacttgcgtgatggtggtgcacaacatttcgccgattgtaaccgtgaaattcgcgctttgaatccgcacatcaagattgaaaccttggtgcctgatttccgtggtcgcatggaagtggctcttgaggccttaaaagacaatccccccgatgtgtttaaccacaatttggaaaccgcgccacgcttgtatcgtaaagtgcgcccaggcgctaactataagtggtcgttagagctgctgcgtcaatttaaagagcagcatcctcatgtaccgactaaatccggtttgatgatgggcttgggtgaaactaaagaagagatcgtcgaagtattgaaagatctccgtgctcatggcgtcaccatgctgactcttggccaatatctcgcacccagtcgccaccatctgccggttgaacgctacgtgccccccgcagagtttgatgagctgaaagaggttgctctagaactcggctttactcatgcagcctgtggaccctttgtacgttcctcttaccatgctgacttacaagccaagggtttagaagtcaaataa

SEQ ID NO: 26839 - protein, 321 aa, Vibrio cholerae
MSKPIQMERGVKYRDADKMALIPIKNMPTEQKEVLRKPEWMKIKLPADSQRIQDIKAAMRKNNLHSVCEEASCPNLAECFNHGTATFMILGAICTRRCPFCDVAHGRPNAPEAEEPKKLAQTIHDMKLKYVVITSVDRDDLRDGGAQHFADCNREIRALNPHIKIETLVPDFRGRMEVALEALKDNPPDVFNHNLETAPRLYRKVRPGANYKWSLELLRQFKEQHPHVPTKSGLMMGLGETKEEIVEVLKDLRAHGVTMLTLGQYLAPSRHHLPVERYVPPAEFDELKEVALELGFTHAACGPFVRSSYHADLQAKGLEVK

SEQ ID NO: 26840 - DNA, 966 bp, Vibrio parahaemolyticus
  CDS (1)..(966): transl_table=11
atgagcaaaccaatccagatggaaaaaggcgttaaatatcgtgacgccgataaaatggcattgattcccgtaaagaacatgcctacagagcagaaagaagtgctacgtaagcctgattggatgaagatcaagctaccagccgacagccaacgaattcaagacatcaaagctgcgatgcgtaagaacaagcttcactccgtatgtgaagaagcgtcttgccctaacctagcggaatgttttaaccacggtacagcaaccttcatgatcctaggtgcaatctgtactcgtcgttgtcctttctgtgacgttgctcatggccgtccattaccaccagaagcagaagagccacaaaaactggcaagaactatcgccgacatgaaactgaagtacgttgttattacttcagtagaccgtgacgacctacgtgatggtggtgcacaacactttgccgattgtaaccgtgagatccgcgagttaaacccagacatcaagatcgaaacactggttcctgacttccgtggtcgtatggacgtagcgcttgacctgatgaaagacaacccgccagatgtcttcaaccacaacctagaaactgcgccgcgtctttaccgtaaagctcgcccaggtgcgaactacaagtggtcacttgagcttcttaagaagttcaaagaacagcatccagatgtaccgaccaaatcaggtctgatgatgggccttggtgaaaccaaagaagaaatcatcgaagtgcttaaagatctgcgtgcacacggtgtaacgatgctgactctaggccagtacctagcgccaagccgtcaccacttgcctgtagaacgttacgttccaccatcagagtttgacgagctaaaagaagtcgcactagagctaggcttcacgcacgcagcatgtggtccatttgttcgctcttcataccatgccgatatgcaggcacaaggtcttgagatcaaataa

SEQ ID NO: 26841 - protein, 321 aa, Vibrio parahaemolyticus
MSKPIQMEKGVKYRDADKMALIPVKNMPTEQKEVLRKPDWMKIKLPADSQRIQDIKAAMRKNKLHSVCEEASCPNLAECFNHGTATFMILGAICTRRCPFCDVAHGRPLPPEAEEPQKLARTIADMKLKYVVITSVDRDDLRDGGAQHFADCNREIRELNPDIKIETLVPDFRGRMDVALDLMKDNPPDVFNHNLETAPRLYRKARPGANYKWSLELLKKFKEQHPDVPTKSGLMMGLGETKEEIIEVLKDLRAHGVTMLTLGQYLAPSRHHLPVERYVPPSEFDELKEVALELGFTHAACGPFVRSSYHADMQAQGLEIK

SEQ ID NO: 26842 - DNA, 951 bp, Wigglesworthia glossinidia brevipalpis
  CDS (1)..(951): transl_table=11
atgaaatcaatatcatatttaaatacaaaagaaaaaaataaaaaaaaattatcaataccatctaaaactatatttgcaaaagaaaatgaatatggtttaaaaaaaccaaattggttaaaaattaaattacctttaaataataaaaaaattaataaaataaaattaataatgagaaaaaataatttacatactgtatgtgaagaagcagcatgtcctaatttagcagaatgttttaatagaggaactgcaacatttatgattttaggatcaatttgtacaagaagatgtcctttttgtaatgtttcgtctggaaggccatctttagtagacacaaaagaacctgaaaatttatcaaaggctgctataaaaatgaaattaaaacatatagtaattacttcggttgatagagatgatttaaaagatggtggttcagaacacttttctaattgtattagatttataagaaaaaaaaatcctgatataaaaatagaaattttagttcctgattttagaggatgtacggagttagcattaaataatattagtacatatcctccagatatttttaatcataatttagaaagcattcctagattatactctaaagtaagacctggagctaattataaaagatctttagaattattggaaaaatttaatctcatcaatccaaacattcctactaaatcaggattaatgcttggattaggagaaaccaaagaagagataattgaagtaatgaaagatttaagaaaatcttatgtaagtatgataactataggtcaatatcttagaccaactaaaaatcatcttactgttaataggtatgttcatccaaaagaatttagagagcttaatttaatagcttttgatttaggatttaaacatgctatgtgcggacctcttgtgagatcttcttatcatgcagaaaatcaaattaattgttattaa

SEQ ID NO: 26843 - protein, 316 aa, Wigglesworthia glossinidia brevipalpis
MKSISYLNTKEKNKKKLSIPSKTIFAKENEYGLKKPNWLKIKLPLNNKKINKIKLIMRKNNLHTVCEEAACPNLAECFNRGTATFMILGSICTRRCPFCNVSSGRPSLVDTKEPENLSKAAIKMKLKHIVITSVDRDDLKDGGSEHFSNCIRFIRKKNPDIKIEILVPDFRGCTELALNNISTYPPDIFNHNLESIPRLYSKVRPGANYKRSLELLEKFNLINPNIPTKSGLMLGLGETKEEIIEVMKDLRKSYVSMITIGQYLRPTKNHLTVNRYVHPKEFRELNLIAFDLGFKHAMCGPLVRSSYHAENQINCY

SEQ ID NO: 26844 - DNA, 864 bp, Wolbachia pipientis wMel
  CDS (1)..(864): transl_table=11
atgcatagcaaacctcaatggctcagagcaaaagctccgaccggtgaagtattcaatgagaccttaaacatcgttaaactgcataacttgcatacagtgtgcgaagaggctgcatgtccaaacattggtgaatgttggaataaacgtcatgctactgtgatgattctcggttctgtttgcactcgtgcttgtgcattttgcaacgttgcaactggcattcctgataaactagatcctcatgaaccagaaaatttagcaaaagcaataaaaaagttaaacttaaaacatgttgtcattacttccgttgatcgtgatgatttgccagatggtggcgcaaatcagtttatacagtgcatagaagaaattagaaagataacttcagaaacaacaatagagattttaactcctgattttttaaataagaaaggagcatttgaagcaatcgctgttgcatcacctgatgtctataaccacaatattgaaacagtgccgagattgtatgcaaaaataagaccacgagctcgctattttcattcactatatttgttgaagatggtaaagcagattaatcctaaagttttcacaaagtcagggcttatggttggtcttggagaaacaaaagaggaaatacttcaggttatggacgatttgcgcagtgctgaggttgattttattacaattggtcaatatctacaaccaactccaaaacatgcaaaacttgataggtatgttaccccagaagagtttgagcattataaatacattgcttactccaaaggtttcttagtggttgcatcaagcccactaactcggtcatcataccacgctgaagaagattttaacaggctcaaggcctgtcgttga

SEQ ID NO: 26845 - protein, 287 aa, Wolbachia pipientis wMel
MHSKPQWLRAKAPTGEVFNETLNIVKLHNLHTVCEEAACPNIGECWNKRHATVMILGSVCTRACAFCNVATGIPDKLDPHEPENLAKAIKKLNLKHVVITSVDRDDLPDGGANQFIQCIEEIRKITSETTIEILTPDFLNKKGAFEAIAVASPDVYNHNIETVPRLYAKIRPRARYFHSLYLLKMVKQINPKVFTKSGLMVGLGETKEEILQVMDDLRSAEVDFITIGQYLQPTPKHAKLDRYVTPEEFEHYKYIAYSKGFLVVASSPLTRSSYHAEEDFNRLKACR

SEQ ID NO: 26846 - DNA, 1014 bp, Xanthomonas axonopodis pv
  CDS (1)..(1014): transl_table=11
atgacccagcctatcgcccgttccattcccttgcaggtcgtctctggcgacaccgccgcgcctgcgccgctgcagactggcgtcaagcagatcggtggcgacaagatcaaccgctcgccggtgcagttcgtggatgcgccggtgctgcggaaaccgtcgtggatccgggtgcggattccgtctggcaatgcggtacagaacctcaaggccaagctgcgcgaaaaccgcctggtcacggtgtgcgaagaagccagctgcccgaacatccacgagtgcttcagccacggcaccgcgaccttcatgattttgggcgaggtgtgcacgcggcgctgctcgttctgcgacgtggcgcatggccggccaaagccgcccgacgcgagcgaacctgccagcctggccgccactgttgccgacatgggcctgaagtacgtggtggtgaccagcgtggatcgtgacgacctgcgcgacggtggcgcgcagcatttcgttgactgcatctcggcgatccggaccagctcgcccaacacgcgtatcgaaatcctgaccccggacttccgcggcaagggccgcatggaccgcgcgctggagatcctggcgctgagcccgccggacgtgttcaaccacaacatcgaaaccgtgccggacctctacccgaatgtgcgccccggcgcggactaccagtggtcgctgacgctgttgcagcgcttcaaggcgcagcatccgtccatcgccaccaagtccggcatcatgctgggcctgggcgagacgatggagcaggtgcaggccacgctgcgcgacctgcgcgcgcacgatgtggacatgatcaccatcggccagtatctgcagccgacgccgcaccatcatccggtgatgcgttactggacgcctgaggaatacaaggcgctggaagactacggcaacgcgctgggcttcagtcatgttgcctccggcccgatggtgcgttcctcgtaccacgccgatcgtcaggccgcaggcgccggcgtcgccgcctga

SEQ ID NO: 26847 - protein, 337 aa, Xanthomonas axonopodis pv
MTQPIARSIPLQVVSGDTAAPAPLQTGVKQIGGDKINRSPVQFVDAPVLRKPSWIRVRIPSGNAVQNLKAKLRENRLVTVCEEASCPNIHECFSHGTATFMILGEVCTRRCSFCDVAHGRPKPPDASEPASLAATVADMGLKYVVVTSVDRDDLRDGGAQHFVDCISAIRTSSPNTRIEILTPDFRGKGRMDRALEILALSPPDVFNHNIETVPDLYPNVRPGADYQWSLTLLQRFKAQHPSIATKSGIMLGLGETMEQVQATLRDLRAHDVDMITIGQYLQPTPHHHPVMRYWTPEEYKALEDYGNALGFSHVASGPMVRSSYHADRQAAGAGVAA

SEQ ID NO: 26848 - DNA, 1014 bp, Xanthomonas campestris pv
  CDS (1)..(1014): transl_table=11
atgacccagcctatcgcccgctccattcccttgcaggtcgtctccggcgacaccgccgcacctgcgtcgctgcagaccggcgtcaagcagatcggtggcgacaagatcaaccgctcgccggtgcagttcgtcgacgcgccggtgctgcgcaagccgtcgtggatccgggtgcggatcccgtccggcaacgcggtgcagaacctcaaggccaagttgcgcgaaaaccgcttggtcacggtctgcgaagaagccagctgcccgaacatccacgagtgcttcagccacggcaccgccaccttcatgatcctgggtgaggtgtgcacgcggcgctgctcgttctgcgacgtggcgcatggtcggcccaagccgccggatgcgagcgagccggccagcctggccaccaccgtggccgacatgggcctgaagtacgtggtggtgaccagcgtggaccgcgacgacctgcgcgacggcggtgcccagcacttcgtcgactgcatctcggcgatccgcgccagcgcgcccaagacccggatcgagatcctgaccccggacttccgtggcaagggccgcatggaccgcgcgctggagatcctggccaccagcccgccggacgtgttcaaccacaacattgaaaccgtgccggacctgtacccgaacgtgcgccccggtgccgattaccagtggtcgctgacgctgctgcagcgcttcaaggcgcagcacccgaccatcgccacgaagtccggcatcatgctcggcctgggcgaaacgatggagcaggtgcaggtcaccctgcgcgacctgcgtgcgcacgatgtggacatgatcacgatcggccaatacctgcagcccacgccgcaccaccacccggtgatgcgctactggacgccggaggaatacaaggcgctggaggagtacggcaatgcgctgggcttcagccacgtggcgtccggcccgatggtgcgttcctcgtaccacgccgaccgccaggctgccggtgccggcgtcgccgcctga

SEQ ID NO: 26849 - protein, 337 aa, Xanthomonas campestris pv
MTQPIARSIPLQVVSGDTAAPASLQTGVKQIGGDKINRSPVQFVDAPVLRKPSWIRVRIPSGNAVQNLKAKLRENRLVTVCEEASCPNIHECFSHGTATFMILGEVCTRRCSFCDVAHGRPKPPDASEPASLATTVADMGLKYVVVTSVDRDDLRDGGAQHFVDCISAIRASAPKTRIEILTPDFRGKGRMDRALEILATSPPDVFNHNIETVPDLYPNVRPGADYQWSLTLLQRFKAQHPTIATKSGIMLGLGETMEQVQVTLRDLRAHDVDMITIGQYLQPTPHHHPVMRYWTPEEYKALEEYGNALGFSHVASGPMVRSSYHADRQAAGAGVAA

SEQ ID NO: 26850 - DNA, 1122 bp, Xylella fastidiosa
  CDS (1)..(1122): transl_table=11
atgactcaacctattgtccgttctatcccgttgcatgttgtctcaaatgatcatccttcatcttccccattgcagcctggagtaaagcaatcgggtgaagacaagattgggcgttcgcctgtgcagtttgcagatgttccggtgttgcgtaaaccatcatggattcgtgttcgcattccatccggcaatgcggtgcaaagtctcaaagccaagctacgtgagaatcgtttagtcacggtgtgtgaggaggctgcctgccctaatatccatgagtgttttagccatggcacagcgacgttcatgattctgggtgaagtgtgcacgcgtcgttgttcgttttgcgatgtggcacatggccgccccaagccaccggacccggaggagccaatcagtttggcacgcaccgtggctgagatgggtttgaagtacgtggtggtgaccagtgtggatcgcgatgatttgcgtgacggtggtgcccagcattttgttgattgcattgctgcgatccgtcagagtgcgccacagacacggatcgagattctgaccccagatttccgaggaaaggggcgcatggatcgtgcattggatattttggcggcatgtccgccggatgtattcaatcataacgttgagacggtgcccgctttgtatcccaatgtgcggccgggagcggattatcaatggtcattgactctcttaaaacgctttaaggcacagcatccgcaggtgcctacgaagtccgggatcatgctcggtttaggggagactctggatcaggtacaggcgacgttgcgtgacttgcgtgctcatgacgtggatatggtcacgattggtcagtatctgcagccgacgtcgcatcatcacccagtgttacggtattggactccagatgagtacaaggcgttggaggagtacggtatggcgttgggtttcagccacgttgcttcaggtccgatggtgcgttcttcgtatcatgccgaccatcaggcgaaagaggcgggcttgggtttcaatgccaccgtttcgctgggctctccagcggtatcgtcgactgaacatcgggagcgccataccatcgcatcaaaatcagcctctaagactgaatcgatccgtcatagatag

SEQ ID NO: 26851 - protein, 373 aa, Xylella fastidiosa
MTQPIVRSIPLHVVSNDHPSSSPLQPGVKQSGEDKIGRSPVQFADVPVLRKPSWIRVRIPSGNAVQSLKAKLRENRLVTVCEEAACPNIHECFSHGTATFMILGEVCTRRCSFCDVAHGRPKPPDPEEPISLARTVAEMGLKYVVVTSVDRDDLRDGGAQHFVDCIAAIRQSAPQTRIEILTPDFRGKGRMDRALDILAACPPDVFNHNVETVPALYPNVRPGADYQWSLTLLKRFKAQHPQVPTKSGIMLGLGETLDQVQATLRDLRAHDVDMVTIGQYLQPTSHHHPVLRYWTPDEYKALEEYGMALGFSHVASGPMVRSSYHADHQAKEAGLGFNATVSLGSPAVSSTEHRERHTIASKSASKTESIRHR

SEQ ID NO: 26852 - DNA, 1122 bp, Xylella fastidiosa
  CDS (1)..(1122): transl_table=11
atgactcaacctattatccgttctatcccgttgcatgttgtctcaaatgatcatccttcatcttccccattgcagcctggagtaaagcaatcgggtgaagacaagattgggcgttcgcctgtgcagtttgcagatgttccggtgttacgtaagccatcatggattcgcgttcgcattccatccggcaatgcggtgcaaagtctcaaagccaagctacgtgagaatcgtttagtcacggtgtgtgaggaggctgcctgccctaatatccatgagtgttttagccatggcacagcgacgttcatgattctgggtgaagtgtgcacgcgtcgttgttcgttttgcgatgtggcgcatggccgccccaaaccgccggacccggaggaaccaatcagtttggcacgcaccgtcgctgagatgggtttgaagtacgtggtggtgaccagtgtggatcgcgatgatttgcgtgacggtggtgcccagcattttgttgattgcattgctgcgatccgtcagagtgcaccacaaacacggatcgagattctgaccccagatttccgaggaaagggacgcatggatcgtgcattggacattttggcggcatgtccgccggatgtattcaatcataacgttgaaacggtgcccgctttgtatcccaatgtgcgacccggagcggattatcaatggtcattgacgctcttaaaacgctttaaggcacagcatccgcaggtgcctacgaagtccgggatcatgctcggtttaggggagactctggatcaggtacaggcgacgttgcgtgacttgcgtgctcatgacgtggatatggtcacggttggtcagtatctgcagccgacgccgcatcatcacccagtgttgcggtattggactccggatgagtacaaggcgttggaagagtacggtatggcgttgggtttcagccacgttgcttcaggtccgatggtgcgttcttcgtatcacgccgaccatcaggcgaaagaggcgggcttaggcttcaatgccaccgtttcgctgggctctccagcggtatcgtcgactgaacatcgggagcgcaataccatcgcatcaaaatcagcctctaagactgaatcgatccatcatagatag

SEQ ID NO: 26853 - protein, 373 aa, Xylella fastidiosa
MTQPIIRSIPLHVVSNDHPSSSPLQPGVKQSGEDKIGRSPVQFADVPVLRKPSWIRVRIPSGNAVQSLKAKLRENRLVTVCEEAACPNIHECFSHGTATFMILGEVCTRRCSFCDVAHGRPKPPDPEEPISLARTVAEMGLKYVVVTSVDRDDLRDGGAQHFVDCIAAIRQSAPQTRIEILTPDFRGKGRMDRALDILAACPPDVFNHNVETVPALYPNVRPGADYQWSLTLLKRFKAQHPQVPTKSGIMLGLGETLDQVQATLRDLRAHDVDMVTVGQYLQPTPHHHPVLRYWTPDEYKALEEYGMALGFSHVASGPMVRSSYHADHQAKEAGLGFNATVSLGSPAVSSTEHRERNTIASKSASKTESIHHR

SEQ ID NO: 26854 - DNA, 966 bp, Yersinia pestis
  CDS (1)..(966): transl_table=11
atgagtaaaccgattcagatggaacgcggcgtaaaataccgtgatgcagacaaaatggcgttaatcccggtaaaaaacgtggtgaccgaacgtcaggagctgttgcgtaaacccgagtggctaaaaatcaagcttccgactgattccagccgcattcagggtatcaaagctgcaatgcgtaagaatggtctgcattcggtttgtgaagaggcctcctgccctaacctgtctgagtgctttaaccacggtacggcaacatttatgatccttggtgcaatttgtacccgccgttgcccattctgtgacgttgcccatggtcgcccagtcacaccggatgctaatgagccagagaagctggcacagacgatccaagacatgggtctgcgctatgttgttatcacgtccgttgaccgtgatgacctacgtgatggtggtgctcagcattttgccgattgtatttcagcgatccgcgccaagaatccaaccatcaaaattgaaacgttagtccctgatttccgtggtcgtatggatcgcgcactcgatattctgaccgcaaccccaccagatgtatttaaccataatttggaaaacgtaccacgtgtttatcggcaggttcgtccaggggcgaactacgattggtcactgaaattacttgagcgcttcaaagaagcacatccagatatcccaactaaatccggcttaatggtcggcttgggcgaaaccaatgccgagattgtcgaggtcatgcatgatttacgccgccacggggtcacgatgttgacgctggggcaatacttgcaaccaagccgccatcatttacccgtacaacgttatgtcagcccggccgagtttgacgaaatgaaagcagaagccatggctatgggctttacccatgcagcctgtggcccatttgttcgctcttcttaccatgcagacctgcaagcgaaaggtatggaagtgaagtaa

SEQ ID NO: 26855 - protein, 321 aa, Yersinia pestis
MSKPIQMERGVKYRDADKMALIPVKNVVTERQELLRKPEWLKIKLPTDSSRIQGIKAAMRKNGLHSVCEEASCPNLSECFNHGTATFMILGAICTRRCPFCDVAHGRPVTPDANEPEKLAQTIQDMGLRYVVITSVDRDDLRDGGAQHFADCISAIRAKNPTIKIETLVPDFRGRMDRALDILTATPPDVFNHNLENVPRVYRQVRPGANYDWSLKLLERFKEAHPDIPTKSGLMVGLGETNAEIVEVMHDLRRHGVTMLTLGQYLQPSRHHLPVQRYVSPAEFDEMKAEAMAMGFTHAACGPFVRSSYHADLQAKGMEVK

SEQ ID NO: 26856 - DNA, 972 bp, Zymomonas mobilis
  CDS (1)..(972): transl_table=11
atgagtaaaattcccgcacctgatgaaaaaaccagccgatccgattctggttcctcgattttgcgtaaaccggactggcttcgtgtccgttctcccggtggcgctgcttttaatgaaacccacggcttgatacggaaactgggtctggccacggtgtgcgaagaagcagcctgtcccaatattggagaatgctggacaaaaaaacaggcaaccgtcatgattttgggggaagtctgtacccgtgcctgtgctttttgcaatgtaaagacaggccatcccgacaaggtcaatcctttggaaccggggcatgttgctgatgtcgctgccgaaatgaatttggagcatattgttatcacatcggttgatcgtgatgacctcgaagacggcggcgcttcgcaatttgtcaaagttatcgaagccgtcagggcaagaaccccgaaaacgacgattgagattctgaccccagatttccgtggtaagccggatcatgcattggatatgatcgtcaaagcccgccccgatgtattcaatcacaatcttgaaacggtgccccgtctttacccaacgattcgtccgggagcgcgctatttcacttccttgcgcttgcttgaaaaagtgcgggaacgggacccctctatctttactaaatccggtttaatgctgggtttaggcgaagatcgtttggaagtgcatcaggtcatggacgacatgcggcaagcggatgtcgacttcttaaccttagggcaatatttgcaacctacgccgcgccatgttcgggtagaagagtttgttacacctgacagcttcaaggcctatgcggcgacagctagagccaagggtttttcaatggtggcatcctctcctttaacgcgttccagctattatgccggtgctgattttgcgcgtttaaaagaagcccgccaaaagaagttggaaaaaatagccgccaaaaatagcgggaagggtgcctaa

SEQ ID NO: 26857 - protein, 323 aa, Zymomonas mobilis
MSKIPAPDEKTSRSDSGSSILRKPDWLRVRSPGGAAFNETHGLIRKLGLATVCEEAACPNIGECWTKKQATVMILGEVCTRACAFCNVKTGHPDKVNPLEPGHVADVAAEMNLEHIVITSVDRDDLEDGGASQFVKVIEAVRARTPKTTIEILTPDFRGKPDHALDMIVKARPDVFNHNLETVPRLYPTIRPGARYFTSLRLLEKVRERDPSIFTKSGLMLGLGEDRLEVHQVMDDMRQADVDFLTLGQYLQPTPRHVRVEEFVTPDSFKAYAATARAKGFSMVASSPLTRSSYYAGADFARLKEARQKKLEKIAAKNSGKGA

SEQ ID NO: 26858 - DNA, 25 bp, Artificial sequence
  (1)..(25): primer
atgagtaaacccattgtgatggaac

SEQ ID NO: 26859 - DNA, 24 bp, Artificial sequence
  (1)..(24): primer
ttacttaacttccatccctttcgc

SEQ ID NO: 26860 - protein, 313 aa, Artificial sequence
  Variant (2)..(2): xaa in position 2 is any amino acid
  Variant (6)..(19): xaa in position 6 to 19 is any amino acid
  Variant (20)..(27): xaa in position 20 to 27 is any or no amino acid
  Variant (30)..(32): xaa in position 30 to 32 is any amino acid
  Variant (34)..(34): xaa in position 34 is any amino acid
  Variant (41)..(41): xaa in position 41 is any amino acid
  Variant (46)..(46): xaa in position 46 is any amino acid
  Variant (50)..(53): xaa in position 50 to 53 is any amino acid
  Variant (54)..(64): xaa in position 54 to 64 is any or no amino acid
  Variant (67)..(67): xaa in position 67 is any amino acid
  Variant (72)..(73): xaa in position 72 to 73 is any amino acid
  Variant (77)..(77): xaa in position 77 is any amino acid
  Variant (79)..(79): xaa in position 79 is any amino acid
  Variant (82)..(82): xaa in position 82 is any amino acid
  Variant (84)..(85): xaa in position 84 to 85 is any amino acid
  Variant (87)..(87): xaa in position 87 is any amino acid
  Variant (88)..(88): xaa in position 88 is any or no amino acid
  Variant (90)..(92): xaa in position 90 to 92 is any amino acid
  Variant (94)..(95): xaa in position 94 to 95 is any amino acid
  Variant (98)..(99): xaa in position 98 to 99 is any amino acid
  Variant (102)..(103): xaa in position 102 to 103 is any amino acid
  Variant (105)..(106): xaa in position 105 to 106 is any amino acid
  Variant (108)..(108): xaa in position 108 is any amino acid
  Variant (110)..(110): xaa in position 110 is any amino acid
  Variant (118)..(118): xaa in position 118 is any amino acid
  Variant (123)..(123): xaa in position 123 is any amino acid
  Variant (128)..(129): xaa in position 128 to 129 is any amino acid
  Variant (131)..(133): xaa in position 131 to 133 is any amino acid
  Variant (135)..(136): xaa in position 135 to 136 is any or no amino acid
  Variant (139)..(141): xaa in position 139 to 141 is any amino acid
  Variant (143)..(150): xaa in position 143 to 150 is any or no amino acid
  Variant (153)..(153): xaa in position 153 is any or no amino acid
  Variant (155)..(155): xaa in position 155 is any or no amino acid
  Variant (159)..(159): xaa in position 159 is any or no amino acid
  Variant (161)..(175): xaa in position 161 to 175 is any or no amino acid
  Variant (177)..(178): xaa in position 177 to 178 is any or no amino acid
  Variant (180)..(184): xaa in position 180 to 184 is any amino acid
  Variant (187)..(188): xaa in position 187 to 188 is any amino acid
  Variant (195)..(196): xaa in position 195 to 196 is any amino acid
  Variant (198)..(199): xaa in position 198 to 199 is any amino acid
  Variant (200)..(200): xaa in position 200 is any or no amino acid
  Variant (203)..(204): xaa in position 203 to 204 is any amino acid
  Variant (205)..(205): xaa in position 205 is any or no amino acid
  Variant (207)..(207): xaa in position 207 is any amino acid
  Variant (209)..(210): xaa in position 209 to 210 is any amino acid
  Variant (213)..(213): xaa in position 213 is any amino acid
  Variant (216)..(218): xaa in position 216 to 218 is any amino acid
  Variant (220)..(222): xaa in position 220 to 222 is any amino acid
  Variant (223)..(226): xaa in position 223 to 226 is any or no amino acid
  Variant (228)..(228): xaa in position 228 is any or no amino acid
  Variant (232)..(232): xaa in position 232 is any amino acid
  Variant (240)..(242): xaa in position 240 to 242 is any amino acid
  Variant (245)..(247): xaa in position 245 to 247 is any amino acid
  Variant (249)..(249): xaa in position 249 is any amino acid
  Variant (253)..(258): xaa in position 253 to 258 is any amino acid
  Variant (266)..(266): xaa in position 266 is any amino acid
  Variant (269)..(270): xaa in position 269 to 270 is any amino acid
  Variant (271)..(272): xaa in position 271 to 272 is any or no amino acid
  Variant (274)..(275): xaa in position 274 to 275 is any amino acid
  Variant (277)..(278): xaa in position 277 to 278 is any amino acid
  Variant (280)..(281): xaa in position 280 to 281 is any amino acid
  Variant (283)..(284): xaa in position 283 to 284 is any amino acid
  Variant (286)..(291): xaa in position 286 to 291 is any amino acid
  Variant (293)..(294): xaa in position 293 to 294 is any amino acid
  Variant (295)..(296): xaa in position 295 to 296 is any or no amino acid
  Variant (299)..(304): xaa in position 299 to 304 is any amino acid
  Variant (307)..(307): xaa in position 307 is any amino acid
  Variant (312)..(312): xaa in position 312 is any amino acid
PXWLRXXXXXXXXXXXXXXXXXXXXXXLRXXXLXTVCEEAXCPNIXECWXXXXXXXXXXXXXXXATXMILGXXCTRXCXFCXVXXGXXPXXXDXXEPXXVAXXVXXMXLXYVVITSVXRDDLXDGGAXXFXXXIXXIRXXXPXXXXXXXXIEXLXPDFXGXXXXXXXXXXXXXXXLXXLXXXXXDVXXHNLETVXXLXXXVRXXXAXYXXSLXLLXXXKXXXXXXXIXTKSXLMLGLGEXXXEVXXXMXDLRXXXXXXLTIGQYLXPSXXXXHXXVXXYXXPXXFXXXXXXAXXXXGFXXXXXXPLXRSSYXA

SEQ ID NO: 26861 - protein, 16 aa, Artificial sequence
  Variant (2)..(2): xaa in position 2 is any amino acid
  Variant (3)..(3): xaa in position 3 is Ser or Thr
  Variant (6)..(6): xaa in position 6 is Glu, Gln or Arg
  Variant (7)..(7): xaa in position 7 is Glu or Ser
  Variant (9)..(9): xaa in position 9 is any amino acid
  Variant (13)..(13): xaa in position 13 is Ile, Leu, Met or Val
  Variant (14)..(14): xaa in position 14 is any amino acid
LXXVCXXAXCPNXXEC

SEQ ID NO: 26862 - protein, 17 aa, Artificial sequence
  Variant (3)..(3): xaa in position 3 is Phe, Ile, Met or Val
  Variant (4)..(4): xaa in position 4 is Leu or Met
  Variant (5)..(5): xaa in position 5 is Ile, Leu or Val
  Variant (6)..(6): xaa in position 6 is any amino acid
  Variant (8)..(9): xaa in position 8 to 9 is any amino acid
  Variant (13)..(13): xaa in position 13 is any amino acid
  Variant (15)..(15): xaa in position 15 is any amino acid
ATXXXXGXXCTRXCXFC

SEQ ID NO: 26863 - protein, 32 aa, Artificial sequence
  Variant (2)..(2): xaa in position 2 is Ala, Gly or Pro
  Variant (3)..(5): xaa in position 3 to 5 is any amino acid
  Variant (6)..(6): xaa in position 6 is Ala, Gly, Ser or Thr
  Variant (7)..(7): xaa in position 7 is any amino acid
  Variant (8)..(8): xaa in position 8 is Ala, Asn, Ser, Thr or Val
  Variant (9)..(13): xaa in position 9 to 13 is any amino acid
  Variant (14)..(14): xaa in position 14 is Ile, Leu or Val
  Variant (15)..(15): xaa in position 15 is any amino acid
  Variant (16)..(16): xaa in position 16 is His or Tyr
  Variant (17)..(17): xaa in position 17 is any amino acid
  Variant (18)..(18): xaa in position 18 is Thr or Val
  Variant (19)..(19): xaa in position 19 is Ile, Leu, Met or Val
  Variant (21)..(21): xaa in position 21 is any amino acid
  Variant (22)..(22): xaa in position 22 is Pro or Val
  Variant (23)..(23): xaa in position 23 is Ala, Cys, Asp, Asn, Ser, Thr or Val
  Variant (28)..(28): xaa in position 28 is any amino acid
  Variant (30)..(30): xaa in position 30 is any amino acid
EXXXXXXXXXXXXXXXXXXTXXXRDDLXDXGA

SEQ ID NO: 26864 - protein, 39 aa, Artificial sequence
  Variant (2)..(2): xaa in position 2 is Ser or Thr
  Variant (3)..(3): xaa in position 3 is Gly, Asn or Ser
  Variant (4)..(4): xaa in position 4 is Ile, Leu or Met
  Variant (5)..(5): xaa in position 5 is Ile or Met
  Variant (6)..(6): xaa in position 6 is Ile, Leu, Met or Val
  Variant (8)..(8): xaa in position 8 is any amino acid
  Variant (11)..(12): xaa in position 11 to 12 is any amino acid
  Variant (13)..(13): xaa in position 13 is any or no amino acid
  Variant (15)..(20): xaa in position 15 to 20 is any amino acid
  Variant (21)..(21): xaa in position 21 is any or no amino acid
  Variant (23)..(30): xaa in position 23 to 30 is any amino acid
  Variant (31)..(31): xaa in position 31 is Ile, Leu, Met or Val
  Variant (32)..(32): xaa in position 32 is Ala or Thr
  Variant (33)..(33): xaa in position 33 is Phe, Ile, Leu or Val
  Variant (34)..(34): xaa in position 34 is Gly or Thr
  Variant (37)..(37): xaa in position 37 is Ile, Leu or Met
  Variant (38)..(38): xaa in position 38 is any amino acid
KXXXXXGXGEXXXEXXXXXXXDXXXXXXXXXXXXQYXXP

SEQ ID NO: 26865 - DNA, 1053 bp, Escherichia coli
  CDS (1)..(1053)
atgaattatcagaacgacgatttacgcatcaaagaaatcaaagagttacttcctcctgtcgcattgctggaaaaattccccgctactgaaaatgccgcgaatacggttgcccatgcccgaaaagcgatccataagatcctgaaaggtaatgatgatcgcctgttggtggtgattggcccgtgctcaattcatgatcctgtcgcggctaaagagtatgccactcgcttgctggcgctgcgtgaagagctgaaagatgagctggaaatcgtaatgcgcgtctattttgaaaagccgcgtactacggtgggctggaaagggctgattaacgatccgcatatggataacagcttccagatcaacgacggtctgcgtatagcccgtaaattgctgcttgatattaacgacagcggtctgccagcggcgggtgaattcctcgatatgatcactcctcagtatctcgctgacctgatgagctggggcgcaattggtgcacgtaccacggaatcgcaggtgcaccgcgaactggcgtctggtctttcttgtccggtaggttttaaaaatggcacagacggtacgattaaagtggctatcgatgccattaatgccgccggtgcgccgcactgcttcctgtccgtaactaaatgggggcattcggcgattgtgaataccagcggtaacggcgattgccatatcattctgcgcggcggtaaagagcctaactacagcgcgaagcacgttgctgaagtgaaagaagggctgaacaaagcaggtctgccagctcaggtgatgatcgatttcagccatgctaattcgtccaaacaattcaaaaagcagatggatgtttgtgctgacgtttgccagcagattgccggtggcgaaaaggccattatcggtgtgatggtggaaagtcatctggtggaaggcaatcagagcctggagagcggggagccgctggcctatggtaagagcatcaccgatgcctgcattggctgggaagataccgatgctctgttacgtcaactggcgaacgcagtgaaagcgcgtcgcgggtaa

SEQ ID NO: 26866 - protein, 350 aa, Escherichia coli; identical to SEQ ID NO: 1580

SEQ ID NO: 26867 - DNA, 1092 bp, Mesorhizobium loti MAFF303099
  CDS (1)..(1092): transl_table=11
gtgttgaccaccacagacgacctccgggtcaaggaaatccgagaactgagcacgccggaccaggtgatgcgggaaatcccgcgcacgctgacggcgacgcgcaccgtgagcgcctcacgcaatgcgatccacgctattctgaacggcaccgacgaccggctgcttgtcgtcgtcggtccctgttcgatccacgatccggtcgcggccgttgactatgccagccgtctggcggcgctgcgcgagaccctgtccgaccggcttgagatcgtgatgcgggtgtatttcgagaagccgcgcaccacggtcggctggaagggcctgatcaacgatcccgaccttgacggcagcttcaacatcgacaaggggctcaggatggcacgcaacgtgctttccgccgtcaacaatctcggcctgccggcggccaccgaattcctcgacatgaccacgccgcaatacattgccgacctcgtcgcctggggtgccatcggcgcgcgcaccaccgaaagccaaatccaccgtgagctggcctcgggcctgtcctgcccggtcggtttcaagaacggcaccgacggcaatctcaggatcgccggcgaggcggtgaaatcggccgcccagccgcatcatttcatggcggtgaccaagggcggacgcagcggcatcgccaccaccaccggcaatgaggactgccatgtcatcctgcgcggcggcgttcagcccaactacgacgcggcgagcgtcgaggcggcctcggtcgaactcgcccgcatcggtgtcgcgccgcggctgatgatcgatgtcagccacgccaactccgccaagaagcctgagaaccagccgaaggtggcggccgatgtggccggccaggtggcggcgggcgacgagcgcatcatcggcctgatgatcgagagcaatctcgtcgccggccggcaggacgtggtgcccggcaagccgctcgtctatggccagagcatcaccgatggctgcatcgactgggcgaccaccgagaccgtgctgcatggccttgccggtgccgtcgagtggcgccggtcggcacgccgcgccatgctggaaagccggcagggtgctgcctga

SEQ ID NO: 26868 - protein, 363 aa, Mesorhizobium loti MAFF303099; identical to SEQ ID NO: 1540

SEQ ID NO: 26869 - DNA, 1074 bp, Vibrio cholerae O1 biovar eltor str. N16961; identical to SEQ ID NO: 1343
  CDS (1)..(1074): transl_table=11

SEQ ID NO: 26870 - protein, 357 aa, Vibrio cholerae O1 biovar eltor str. N16961; identical to SEQ ID NO: 1344

SEQ ID NO: 26871 - DNA, 1188 bp, Vibrio cholerae O1 biovar eltor str. N16961
  CDS (1)..(1188): transl_table=11
ttggtcaaatgctcggtttttacttcaatttacacccctttccgcagctgttttcggcgtaatggtttattctcgttgacaaattcgttatctttagcgcttcgcaataaaaggacaggcgctcctatgccactgaaaaccgatgaattaagaacccaagcattgggacctatgcctactccggcagaattaagtcacgcacatcctatcactgatgaagttgcgctacggatcgcgcagtctcgtcgccaaattgaaagcattcttaccggtgaagatgatcgcctattagtgatagtggggccttgttcggtgcatgataccgatgccgcactcgactacgctcgccgccttgctgcgctacaagaaaactatactgatgagctttttgtggtgatgcggacctatttcgaaaaaccacgtactgtggtgggttggaaaggactgatcaccgatccaaacttagatggctcttacgctttagaaaccggtctcaataaagcgcgaaagttgctgcttgatgtaaacaagctcggattggctaccgcgaccgagtttcttgatatgatcacaggccaatacatcgcggaccttatcacgtggggcgcaattggtgcgcgtaccactgagtcgcaaattcaccgtgagatggcctctgcgctctcctgccctgtgggttttaaaaatggcactaacggtaatgtgaaaatcgcgattgatgcgatccgcgcggccaaagcgtcacattacttctattcaccagataagaatggtcgtatgacggtttaccgtaccagtggtaacccatttggtcatattattctgcgtggtggtgatagcggaccaaactttgatgcggcttcgattaatgaagcttgccagcagttggcgcaattcaacttaccagagcgtttagtggtggatttcagccacgcgaactgtcaaaaacaacaccgtaaacaagtggatgtcgcgcgcgatatttgccagcaaattgaagctggcagccacaaaattgcgggcatcatggcggaaagcttccttgtggaaggcaatcagccaatgcacgatctcaataatctgacttatggtctgtcgatcaccgatccttgtttaggatggaaagataccgccaccatgcttgatatgctggctcaatcgatcaaagtccgtcgttctcgtcattaa

SEQ ID NO: 26872 - protein, 395 aa, Vibrio cholerae O1 biovar eltor str. N16961
MVKCSVFTSIYTPFRSCFRRNGLFSLTNSLSLALRNKRTGAPMPLKTDELRTQALGPMPTPAELSHAHPITDEVALRIAQSRRQIESILTGEDDRLLVIVGPCSVHDTDAALDYARRLAALQENYTDELFVVMRTYFEKPRTVVGWKGLITDPNLDGSYALETGLNKARKLLLDVNKLGLATATEFLDMITGQYIADLITWGAIGARTTESQIHREMASALSCPVGFKNGTNGNVKIAIDAIRAAKASHYFYSPDKNGRMTVYRTSGNPFGHIILRGGDSGPNFDAASINEACQQLAQFNLPERLVVDFSHANCQKQHRKQVDVARDICQQIEAGSHKIAGIMAESFLVEGNQPMHDLNNLTYGLSITDPCLGWKDTATMLDMLAQSIKVRRSRH

SEQ ID NO: 26873 - DNA, 1086 bp, Pasteurella multocida subsp. multocida str. Pm70; identical to SEQ ID NO: 1545
  CDS (1)..(1086): transl_table=11

SEQ ID NO: 26874 - protein, 361 aa, Pasteurella multocida subsp. multocida str. Pm70; identical to SEQ ID NO: 1546

SEQ ID NO: 26875 - DNA, 1053 bp, Pasteurella multocida subsp. multocida str. Pm70
  CDS (1)..(1053): transl_table=11
gtgaataaagataacatacataatgtcaatattgttggtgaaaaggtactgattaccccaaaagaattgaaggaaaaactccctctatcccttcctcttcgtagccaaatagcgcaatcacgccgtgatattgcgaatatcatccataaaaaagatcagcgtttattggttgtgattggaccatgttctattcatgatccgatcgcggctttagaatacgcttcacgtttaaaacacttagcagaagaattacaagatcaattgtatattgtgatgcgagtgtattttgaaaaaccaagaacaactgttggctggaaaggattgattaatgatccgaaattggatggttcatttgatgtggaacatggcttacatattgcacgagcattactgctagagctggctgaaatgggactccctttggcaaccgaagcacttgatcccattatgccgcaatatattgctgatctatttagttggtctgcgattggtgcgagaacgacagaatcacaaacgcacagagaaatgtcatcaggtttatccatggcagtgggatttaaaaatggtacggatggcagtttagccaccgcaattaatgcaatgaaagcagcgtcagttggacacagttttattgggattaatcaacaaggtcaagtcaatctattacatacagcgggcaaccctaatgggcatgtgattttgcgtggcggaaaatcaccaaattatgaagctgaacatatcgcactttgtgaacaagaattgcaaaaagcaggtttgacgcaagcaattatgatcgattgtagccatggtaactcgaataaagattaccgtttgcagccgaaagtggcaaaaaatgccgtacagcaaattgtgaagggaaatcgctctattatcgggttgatgttagaaagtcatttatacgcaggtaatcaaagtgctgatcagccattgagtgaaatgcaatatggggtttcgattacggatgcctgtattgattggcagacgacagaacaattattacgtgaaatgacgagcgcattgcgccaaaaataa

SEQ ID NO: 26876 - protein, 350 aa, Pasteurella multocida subsp. multocida str. Pm70; identical to SEQ ID NO: 1544

SEQ ID NO: 26877 - DNA, 1077 bp, Pseudomonas aeruginosa PAO1; identical to SEQ ID NO: 1339
  CDS (1)..(1077): transl_table=11

SEQ ID NO: 26878 - protein, 358 aa, Pseudomonas aeruginosa PAO1; identical to SEQ ID NO: 1340

SEQ ID NO: 26879 - DNA, 1095 bp, Pseudomonas aeruginosa PAO1; identical to SEQ ID NO: 1351
  CDS (1)..(1095): transl_table=11

SEQ ID NO: 26880 - protein, 364 aa, Pseudomonas aeruginosa PAO1; identical to SEQ ID NO: 1352

SEQ ID NO: 26881 - DNA, 1038 bp, Lactococcus lactis subsp. lactis Il1403; identical to SEQ ID NO: 1345
  CDS (1)..(1038): transl_table=11

SEQ ID NO: 26882 - protein, 345 aa, Lactococcus lactis subsp. lactis Il1403; identical to SEQ ID NO: 1346

SEQ ID NO: 26883 - DNA, 1023 bp, Lactococcus lactis subsp. lactis Il1403; identical to SEQ ID NO: 1347
  CDS (1)..(1023): transl_table=11

SEQ ID NO: 26884 - protein, 340 aa, Lactococcus lactis subsp. lactis Il1403; identical to SEQ ID NO: 1348

SEQ ID NO: 26885 - DNA, 1056 bp, Neisseria meningitidis MC58; identical to SEQ ID NO: 2269
  CDS (1)..(1056): transl_table=11

SEQ ID NO: 26886 - protein, 351 aa, Neisseria meningitidis MC58; identical to SEQ ID NO: 2270

SEQ ID NO: 26887 - DNA, 1056 bp, Neisseria meningitidis Z2491; identical to SEQ ID NO: 1329
  CDS (1)..(1056): transl_table=11

SEQ ID NO: 26888 - protein, 351 aa, Neisseria meningitidis Z2491; identical to SEQ ID NO: 1330

SEQ ID NO: 26889 - DNA, 1086 bp, Deinococcus radiodurans R1; identical to SEQ ID NO: 1327
  CDS (1)..(1086): transl_table=11

SEQ ID NO: 26890 - protein, 361 aa, Deinococcus radiodurans R1; identical to SEQ ID NO: 1328

SEQ ID NO: 26891 - DNA, 1143 bp, Xylella fastidiosa 9a5c
  CDS (1)..(1143): transl_table=11
ttgtctcctccgcttggtctatgtctaaatgttctgagattacatcccatgccaccatttaccgacgacctccgtatccgcaaaattgaaccactgacacctcctaaccagctcctattgcaactaccatgcgatgagcaggcatcgctgactgttgcgacctcacgcaacgcactgcacgatatcctgcacggccacaacgaccgtttagccgtcgtgataggcccatgctcaatccatgatccaattgcagccattgattacgcgcaacgtctacacccattgcgtgagatgtacaaggatgcactagagatcgtgatgcgggtttactttcagaaaccgcgcaccaccattggttggaaaggattggtcaacgatccggatcttgatggcagcttccaaatcaataagggcctgcatatcgcgcgcaacctgctacgcgatatcaatcatctcggcttacccgctggtgtggaatttctagacacgatttcgccgcaatatctggctgacttagtcgcctggggtgccattggtgcacgcaccactgagagccaaatacaccgtgaaatggcttcaggtttatcgtgcccgattggctttaaaaacagtaccagtggtgatgtgaaaattgctgctgacgcgattaaagcagcttcgcatccgcaccatttcctttcagtgacaaagacaggtgttgccgcagtcgtcgccacccagggtaaccccgattgtcacgtgattctacgtggaggcagggtcccgaattacgacgcaatcaatgtcgaagctgccagccaaacattgcttaaatccaagctaccggtgcgactgatgattgatgcgagccatgccaatagcggcaaaaacccaaacaatcaacccaaggtgatcgagaacatcgtagaacagcttgaagccggtgaacgccgcatcgtcggtgtcatgattgaaagccacattgttggtggtcggcaagaattagtccttggaaacacacttacctatggacagagcattaccgatgcttgcatcgactgggatacctcggtcgcaatgttagagcagctcgctcaggccgtacgcgtcagacagactctaccaacgaccgctacaactaacaaaacatcaaaaacccaataa

SEQ ID NO: 26892 - protein, 380 aa, Xylella fastidiosa 9a5c; identical to SEQ ID NO: 1604

SEQ ID NO: 26893 - DNA, 1071 bp, Escherichia coli O157:H7
  CDS (1)..(1071): transl_table=11
atgcaaaaagacgcgctgaataacgtacatattaccgacgaacaggttttaatgactccggcacaactgaaggccgcttttccattaagcctgcaacaagaagcccagattgctgactcgcgtaaaaccatttcagatattatcgccgggcgcgatcctcgtctgctggtagtatgtggcccttgttccattcatgatccggaaactgctctggaatatgctcgtcgatttaaagcccttgccgcagaggtcagcgatagcctctatctggtaatgcgcgtctattttgaaaaaccccgtaccactgtcggctggaaagggttaattaacgatccccatatggatggctcttttgatgtagaagccgggctgcagatcgcgcgtaaattgctgcttgagctggtgaatatgggactgccactggcgacggaagcgttagatccgaatagcccgcaatacctgggcgatctgtttagctggtcagcaattggtgctcgtacaacggaatcgcaaactcaccgtgaaatggcctccgggctttccatgccggttggctttaaaaacggcaccgacggcagtctggcaacagcaattaacgctatgcgcgccgccgcccagccgcaccgttttgttggcattaaccaggcagggcaggttgcgttgctacaaactcaggggaatccggacgggcatgtcatcctgcgcggtggtaaagcgccgaactatagccctgcggatgttgcgcaatgtgaaaaagagatggaacaggcgggactgcgcccgtctctgatggtagattgcagccacggtaattccaataaagattatcgccgtcagcctgcggtggcagaatccgtggttgctcaaatcaaagatggcaatcgctcaattattggtctgatgatcgaaagtaatatccacgagggcaatcagtcttccgagcaaccgcgcagtgaaatgaaatacggtgtatccgtaaccgatgcctgcattagctgggaaatgaccgatgccttgctgcgtgaaattcatcaggatctgaacgggcagctgacggctcgcgtggcttaa

SEQ ID NO: 26894 - protein, 356 aa, Escherichia coli O157:H7
MQKDALNNVHITDEQVLMTPAQLKAAFPLSLQQEAQIADSRKTISDIIAGRDPRLLVVCGPCSIHDPETALEYARRFKALAAEVSDSLYLVMRVYFEKPRTTVGWKGLINDPHMDGSFDVEAGLQIARKLLLELVNMGLPLATEALDPNSPQYLGDLFSWSAIGARTTESQTHREMASGLSMPVGFKNGTDGSLATAINAMRAAAQPHRFVGINQAGQVALLQTQGNPDGHVILRGGKAPNYSPADVAQCEKEMEQAGLRPSLMVDCSHGNSNKDYRRQPAVAESVVAQIKDGNRSIIGLMIESNIHEGNQSSEQPRSEMKYGVSVTDACISWEMTDALLREIHQDLNGQLTARVA

SEQ ID NO: 26895 - DNA, 1032 bp, Streptococcus pneumoniae TIGR4; identical to SEQ ID NO: 1349
  CDS (1)..(1032): transl_table=11

SEQ ID NO: 26896 - protein, 343 aa, Streptococcus pneumoniae TIGR4; identical to SEQ ID NO: 1350

SEQ ID NO: 26897 - DNA, 1032 bp, Streptococcus pneumoniae TIGR4
  CDS (1)..(1032): transl_table=11
atggtatttacagcaaaaagctctaaaataaatatagaagaagttcgtgccttgtcaaaattagaaggtcaggctttggagaggaaatcacagcgagatcaagagctagaagccattatacgtggagaagaccagcgaattctcttggtaatcgggccatgctcatctgacaacgaagaagctgtccttgaatacgctaagcgtttggcagtcctacaagaagaagtggcagatcgtatctttatggttatgcgtgtttatactgccaaaccccgtaccaacggagatggctataagggcttgattcaccagcctaacgcgacagaagcgcctagtcttatcaatggaatcaaagccgttcgccatcttcactatcgtgtcatcacagaaacagggatgacaactgctgatgaaatgctttatcctgaaaaccttccgcttgtagatgatttgatttcttacatggcagttggtgcccgttcagttgaagaccagcaacaccgctttgtggcaagtggggcaggattttctactggttttaaaaatccaacctctggaaatctcaatgtcatgtttaatgggatttatgctgctcaaaacaaacaaagtttccttttcttaggaaaagaagtagaaacaactgggaacccgctttcacacgctattcttcgtggtgctcttaatgagtatggaaaaaatattcccaactactattatgacaatttaattgataccattgcccagtatgagaaaatgggcttggaaaatccttttatcatcattgataccaatcatgacaattctggtaagcagtatattgaacagatccgaattgtccgccagaccttgattaaccgtgcttggaatgaaaaaattaagcagttcgttcgtggttttatgattgagtcttatctggaagatggtcgacaaaatgagccagaagtatttggtaagtctatcacagacccttgcctgggttgggataacacagaagctcttgtcagagaaatttacaaaacgttaggagaataa

SEQ ID NO: 26898 - protein, 343 aa, Streptococcus pneumoniae TIGR4; identical to SEQ ID NO: 1590

SEQ ID NO: 26899 - DNA, 1032 bp, Streptococcus pneumoniae R6; identical to SEQ ID NO: 1355
  CDS (1)..(1032): transl_table=11

SEQ ID NO: 26900 - protein, 343 aa, Streptococcus pneumoniae R6; identical to SEQ ID NO: 1356

SEQ ID NO: 26901 - DNA, 1071 bp, Yersinia pestis CO92; identical to SEQ ID NO: 2247
  CDS (1)..(1071): transl_table=11

SEQ ID NO: 26902 - protein, 356 aa, Yersinia pestis CO92; identical to SEQ ID NO: 2248

SEQ ID NO: 26903 - DNA, 1110 bp, Caulobacter crescentus CB15; identical to SEQ ID NO: 1353
  CDS (1)..(1110): transl_table=11

SEQ ID NO: 26904 - protein, 369 aa, Caulobacter crescentus CB15; identical to SEQ ID NO: 1354

SEQ ID NO: 26905 - DNA, 1053 bp, Salmonella typhimurium LT2
  CDS (1)..(1053): transl_table=11
atgaattatcagaacgacgatttacgcattaaagaaatcaacgagttattacctccggtcgcgctgctggaaaagtttcccgccacggaaaatgcagcaaataccgttgctcacgcgcgcaaagccatccataaaattctcaaaggcaatgacgatcgtctgctggtggtgatcggtccttgttcaattcatgatccggcagcggcgaaagagtatgccgcccgtttgctggcgctacgcgatgagcttcaaggcgagcttgaaattgtcatgcgcgtctattttgagaaaccgcgtaccaccgtcggctggaaagggctgattaacgatccgcacatggataacagcttccagattaacgacggtctgcgtattgcgcgcaaactgctgctggatattaacgacagcggcctgcctgccgccggcgaattcctcgatatgatcacgccgcaatatctggccgatctgatgagctggggcgccattggcgcgcggactactgaatcccaggttcatcgcgaattggcgtctggcctctcttgtccggtcggttttaaaaatggtactgatggcacgattaaagtcgccattgacgccatcaacgccgccggcgcgccgcattgcttcctctccgtcactaaatggggtcattcggcgattgtgaataccagcggcaacggcgactgccatatcattctgcgcggcggtaaagcgccaaactatagcgcgcagcatgttgctgaggtgaaagaaggcctcaccaaagcgggactgacgccgcaggtcatgatcgatttcagccatgccaactcctgtaagcaatttcaaaagcagatggaggtttgcgccgatgtctgccagcagatagcgggcggtgaaaaagcgattattggcgtgatggtagagagtcatctggtagaaggaaaccagagtctggaaagcggtcagccgctgacctacggtaaaagcattactgacgcctgtattggctgggaagataccgatgcgctgcttcgtcagttgtcggcagcggtaaaagcccgtcgcggctaa

SEQ ID NO: 26906 - protein, 350 aa, Salmonella typhimurium LT2
MNYQNDDLRIKEINELLPPVALLEKFPATENAANTVAHARKAIHKILKGNDDRLLVVIGPCSIHDPAAAKEYAARLLALRDELQGELEIVMRVYFEKPRTTVGWKGLINDPHMDNSFQINDGLRIARKLLLDINDSGLPAAGEFLDMITPQYLADLMSWGAIGARTTESQVHRELASGLSCPVGFKNGTDGTIKVAIDAINAAGAPHCFLSVTKWGHSAIVNTSGNGDCHIILRGGKAPNYSAQHVAEVKEGLTKAGLTPQVMIDFSHANSCKQFQKQMEVCADVCQQIAGGEKAIIGVMVESHLVEGNQSLESGQPLTYGKSITDACIGWEDTDALLRQLSAAVKARRG

SEQ ID NO: 26907 - DNA, 1131 bp, Nostoc sp. PCC 7120; identical to SEQ ID NO: 1335
  CDS (1)..(1131): transl_table=11

SEQ ID NO: 26908 - protein, 376 aa, Nostoc sp. PCC 7120; identical to SEQ ID NO: 1336

SEQ ID NO: 26909 - DNA, 1179 bp, Ralstonia solanacearum GMI1000; identical to SEQ ID NO: 1531
  CDS (1)..(1179): transl_table=11

SEQ ID NO: 26910 - protein, 392 aa, Ralstonia solanacearum GMI1000; identical to SEQ ID NO: 1532

SEQ ID NO: 26911 - DNA, 1080 bp, Ralstonia solanacearum GMI1000; identical to SEQ ID NO: 1529
  CDS (1)..(1080): transl_table=11

SEQ ID NO: 26912 - protein, 359 aa, Ralstonia solanacearum GMI1000; identical to SEQ ID NO: 1530

SEQ ID NO: 26913 - DNA, 1119 bp, Schizosaccharomyces pombe 972h-; identical to SEQ ID NO: 1371
  CDS (1)..(1119)

SEQ ID NO: 26914 - protein, 372 aa, Schizosaccharomyces pombe 972h-; identical to SEQ ID NO: 1372

SEQ ID NO: 26915 - DNA, 1074 bp, Xanthomonas campestris pv. campestris str. ATCC 33913; identical to SEQ ID NO: 1525
  CDS (1)..(1074): transl_table=11

SEQ ID NO: 26916 - protein, 357 aa, Xanthomonas campestris pv. campestris str. ATCC 33913; identical to SEQ ID NO: 1526

SEQ ID NO: 26917 - DNA, 1074 bp, Xanthomonas axonopodis pv. citri str. 306; identical to SEQ ID NO: 1527
  CDS (1)..(1074): transl_table=11

SEQ ID NO: 26918 - protein, 357 aa, Xanthomonas axonopodis pv. citri str. 306; identical to SEQ ID NO: 1528

SEQ ID NO: 26919 - DNA, 1062 bp, Chlorobium tepidum TLS; identical to SEQ ID NO: 1523
  CDS (1)..(1062): transl_table=11

SEQ ID NO: 26920 - protein, 353 aa, Chlorobium tepidum TLS; identical to SEQ ID NO: 1524

SEQ ID NO: 26921 - DNA, 1077 bp, Yersinia pestis KIM; identical to SEQ ID NO: 1489
  CDS (1)..(1077): transl_table=11

SEQ ID NO: 26922 - protein, 358 aa, Yersinia pestis KIM; identical to SEQ ID NO: 1490

SEQ ID NO: 26923 - DNA, 1047 bp, Yersinia pestis KIM; identical to SEQ ID NO: 1331
  CDS (1)..(1047): transl_table=11

SEQ ID NO: 26924 - protein, 348 aa, Yersinia pestis KIM; identical to SEQ ID NO: 1332

SEQ ID NO: 26925 - DNA, 1053 bp, Yersinia pestis KIM; identical to SEQ ID NO: 1487
  CDS (1)..(1053): transl_table=11

SEQ ID NO: 26926 - protein, 350 aa, Yersinia pestis KIM; identical to SEQ ID NO: 1488

SEQ ID NO: 26927 - DNA, 1062 bp, Thermosynechococcus elongatus BP-1; identical to SEQ ID NO: 1499
  CDS (1)..(1062): transl_table=11

SEQ ID NO: 26928 - protein, 353 aa, Thermosynechococcus elongatus BP-1; identical to SEQ ID NO: 1500

SEQ ID NO: 26929 - DNA, 1008 bp, Streptococcus agalactiae 2603V/R
  CDS (1)..(1008): transl_table=11
atgggatttcatcagttaagtgataaaattaatattgaaatattgaagcagaaaactagcttagatctagaagttagccaaaaaaaattagccaaagaagaagagttaaaaaatatcataaaaggtgaggatcagcggtttctagtaatagtaggtccttgttctgcggataatccaaaggcggtgctaacttatgcaaagcgtttagctaaattggaagctgcctttaaagataaaatgtttttggttatgagagtttataccgctaagccaagaacgaatggtgatggttataaaggcttagttcaccattctgacaaactaggagttttttttcaagcacgtaagatgcactatgacatcattcgagagactggactcctgacagctgatgaattactttatccagagatgttatcagtgatggatgatttagtttcttactatgctattggtgcgcgttcagtggaagatcagggacaccgttttatatcttcaggtatagatgcaccagtaggtatgaaaaatccaacgtctggtaatttaagagtcatgtttaatgcggtctatgcagcacaaaatcaacaggaattattctatcaaaataagcaagttagaacagatggtaatttgctgtcacatgttattttgagaggatatcataatgccgactatcgaagtatccctaattatcattatgaaaaccttttagaaactattactcattatgaagagactgatttgcaaaatccctttattgttgttgatacaaatcatgacaattcaggtaagcaatttttagaacaaattcgcattgtgaaatcagtacttgcagaccgacagtggcatactaaaattagaaactatgttcgtggttttttgatagaatcttatttagaagatggaagacaagataaaccagatgtttttggtaagtctatcacagatccatgtctaggttgggataaaacagaaatgctaattagggatatttacaatagtttgtaa

SEQ ID NO: 26930 - protein, 335 aa, Streptococcus agalactiae 2603V/R
MGFHQLSDKINIEILKQKTSLDLEVSQKKLAKEEELKNIIKGEDQRFLVIVGPCSADNPKAVLTYAKRLAKLEAAFKDKMFLVMRVYTAKPRTNGDGYKGLVHHSDKLGVFFQARKMHYDIIRETGLLTADELLYPEMLSVMDDLVSYYAIGARSVEDQGHRFISSGIDAPVGMKNPTSGNLRVMFNAVYAAQNQQELFYQNKQVRTDGNLLSHVILRGYHNADYRSIPNYHYENLLETITHYEETDLQNPFIVVDTNHDNSGKQFLEQIRIVKSVLADRQWHTKIRNYVRGFLIESYLEDGRQDKPDVFGKSITDPCLGWDKTEMLIRDIYNSL

SEQ ID NO: 26931 - DNA, 1233 bp, Bifidobacterium longum NCC2705; identical to SEQ ID NO: 1519
  CDS (1)..(1233): transl_table=11

SEQ ID NO: 26932 - protein, 410 aa, Bifidobacterium longum NCC2705; identical to SEQ ID NO: 1520

SEQ ID NO: 26933 - DNA, 1134 bp, Bifidobacterium longum NCC2705; identical to SEQ ID NO: 1517
  CDS (1)..(1134): transl_table=11

SEQ ID NO: 26934 - protein, 377 aa, Bifidobacterium longum NCC2705; identical to SEQ ID NO: 1518

SEQ ID NO: 26935 - DNA, 1071 bp, Shigella flexneri 2a str. 301
  CDS (1)..(1071): transl_table=11
atgcataaagacgcgctgaataacgtacatattaccgacgaacaggttttaatgactccggaacaactgaaggccgcttttccattgagcctgcaacaagaagcccagattgctgactcgcgtaaaaccatttcagatattatcgccgggcgcgatcctcgtctgctggtagtatgtggtccttgttccattcatgatccggaaactgctctggaatatgctcgtcgatttaaagctcttgccgcagaggtcagcgatagcctctatctggtaatgcgcgtctattttgaaaaaccccgtaccactgtcggctggaaagggttaattaacgatccccatatggatggctcttttgatgtagaagccgggctgcaaatcgcgcgtaaattgttgcttgagctggtgaatatgggactgccactggcgacggaagcgttagatccgaatagcccgcaatacctgggcgatctgtttagctggtcagcaattggtgctcgtacaacggaatcgcaaactcaccgtgaaatggcctccgggctttccatgccggttggttttaaaaacggcaccgacggcagtctggcaacagcaattaacgctatgcgcgccgccgcccagccgcactgttttgttggcattaaccaggcagggcaggttgcgttgctacaaactcaggggaatccggacgggcatgtgatcctgcgcggtggtaaagcgccgaactatagccctgcggatgttgcgcaatgtgaaaaagagatggaacaggcgggactgcgcccgtctctgatggtagattgcagccacggtaattccaataaagattatcgccgtcagcctgcggtggcagaatccgtggttgctcaaatcaaagatggtaatcgctcaattattggtctgatgatcgaaagtaatatccacgagggcaatcagtcttctgagcaaccgcgcagtgaaatgaaatacggtgtatccgtaaccgatgcctgcattagctgggaaatgactgatgccttgctgcgtgaaattcatcaggatctgaacgggcagctgacggctcgcgtggcttaa

SEQ ID NO: 26936 - protein, 356 aa, Shigella flexneri 2a str. 301
MHKDALNNVHITDEQVLMTPEQLKAAFPLSLQQEAQIADSRKTISDIIAGRDPRLLVVCGPCSIHDPETALEYARRFKALAAEVSDSLYLVMRVYFEKPRTTVGWKGLINDPHMDGSFDVEAGLQIARKLLLELVNMGLPLATEALDPNSPQYLGDLFSWSAIGARTTESQTHREMASGLSMPVGFKNGTDGSLATAINAMRAAAQPHCFVGINQAGQVALLQTQGNPDGHVILRGGKAPNYSPADVAQCEKEMEQAGLRPSLMVDCSHGNSNKDYRRQPAVAESVVAQIKDGNRSIIGLMIESNIHEGNQSSEQPRSEMKYGVSVTDACISWEMTDALLREIHQDLNGQLTARVA

SEQ ID NO: 26937 - DNA, 1059 bp, Shewanella oneidensis MR-1; identical to SEQ ID NO: 1511
  CDS (1)..(1059): transl_table=11

SEQ ID NO: 26938 - protein, 352 aa, Shewanella oneidensis MR-1; identical to SEQ ID NO: 1512

SEQ ID NO: 26939 - DNA, 1092 bp, Shewanella oneidensis MR-1; identical to SEQ ID NO: 1509
  CDS (1)..(1092): transl_table=11

SEQ ID NO: 26940 - protein, 363 aa, Shewanella oneidensis MR-1; identical to SEQ ID NO: 1510

SEQ ID NO: 26941 - DNA, 1065 bp, Shewanella oneidensis MR-1; identical to SEQ ID NO: 1507
  CDS (1)..(1065): transl_table=11

SEQ ID NO: 26942 - protein, 354 aa, Shewanella oneidensis MR-1; identical to SEQ ID NO: 1508

SEQ ID NO: 26943 - DNA, 1035 bp, Streptococcus mutans UA159; identical to SEQ ID NO: 1503
  CDS (1)..(1035): transl_table=11

SEQ ID NO: 26944 - protein, 344 aa, Streptococcus mutans UA159; identical to SEQ ID NO: 1504

SEQ ID NO: 26945 - DNA, 1032 bp, Streptococcus mutans UA159; identical to SEQ ID NO: 1501
  CDS (1)..(1032): transl_table=11

SEQ ID NO: 26946 - protein, 343 aa, Streptococcus mutans UA159; identical to SEQ ID NO: 1502

SEQ ID NO: 26947 - DNA, 1008 bp, Streptococcus agalactiae NEM316; identical to SEQ ID NO: 1505
  CDS (1)..(1008): transl_table=11

SEQ ID NO: 26948 - protein, 335 aa, Streptococcus agalactiae NEM316; identical to SEQ ID NO: 1506

SEQ ID NO: 26949 - DNA, 1170 bp, Corynebacterium efficiens YS-314
  CDS (1)..(1170): transl_table=11
ttgtttccccatatgatttcccccataaacggtttccacaccaccatcaccgcccgaaaggcagaccccagcaccatgagcgccccagtgtccctccccaacccggcatccaccagcaacaaacgggtggttgccttccatgagctgcccagcccggccgaactcaccgccgacaaccccctgagtccacgtcaggcggagaaggttgagcgcgaccgccaggagatcgccgatatcttcgccggcgatgatgaccgcctcgtggttgtggtcggcccgtgttcggtccatgacccggaggctgcgatcgactacgccaaccgcctggcgcccctggccaagcggctggaccaggacctgaagatcgtcatgcgtgtctacttcgagaagccacgcaccaccgtcgggtggaaggggctgatcaatgatccgcacctcaacgagacctacgacatcgccgagggactgcgcctggcacgcaaggtgcttatcgacgttgtgaacctcgacctgcccgtcggttgtgaattcctcgaaccgaacagcccgcagtactacgccgatgccgtggcctggggtgccatcggtgcacgcaccaccgaatcccaggtccaccgccagctcgcctccgggatgtccatgcccatcggtttcaagaacggcaccgacggcaatgtccaggttgccatcgatgcggtggaatccgcccggagcccccacttcttctttggcacctccgaccacggtgcaccctcggtggtgcagaccgcgggtaactccaacagccatatcatcctccgtggtggcaccaccggacccaaccacgatgcggcatccgtggcgcaggccgtggagaagctgggggagggggcacgtctcatgatcgatgcctcccacgccaactcaggcaaggaccatatccgtcaggtcggtgtggtccgtgagatcgccgagcagatcgccgctggtgatgaggccatcgccggcatcatgatcgagtccttcctcgtcggtggcgcccagaacctggatcctgccaggctgaagatcaacggcggtgaggggctggtctacggccagtccgtcaccgacaagtgcatcgacatcgacaccaccgtcgatctgctcggtgagctcgccgcggcggtccgtacccgccggcaggcctga

SEQ ID NO: 26950 - protein, 389 aa, Corynebacterium efficiens YS-314; identical to SEQ ID NO: 1516

SEQ ID NO: 26951 - DNA, 1113 bp, Pseudomonas putida KT2440
  CDS (1)..(1113): transl_table=11
ttggcggccggcacccgtgacctgacgagtaacacgatggctgatttaccgatcgatgacttgaacgttgcctccaacgagaccctgatcacccctgatcagctcaagaaggaaatccccctcagcgccaaggccctgcagaccgtgactgccggccgtgaagtggtgcgcaatattctcgacggcaaggaccatcgcctgttcgtcgtggtcggcccttgctccatccacgacatcaaggcagcccacgaatacgccgagcgcctgaaagtgctggccgaagaagtgtccgatacgctgtacctggtcatgcgcgtgtacttcgaaaagccgcgcaccaccgtcggctggaaaggcctgatcaacgatccgtacctggatgactcgttcaagatccaggacggcctgcacatcggccgcaagttgctgctggacctggccgaaatgggcctgccgaccgccaccgaagcgctcgacccgatttcgccgcagtacctgcaagacctgatcagctggtcggccatcggtgcccgcaccaccgaatcgcaaacacaccgcgagatggcctcgggcctgtcctcggcggtgggtttcaagaacggtaccgatggcggcctgaccgttgccatcaatgccctgcagtcggtgtccaagccgcaccgcttcctgggcatcaaccaggaaggcggcgtgtcgatcgtcaccaccaagggcaacccatacggccacgtggtactgcgcggcggcaatggcaagccgaactacgactcggtcagcgtcgccctgtgcgaacaggacctggccaaggccaagatcaaggccaacatcatggtcgactgcagccatgccaactccaacaaggacccggccctgcaaccgctggtgatggagaacgtcgccaaccagattctcgaaggcaaccagtcgatcatcggcctgatggtcgaaagccacctgaactggggctgtcagtccattccgaaaaacctggacgatttgcagtatggcgtgtcgatcacggacgcctgcatcgactggtcggctaccgagaaaaccctgcgcagcatgcatgccaagctcaaggatgtgctgccgcagcgtaagcgcggctga

SEQ ID NO: 26952 - protein, 370 aa, Pseudomonas putida KT2440; identical to SEQ ID NO: 1484

SEQ ID NO: 26953 - DNA, 1062 bp, Pseudomonas putida KT2440; identical to SEQ ID NO: 1481
  CDS (1)..(1062): transl_table=11

SEQ ID NO: 26954 - protein, 353 aa, Pseudomonas putida KT2440; identical to SEQ ID NO: 1482

SEQ ID NO: 26955 - DNA, 1077 bp, Escherichia coli CFT073
  CDS (1)..(1077): transl_table=11
gtgtgcaatagatggttaagaatagaactttcaggagatacaatgcagtcagtcagtaaatcaatctaccgagggaagttgcttagcagtttacctgctgtgggcgagattcataaagaaatcgcagtatcagaagaaaccgtaacatggatctctctgcaacgagagattatagcgaatattttgctgggaaaagatcctcgcttgcttgtgattgttggtccatgctcaatccatgacgttcaggctgccgttgaatatgcgaaacgattgtccgtattacagaataagtacttatcgcaaatgtacattgtaatgcgcacttattttgagaaacctcgaactcgtaaaggctggaaaggaataatgcacgatcctgatctaaatggaagctataatgttgagaaagggatacgatatgctcgccagtgtttgtcctcaatcacaacaatgcgtgtcgcaaccgctacagaattcctcgatcctttccttactccctatattgctgatttaatatgttggggggctgttggtgccagaactactgaatcacaaacgcatcgtcaacttgcgtctggtttacattgtcctgttggatttaaaaacagcactgatggaaatattaacttagctattgatgctattcttgcagcccgtgaacaacatgttgtatatatgacatctttaacaaaatgtatatctaccctattaaccgatggcaatccacatggacatctcatattacgtggtggtagagagccgaactatggtttgtcggatataacgaaggcagtgaaattaatgcatgatgaaggtatcaatcatcgtctgataattgactgtagccatggtaatagtggtaaagtggctgaacggcaaatctctgttgctcgtgaagtcattgataatcggaaaaagatgccgggatatgtagctggaattatgctggaaagctttttacaaggtggaaaacaatcagacagccttccgcgagagtatggtcagtctgttactgatgagtgtctttcatggcaacagacagaacaattattatcaactctggcagcacaactttaa

SEQ ID NO: 26956 - protein, 358 aa, Escherichia coli CFT073
MCNRWLRIELSGDTMQSVSKSIYRGKLLSSLPAVGEIHKEIAVSEETVTWISLQREIIANILLGKDPRLLVIVGPCSIHDVQAAVEYAKRLSVLQNKYLSQMYIVMRTYFEKPRTRKGWKGIMHDPDLNGSYNVEKGIRYARQCLSSITTMRVATATEFLDPFLTPYIADLICWGAVGARTTESQTHRQLASGLHCPVGFKNSTDGNINLAIDAILAAREQHVVYMTSLTKCISTLLTDGNPHGHLILRGGREPNYGLSDITKAVKLMHDEGINHRLIIDCSHGNSGKVAERQISVAREVIDNRKKMPGYVAGIMLESFLQGGKQSDSLPREYGQSVTDECLSWQQTEQLLSTLAAQL

SEQ ID NO: 26957 - DNA, 1140 bp, Escherichia coli CFT073
  CDS (1)..(1140): transl_table=11
atgtgttatcgttacgtcatcctcgctgaggatcaactatcgcaaacgagcataaacaggatcgccatcatgcagaaagacgcgctgaataacgtacatattaccgacgaacaggttttaatgactccggaacaactgaaggccgcttttccattaagcctgcaacaagaagcccagattgctgactcgcgtaaaaccatttcagatattatcgccgggcgcgatcctcgtctgctggtagtatgtggtccttgttccattcatgatccggaaactgctctggaatatgctcgtcgatttaaagcccttgccgcagaggtcagcgatagcctctatctggtaatgcgcgtctattttgaaaaaccccgtaccactgtcggctggaaagggttaattaacgatccccatatggatggctcttttgatgtagaagccgggctgcagatcgcgcgtaaattgctgcttgagctggtgaatatgggactgccactggcgacggaagcgttagatccgaatagcccgcaatacctgggcgatctgtttagctggtcagcaattggtgctcgtacaacggaatcgcaaactcaccgtgaaatggcctccgggctttccatgccggttggttttaaaaacggcaccgatggcagtctggcaacggcaattaacgctatgcgtgccgccgcccagccgcaccgttttgttggcattaaccaggcagggcaggttgcgttgctacaaactcaggggaatccggacgggcatgtgatcctgcgcggtggtaaagcgccaaactatagccctgcggatgttgcgcaatgtgaaaaagagatggaacaggcgggactgcgcccgtctctgatggtagattgcagccacggtaattccaataaagattatcgccgtcagcctgcggtggcagaatccgtggttgctcaaatcaaagatggcaatcgctcaattattggtctgatgatcgaaagtaatatccacgagggcaatcagtcttccgagcaaccgcgcagtgaaatgaaatacggtgtatccgtaaccgatgcctgcattagctgggaaatgaccgatgccttgctgcgtgaaattcatcaggatctgaacgggcagctgacggctcgcgtggcttaa

SEQ ID NO: 26958 - protein, 379 aa, Escherichia coli CFT073
MCYRYVILAEDQLSQTSINRIAIMQKDALNNVHITDEQVLMTPEQLKAAFPLSLQQEAQIADSRKTISDIIAGRDPRLLVVCGPCSIHDPETALEYARRFKALAAEVSDSLYLVMRVYFEKPRTTVGWKGLINDPHMDGSFDVEAGLQIARKLLLELVNMGLPLATEALDPNSPQYLGDLFSWSAIGARTTESQTHREMASGLSMPVGFKNGTDGSLATAINAMRAAAQPHRFVGINQAGQVALLQTQGNPDGHVILRGGKAPNYSPADVAQCEKEMEQAGLRPSLMVDCSHGNSNKDYRRQPAVAESVVAQIKDGNRSIIGLMIESNIHEGNQSSEQPRSEMKYGVSVTDACISWEMTDALLREIHQDLNGQLTARVA

SEQ ID NO: 26959 - DNA, 1071 bp, Vibrio vulnificus CMCP6; identical to SEQ ID NO: 1497
  CDS (1)..(1071): transl_table=11

SEQ ID NO: 26960 - protein, 356 aa, Vibrio vulnificus CMCP6; identical to SEQ ID NO: 1498

SEQ ID NO: 26961 - DNA, 1053 bp, Vibrio vulnificus CMCP6; identical to SEQ ID NO: 1495
  CDS (1)..(1053): transl_table=11

SEQ ID NO: 26962 - protein, 350 aa, Vibrio vulnificus CMCP6; identical to SEQ ID NO: 1496

SEQ ID NO: 26963 - DNA, 1071 bp, Vibrio vulnificus CMCP6; identical to SEQ ID NO: 1739
  CDS (1)..(1071): transl_table=11

SEQ ID NO: 26964 - protein, 356 aa, Vibrio vulnificus CMCP6; identical to SEQ ID NO: 1740

SEQ ID NO: 26965 - DNA, 1086 bp, Bradyrhizobium japonicum USDA 110
  CDS (1)..(1086): transl_table=11
gtgctgagcacgactgacgatcttcgtatccgtgaactgaaagagctgagcacgccggatgaggtaatgcgggaggtcccgcgcacgctcaccgcaacgcgtgtggtgatggcggcgcgcaacgccatccatgccatcctcaccggccaggacgaccgcctgctggtggtggtcggcccgtgctcggtgcatgatccccgggccgcgctcgactacgctgagcgtctgacaaaactgcgcgaggacctcgccgaccagctcgagatcgtaatgcgggtctatttcgagaagccgcgcaccaccgtcggctggaagggcctgatcaacgaccccgatctcgacggcagcttcgacatcaacaagggcctgcggctggcgcgcaacgtgctgtcagcggtgaacaatctcggcctcccggccggcgccgaattcctggacatgacgacgccgcaatacatcgctgacctcgtgtcctgggccgcgatcggcgcgcgcacgaccgagagccagatccatcgcgagctggcctccgggctgtcctgcccggtcggcttcaagaacggcaccgatggcaatgtgcggatcgcggcggacgcagtgaagtcggcctcgcatccgcatcatttcatggcggtgaccaagctcggccgctcggcgatcgcctcgaccgcgggcaacgaggactgccacatcatcctgcgcggcggcagcacgccgaactacgatgcggcaagcgtcgcggcggcctgcaacgagctggcgaaatccggcgtcgcgccgctggtgatggtggatgcgagccacgccaattcgagcaagaagccggagaaccagccgctggtcatggccgacattgccggccagatttccggtggcgagagccgcatcatgggtgtgatgatcgagagcaatctcgtcgccggccgccaggacgtggttccgggcaagccgctcacctacggccagagcatcacggacggctgtatcgactgggcgaccacggcaactgtgctcgagcagctcgccgatgcggtcgaaatccggcgcaacgcccagcgcgcggggctgcacgagcgctcggcgtaa

SEQ ID NO: 26966 - protein, 361 aa, Bradyrhizobium japonicum USDA 110; identical to SEQ ID NO: 1486

SEQ ID NO: 26967 - DNA, 1143 bp, Xylella fastidiosa Temecula1
  CDS (1)..(1143): transl_table=11
ttgtctcctccgcttggtctatgtctaaatgttctgagattacatcccatgccaccatttaccgacgacctccgtatccgaaaaattgaaccactgacacctcctaacaagctcctcttacaactaccatgcgatgagcaggcatcgctgactgttgcgacctcacgcaacgcactgcacgatatcctgcacggccacaatgaccgtttagccgtcgtgataggcccatgctcaatccatgatccaattgcagccattgattactcgcaacgtctacgcccattgcgtgagatgtacaaggatgcactagaaatcgtgatgcgagtttactttcagaaaccgcgcaccactattggttggaaaggattggtcaacgatccggatcttgatggcagcttccagatcaataagggcttgcatatcgcgcgcaacctgctgcgcgatatcaatcatctcggcttacccgctggtgtggaatttctagacacgatttcgccgcaatatctggctgacttagtcgcctggggtgccattggtgctcgcaccactgaaagccaaatacaccgtgaaatggcttcaggtttatcgtgcccgattggctttaaaaacagtaccagtggtgatgtgaagattgctgctgacgcgattaaagcagcttcgcatccgcaccatttcctttcagtgacaaagacaggtgttgccgcagtcgtcgccacccagggtaaccccgattgtcacgtgattctgcgtggaggcaaggtcccgaattacgacgcaatcaatgtcgaagctgccagccaaacattgcttaaatccaagctaccggtgcgactgatgattgatgcgagccatgccaatagcggcaaaaatccaaacaatcaacctaaggtgatcgagaacatcgtagaacagcttaaagccggtgaacgccgcatcatcggtgtcatgattgaaagccacattgttggtggccggcaagaattagtccttggaaacacacttaactatggacagagcattaccgatgcttgcatcgactgggatacctcggttgcaatgttagaacagctcgctcaggccgtacgcgtcagacagactctaccaacgaccactacagctaacaaaacatcaaaaacccaataa

SEQ ID NO: 26968 - protein, 380 aa, Xylella fastidiosa Temecula1; identical to SEQ ID NO: 1470

SEQ ID NO: 26969 - DNA, 1077 bp, Pseudomonas syringae pv. tomato str. DC3000; identical to SEQ ID NO: 1479
  CDS (1)..(1077): transl_table=11

SEQ ID NO: 26970 - protein, 358 aa, Pseudomonas syringae pv. tomato str. DC3000; identical to SEQ ID NO: 1480

SEQ ID NO: 26971 - DNA, 1083 bp, Pseudomonas syringae pv. tomato str. DC3000; identical to SEQ ID NO: 1477
  CDS (1)..(1083): transl_table=11

SEQ ID NO: 26972 - protein, 360 aa, Pseudomonas syringae pv. tomato str. DC3000; identical to SEQ ID NO: 1478

SEQ ID NO: 26973 - DNA, 1074 bp, Vibrio parahaemolyticus RIMD 2210633; identical to SEQ ID NO: 1475
  CDS (1)..(1074): transl_table=11

SEQ ID NO: 26974 - protein, 357 aa, Vibrio parahaemolyticus RIMD 2210633; identical to SEQ ID NO: 1476

SEQ ID NO: 26975 - DNA, 1053 bp, Vibrio parahaemolyticus RIMD 2210633; identical to SEQ ID NO: 1473
  CDS (1)..(1053): transl_table=11

SEQ ID NO: 26976 - protein, 350 aa, Vibrio parahaemolyticus RIMD 2210633; identical to SEQ ID NO: 1474

SEQ ID NO: 26977 - DNA, 1053 bp, Vibrio parahaemolyticus RIMD 2210633; identical to SEQ ID NO: 1471
  CDS (1)..(1053): transl_table=11

SEQ ID NO: 26978 - protein, 350 aa, Vibrio parahaemolyticus RIMD 2210633; identical to SEQ ID NO: 1472

SEQ ID NO: 26979 - DNA, 1053 bp, Salmonella enterica subsp. enterica serovar Typhi Ty2; identical to SEQ ID NO: 1337
  CDS (1)..(1053): transl_table=11

SEQ ID NO: 26980 - protein, 350 aa, Salmonella enterica subsp. enterica serovar Typhi Ty2; identical to SEQ ID NO: 1338

SEQ ID NO: 26981 - DNA, 1083 bp, Coxiella burnetii RSA 493; identical to SEQ ID NO: 1465
  CDS (1)..(1083): transl_table=11

SEQ ID NO: 26982 - protein, 360 aa, Coxiella burnetii RSA 493; identical to SEQ ID NO: 1466

SEQ ID NO: 26983 - DNA, 1179 bp, Nitrosomonas europaea ATCC 19718; identical to SEQ ID NO: 1463
  CDS (1)..(1179): transl_table=11

SEQ ID NO: 26984 - protein, 392 aa, Nitrosomonas europaea ATCC 19718; identical to SEQ ID NO: 1464

SEQ ID NO: 26985 - DNA, 1053 bp, Rhodopirellula baltica SH 1; identical to SEQ ID NO: 1445
  CDS (1)..(1053): transl_table=11

SEQ ID NO: 26986 - protein, 350 aa, Rhodopirellula baltica SH 1; identical to SEQ ID NO: 1446

SEQ ID NO: 26987 - DNA, 1038 bp, Wigglesworthia glossinidia endosymbiont of Glossina brevipalpis; identical to SEQ ID NO: 1491
  CDS (1)..(1038): transl_table=11

SEQ ID NO: 26988 - protein, 345 aa, Wigglesworthia glossinidia endosymbiont of Glossina brevipalpis; identical to SEQ ID NO: 1492

SEQ ID NO: 26989 - DNA, 1080 bp, Haemophilus ducreyi 35000HP
  CDS (1)..(1080): transl_table=11
gtggattctgtagcaaatcaagatagtttacataatgtaaatatctctactgaaaaagtattacttactccaaaacaactaaaaactgagtttccattacccgatcatttacgtaagcaaattgaaaaatcacgccaagaaattgccgcgattattcataaaaaagatccacgtaaacttattatcatcggaccttgttctattcacgatatctctgccgcattagagtatggccaaaaactaaaaaaattagccgaccaagtaagcgatcaactttatattgtaatgcgggtatattttgaaaaaccgcgcaccaccgtaggatggaagggcttaattaacgatccacaaatagatggcacttttaatgttgaagccggtttacgcattgcacgtaaattgtgcttagatttaactgaactaggcttaccattagccacagaagcactagatccaatgacaccacaatatttagcagatctttttagctggtcagcgattggagcaagaacgactgaatcacaaacacatcgtgaattagcttctggtttatctatggccgttggctttaaaaatggcactgatggcggcctagctgtggcgattaacgccatgcaatctgccgcacaaccgcatcgtttcattggtatcaatcaaaatggacaggtcaatttattaaataccaaagggaatcctgatggccacgtgattttacgtggcggtaaaaaacctaactttgaacaaaaatatgtaatggaatgtgaaactgcattacgtaaagcgggtttagaagaagcaataatgattgattgtagccacggtaattcaaataaagatcacacacgtcaacctatagttgcagaaaatgtactcacgcaattattggcaggtaaccgatcgatcatcggcttaatgattgaaagccatttaaatgcgggtaatcagccctctgaacaatcattccaagagatgaaatacggcatatccattacagatgcttgtattgattggcaaaccactgaacatatacttctcaacttcgccgcaaaattaagaaatcccccatcttcctttcagtaa

SEQ ID NO: 26990 - protein, 359 aa, Haemophilus ducreyi 35000HP; identical to SEQ ID NO: 1456

SEQ ID NO: 26991 - DNA, 1113 bp, Haemophilus ducreyi 35000HP; identical to SEQ ID NO: 1453
  CDS (1)..(1113): transl_table=11

SEQ ID NO: 26992 - protein, 370 aa, Haemophilus ducreyi 35000HP; identical to SEQ ID NO: 1454

SEQ ID NO: 26993 - DNA, 1074 bp, Prochlorococcus marinus subsp. marinus str. CCMP1375; identical to SEQ ID NO: 1451
  CDS (1)..(1074): transl_table=11

SEQ ID NO: 26994 - protein, 357 aa, Prochlorococcus marinus subsp. marinus str. CCMP1375; identical to SEQ ID NO: 1452

SEQ ID NO: 26995 - DNA, 1086 bp, Candidatus Blochmannia floridanus; identical to SEQ ID NO: 1457
  CDS (1)..(1086): transl_table=11

SEQ ID NO: 26996 - protein, 361 aa, Candidatus Blochmannia floridanus; identical to SEQ ID NO: 1458

SEQ ID NO: 26997 - DNA, 1119 bp, Bordetella parapertussis 12822
  CDS (1)..(1119): transl_table=11
ttgacccgtatcgatgacccgctgcacgatcgcgaggccggccaggccgacgcgacgcaagacaccacccgcatcgacgacgtgcgcatcggcgccgtgcgtcccctgatttcgcccgccctgctgcaggacgaactgccggtatcggcgccgctacaggcgctggtcgaggacagccgcgcgcgcatcgccgacgtgctgcacggccgcgacgaccggctggtggtggtggtcggcccctgctccatccacgaccacgaacaggccatggagtacgcgcgccagctcaaggaggcgaccgacacgctggccgacgacctgctcatcgtcatgcgcgtgtacttcgagaagccgcgcaccaccgtgggctggaagggctacatcaacgatccgcgcctggacggcagtttccgcatcaacgaaggcctgcgccgcgcgcgccacctgctgctggaaatcggcgccctgggactgcccatcgccaccgaattcctggacctgctcagcccgcaatacatcgccgacctgatcgcctggggcgcgatcggcgcgcgcaccaccgaaagccccagccaccggcaactggcctcgggcctgagctgcccgctgggtttcaagaacggcaccgacggcggcatccaggtggcggccgacgccatcgtggccgccagcgccccgcatgccttcatgggcatgaccaagatgggcaccgccgccatcttcgagacgcgcggcaacgacgacacccacgtcatcctgcgcggcggcaagcaaggccccaactacgacgcggccgccatcgacgcctgctgtgcggcgctggccaaggccggcctgcgcgagcaggtcatggtcgactgctcgcacgccaattcgaacaagtcgcacgcgcgccaggtcgacgtggcgcgcgacctggcccggcagctggccggcggcgaccgccgcatcatcggcatcatgatcgaaagcaacctcgaggaaggccgccaggatctcaagcccggcgtgccgctcaagcgcggcgtgtccatcaccgacgcctgcctgagctgggcccagaccgagccggtgctggccgagctggcccaggccgtgcgccagcgccgcgaaggctga

SEQ ID NO: 26998 - protein, 372 aa, Bordetella parapertussis 12822
MTRIDDPLHDREAGQADATQDTTRIDDVRIGAVRPLISPALLQDELPVSAPLQALVEDSRARIADVLHGRDDRLVVVVGPCSIHDHEQAMEYARQLKEATDTLADDLLIVMRVYFEKPRTTVGWKGYINDPRLDGSFRINEGLRRARHLLLEIGALGLPIATEFLDLLSPQYIADLIAWGAIGARTTESPSHRQLASGLSCPLGFKNGTDGGIQVAADAIVAASAPHAFMGMTKMGTAAIFETRGNDDTHVILRGGKQGPNYDAAAIDACCAALAKAGLREQVMVDCSHANSNKSHARQVDVARDLARQLAGGDRRIIGIMIESNLEEGRQDLKPGVPLKRGVSITDACLSWAQTEPVLAELAQAVRQRREG

SEQ ID NO: 26999 - DNA, 1074 bp, Bordetella parapertussis 12822
  CDS (1)..(1074): transl_table=11
gtgtcgcacaataccgatgactttcgtatccgtgaaatcaaagagctgaatcctcctgcgcatgtcatgcgcgagtttccgtgctcgaaggatgtttctgaaatcgtctacgccgcccgccagggcatgcatcgcatcctgcatggcatggatgaccgcctgatcgtcgtgatcggcccttgctcgatccacgataccaaggcggcgctcgaatacgcggatcgcctcaagccggtgcgcgaccgcctggccgccgatctcgaggtggtgatgcgcgtctacttcgaaaagccgcgcaccaccgtgggctggaagggcctgatcaacgaccccgacctggatggcagcttcgatatcaacaagggcgtgcgcgtggcgcgcgaactgctgctggacatcaacagccgcggcctgccggcgggttgcgagttcctcgacatgattaccccgcagtacatcgccgacctggtgtcgtggggggcgatcggggcgcggacgaccgaaagccaggttcaccgcgagctggcttccggcctgtcgtgtcctgtcggtttcaagaacggcaccgacggcaatgtgaagatcgccgtcgacgccatcaaggccgcctcgcaaccgcaccatttcctctcggtgaccaagggcgggcattcggccatcgtctcgaccgcgggcaacgaggactgccacgtcattctgcgcggcggcaaggcgcccaactacgatgccgccagcatcgaagcggcctgccaggacatggccaaggccggcctggcccagcgcatcatgatcgacgccagccacgccaacagcagcaagaaacccgagaatcagccgctggtggtcgatgatgtggccaaccagatcgagcagggcgatgcccgcatcgtgggcctgatgatagaaagccatctgctgggcggccgccaggacctggtgcccggccaggccttgacgtacgggcagagcatcaccgacggttgcatcgactgggatgcttcggtgcaggtgctggagcgcctggcccatgcggtgcgcgaacgccggcgcgcgtcgctgagcgccggcaagtag

SEQ ID NO: 27000 - protein, 357 aa, Bordetella parapertussis 12822
MSHNTDDFRIREIKELNPPAHVMREFPCSKDVSEIVYAARQGMHRILHGMDDRLIVVIGPCSIHDTKAALEYADRLKPVRDRLAADLEVVMRVYFEKPRTTVGWKGLINDPDLDGSFDINKGVRVARELLLDINSRGLPAGCEFLDMITPQYIADLVSWGAIGARTTESQVHRELASGLSCPVGFKNGTDGNVKIAVDAIKAASQPHHFLSVTKGGHSAIVSTAGNEDCHVILRGGKAPNYDAASIEAACQDMAKAGLAQRIMIDASHANSSKKPENQPLVVDDVANQIEQGDARIVGLMIESHLLGGRQDLVPGQALTYGQSITDGCIDWDASVQVLERLAHAVRERRRASLSAGK

SEQ ID NO: 27001 - DNA, 1074 bp, Bordetella bronchiseptica RB50
  CDS (1)..(1074): transl_table=11
gtgtcgcacaataccgatgaccttcgtatccgtgaaatcaaagagctgaatcctcccgcgcatgtcatgcgcgagtttccgtgctcgaaggatgtttctgaaatcgtctacgccgcccgccagggcatgcatcgcatcctgcatggcatggatgaccgcctgatcgtcgtgatcggcccttgctcgatccacgataccaaggcggcgctcgaatacgcggatcgcctcaagccggtgcgcgaccgcctggccgccgatctcgaggtggtgatgcgcgtctacttcgaaaagccgcgcaccaccgtgggctggaagggcctgatcaacgaccccgacctggatggcagcttcgatatcaacaagggcgtgcgcgtggcgcgcgaactgctgctggacatcaacagccgcggcctgccggcgggttgcgagttcctcgacatgattaccccgcagtacatcgccgacctggtgtcgtggggggcgatcggggcgcggacgaccgaaagccaggttcaccgcgagctggcttccggcctgtcgtgtcctgtcggtttcaagaatggcaccgacggcaatgtgaagatcgccgtcgacgccatcaaggccgcctcgcaaccgcaccatttcctctcggtgaccaagggcgggcattcggccatcgtctcgaccgcgggcaacgaggactgccacgtcattctgcgcggcggcaaggcgcccaactacgatgccgccagcatcgaagcggcctgccaggacatggccaaggccggcctggcccagcgcatcatgatcgacgccagccacgccaacagcagcaagaagcccgagaatcagccgctggtggtcgatgatgtggccaaccagatcgagcagggcgatgcccgcatcgtgggcctgatgatagaaagccatctgctgggcggccgccaggacctggtgcccggccaggccttgacgtacgggcagagcatcaccgacggttgcatcgactgggatgcttcggtgcaggtgctggagcgcctggcccatgcggtgcgcgaacgccggcgcgcgtcgctgagcgccggcaagtag

SEQ ID NO: 27002 - protein, 357 aa, Bordetella bronchiseptica RB50; identical to SEQ ID NO: 1460

SEQ ID NO: 27003 - DNA, 1119 bp, Bordetella bronchiseptica RB50
  CDS (1)..(1119): transl_table=11
ttgacccgtatcgatgacccgctgcacgatcgcgaggccggccaggccgacgcgacgcaagacaccacccgcatcgacgacgtgcgcatcggcgccgtgcgtcccctgatttcgcccgccctgctgcaggacgaactgccggtatcggcgccgctacaggcgctggtcgaggacagccgcgcgcgcatcgccgacgtgctgcacggccgcgacgaccggctggtggtggtggtcggcccctgctccatccacgaccacgaacaggccatggagtacgcgcgccagctcaaggaggcggccgacacgctggccgacgacctgctcatcgtcatgcgcgtgtacttcgagaagccgcgcaccaccgtgggctggaagggctacatcaacgatccgcgcctggacggcagtttccgcatcaacgaaggcctgcgccgcgcgcgccacctgctgctggaaatcggcgccctgggactgcccatcgccaccgaattcctggacctgctcagcccgcaatacatcgccgacctgatcgcctggggcgcgatcggcgcgcgcaccaccgaaagccccagccaccggcaactggcctcgggcctgagctgcccgctgggtttcaagaacggcaccgacggcggcatccaggtggcggctgacgccatcgtggccgccagcgccccgcatgccttcatgggcatgaccaagatgggcaccgccgccatcttcgagacgcgcggcaacgacgacacccacgtcatcctgcgcggcggcaagcaaggccccaactacgacgcggccgccatcgacgcctgctgtgcggcgctggccaaggccggcctgcgcgagcaggtcatggtcgactgctcgcacgccaattcgaacaagtcgcacgcgcgccaggtcgacgtggcgcgcgacctggcccggcagctggccggcggcgaccgccgcatcatcggcatcatgatcgaaagcaacctcgaggaaggccgccaggatctcaagcccggcgtgccgctcaagcgcggcgtgtccatcaccgacgcctgcctgagctgggcccagaccgagccggtgctggccgagctggcccaggccgtgcgccagcgccgcgaaggctga

SEQ ID NO: 27004 - protein, 372 aa, Bordetella bronchiseptica RB50; identical to SEQ ID NO: 1462

SEQ ID NO: 27005 - DNA, 1068 bp, Prochlorococcus marinus subsp. pastoris str. CCMP1986; identical to SEQ ID NO: 1447
  CDS (1)..(1068): transl_table=11

SEQ ID NO: 27006 - protein, 355 aa, Prochlorococcus marinus subsp. pastoris str. CCMP1986; identical to SEQ ID NO: 1448

SEQ ID NO: 27007 - DNA, 1083 bp, Prochlorococcus marinus str. MIT 9313; identical to SEQ ID NO: 1449
  CDS (1)..(1083): transl_table=11

SEQ ID NO: 27008 - protein, 360 aa, Prochlorococcus marinus str. MIT 9313; identical to SEQ ID NO: 1450

SEQ ID NO: 27009 - DNA, 1068 bp, Synechococcus sp. WH 8102; identical to SEQ ID NO: 1443
  CDS (1)..(1068): transl_table=11

SEQ ID NO: 27010 - protein, 355 aa, Synechococcus sp. WH 8102; identical to SEQ ID NO: 1444

SEQ ID NO: 27011 - DNA, 1059 bp, Chromobacterium violaceum ATCC 12472; identical to SEQ ID NO: 1437
  CDS (1)..(1059): transl_table=11

SEQ ID NO: 27012 - protein, 352 aa, Chromobacterium violaceum ATCC 12472; identical to SEQ ID NO: 1438

SEQ ID NO: 27013 - DNA, 1107 bp, Chromobacterium violaceum ATCC 12472; identical to SEQ ID NO: 1435
  CDS (1)..(1107): transl_table=11

SEQ ID NO: 27014 - protein, 368 aa, Chromobacterium violaceum ATCC 12472; identical to SEQ ID NO: 1436

SEQ ID NO: 27015 - DNA, 1119 bp, Gloeobacter violaceus PCC 7421
  CDS (1)..(1119): transl_table=11
gtgcccggcggctctcgcgatgtcggcgagttcgcctttgagccgctcgacgatttgcggatcgtctcggtgagtgagattcctcctccagtgcaactgcgcgagcaattgcctctggatgcggctgcccagaatacagtgcgccggggccgctcgcagattcgcgctgtattgggcggctttgattcacgcctgttggtggtggtcggcccctgttcggtgcacgacgccgatgcggcgcgcgagtacgcccagaggctggccgagtgcgcccgccgctatgcggacgaactgctcatcgccatgcgcgtttacttcgagaaaccgcgcaccacggtcggctggaaaggactcatcaacgatcccggcctcgacggcagctgtcgtatcggtgagggactgaccaccgcccgcgcgttgctgctcgacattgcccggctcggactgccggcggccaccgaatttctcgacccgatcacccccgagtacatcgtcgatctgatcagttggggggcgattggggcgcgcacggtcgaaagtcaggtgcacaggcaagtggcttcggcgctttcctgtccggtgggttttaaaaacggctcctccggcgacatcgccgttgccgtcgaagcggtgctctcggcgcgcaacgcccatcagttcctttcgcacacccgcgagggtcgcacggctatcgtgctgaccagcggcaatcccgattgccatgtcgtgttgcgcggcggcaaaaacggccccaaccactcggctgaacatctcgcgcaggcagggcggttgttgcgcgaggcgggcttgccggagcgggtgatggtcgactgcagccacgccaacagctccaaagatcaccgccgccagggggaagtctgcaaacagttggcggcacggattgccgagggggatatgcggatgatgggcctgatgatcgaaagtcacctagtcgaagggcggcaggagttaggcgacggctgcaacttgcgccacggtcagagcatcaccgatgcgtgcatcggctgggaacagacagagcaattgcttaccggcctacacgaggcggccggcgctagacggtgtaagccggccgtccgcgccgagttgctggtttga

SEQ ID NO: 27016 - protein, 372 aa, Gloeobacter violaceus PCC 7421; identical to SEQ ID NO: 1434

SEQ ID NO: 27017 - DNA, 1095 bp, Photorhabdus luminescens subsp. laumondii TTO1; identical to SEQ ID NO: 1431
  CDS (1)..(1095): transl_table=11

SEQ ID NO: 27018 - protein, 364 aa, Photorhabdus luminescens subsp. laumondii TTO1; identical to SEQ ID NO: 1432

SEQ ID NO: 27019 - DNA, 1053 bp, Photorhabdus luminescens subsp. laumondii TTO1; identical to SEQ ID NO: 1429
  CDS (1)..(1053): transl_table=11

SEQ ID NO: 27020 - protein, 350 aa, Photorhabdus luminescens subsp. laumondii TTO1; identical to SEQ ID NO: 1430

SEQ ID NO: 27021 - DNA, 1047 bp, Photorhabdus luminescens subsp. laumondii TTO1; identical to SEQ ID NO: 1427
  CDS (1)..(1047): transl_table=11

SEQ ID NO: 27022 - protein, 348 aa, Photorhabdus luminescens subsp. laumondii TTO1; identical to SEQ ID NO: 1428

SEQ ID NO: 27023 - DNA, 1245 bp, Vibrio vulnificus YJ016
  CDS (1)..(1245): transl_table=11
ttgaaaaccaaagcgaggcgctttggtttttttataatgtgtaatttattttttacatttgatgttttttattgtttacggttgatttttaattcaaccctgttaacttgtgttcaaacagatttcgactctcagggatatgagggtgtaaaaaataatatacaggtgagtgtcatgcagaaaagtgaactaagcaatattaatatcagcgatgaacaagtgctgattacgccagaacagctaaaacagaaactgccactgagcgacaacgcccgccgcttcattcaagagtcgcgtaataccgtcgccaatattattcataagcaagatcatcgtctgctggtggtttgtggtccttgttctattcacgatctggacgcggcaaaggattatgcgcgtcgcctaaaagcgctctccgccgagttaagcgatcaactgtatattgtgatgcgtgtttactttgaaaaacctcgtacaactgtgggttggaaagggctcatcaacgaccctcatctggatggtagcttcgatattgagcatggtctgcatgttggccgtcaattgctggtggagctggctgaaatggagatccctctggcgacagaagcactcgacccaattagtccgcaatacttggctgatacattcagttgggctgcgattggtgcgcgtacgacagaatcacaaactcaccgtgaaatggccagtggtttgtctatgccgattggttttaaaaatggcacggatggcagcttgtcaacggcgattaacgcaatgcaagcggcctcttcaagccaccgttttatggggatcaaccgtgaaggccaagtggcattgctgacgactcaaggtaacccaaatggtcacgtgattttgcgtggtggtaagcagaccaactacgattctgtgtcggtggcggagtgtgagcaagacatggccaaagtgggtttagatgcgtcattgatggtggattgtagccatgccaattcgcgcaaagattaccgtcgtcagcctttagtcgccgaagacgtgattcatcaaattcgcgaaggcaacaaatcgatcattggtttgatgattgaaagccacattaatgaaggtaatcaatcctcagatttaccgctttctgagatgcagtacggtgtttctattaccgatgcctgtatcaattggcaggcaactgaggcactattgcgtaaagcacacaaagagttagtgccacatttagaaaaccgtctcaaataa

SEQ ID NO: 27024 - protein, 414 aa, Vibrio vulnificus YJ016
MKTKARRFGFFIMCNLFFTFDVFYCLRLIFNSTLLTCVQTDFDSQGYEGVKNNIQVSVMQKSELSNINISDEQVLITPEQLKQKLPLSDNARRFIQESRNTVANIIHKQDHRLLVVCGPCSIHDLDAAKDYARRLKALSAELSDQLYIVMRVYFEKPRTTVGWKGLINDPHLDGSFDIEHGLHVGRQLLVELAEMEIPLATEALDPISPQYLADTFSWAAIGARTTESQTHREMASGLSMPIGFKNGTDGSLSTAINAMQAASSSHRFMGINREGQVALLTTQGNPNGHVILRGGKQTNYDSVSVAECEQDMAKVGLDASLMVDCSHANSRKDYRRQPLVAEDVIHQIREGNKSIIGLMIESHINEGNQSSDLPLSEMQYGVSITDACINWQATEALLRKAHKELVPHLENRLK

SEQ ID NO: 27025 - DNA, 1053 bp, Vibrio vulnificus YJ016; identical to SEQ ID NO: 2345
  CDS (1)..(1053): transl_table=11

SEQ ID NO: 27026 - protein, 350 aa, Vibrio vulnificus YJ016; identical to SEQ ID NO: 2346

SEQ ID NO: 27027 - DNA, 1053 bp, Vibrio vulnificus YJ016; identical to SEQ ID NO: 1675
  CDS (1)..(1053): transl_table=11

SEQ ID NO: 27028 - protein, 350 aa, Vibrio vulnificus YJ016; identical to SEQ ID NO: 1676

SEQ ID NO: 27029 - DNA, 1071 bp, Vibrio vulnificus YJ016; identical to SEQ ID NO: 1425
  CDS (1)..(1071): transl_table=11

SEQ ID NO: 27030 - protein, 356 aa, Vibrio vulnificus YJ016; identical to SEQ ID NO: 1426

SEQ ID NO: 27031 - DNA, 1095 bp, Rhodopseudomonas palustris CGA009
  CDS (1)..(1095): transl_table=11
gtgttgaccaccacagacgaccttcgccttcagaaaatcaccgagctgagtacgcctgccgaggtgatgggcgagattccgcgcacactgaccgcaacgcgtaccgttgcggcgagccgcagcgcgattcatgccatcctgaacggagccgacgaccggctcctcgtcgtcgtcggcccctgttcgattcacgatccggccgcagccatggactatgccagccgtctggcggcgctgcgcgagaccctggccgaccggctcgagatcgtgatgcgggtgtatttcgaaaagccgcgcaccacggtgggttggaagggactgatcaacgaccccgatctcgatggcagcttccggatcgacaaggggctacggttggcgcgggaagtactctcggccgtgaacaatctcggcctgccagcggcgaccgaattcctcgatctgatcacgcctcaatacatcgcggatctcgtcgcctggggcgcgatcggcgcgcgcaccaccgagagccagatccaccgcgaactcgcgtcaggcctgtcatgcccaatcggcttcaagaatggcaccgacggcaatgtccggatcgccgcggaggcggtgaagtccgcggcgcagccgcatcatttcatggcggtgaccaagggcgggcgcaatgcgatcgcggccaccactggtaacagcgactgccacgtcatcctgcgcggcggcgtcacaccgaactacgatgccgcaagtgtggaagccgccgcagcggtcctcggcaagatcggcctgccgccgcgcctgatgatcgacgccagccacgccaacagcagcaagcagccggacaaccagccgaaggtaacggccgatatcgggcgtcagatggcggctggcgagagccgcatcatcggcgtgatgatcgagagcaatctggtcgccggtcggcaggatgtggcgccgggtcggccgctgcaatacggccagagcatcaccgacggctgtatcgactgggcgacgaccgagacggtgctgcacgagctagccgatgcggtcgagagccggcgagctgcgcggcacgccgcaagcgctcagcagaaaggtgctgcggcgtga

SEQ ID NO: 27032 - protein, 364 aa, Rhodopseudomonas palustris CGA009; identical to SEQ ID NO: 1412

SEQ ID NO: 27033 - DNA, 1068 bp, Geobacter sulfurreducens PCA; identical to SEQ ID NO: 1417
  CDS (1)..(1068): transl_table=11

SEQ ID NO: 27034 - protein, 355 aa, Geobacter sulfurreducens PCA; identical to SEQ ID NO: 1418

SEQ ID NO: 27035 - DNA, 1071 bp, Treponema denticola ATCC 35405; identical to SEQ ID NO: 1415
  CDS (1)..(1071): transl_table=11

SEQ ID NO: 27036 - protein, 356 aa, Treponema denticola ATCC 35405; identical to SEQ ID NO: 1416

SEQ ID NO: 27037 - DNA, 1122 bp, Eremothecium gossypii; identical to SEQ ID NO: 1421
  CDS (1)..(1122)

SEQ ID NO: 27038 - protein, 373 aa, Eremothecium gossypii; identical to SEQ ID NO: 1422

SEQ ID NO: 27039 - DNA, 1095 bp, Eremothecium gossypii; identical to SEQ ID NO: 1419
  CDS (1)..(1095)

SEQ ID NO: 27040 - protein, 364 aa, Eremothecium gossypii; identical to SEQ ID NO: 1420

SEQ ID NO: 27041 - DNA, 1092 bp, Parachlamydia sp. UWE25; identical to SEQ ID NO: 1409
  CDS (1)..(1092): transl_table=11

SEQ ID NO: 27042 - protein, 363 aa, Parachlamydia sp. UWE25; identical to SEQ ID NO: 1410

SEQ ID NO: 27043 - DNA, 1056 bp, Acinetobacter sp. ADP1; identical to SEQ ID NO: 1395
  CDS (1)..(1056): transl_table=11

SEQ ID NO: 27044 - protein, 351 aa, Acinetobacter sp. ADP1; identical to SEQ ID NO: 1396

SEQ ID NO: 27045 - DNA, 1113 bp, Acinetobacter sp. ADP1; identical to SEQ ID NO: 1393
  CDS (1)..(1113): transl_table=11

SEQ ID NO: 27046 - protein, 370 aa, Acinetobacter sp. ADP1; identical to SEQ ID NO: 1394

SEQ ID NO: 27047 - DNA, 1056 bp, Erwinia carotovora subsp. atroseptica SCRI1043; identical to SEQ ID NO: 1391
  CDS (1)..(1056): transl_table=11

SEQ ID NO: 27048 - protein, 351 aa, Erwinia carotovora subsp. atroseptica SCRI1043; identical to SEQ ID NO: 1392

SEQ ID NO: 27049 - DNA, 1047 bp, Erwinia carotovora subsp. atroseptica SCRI1043; identical to SEQ ID NO: 1389
  CDS (1)..(1047): transl_table=11

SEQ ID NO: 27050 - protein, 348 aa, Erwinia carotovora subsp. atroseptica SCRI1043; identical to SEQ ID NO: 1390

SEQ ID NO: 27051 - DNA, 1074 bp, Erwinia carotovora subsp. atroseptica SCRI1043; identical to SEQ ID NO: 1387
  CDS (1)..(1074): transl_table=11

SEQ ID NO: 27052 - protein, 357 aa, Erwinia carotovora subsp. atroseptica SCRI1043; identical to SEQ ID NO: 1388

SEQ ID NO: 27053 - DNA, 1047 bp, Yersinia pseudotuberculosis IP 32953; identical to SEQ ID NO: 1623
  CDS (1)..(1047): transl_table=11

SEQ ID NO: 27054 - protein, 348 aa, Yersinia pseudotuberculosis IP 32953; identical to SEQ ID NO: 1624

SEQ ID NO: 27055 - DNA, 1056 bp, Mannheimia succiniciproducens MBEL55E
  CDS (1)..(1056): transl_table=11
atgaaagatagtatccataatgttcatatcattgatgaaaaagtattaattacacctgccgaattaaaacaaaagctcccgctcccaatcgcactgcgtacacaaattgaaacacatcgccgtgaaattgccgatatagtacacaaaaaagacgatcgcttactggtggtcattgggccttgttccgtacatgacaccaaagcggcaatcgattatgccaaacgtctgaaagcgctttcagatgaattaaaggatcagctttatatcgttatgcgggtttattttgaaaaaccgcgtaccacggtaggctggaaagggctcattaatgacccgcgtatcgacggcacatttaatgtggaagaagggctgcatatcggtcgtaaattattgctggatttagctgaaatgggcttgccgttggcaacggaagcgttggatccgatgacgccgcaatatctcgccgatttattcagttggtcggctatcggcgcgcgtactaccgaatcgcaaactcaccgtgaactggcttccggattatctatggcagtcggctttaaaaacggcaccgacggtagtctggctaccgccattaatgccatgaaagccgcctcaatgggacacagttttatcggtattaaccagcaaggacaggtcaatttattacatacggagggcaatcctgacggtcatgttatcctgcgtggcggcaaaaaaccgaattaccaacaggaatttgtcaaccaatgcgaagaagaattagccaaagcaggtctggaaacggcgattatgatcgattgcagccacggtaattcaaataaagattataaacgccagccttcagttgcgaaagatgcggtaaatcaaattgtggcggggaataaatccattatcggtttaatgattgaaagcaacatcaatgcgggtaaccaaagctcggaacaaaaggtttccgagatgaaatacggtgtttccattaccgatgcctgtattgattgggaaacaacggataatttattacgtaaaattgccgccgcattgaaaaatagagcggagtaa

SEQ ID NO: 27056 - protein, 351 aa, Mannheimia succiniciproducens MBEL55E
MKDSIHNVHIIDEKVLITPAELKQKLPLPIALRTQIETHRREIADIVHKKDDRLLVVIGPCSVHDTKAAIDYAKRLKALSDELKDQLYIVMRVYFEKPRTTVGWKGLINDPRIDGTFNVEEGLHIGRKLLLDLAEMGLPLATEALDPMTPQYLADLFSWSAIGARTTESQTHRELASGLSMAVGFKNGTDGSLATAINAMKAASMGHSFIGINQQGQVNLLHTEGNPDGHVILRGGKKPNYQQEFVNQCEEELAKAGLETAIMIDCSHGNSNKDYKRQPSVAKDAVNQIVAGNKSIIGLMIESNINAGNQSSEQKVSEMKYGVSITDACIDWETTDNLLRKIAAALKNRAE

SEQ ID NO: 27057 - DNA, 1155 bp, Mannheimia succiniciproducens MBEL55E
  CDS (1)..(1155): transl_table=11
ttgataagctttaaagtgcggttaaatttttctatttttcggatgatatacagagagttgattatgcctacaaaaaacaaaaataatattcgtgtcgcaaacgacgataccagaattgccaatatcgaacagttgcttccgccggtcgctttattggaaaaatatccggcaagcaatgtcgccgttaaaacggtcagaaacgcccgcaataaagcccatcaaattattcacggtgaagatgatcgcctgttggtgattatcggtccttgttcgattcatgatcctaaagcggcgcttgaatatgccaaccgcatggcgaaaatgcgcgaaaaatataaagataccttagaaatcatcatgcgcgtttattttgaaaaaccgcgtactaccgtgggttggaaagggttaattaacgatccgtatttaaacgatacctatgcattaaacgacggtttacgtattgcgcgcaaactattatcagacatcaatgatctcggtttgccgactgcgggtgaatttttagacatgatcaccccgcaatatgtggctgatttcatgagctggggcgcaattggcgcccgtaccacggaatcgcaggttcatcgtgaactggcttccggtttgtcttgtgcggtgggctttaaaaacggcacaaacggcggtgtgaaaatcgctttagacgctattggtgcggcggaagcttcccaccatttcttatcggttactaaattcgggcattcggcgattgtttcaacaaaaggtaatctggattgccatattattttacgcggcggtgataaaggtacgaattatgatgcggaaaatatcgcaaaagtttgtgctaatatcgagaaaagcggccgtatcggtcatgtaatgatcgacttcagccatgctaacagcagtaaacagttcaaaaaacaagtggaagtttgtcatgatgtcgcaaaacaaatcgcacagggttcaaaccaaattttcggcgtgatggttgaaagccacttggttgaaggtcgtcaggatttagtaaacggaaaagcggaaacttacggtcaaagtatcaccgatgcctgtatcggctgggatgacacggaaatcgtgttacaagaactgtccgatgcggtagccgctcgtcgcaaagtcaacggcaaataa

SEQ ID NO: 27058 - protein, 384 aa, Mannheimia succiniciproducens MBEL55E
MISFKVRLNFSIFRMIYRELIMPTKNKNNIRVANDDTRIANIEQLLPPVALLEKYPASNVAVKTVRNARNKAHQIIHGEDDRLLVIIGPCSIHDPKAALEYANRMAKMREKYKDTLEIIMRVYFEKPRTTVGWKGLINDPYLNDTYALNDGLRIARKLLSDINDLGLPTAGEFLDMITPQYVADFMSWGAIGARTTESQVHRELASGLSCAVGFKNGTNGGVKIALDAIGAAEASHHFLSVTKFGHSAIVSTKGNLDCHIILRGGDKGTNYDAENIAKVCANIEKSGRIGHVMIDFSHANSSKQFKKQVEVCHDVAKQIAQGSNQIFGVMVESHLVEGRQDLVNGKAETYGQSITDACIGWDDTEIVLQELSDAVAARRKVNGK

SEQ ID NO: 27059 - DNA, 1044 bp, Legionella pneumophila subsp. pneumophila str. Philadelphia 1
  CDS (1)..(1044): transl_table=11
atgagttattccatcttaaaaaaactgccaccaatagaaaaaattatccgggaattgccactatcccaccccgcctatctacaaattgcccaagaccgacaagaggtcaaagctattttggaagggcgagataaacgtcttttgatgatagttggtccttgttcagcatggcctaaaaaagcggtattggaatacgctgagcgtttggtacaactcaacagcaaagtaaaacacgctttaaaattaatcatgcgcgtttacattcaaaagccaagaaccaccaaaggctggactggaccggtgaatcaacccgatttattttcaactcctgatattgaggcaggtataaaatatacccgggacatgatgataaaagtcattcaaatggggctccctatcgctgatgaggctcttttcacccataatgccaaaggatttcttgaacttctgtcctgggttgcaataggcgcccgtagttcagaggatcaagagcatcgaatttttgcctccgcccttgactgtgccgtaggattaaaaaaccctacacatggttcactcgctgtcggagtaaacagcctggttgcatcacagcatcctcatgtcgctgtcttcgatggctatgaagtacaaacccatggtaatcatcatgctcatctcgttctgcgtggttcaaaccaagctcccaattactctgtttctcatctggaggaagtcatgtactacatgggcatgcatcagatagtgaacccttctgtcattattgatgttagccatgacaactgtctggtgaatgggaaaaaaaatcatcagctacaaccagagattgcatttaatattctggaaagcatcaaaaacagacctgatttaaaacaactggtcaagggattcatggtagaaagtttcatcaaagaaggtaatcaaaaattagattctatcaatcccgataacattgatttaagcgggttatccgttaccgatccttgcctcagttgggagaagacagaatcgttcctgttggaactggcagagagggaagcgttatga

SEQ ID NO: 27060 - protein, 347 aa, Legionella pneumophila subsp. pneumophila str. Philadelphia 1
MSYSILKKLPPIEKIIRELPLSHPAYLQIAQDRQEVKAILEGRDKRLLMIVGPCSAWPKKAVLEYAERLVQLNSKVKHALKLIMRVYIQKPRTTKGWTGPVNQPDLFSTPDIEAGIKYTRDMMIKVIQMGLPIADEALFTHNAKGFLELLSWVAIGARSSEDQEHRIFASALDCAVGLKNPTHGSLAVGVNSLVASQHPHVAVFDGYEVQTHGNHHAHLVLRGSNQAPNYSVSHLEEVMYYMGMHQIVNPSVIIDVSHDNCLVNGKKNHQLQPEIAFNILESIKNRPDLKQLVKGFMVESFIKEGNQKLDSINPDNIDLSGLSVTDPCLSWEKTESFLLELAEREAL

SEQ ID NO: 27061 - DNA, 1074 bp, Burkholderia mallei ATCC 23344
  CDS (1)..(1074): transl_table=11
atgcccccgcacaataccgacgacgtccgcatccgtgaactgaaggagctgactccgcccgcccacctgatccgcgaattcgcgctcggcgaggcggtgtcggagctcatctacaacgcgcgccaggcgatgcaccggatcctgcacgggatggacgatcgcctgatcgtcatcatcgggccgtgctcgatccacgacacgaaggcggcgctcgaatacgcgggccggctcgtccaggagcgcgagcgcttcgcaagcgaactcgagatcgtaatgcgcgtgtacttcgagaagccgcgcacgacggtcggctggaaggggctcatcaacgatccgcacctggataacagcttcaagatcaacgacggcctgcgcaccgcgcgcgagctgctgctgcagatcaacgagatggggctgcccgccggcaccgaatacctcgacatgatcagcccgcaatacatcgcggacctgatctcgtggggcgcgatcggcgcgcgcacgaccgaatcgcaggtgcaccgcgagctcgcgtcggggctgtcgtgcccggtcggcttcaagaacggcaccgacggcaacgtgaagatcgcggtcgacgcgatcaaggccgcatcgcagccgcaccatttcctgtcggtgacgaagggcgaccattcggcgatcgtgtcgacggccggcaacgaggactgccacgtgatcctgcgcggcggcaaggcgccgaactacgatgccgacagcgtgaacgccgcgtgcgcggacatcggcaaggccggcctcgccgcgcgcctgatgatcgacgcgagccatgcgaacagctcgaagaagcacgagaaccagattccggtatgcgcggacatcggccgccagatcgccgcgggcgacgagcgcatcgtcggcgtgatggtcgagtcgcacctcgtcgaaggccgccaggacctgaaggaaggctgcccgctcacgtacggccagagcatcaccgatgcatgcatcaactgggacgacagcgtgaaggtgctcgaagggctcgccgaagcggtgaaggcgcggcgcgtcgcgcgcggcagcggcaactga

SEQ ID NO: 27062 - protein, 357 aa, Burkholderia mallei ATCC 23344
MPPHNTDDVRIRELKELTPPAHLIREFALGEAVSELIYNARQAMHRILHGMDDRLIVIIGPCSIHDTKAALEYAGRLVQERERFASELEIVMRVYFEKPRTTVGWKGLINDPHLDNSFKINDGLRTARELLLQINEMGLPAGTEYLDMISPQYIADLISWGAIGARTTESQVHRELASGLSCPVGFKNGTDGNVKIAVDAIKAASQPHHFLSVTKGDHSAIVSTAGNEDCHVILRGGKAPNYDADSVNAACADIGKAGLAARLMIDASHANSSKKHENQIPVCADIGRQIAAGDERIVGVMVESHLVEGRQDLKEGCPLTYGQSITDACINWDDSVKVLEGLAEAVKARRVARGSGN

SEQ ID NO: 27063 - DNA, 1119 bp, Burkholderia mallei ATCC 23344
  CDS (1)..(1119): transl_table=11
atgcaaaacatcgacaatccgcaacgcgatcgggaaaccggcttcgccgacgcgacgcaggacacgacgcgcatcgacgacgtgcgcatcggcgcggtgcgcccgctcatctcgcccgcgctgctgcaggacgaactgccggtgccgagcgccgtccaggcgctcgtcgaagcgagccgcgacgcgatcggcgacgtgctgcacggccgcgacgaccgcctgctcgcgatcgtcggcccgtgctcgatccacgatcacgatcaggcgctcgactacgcgcgccggctgaaaagcgccgccgacgcgctgcgcgacgacctgctgatcgtgatgcgcgtgtatttcgagaagccgcgcacgacggtcggctggaagggctacatcaacgatccgcgcctcgacggcagcttccgcatcaacgaagggctgcgcgccgcgcgccggctgctgatcgacatcaacgcgctcggcctgcccgccggcaccgaattcctcgatctgctgagcccgcagtacatcgcggatctgatcgcctggggcgcgatcggcgcgcgcacgaccgagagccagagccaccggcagctcgcgtcggggctgagctgcccgatcggcttcaagaacggcaccgacggcggcgtgcaggtcgcggccgacgcgatcgtcgcggcgcgcgcgagccacgcgttcatgggcatgacgaagatggggatggccgcgattttcgagacgcgcggcaacgacgccgcgcacgtgatcctgcgcggcggcaagcggggcccgaactacgatcgcgcgagcgtcgacgaggcgtgcgcggtgctgcgcgcggcgggccagcgcgagcaggtgatgatcgactgctcgcacgcgaattcgaacaagtcgcacctgcggcaggtcgacgtcgccgaggacctcgcgcgccagttgtcggacggcgagcgacgcatcaccggcgtgatggtcgagagcaacctggaggccggccggcaggacctgaagcccggcgtgccgctgcaatacggcgtgtcgatcaccgacgcgtgcctgagctgggcgcagaccgagcccgtgctcgacacgctcgcgcaggcggtgcggcggcggcgcgccgcctga

SEQ ID NO: 27064 - protein, 372 aa, Burkholderia mallei ATCC 23344
MQNIDNPQRDRETGFADATQDTTRIDDVRIGAVRPLISPALLQDELPVPSAVQALVEASRDAIGDVLHGRDDRLLAIVGPCSIHDHDQALDYARRLKSAADALRDDLLIVMRVYFEKPRTTVGWKGYINDPRLDGSFRINEGLRAARRLLIDINALGLPAGTEFLDLLSPQYIADLIAWGAIGARTTESQSHRQLASGLSCPIGFKNGTDGGVQVAADAIVAARASHAFMGMTKMGMAAIFETRGNDAAHVILRGGKRGPNYDRASVDEACAVLRAAGQREQVMIDCSHANSNKSHLRQVDVAEDLARQLSDGERRITGVMVESNLEAGRQDLKPGVPLQYGVSITDACLSWAQTEPVLDTLAQAVRRRRAA

SEQ ID NO: 27065 - DNA, 1074 bp, Burkholderia pseudomallei K96243
  CDS (1)..(1074): transl_table=11
atgcccccgcacaataccgacgacgtccgcatccgtgaactgaaggagctgactccgcccgcccacctgatccgcgaattcgcgctcggcgaggcggtgtcggagctcatctacaacgcgcgccaggcgatgcaccggatcctgcacgggatggacgatcgcctgatcgtcatcatcgggccgtgctcgatccacgacacgaaggcggcgctcgaatacgcgggccggctcgtccaggagcgcgagcgcttcgcaagcgagctcgagatcgtgatgcgcgtgtacttcgagaagccgcgcacgacggtcggctggaaggggctcatcaacgatccgcacctggataacagcttcaagatcaacgacggcctgcgcaccgcgcgcgagctgctgctgcagatcaacgagatggggctgcccgccggcaccgaatacctcgacatgatcagcccgcagtacatcgcggacctgatctcgtggggcgcgatcggcgcgcgcacgaccgaatcgcaggtgcaccgcgagctcgcgtcggggctgtcgtgcccggtcggcttcaagaacggcaccgacggcaacgtgaagatcgcggtcgacgcgatcaaggccgcatcgcagccgcaccatttcctgtcggtgacgaagggcggccattcggcgatcgtgtcgacggccggcaacgaggactgccacgtgatcctgcgcggcggcaaggcgccgaactacgatgccgacagcgtgaacgccgcgtgcgcggacatcggcaaggccggcctcgccgcgcgcctgatgatcgacgcgagccatgcgaacagctcgaagaagcacgagaaccagattccggtatgcgcggacatcggccgccagatcgccgcgggcgacgagcgcatcgtcggcgtgatggtcgagtcgcacctcgtcgaaggccgccaggacctgaaggaaggctgcccgctcacgtacggccagagcatcaccgatgcatgcatcaactgggacgacagcgtgaaggtgctcgaagggctcgccgaagcggtgaaggcgcggcgcgtcgcgcgcggcagcggcaactga

SEQ ID NO: 27066 - protein, 357 aa, Burkholderia pseudomallei K96243
MPPHNTDDVRIRELKELTPPAHLIREFALGEAVSELIYNARQAMHRILHGMDDRLIVIIGPCSIHDTKAALEYAGRLVQERERFASELEIVMRVYFEKPRTTVGWKGLINDPHLDNSFKINDGLRTARELLLQINEMGLPAGTEYLDMISPQYIADLISWGAIGARTTESQVHRELASGLSCPVGFKNGTDGNVKIAVDAIKAASQPHHFLSVTKGGHSAIVSTAGNEDCHVILRGGKAPNYDADSVNAACADIGKAGLAARLMIDASHANSSKKHENQIPVCADIGRQIAAGDERIVGVMVESHLVEGRQDLKEGCPLTYGQSITDACINWDDSVKVLEGLAEAVKARRVARGSGN

SEQ ID NO: 27067 - DNA, 1092 bp, Methylococcus capsulatus str. Bath
  CDS (1)..(1092): transl_table=11
atgcccagcgtgtacaacaccgacgatcttcgcatctgcgagatcaaggaagtcattccgcccgtccaggttcatgaggaattcccgatcacggaccgggccgcactcacgacactgaccgcccgccgagggattcacgcaatcctttccaaggaggacgaccgcctgctggtggtgatcgggccctgttcgatccatgaccccaaggccgcgctcgaatacggggagcggctgctgccactccgccagaaactggcgagacatctggaaatcgtgatgcgggtctatttcgagaagccgcgaacgaccgtcggctggaagggcctgatcaatgatcccgatctggacgagagtttcaacatcaacaaaggcttgcgcctcgcccgcaagctgttgctcgatctgaacgaactgggcatgcccgcggccaccgagtacctcgatctcatcaccccgcagtatgtctccgacctgatcgcttggggcgccatcggtgctcgtaccacggagagccagtctcaccgtgaactggcatcggggctgtcatgtccggttggattcaagaacgccaccgacggcacgatcaaggttgctgtcgacgccataggtgcggcacggcggccacatcatttcctgtctttgaccaaggccggtcattcggcgatcttctccacgaccggtaacgccgactgtcacatcatccttcgtggcggagcccggccgaattacgacgcggccagcgtcgaagcggcggccagggcgctggaagccgtcggcctgccgcccaacatcatggtggactgcagccatgccaacagcatgaaggattacctgaagcagctgcgggtggccgaggacgtggccgaacagatagacggcggcgacaggcggatcatcggcttgatggtggaaagtcacctcaagccgggcaatcagaaactccacaagggcatggttcccgaatacggcgtcagcatcaccgatgcctgcatcggctgggatgacagcgtggccgtgctggaacggctcgccgccgcggtggagagccggcgcggccggtcggcaggcatccggaacgtgcggggggcctga

SEQ ID NO: 27068 - protein, 363 aa, Methylococcus capsulatus str. Bath
MPSVYNTDDLRICEIKEVIPPVQVHEEFPITDRAALTTLTARRGIHAILSKEDDRLLVVIGPCSIHDPKAALEYGERLLPLRQKLARHLEIVMRVYFEKPRTTVGWKGLINDPDLDESFNINKGLRLARKLLLDLNELGMPAATEYLDLITPQYVSDLIAWGAIGARTTESQSHRELASGLSCPVGFKNATDGTIKVAVDAIGAARRPHHFLSLTKAGHSAIFSTTGNADCHIILRGGARPNYDAASVEAAARALEAVGLPPNIMVDCSHANSMKDYLKQLRVAEDVAEQIDGGDRRIIGLMVESHLKPGNQKLHKGMVPEYGVSITDACIGWDDSVAVLERLAAAVESRRGRSAGIRNVRGA

SEQ ID NO: 27069 - DNA, 1083 bp, Nocardia farcinica IFM 10152
  CDS (1)..(1083): transl_table=11
atgactaccgcagccgatgtcgacgcgcggcattccgatctcgacgaccagcgcaccctgtcggtgagcccgttgcgctcgcccgccgaggtgcgcatggtgcacccgatcaccgacgacctcgccgataccgtccgggcgggccgtaaggccaccgtcgaggtgctcgacggcaccgacgaccgcctgatggtgatcgtgggcccgtgctcggtgcacgaccccgccgccgccctcgactacgcccggcgcctggccgccaaggccgccgaactcgacgaccgcctgcacgtggtgatgcgggtgtacttcgagaagccgcgcaccagcctgggctggaagggcctggtcaacgatccgcacctggacggctccttcgacgtcaacaccggtctgggcatcggccgcaagttgctggtcgacatcaccgcgctcggcctgccggtcgcgtgcgagttcctcgatccgatcaccccgcagtacatcgccgatctggtgtcctacggcgcgatcggcgcgcgcaccgcggccagccaggtgcaccgccagctcagcagcgcgctgtccatgccggtcggcatcaagaacggcaccgacggtgacgtccaggtcgcggtcgacggtgtgcgggcggccgcggccagccacgtcttccccggtaccgatctcgacgggcgcgccgcgctgatccgcaccaccggcaacccggactgccacgtcatcctgcgcggcggcagcaacggcaccaactacgacgcggcctcggtggccgaggcgtgcctgcggctggagaaggccgggctggcgcgccgggtcgtcgtggacgccagccacggcaacagcaacaaggaccacaacaagcaggtcgacgtggtggccgacatcgccgagcggatcgcgggcggtgagcgcgaggtcgtcggcgtgatgctggagagcttcctggtggcgggccgccaggacctcaccctcggccggtcggcggatctggtctacggccagtcgatcaccgacgcctgcctggactgggagaccaccgccgcacagctcgaccgcctggccgaggccgtcgcggcgcgctag

SEQ ID NO: 27070 - protein, 360 aa, Nocardia farcinica IFM 10152
MTTAADVDARHSDLDDQRTLSVSPLRSPAEVRMVHPITDDLADTVRAGRKATVEVLDGTDDRLMVIVGPCSVHDPAAALDYARRLAAKAAELDDRLHVVMRVYFEKPRTSLGWKGLVNDPHLDGSFDVNTGLGIGRKLLVDITALGLPVACEFLDPITPQYIADLVSYGAIGARTAASQVHRQLSSALSMPVGIKNGTDGDVQVAVDGVRAAAASHVFPGTDLDGRAALIRTTGNPDCHVILRGGSNGTNYDAASVAEACLRLEKAGLARRVVVDASHGNSNKDHNKQVDVVADIAERIAGGEREVVGVMLESFLVAGRQDLTLGRSADLVYGQSITDACLDWETTAAQLDRLAEAVAAR

SEQ ID NO: 27071 - DNA, 1044 bp, Legionella pneumophila str. Paris
  CDS (1)..(1044): transl_table=11
atgagttattccatcttaaaaaagctgccaccaatagaaaaaatcatccgggaattgccactatcccaccccgcctatctacaaattgctcaagaccggcaagagatcaaagctattttggaagggcgagataaacgtcttttgatgatagttggtccttgctcagcatggcctaaaaaagcggtattggaatacgctgagcgtttggtacaactcaacagcaaagtaaaacacgctttaaaattaatcatgcgcgtttacattcaaaagccaagaaccaccaaaggctggactggaccggtgaatcaacccgatttattttcaactcctgatattgaggcaggtataaaatatacccgggacatgatgataaaagtcattcaaatggggctccctatcgctgatgaggctcttttcacccataatgccaaaggatttcttgaacttctgtcctgggttgcaataggcgcccgtagttcagaggatcaagagcatcgaatttttgcctccgcccttgactgtgccgtaggattaaaaaaccctacacatggttcactcgctgtcggagtaaatagcctggttgcatcacagcatcctcatgttgctgtcttcgatggctatgaagtgcaaacccatggtaatcatcatgctcatctcgttctgcgtggttcaaaccaagctcccaattactccgtttctcatctggaggaagtcatgtactacatgggcatgcatcagatagtgaacccttctgtcattattgatgttagccatgacaactgtctggtgaatgggaaaaaaaatcatcagctacaaccagagattgcatttaatattctggaaagcatcaaaaatagacctgatttaaaacaactggtcaaaggattcatggtagaaagtttcatcaaagaaggtaatcaaaaattagattctatcaatcccgataacattgatttaagcgggttatccgttaccgatccttgcctcagttgggagaagacagaatcgttcctgttggaactggcggagagggaagcattatga

SEQ ID NO: 27072 - protein, 347 aa, Legionella pneumophila str. Paris
MSYSILKKLPPIEKIIRELPLSHPAYLQIAQDRQEIKAILEGRDKRLLMIVGPCSAWPKKAVLEYAERLVQLNSKVKHALKLIMRVYIQKPRTTKGWTGPVNQPDLFSTPDIEAGIKYTRDMMIKVIQMGLPIADEALFTHNAKGFLELLSWVAIGARSSEDQEHRIFASALDCAVGLKNPTHGSLAVGVNSLVASQHPHVAVFDGYEVQTHGNHHAHLVLRGSNQAPNYSVSHLEEVMYYMGMHQIVNPSVIIDVSHDNCLVNGKKNHQLQPEIAFNILESIKNRPDLKQLVKGFMVESFIKEGNQKLDSINPDNIDLSGLSVTDPCLSWEKTESFLLELAEREAL

SEQ ID NO: 27073 - DNA, 1056 bp, Photobacterium profundum SS9; identical to SEQ ID NO: 1407
  CDS (1)..(1056): transl_table=11

SEQ ID NO: 27074 - protein, 351 aa, Photobacterium profundum SS9; identical to SEQ ID NO: 1408

SEQ ID NO: 27075 - DNA, 1113 bp, Photobacterium profundum SS9
  CDS (1)..(1113): transl_table=11
ttgccttctactacccagaatagattgaggaaagccaccatgcaaaaagaccaactgaataatgtacatattcaagatgaatgcgtattgatcactcctcaacaactaaaagccaggttgccactcagtgaaacagcactgaacttcattcgtgaatctcgtcaaaccattgcagatattactcacaagcgtgaccaccgtttactcgtggtatgcggaccatgctcaattcacgatattgacgcagcgaaagcgtacgcccaaaaattgaagcagctttctgaagagctaagtgatcaactgtacattgtaatgcgcgtttattttgaaaaaccacgtacaacagttggttggaaaggtcttatcaatgacccgcatcttgatggctcttttgaagtggaagaaggtttacacattggtcgtcagctactcattgacttggttgaaatggggattcctttagcaacagaagcgcttgatccgatcagtcctcaatacttaggtgatttattcagttgggcagccattggtgcacgtaccactgaatcacaaacacaccgtgaaatggcaagtggcctttcaatgcccgttgggtttaaaaatggtactgatggaagtttggcaacggctatcaatgccatgaaagctgcagcttctgggcaccgttttatggggattaatccagaaggtcaggtggcgctgttgaacacccaaggaaaccctgatggccatgtaattttacgtggcggtaagcaaacgaattatgattcagtctcggttactgagtgtgaaaatgagatgcatcagtcaggtctttcaccatccttgatggtagactgtagccatgcgaattcacgtaaagattaccgtcgtcagccattagtcgctgaagatgtacttcatcaaatccgtgaaggtaataaatcgatcattggtttgatgattgaaagccatttaaatgaaggtagtcaaagcgctgatttaccgcgcgaagaaatggcttatggggtatcgattaccgatgcatgtatcagctgggaagatacagaaacactattacgtcgtacgcgtaaagaattaacgcctttcttaaaggatcgctgcgaaggataa

SEQ ID NO: 27076 - protein, 370 aa, Photobacterium profundum SS9; identical to SEQ ID NO: 1406

SEQ ID NO: 27077 - DNA, 1053 bp, Photobacterium profundum SS9; identical to SEQ ID NO: 1403
  CDS (1)..(1053): transl_table=11

SEQ ID NO: 27078 - protein, 350 aa, Photobacterium profundum SS9; identical to SEQ ID NO: 1404

SEQ ID NO: 27079 - DNA, 1083 bp, Photobacterium profundum SS9; identical to SEQ ID NO: 1401
  CDS (1)..(1083): transl_table=11

SEQ ID NO: 27080 - protein, 360 aa, Photobacterium profundum SS9; identical to SEQ ID NO: 1402

SEQ ID NO: 27081 - DNA, 1113 bp, Francisella tularensis subsp. tularensis SCHU S4
  CDS (1)..(1113): transl_table=11
atgataggtgataaaaactttgataaagtttctaatataaatataaaaaaggaaaaagtattgattcctgcagaagttctaatccaagatatacctcttttaaagacttcttttgaaactgtaagaaaatctcgtaaagaaatagctaatatcatccatggaaatgatgatagagttgctgtagttgtaggaccttgctctattcatgatcctgctgctgcaattgagtatgctactaaactcaaagagcaagttaagaaatttcataaagatatacttattataatgagggtatattttgaaaaaccacgtactacgattggttggaaaggatttatcaatgaccctgatttagataactcatataatatcaacaaaggtttacgtcttgcgcgtaatttattatcagatttaactaatatgggactaccgtgtgcaactgaatttctagatgtaattactccacaatactttgctgagctaatcacttggggagcaattggcgctagaactgttgaaagtcaggtacatagagaattagcttctggtctttctgcatcgattggttttaaaaatgccactaatggtgatgtccaagtagctgtagatgctgtaaaatctgccacttatccccatcacttcttaagtacgacaaaatctggttctacagcaatatttgcaactaaaggtaaccaaaatggtcatgtaattcttcgtggtggtgcctctggtcctaactttagtaaagagcatgttgatgactgtattgctaaactaaaaaaagctgatattaatactaaggtaatgattgactgtagtcacggcaatagtcaaaaagatcattctaagcaaattagcgtattagctgatatttgtgagcaaataaagcacagtaacgatatttttggggtaatgatagaaagtaatcttgtggctggtaatcaagatatcaataaaaaacctctcacttatgggcaaagtgtcacagataaatgcgttgactttgaagaaacagttaagatgctagaaatgttagctgaagcagtccaggtaagacgtggttctcaaactaaacaacaagttaaagaagagtcacaattttctttactgtaa

SEQ ID NO: 27082 - protein, 370 aa, Francisella tularensis subsp. tularensis SCHU S4
MIGDKNFDKVSNINIKKEKVLIPAEVLIQDIPLLKTSFETVRKSRKEIANIIHGNDDRVAVVVGPCSIHDPAAAIEYATKLKEQVKKFHKDILIIMRVYFEKPRTTIGWKGFINDPDLDNSYNINKGLRLARNLLSDLTNMGLPCATEFLDVITPQYFAELITWGAIGARTVESQVHRELASGLSASIGFKNATNGDVQVAVDAVKSATYPHHFLSTTKSGSTAIFATKGNQNGHVILRGGASGPNFSKEHVDDCIAKLKKADINTKVMIDCSHGNSQKDHSKQISVLADICEQIKHSNDIFGVMIESNLVAGNQDINKKPLTYGQSVTDKCVDFEETVKMLEMLAEAVQVRRGSQTKQQVKEESQFSLL

SEQ ID NO: 27083 - DNA, 1089 bp, Haemophilus influenzae R2866
  CDS (1)..(1089)
atggctaaagagaaaattgaaattgtcgtggcaaacgacgatacgcgaattgaaaaagtcgatcaggtgttaccacccattgccttattagaaaaatacccagcaagtgaacatgctgcggcgttagtgaagcaaactcgtcatgaggcacataatattattcatggtaaagatgatcgtttattagtcgtgattgggccttgctctattcatgatccgaaagttgccattgaatatgcgactcgtttaaaaccattacgtgaaaaatacaaagatagccttgaaattattatgcgtgtgtattttgagaaaccgcgtacaacggtgggttggaaaggtctaattaatgatccatatttgaatgatacttatcgtttaaatgatgggttacgtattgcacggaaattactttcagatattaatgatcttggtgtgcctgcagcgggcgagtttttagatatgattacacctcagtatttggcagattttatgagctggggggcgattggggctagaacaacagaatcacaagttcatcgtgagttggcttcaggtttatcttgtgctgttgggtttaaaaatgccactaatggtggtgtgaaagtcgctttagatgcaattggtgcggcggaagctccccactatttcttatctgtcactaaatttggtcattctgcaattgtttctacaaaagggaatgaagattgccatattattttacgaggtggagataaaggccctaactatagtgctgaagatgtagaaaaagtttgtgctgatattgaaaaaacagggcgtattccacacgttatggttgattttagccatgcaaacagcagtaaacaatataaaaagcaaatggatgtttgccaagacgtatgtaatcagattgcatttggttctaaacaaatctttggcgtaatggtggaaagccatttagtggaaggtcgtcaagatttagttgatggcaaagcgcagacttatggacaaagtattacggatgcgtgcattggatgggaagattctgaaagattattgcaacaactttctgatgcagttattgctagacgtaaagcgacgagtaattaa

SEQ ID NO: 27084 - protein, 362 aa, Haemophilus influenzae R2866
MAKEKIEIVVANDDTRIEKVDQVLPPIALLEKYPASEHAAALVKQTRHEAHNIIHGKDDRLLVVIGPCSIHDPKVAIEYATRLKPLREKYKDSLEIIMRVYFEKPRTTVGWKGLINDPYLNDTYRLNDGLRIARKLLSDINDLGVPAAGEFLDMITPQYLADFMSWGAIGARTTESQVHRELASGLSCAVGFKNATNGGVKVALDAIGAAEAPHYFLSVTKFGHSAIVSTKGNEDCHIILRGGDKGPNYSAEDVEKVCADIEKTGRIPHVMVDFSHANSSKQYKKQMDVCQDVCNQIAFGSKQIFGVMVESHLVEGRQDLVDGKAQTYGQSITDACIGWEDSERLLQQLSDAVIARRKATSN

SEQ ID NO: 27085 - DNA, 1089 bp, Amycolatopsis orientalis; identical to SEQ ID NO: 1369
  CDS (1)..(1089): transl_table=11

SEQ ID NO: 27086 - protein, 362 aa, Amycolatopsis orientalis; identical to SEQ ID NO: 1370

SEQ ID NO: 27087 - DNA, 1035 bp, Escherichia coli
  CDS (1)..(1035): transl_table=11
atgcagtcagtcagtaaatcaatctaccgagggaagttgcttagcagtttacctgctgtgggcgagattcataaagaaatcgcagtatcagaagaaaccgtaacatggatctctctgcaacgagagattatagcgaatattttgctgggaaaagatcctcgcttgcttgtgattgttggtccatgctcaatccatgacgttcaggctgccgttgaatatgcgaaacgattgtccgtattacagaataagtacttatcgcaaatgtacattgtaatgcgcacttattttgagaaacctcgaactcgtaaaggctggaaaggaataatgcacgatcctgatctaaatggaagctataatgttgagaaagggatacgatatgctcgccagtgtttgtcctcaatcacaacaatgcgtgtcgcaaccgctacagaattcctcgatcctttccttactccctatattgctgatttaatatgttggggggctgttggtgccagaactactgaatcacaaacgcatcgtcaacttgcgtctggtttacattgtcctgttggatttaaaaacagcactgatggaaatattaacttagctattgatgctattcttgcagcccgtgaacaacatgttgtatatatgacatctttaacaaaatgtatatctaccctattaaccgatggcaatccacatggacatctcatattacgtggtggtagagagccgaactatggtttgtcggatataacgaaggcagtgaaattaatgcatgatgaaggtatcaatcatcgtctgataattgactgtagccatggtaatagtggtaaagtggctgaacggcaaatctctgttgctcgtgaagtcattgataatcggaaaaagatgccgggatatgtagctggaattatgctggaaagctttttacaaggtggaaaacaatcagacagccttccgcgagagtatggtcagtctgttactgatgagtgtctttcatggcaacagacagaacaattattatcaactctggcagcacaactttaa

SEQ ID NO: 27088 - protein, 344 aa, Escherichia coli
MQSVSKSIYRGKLLSSLPAVGEIHKEIAVSEETVTWISLQREIIANILLGKDPRLLVIVGPCSIHDVQAAVEYAKRLSVLQNKYLSQMYIVMRTYFEKPRTRKGWKGIMHDPDLNGSYNVEKGIRYARQCLSSITTMRVATATEFLDPFLTPYIADLICWGAVGARTTESQTHRQLASGLHCPVGFKNSTDGNINLAIDAILAAREQHVVYMTSLTKCISTLLTDGNPHGHLILRGGREPNYGLSDITKAVKLMHDEGINHRLIIDCSHGNSGKVAERQISVAREVIDNRKKMPGYVAGIMLESFLQGGKQSDSLPREYGQSVTDECLSWQQTEQLLSTLAAQL

SEQ ID NO: 27089 - DNA, 1086 bp, Amycolatopsis methanolica
  CDS (1)..(1086): transl_table=11
atgtctctcagcgcaggccccgcggaaatttccgaaggcctcgacaaccagcgcaccctcggcgtcagcccgctgatctcccccgccctgctgcggcaggagctgccggtggacgcggcgatcgccaagaccgtcgcgcatggccggtcgtcggccgtcgacatcctccacggcgacgacgaccgcctcatcgtggtcgtcggcccctgctcggtgcacgaccccgcggccgccctcgactacgcccaccggctggccgagcacgccgccggtgtgcgcgacgaactgcacgtgatcatgcgggtgtacttcgagaagccacgcaccacgctgggctggaagggcctcatcaacgacccggacctggacggcagctacgccgtcaacaagggcctgcggatggcgcgcaagctgctgctggacatctccgcactggggctgccggtcgggtgcgagttcctggacccgatcacgccgcagttcatcgccgacaccgtgagctggggatccatcggcgcgcggaccgcggccagccaggtgcaccgccagctgtgcagcgcgctgtccatgccggtggggatcaagaactccactgagggcgatgtgcaggtggcggtggacgcgacccgcgcggcggcggcgagccacgtgttcgcgggcatcaacaacgacggcctggcggcgctgttcaccacggcgggcaacccggactgccacgtcatcctgcgcggcggttccgcaggcccgaactacgacgcggcgacggtggccgacacgctcgcgcggcaggccaaggccgggctgccggagcgggtgatcatcgacgcgagccacggcaacagcggcaaggaccacgtccgccagggcgtggtggccggggagatcgcggaccggatcgccgccggcgagcgcgggatcgccgggatcatgctggagagcttcctcgaggccgggcggcaggacctggtgctggggcacgcgggcgagctgacctacgggcagtcgatcaccgatgcgtgcctggactggcgaagcacgggtgagctgctggaccgcctctcggaggcggtggcggcgcggcggtga

SEQ ID NO: 27090 - protein, 361 aa, Amycolatopsis methanolica; identical to SEQ ID NO: 1414

SEQ ID NO: 27091 - DNA, 1098 bp, Amycolatopsis balhimycina
  CDS (1)..(1098): transl_table=11
gtggccgcgatgacccacaccgtcgccacgaccgacctcgacaaccagcgcatcgagcggatcgtccccctggtcacccccgccctgctgcatcacgaactgccgctcagcgccaccgcggccgagacggtgcgaaagggccgcgagagcgtcgtccgcgtcctcgacggcacggacgaccggctgctcgtgatcaccgggccgtgctccatccacgaccccgccgcggcgctcgactacgccggccacctcgccgccatcgccggcgaggtcgccggcgacctgctcgtcgtcatgcgcgtgtacttcgagaaaccccggacgatcggcggctggaaggggctcatcaacgacccccacctcgacggcaccggcgacgtcaaccacgggctgcgcacggcccggcacctcctgctggagctcgccgaacgcggcctgcccgccgcgtgcgaatggctggacaccaccattcccgcgtacttcgcggacacggtctcgtggggcgccatcggcgcccgcaccgtggaaagccagaaccaccgcatgctcgccagcggcctgtccatgcccgtcggcttcaagaaccgccgcgacggcgacatcaccgtcgccatcgacgcgatccgggccgccgcggtccgccacgtggtccccggcgtcgaccccggcgggttgcccgccatcctgcacacggcgggcaacccggactgccacgtcgtcctgcgcggtggtgacggcgcgcccaaccacgactccgcgtccgtccacaagacactgaccgcgctggaggccgcgggcctgcccggccgggtggtgatcgacgccagccacgacaacagcggcaaggaccaccaccgccagcccctcgtcgcggccgagatcgcgggccaggtcgagaacgggcggaacggcatcgtcggggtgatgctcgagtccaacctccgcgccggccgccaggacctccagccgggccgtccgccggcatacggccagtccatcaccgacgcctgcatcgacgtccccaccacccggacggtcctccacggcctcgccgcggcggccgcggcccggcgaaagctcggcaagcaagcaagctga

SEQ ID NO: 27092 - protein, 365 aa, Amycolatopsis balhimycina; identical to SEQ ID NO: 1424

SEQ ID NO: 27093 - DNA, 1134 bp, Phytophthora infestans
  CDS (1)..(1134)
atgccgagcacccagccgcaccctgcacctgaaaccgaacgtgtgaccaagcgtcagcgtctagaagaccgtaatgtcgtcgccattaagccgctggtgcctcctgcctgcgtcctggaggaactgcccgtgactcctgaggtgcacgaactggtggacgctacgcgcgacgccgtgtcccgcatcctgcacggtcaagatgaccgcctcgtcgtggtcgtcggcccttgctccattcacgacgtggacgctgccatggactacgccaagcgtctgaaaactcttgcgggcgagctgaacggagaacttctggtgatcatgcgcacctacttcgagaagccccgaacgactgtgggctggaagggtctgatcaatgacccggacctcgaccagtctttcaagatcaacaagggtattcgcattgcccgtaagctgttgctggacgtgaattcgctgggtcttcccgtgagtctggagttcctcgacaccatctcgccccagttcacctcagacctcatttcgtggggagccatgggcgcgcgtactaccgagtcccagctgcaccgcgaacttaccagtggcctgtcgattcctgtgggattcaagaatggcacgggcggcaacgccaaggtggcagtggacgctgccgttgcttcgtcgcagcctcacaacttcctcggtctgaacgaacacggattggcatcgattgtgcgcaccaagggcaacaaggactgccacgtcatcctgcgcggcggctccgatggccccaactacgagcaaaagtacattgatgaggctgctgccatgctaaagaaggctaagcagccgtccaaaatcatggtggactgctcgcacggcaactcgcgcaagctgcacgctaaccagcgaaaggtagttagctacctggctggtattgtttccgagggaaacacgaatgtgcttggtgttatgatcgagtccaatatcgtggagggcaaccagtcgcttggcgacgacccgtccaagctcgtctacggccagagcatcacggatgcgtgcatcaactgggatgacacagtcacgacgctgaaggaacttgcaggtgccgtcgcaaagcggcgcaaacttgatgccgcgaacccggccaccaagtag

SEQ ID NO: 27094 - protein, 377 aa, Phytophthora infestans; identical to SEQ ID NO: 1522

SEQ ID NO: 27095 - DNA, 1035 bp, Escherichia coli; identical to SEQ ID NO: 1535
  CDS (1)..(1035): transl_table=11

SEQ ID NO: 27096 - protein, 344 aa, Escherichia coli; identical to SEQ ID NO: 1536

SEQ ID NO: 27097 - DNA, 1086 bp, Stigmatella aurantiaca
  CDS (1)..(1086): transl_table=11
atgaccgctcgcactgaaaatctgaacgtagttggtttcgaccacatgccctccccctccgagatcaaggagcgcgtgccgatgacaagcctcgcagccgacaccgtgctctccggacggcgcgcgctgatggacatcctcaaccgcaaggatccacgcatcttcgtcatcgtgggcccctgctccatacatgatcccaaggccggcatcgagtacgcccgtcgacttcgcaacctctccgacgagatccgggagacgatcctcgtggtgatgcgggtgtacttcgagaaaccgcgcacctccaccggctggaagggcttcatcaacgacccgaggatggacgactccttccacatcgaggaaggcatggagcggggccgccgcttcttgagggacgtggccgaactgggcctgcccgcggcgaccgaagcgctcgatcccattgccccccagtattacggcgacctgatttcctggacggcgattggcgcgcgcacggcggagtcccagacccaccgcgagatggcctcggggctgtcgacgcccgtgggcttcaagaacggaaccgacggctcgctggacgcggcggtcaacggcatcctctccgcctcgcacccccacagcttcctggggctgaacgagggcggtgaggcggcgatcatccgcaccggaggcaatgcctacagccacctggtgctccgaggcggagggggacggcccaactacgacacggtgtccatcgcgctcgccgaacaggcgctcaccaaggccaagctgccggggaacatcgtggtggactgctcccacgccaactcctggaagaagccggagttgcagcccctggtcatgcgcgacgtggtgcaccagatccgcgaaggcaaccgctccgtggtgggtttgatgctcgaaagcttcctggaagcgggcaaccagcccatccccgccgatctctcgaagctgcgctacggctgctcggtgaccgatgcgtgcgtggactggggcaccaccgaagagacgctgcgcaacgcccacaaggtgctgcgcgaggcattgcccacgcggagctcgggccgcccagcgccctga

SEQ ID NO: 27098 - protein, 361 aa, Stigmatella aurantiaca; identical to SEQ ID NO: 1538

SEQ ID NO: 27099 - DNA, 1083 bp, Amycolatopsis mediterranei; identical to SEQ ID NO: 1541
  CDS (1)..(1083): transl_table=11

SEQ ID NO: 27100 - protein, 360 aa, Amycolatopsis mediterranei; identical to SEQ ID NO: 1542

SEQ ID NO: 27101 - DNA, 1125 bp, Emericella nidulans; identical to SEQ ID NO: 1547
  CDS (1)..(1125)

SEQ ID NO: 27102 - protein, 374 aa, Emericella nidulans; identical to SEQ ID NO: 1548

SEQ ID NO: 27103 - DNA, 1062 bp, Vibrio cholerae
  CDS (1)..(1062): transl_table=11
atgccactgaaaaccgatgaattaagaacccaagcattgggacctatgcctactccggcagaattaagtcacgcacatcctatcactgatgaagttgcgctacggatcgcgcagtctcgtcgccaaattgaaagcattcttaccggtgaagatgatcgcctattagtgatagtggggccttgttcggtgcatgataccgatgccgcactcgactacgctcgccgccttgctgcgctacaagaaaactatactgatgagctttttgtggtgatgcggacctatttcgaaaaaccacgtactgtggtgggttggaaaggactgatcaccgatccaaacttagatggctcttacgctttagaaaccggtctcaataaagcgcgaaagttgctgcttgatgtaaacaagctcggattggctaccgcgaccgagtttcttgatatgatcacaggccaatacatcgcggaccttatcacgtggggcgcaattggtgcgcgtaccactgagtcgcaaattcaccgtgagatggcctctgcgctctcctgccctgtgggttttaaaaatggcactaacggtaatgtgaaaatcgcgattgatgcgatccgcgcggccaaagcgtcacattacttctattcaccagataagaatggtcgtatgacggtttaccgtaccagtggtaacccatttggtcatattattctgcgtggtggtgatagcggaccaaactttgatgcggcttcgattaatgaagcttgccagcagttggcgcaattcaacttaccagagcgtttagtggtggatttcagccacgcgaactgtcaaaaacaacaccgtaaacaagtggatgtcgcgcgcgatatttgccagcaaattgaagctggcagccacaaaattgcgggcatcatggcggaaagcttccttgtggaaggcaatcagccaatgcacgatctcaataatctgacttatggtctgtcgatcaccgatccttgtttaggatggaaagataccgccaccatgcttgatatgctggctcaatcgatcaaagtccgtcgttctcgtcattaa

SEQ ID NO: 27104 - protein, 353 aa, Vibrio cholerae; identical to SEQ ID NO: 1552

SEQ ID NO: 27105 - DNA, 942 bp, Neisseria meningitidis
  CDS (1)..(942): transl_table=11
atgacacaccattaccccacagacgatattaagattaaagaagttaaagagttgttgccgccgattgcccatctttacgagctgccgatttccaaagaggcttcgggcttggttcaccgcacccgtcaggaaatttccgatttggttcacggcagggacaagcggctgttggttattatcgggccgtgttcgattcacgatccgaaagcggcgttggaatatgcggagcgtttgttgaaactccgcaagcagtatgaaaacgagcttttgattgtgatgcgcgtttatttcgagaagccgaggacgacggtgggttggaaaggtttgattaacgacccgcatttggacggtacgtttgacatcaatttcggtttgcgtcaggcgcgcagcctgttgttgtcgctgaacaatatgggtatgcctgcctctaccgagtttttggatatgattacgccgcaatattatgcggacttgatttcttggggggcaatcggtgcgcggacgaccgaaagccaagttcaccgcgaattggcaagcgggctgtcctgccccgtcggctttaaaaacggtacggacggcaatttgaagattgccatcgacgcaatcggtgcggcgagccattcgcatcatttcctgtctgtaaccaaggccgggcattccgccattgtccataccggcggcaatcctgactgtcatgtcattttgcgcggcggaaaagagccgaattatgatgcgggacacgtcagcgaggcggcggaacaactgcgtgcggcaggggtaaccgacaagctgatgatagattgcagccacgccaacagccgcaaggattacacccggcagatggaagtggcacaagatattgccgcccaattggaacaggacggcggcaatatcatgggcgtgatggtggaaagccatttggtcgaaggcaggcaggactag

SEQ ID NO: 27106 - protein, 313 aa, Neisseria meningitidis
MTHHYPTDDIKIKEVKELLPPIAHLYELPISKEASGLVHRTRQEISDLVHGRDKRLLVIIGPCSIHDPKAALEYAERLLKLRKQYENELLIVMRVYFEKPRTTVGWKGLINDPHLDGTFDINFGLRQARSLLLSLNNMGMPASTEFLDMITPQYYADLISWGAIGARTTESQVHRELASGLSCPVGFKNGTDGNLKIAIDAIGAASHSHHFLSVTKAGHSAIVHTGGNPDCHVILRGGKEPNYDAGHVSEAAEQLRAAGVTDKLMIDCSHANSRKDYTRQMEVAQDIAAQLEQDGGNIMGVMVESHLVEGRQD

SEQ ID NO: 27107 - DNA, 942 bp, Neisseria gonorrhoeae
  CDS (1)..(942): transl_table=11
atgacacaccattaccccacagacgatattaagattaaagaagttaaagagttgttgccgccgattgcccatctttacgagctgccgatttccaaagaggcttcgggcttggttcaccgcacccgtcaggaaatttccgatttggttcacggcagggacaggcggctgttggtcattatcgggccgtgttcgattcacgatccgaaagcggcgttggaatatgcggaacgtctgttgaaactccgcaagcggtatgaaaacgagcttttgatcgtgatgcgcgtttatttcgagaagccgagaacgacggtgggttggaaaggtttgattaacgacccgcatttggacggtacgttcgacatcaatttcggtttgcgtcaggcgcgcagtctgttgttgtccctgaataatatgggcatgcctgcctctaccgaatttttggatatgattacaccccagtattatgccgacctgatttcttggggggcaatcggcgcgcggacgaccgaaagccaagtccaccgcgaattggcaagcggtctgtcctgccccgtcggctttaaaaacggtacggacggcaatttgaagattgcgatcgacgcaatcggtgcggcgagccattcgcatcatttcttgtctgtaaccaaggccgggcattccgccattgtccataccggcggcaatcccgactgtcatgtcattttgcgcggcggaaaagagccgaattatgatgcgggacacgtcagcgaggcggtggaacaactgcgtgcggcaggggtaaccgacaagctgatgatcgattgcagccacgccaacagccgcaaggattacacccggcagatggaagtggcacaagacattgccgaccaattggaacaggacggcggcaatatcatgggcgtgatggtggaaagccatttggtcgaaggcaggcaggactag

SEQ ID NO: 27108 - protein, 313 aa, Neisseria gonorrhoeae
MTHHYPTDDIKIKEVKELLPPIAHLYELPISKEASGLVHRTRQEISDLVHGRDRRLLVIIGPCSIHDPKAALEYAERLLKLRKRYENELLIVMRVYFEKPRTTVGWKGLINDPHLDGTFDINFGLRQARSLLLSLNNMGMPASTEFLDMITPQYYADLISWGAIGARTTESQVHRELASGLSCPVGFKNGTDGNLKIAIDAIGAASHSHHFLSVTKAGHSAIVHTGGNPDCHVILRGGKEPNYDAGHVSEAVEQLRAAGVTDKLMIDCSHANSRKDYTRQMEVAQDIADQLEQDGGNIMGVMVESHLVEGRQD

SEQ ID NO: 27109 - DNA, 1107 bp, Candida albicans
  CDS (1)..(1107): transl_table=12
atgtttattacaaacgaacacgttggtgacagaagtcgtatggaagattggagaatccgtggttacgatccattaactcctccagatcttttacaacatgaatacccattaactcctgaatcacagaagattatcgttgaaggtagaaatgctgcttgtgatattttgaacggcaaagaccgaagattgattggaccttgttcgattcatgatcctcaagctgccttggattactgtgaaagattatatcaagcttctgaaaaacacaagggtgaattattgattgttatgagagcatacttggaaaaaccaagaaccacagttggttggaaaggtttaattaacgacccagatatcgatggtaccttccatataaataaggggttgagaattgctagaaagttgtttgttcaattaacttcaaaattaccaattgctggtgaaatgttggatacaatctcacctcaatttttatctgatttattctcagtgggggctattggtgcaagaaccaccgaatcgcaattgcacagagagttggcatctggttatcattcccagttggattcaaaaacggtaccgatggtactttgggtgttgccattgacgcctttgagagctgcttctcatccacatcatttcctttcagtcacaaaacctggtgttgttgctattgttgggactgatgggaaccaagactgttttgttatattaagaggtggtaagaagggtacaaactatgatgccaaatccgtacaagaaacacaagaagaattaatcaaatcaaaagttgttaccgaaatgaaacctggtccaagaattatggttgattgttctcatggtaattctaataaagatcatagaaaccaaccgaaagttgcccaagttgttgctgaacaagtggccggtggtgataaatccatatgtggattaatgattgagagtaatataaatgatggaagacaagatgttccaccaaaggaacaaggtggtaaagatgctttgaaatacggtgtttctattaccgatgcttgtattggttgggaaaccacagaagaagttttggaggttttagccaatgctgtcaaaaccagaagatctttatag

SEQ ID NO: 27110 - protein, 368 aa, Candida albicans; identical to SEQ ID NO: 1362

SEQ ID NO: 27111 - DNA, 1071 bp, Escherichia coli; identical to SEQ ID NO: 1333
  CDS (1)..(1071): transl_table=11

SEQ ID NO: 27112 - protein, 356 aa, Escherichia coli; identical to SEQ ID NO: 1334

SEQ ID NO: 27113 - DNA, 1071 bp, Salmonella typhimurium; identical to SEQ ID NO: 2245
  CDS (1)..(1071): transl_table=11

SEQ ID NO: 27114 - protein, 356 aa, Salmonella typhimurium; identical to SEQ ID NO: 2246

SEQ ID NO: 27115 - DNA, 1113 bp, Saccharomyces cerevisiae; identical to SEQ ID NO: 1363
  CDS (1)..(1113)

SEQ ID NO: 27116 - protein, 370 aa, Saccharomyces cerevisiae; identical to SEQ ID NO: 1364

SEQ ID NO: 27117 - DNA, 1113 bp, Candida albicans
  CDS (1)..(1113): transl_table=12
atgagtaaaactcctgttcctaccgaatacgacgacacaagaatattgggttacgatcctttagttccaccagccttattacaacacgaaataaaggcatctgccgaatcattggatgttgttataaaaggccgttacgattctgcccaaatccttaagggtaatgatgacagatgtattgtaattgttggtccatgttcaattcacgatcctccacaagccttagaatatggtaaacgtttgaagaaattggctgatgaattaaaagatgacttggtgattatcatgagagcttatttggaaaaaccaagaactaccgttggttggaaaggtttgatcaatgatcctgatgttgataattcttttgatattaaccgtgggttgaagatatctcgtcaattatattccgatttgactagtgttgttggattaccaattggatcagaaatgttagacaccatttctccacaatacttttccgatttcttgagttttggggccattggagctagaaccaccgaatcacaattacacagagaattagcttctggtttaagcttcccaattggatttaaaaatggtaccgatggtggtttagccgttgccttggatgccgtgcaagcttcttcaaaaggacatcacttcatgggtgtcaccaaaaacggtatggctgccattaccactactaaaggtaacgattgttgtttcattatattaagaggtggtaaaaaaatcaccaattacgatgttgaatcagttaaagctgctaaagaagctattgccaaatgtaccgatccaagtatcaagttgatggttgattgctctcacgacaactcaagaaaagactacagaaaccaacctcaagtattagacagtgttgctgaacaaataagtaatggtgaagactccattattggggttatgattgaatccaatattcatgaaggtaaacaaccaatgcccccagcaggtagtggtaaagaagcattgaaatacggtgtgtctatcaccgatggatgtgtttcttgggaaaccactgttgaaatgttgaccaaattgagtcaagcagtccaaactagaagaagtttaaagaaacaaaaagtttccaattaa

SEQ ID NO: 27118 - protein, 370 aa, Candida albicans; identical to SEQ ID NO: 1554

SEQ ID NO: 27119 - DNA, 1101 bp, Corynebacterium glutamicum
  CDS (1)..(1101): transl_table=11
atgagttctccagtctcactcgaaaacgcggcgtcaaccagcaacaagcgcgtcgtggctttccacgagctgcctagccctacagatctcatcgccgcaaacccactgacaccaaagcaggcttccaaggtggagcaggatcgccaggacatcgctgatatcttcgctggcgacgatgaccgcctcgttgtcgttgtgggaccttgctcagttcacgatcctgaagcagccatcgattacgcaaaccgcctggctccgctggcaaagcgccttgatcaggacctcaagattgtcatgcgcgtgtacttcgagaagcctcgcaccatcgtcggatggaagggattgatcaatgatcctcacctcaacgaaacctacgacatcccagagggcttgcgcattgcgcgcaaagtgcttatcgacgttgtgaaccttgatctcccagtcggctgcgaattcctcgaaccaaacagccctcagtactacgccgacactgtcgcatggggagcaatcggcgctcgtaccaccgaatctcaggtgcaccgccagctggcttctgggatgtctatgccaattggtttcaagaacggaactgacggaaacatccaggttgcagtcgacgcggtacaggctgcccagaacccacacttcttcttcggaacctccgacgacggcgcgctgagcgtcgtggagaccgcaggcaacagcaactcccacatcattttgcgcggcggtacctccggcccgaatcatgatgcagcttcggtggaggccgtcgtcgagaagcttggtgaaaacgctcgtctcatgatcgatgcttcccatgctaactccggcaaggatcatatccgacaggttgaggttgttcgtgaaatcgcagagcagatttctggcggttctgaagctgtggctggaatcatgattgagtccttcctcgttggtggcgcacagaaccttgatcctgcgaaattgcgcatcaatggcggtgaaggcctggtgtacggacagtctgtgaccgataagtgcatcgatattgacaccaccatcgatttgctcgctgagctggccgcagcagtaagggaacgccgagcagcagccaagtaa

SEQ ID NO: 27120 - protein, 366 aa, Corynebacterium glutamicum
MSSPVSLENAASTSNKRVVAFHELPSPTDLIAANPLTPKQASKVEQDRQDIADIFAGDDDRLVVVVGPCSVHDPEAAIDYANRLAPLAKRLDQDLKIVMRVYFEKPRTIVGWKGLINDPHLNETYDIPEGLRIARKVLIDVVNLDLPVGCEFLEPNSPQYYADTVAWGAIGARTTESQVHRQLASGMSMPIGFKNGTDGNIQVAVDAVQAAQNPHFFFGTSDDGALSVVETAGNSNSHIILRGGTSGPNHDAASVEAVVEKLGENARLMIDASHANSGKDHIRQVEVVREIAEQISGGSEAVAGIMIESFLVGGAQNLDPAKLRINGGEGLVYGQSVTDKCIDIDTTIDLLAELAAAVRERRAAAK

SEQ ID NO: 27121 - DNA, 1089 bp, Haemophilus influenzae; identical to SEQ ID NO: 1359
  CDS (1)..(1089): transl_table=11

SEQ ID NO: 27122 - protein, 362 aa, Haemophilus influenzae; identical to SEQ ID NO: 1360

SEQ ID NO: 27123 - DNA, 1113 bp, Saccharomyces cerevisiae
  CDS (1)..(1113)
atgagtgaatctccaatgttcgctgccaacggcatgccaaaggtaaatcaaggtgctgaagaagatgtcagaattttaggttacgacccattagcttctccagctctccttcaagtgcaaatcccagccacaccaacttctttggaaactgccaagagaggtagaagagaagctatagatattattaccggtaaagacgacagagttcttgtcattgtcggtccttgttccatccatgatctagaagccgctcaagaatacgctttgagattaaagaaattgtcagatgaattaaaaggtgatttatccatcattatgagagcatacttggagaagccaagaacaaccgtcggctggaaaggtctaattaatgaccctgatgttaacaacactttcaacatcaacaagggtttgcaatccgctagacaattgtttgtcaacttgacaaatatcggtttgccaattggttctgaaatgcttgataccatttctcctcaatacttggctgatttggtctccttcggtgccattggtgccagaaccaccgaatctcaactgcacagagaattggcctccggtttgtctttcccagttggtttcaagaacggtaccgatggtaccttaaatgttgctgtggatgcttgtcaagccgctgctcattctcaccatttcatgggtgttactaagcatggtgttgctgctatcaccactactaagggtaacgaacactgcttcgttattctaagaggtggtaaaaagggtaccaactacgacgctaagtccgttgcagaagctaaggctcaattgcctgccggttccaacggtctaatgattgactactctcacggtaactccaataaggatttcagaaaccaaccaaaggtcaatgacgttgtttgtgagcaaatcgctaacggtgaaaacgccattaccggtgtcatgattgaatcaaacatcaacgaaggtaaccaaggcatcccagccgaaggtaaagccggcttgaaatatggtgtttccatcactgatgcttgtataggttgggaaactactgaagacgtcttgaggaaattggctgctgctgtcagacaaagaagagaagttaacaagaaatag

SEQ ID NO: 27124 - protein, 370 aa, Saccharomyces cerevisiae; identical to SEQ ID NO: 1366

SEQ ID NO: 27125 - DNA, 1047 bp, Buchnera aphidicola subsp; identical to SEQ ID NO: 1341
  CDS (1)..(1047): transl_table=11

SEQ ID NO: 27126 - protein, 348 aa, Buchnera aphidicola subsp; identical to SEQ ID NO: 1342

SEQ ID NO: 27127 - DNA, 1047 bp, Buchnera aphidicola subsp; identical to SEQ ID NO: 1555
  CDS (1)..(1047): transl_table=11

SEQ ID NO: 27128 - protein, 348 aa, Buchnera aphidicola subsp; identical to SEQ ID NO: 1556

SEQ ID NO: 27129 - DNA, 1047 bp, Buchnera aphidicola subsp; identical to SEQ ID NO: 1557
  CDS (1)..(1047): transl_table=11

SEQ ID NO: 27130 - protein, 348 aa, Buchnera aphidicola subsp; identical to SEQ ID NO: 1558

SEQ ID NO: 27131 - DNA, 1047 bp, Escherichia coli O157
  CDS (1)..(1047): transl_table=11
atgaacagaactgacgaactccgtactgcgcgtattgagagcctggtaacgcccgccgaactcgcgctacggtatcccgtaacgcctggcgtcgccacccatgtcaccgactcccgccgcagaattgaaaaaatactcaatggtgaagataagcgactgttggtcattattggcccctgctcgatccacgatctcaccgctgcaatggagtacgccacccgtctgcagtcgctgcgcaaccagtaccagtcacggctggaaatcgtaatgcgcacctattttgaaaaaccacgaactgttgtcggctggaaaggactaatctccgatccagatttaaacggcagctatcggataaatcacggtctggagctggcgcgcaaattacttttacaggtaaatgagctgggcgtcccaaccgcgactgagttcctcgatatggtgaccggtcagtttattgctgatttaatcagttggggcgcgattggcgcacgtactaccgaaagtcagatccaccgtgaaatggcttcggcactctcctgtccggtaggttttaaaaatggtaccgatggcaatacgcggattgctgtggatgctatccgcgcagcccgcgccagccatatgttcctctcgccagacaaaaatggtcagatgaccatctatcagaccagcggcaacccgtatggccacattattatgcgtggcggcaaaaaaccgaattatcatgccgatgatatcgccgcagcctgcgatacgctgcacgagtttgatttacctgaacatctggtggtggatttcagccacggtaactgccagaagcagcaccgtcgccagttagaagtttgtgaggatatttgtcagcaaatccgcaatggctctacggcgattgctggaattatggcggaaagtttcctgcgcgaaggaacgcaaaaaatcgtcggcggtcagccgctcacttacggtcaatccattaccgacccgtgtctgggctgggaagataccgaacgcctggtcgaaaaactagcctctgcggtagatacccgcttctga

SEQ ID NO: 27132 - protein, 348 aa, Escherichia coli O157
MNRTDELRTARIESLVTPAELALRYPVTPGVATHVTDSRRRIEKILNGEDKRLLVIIGPCSIHDLTAAMEYATRLQSLRNQYQSRLEIVMRTYFEKPRTVVGWKGLISDPDLNGSYRINHGLELARKLLLQVNELGVPTATEFLDMVTGQFIADLISWGAIGARTTESQIHREMASALSCPVGFKNGTDGNTRIAVDAIRAARASHMFLSPDKNGQMTIYQTSGNPYGHIIMRGGKKPNYHADDIAAACDTLHEFDLPEHLVVDFSHGNCQKQHRRQLEVCEDICQQIRNGSTAIAGIMAESFLREGTQKIVGGQPLTYGQSITDPCLGWEDTERLVEKLASAVDTRF

SEQ ID NO: 27133 - DNA, 1047 bp, Escherichia coli O6
  CDS (1)..(1047): transl_table=11
atgaacagaactgacgaactccgtactgcgcgtattgagagcctggtaacgcccgccgaactcgcgctacggtatcccgtaacgcctggcgtcgccacccatgtcaccgactcccgccgtagaattgaaaaaatactgaatggtgaagataagcgactgttggtcattattggcccctgctcgatccacgatctcaccgctgcgatggagtacgccacccgtctgcagtcgctgcgcaaccagtaccagtcacggctggaaatcgtaatgcgcacctattttgaaaaaccacgaacggttgtcggctggaaaggactcatctccgatccagatttaaacggtagctatcgggtaaatcacggtctggagctggcgcgcaaattacttttacaggtaaatgagctgggcgtccctaccgcgactgagttcctcgatatggtgaccggtcagtttattgctgatttaatcagttggggtgcgattggcgcacgtactaccgaaagtcagatccaccgcgaaatggcttcggcactctcctgtccggtgggttttaaaaatggtaccgatggcaacacgcggattgccgtggatgctatccgcgcagcccgcgccagccatatgttcctctcgccagacaaaaatggtcagatgaccatctatcagaccagcggcaacccgtatggccacattattatgcgtggtggcaaaaaaccgaattatcatgccgatgatatcgccgcagcctgcgatacgctgcacgagtttgatttacctgaacatctggtggtggatttcagccacggtaactgccagaagcagcaccgtcgccagttagaagtttgtgaggatatttgtcagcaaatccgcaatggctctacggcgattgctggaattatggcggaaagtttcctgcgcgaaggaacgcaaaaaatcgtcggcggtcagccgctcacttacggtcaatccattaccgacccgtgtctgggctgggaagataccgaacgcctggtcgaaaaactcgcctctgcggtagatactcgcttctga

SEQ ID NO: 27134 - protein, 348 aa, Escherichia coli O6
MNRTDELRTARIESLVTPAELALRYPVTPGVATHVTDSRRRIEKILNGEDKRLLVIIGPCSIHDLTAAMEYATRLQSLRNQYQSRLEIVMRTYFEKPRTVVGWKGLISDPDLNGSYRVNHGLELARKLLLQVNELGVPTATEFLDMVTGQFIADLISWGAIGARTTESQIHREMASALSCPVGFKNGTDGNTRIAVDAIRAARASHMFLSPDKNGQMTIYQTSGNPYGHIIMRGGKKPNYHADDIAAACDTLHEFDLPEHLVVDFSHGNCQKQHRRQLEVCEDICQQIRNGSTAIAGIMAESFLREGTQKIVGGQPLTYGQSITDPCLGWEDTERLVEKLASAVDTRF

SEQ ID NO: 27135 - DNA, 1047 bp, Escherichia coli; identical to SEQ ID NO: 1323
  CDS (1)..(1047): transl_table=11

SEQ ID NO: 27136 - protein, 348 aa, Escherichia coli; identical to SEQ ID NO: 1324

SEQ ID NO: 27137 - DNA, 1047 bp, Salmonella typhi; identical to SEQ ID NO: 1575
  CDS (1)..(1047): transl_table=11

SEQ ID NO: 27138 - protein, 348 aa, Salmonella typhi; identical to SEQ ID NO: 1576

SEQ ID NO: 27139 - DNA, 1047 bp, Shigella flexneri; identical to SEQ ID NO: 2473
  CDS (1)..(1047): transl_table=11

SEQ ID NO: 27140 - protein, 348 aa, Shigella flexneri; identical to SEQ ID NO: 2474

SEQ ID NO: 27141 - DNA, 25 bp, Artificial sequence
  (1)..(25): primer
atgaattatcagaacgacgatttac

SEQ ID NO: 27142 - DNA, 22 bp, Artificial sequence
  (1)..(22): primer
ttacccgcgacgcgcttttact

SEQ ID NO: 27143 - protein, 363 aa, Artificial sequence
  Variant (2)..(3): xaa in position 2 to 3 is any amino acid
  Variant (5)..(6): xaa in position 5 to 6 is any amino acid
  Variant (8)..(11): xaa in position 8 to 11 is any amino acid
  Variant (13)..(20): xaa in position 13 to 20 is any amino acid
  Variant (22)..(24): xaa in position 22 to 24 is any amino acid
  Variant (26)..(27): xaa in position 26 to 27 is any amino acid
  Variant (29)..(30): xaa in position 29 to 30 is any amino acid
  Variant (33)..(33): xaa in position 33 is any amino acid
  Variant (35)..(35): xaa in position 35 is any amino acid
  Variant (37)..(40): xaa in position 37 to 40 is any or no amino acid
  Variant (54)..(55): xaa in position 54 to 55 is any amino acid
  Variant (58)..(58): xaa in position 58 is any amino acid
  Variant (62)..(62): xaa in position 62 is any amino acid
  Variant (65)..(66): xaa in position 65 to 66 is any amino acid
  Variant (68)..(74): xaa in position 68 to 74 is any amino acid
  Variant (75)..(76): xaa in position 75 to 76 is any or no amino acid
  Variant (78)..(78): xaa in position 78 is any amino acid
  Variant (83)..(83): xaa in position 83 is any amino acid
  Variant (91)..(91): xaa in position 91 is any amino acid
  Variant (92)..(92): xaa in position 92 is any or no amino acid
  Variant (100)..(100): xaa in position 100 is any amino acid
  Variant (103)..(103): xaa in position 103 is any amino acid
  Variant (105)..(106): xaa in position 105 to 106 is any amino acid
  Variant (108)..(109): xaa in position 108 to 109 is any or no amino acid
  Variant (111)..(112): xaa in position 111 to 112 is any or no amino acid
  Variant (115)..(116): xaa in position 115 to 116 is any amino acid
  Variant (119)..(119): xaa in position 119 is any amino acid
  Variant (122)..(123): xaa in position 122 to 123 is any amino acid
  Variant (125)..(127): xaa in position 125 to 127 is any amino acid
  Variant (128)..(129): xaa in position 128 to 129 is any or no amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(143): xaa in position 139 to 143 is any amino acid
  Variant (146)..(146): xaa in position 146 is any amino acid
  Variant (152)..(152): xaa in position 152 is any amino acid
  Variant (163)..(163): xaa in position 163 is any amino acid
  Variant (166)..(166): xaa in position 166 is any amino acid
  Variant (173)..(173): xaa in position 173 is any amino acid
  Variant (182)..(182): xaa in position 182 is any amino acid
  Variant (184)..(184): xaa in position 184 is any amino acid
  Variant (186)..(186): xaa in position 186 is any amino acid
  Variant (190)..(190): xaa in position 190 is any amino acid
  Variant (193)..(193): xaa in position 193 is any amino acid
  Variant (196)..(198): xaa in position 196 to 198 is any amino acid
  Variant (200)..(200): xaa in position 200 is any amino acid
  Variant (202)..(205): xaa in position 202 to 205 is any amino acid
  Variant (206)..(207): xaa in position 206 to 207 is any or no amino acid
  Variant (209)..(211): xaa in position 209 to 211 is any or no amino acid
  Variant (213)..(214): xaa in position 213 to 214 is any amino acid
  Variant (216)..(216): xaa in position 216 is any amino acid
  Variant (219)..(221): xaa in position 219 to 221 is any amino acid
  Variant (229)..(230): xaa in position 229 to 230 is any amino acid
  Variant (231)..(236): xaa in position 231 to 236 is any or no amino acid
  Variant (240)..(243): xaa in position 240 to 243 is any amino acid
  Variant (245)..(250): xaa in position 245 to 250 is any amino acid
  Variant (252)..(256): xaa in position 252 to 256 is any amino acid
  Variant (257)..(265): xaa in position 257 to 265 is any or no amino acid
  Variant (270)..(270): xaa in position 270 is any amino acid
  Variant (274)..(277): xaa in position 274 to 277 is any or no amino acid
  Variant (280)..(280): xaa in position 280 is any amino acid
  Variant (282)..(285): xaa in position 282 to 285 is any amino acid
  Variant (287)..(288): xaa in position 287 to 288 is any amino acid
  Variant (290)..(292): xaa in position 290 to 292 is any amino acid
  Variant (294)..(295): xaa in position 294 to 295 is any amino acid
  Variant (298)..(299): xaa in position 298 to 299 is any amino acid
  Variant (301)..(301): xaa in position 301 is any amino acid
  Variant (302)..(306): xaa in position 302 to 306 is any or no amino acid
  Variant (308)..(308): xaa in position 308 is any amino acid
  Variant (315)..(315): xaa in position 315 is any amino acid
  Variant (317)..(318): xaa in position 317 to 318 is any amino acid
  Variant (320)..(320): xaa in position 320 is any amino acid
  Variant (322)..(325): xaa in position 322 to 325 is any amino acid
  Variant (326)..(335): xaa in position 326 to 335 is any or no amino acid
  Variant (337)..(337): xaa in position 337 is any or no amino acid
  Variant (340)..(340): xaa in position 340 is any amino acid
  Variant (345)..(345): xaa in position 345 is any amino acid
  Variant (348)..(348): xaa in position 348 is any amino acid
  Variant (350)..(351): xaa in position 350 to 351 is any amino acid
  Variant (353)..(354): xaa in position 353 to 354 is any amino acid
  Variant (357)..(358): xaa in position 357 to 358 is any amino acid
  Variant (360)..(362): xaa in position 360 to 362 is any amino acid
LXXPXXLXXXXPXXXXXXXXVXXXRXXIXXILXGXDXXXXRLLVVIGPCSIHDXXAAXEYAXRLXXLXXXXXXXXXLXIVMRXYFEKPRTXXVGWKGLIXDPXLXXSXXIXXGLXXARXLLXXLXXXXXLPXAXEXLDXXXXXYIXDLISWXAIGARTTESQXHRXLASGLSXPVGFKNGTXGXLXIAIXAIXAAXXXHXFXXXXXXGXXXIXXTXGNXXXHVILRGGXXXXXXXXPNYXXXXVXXXXXXLXXXXXXXXXXXXXXLMIDXSHAXXXXNSXKXXXXQXXVXXXVXXQIXXGXXXXXXIXGVMIESXLXXGXQXXXXXXXXXXXXXXLXYGXSITDXCIXWXXTXXLLXXLXXXV

SEQ ID NO: 27144 - protein, 25 aa, Artificial sequence
  Variant (2)..(3): xaa in position 2 to 3 is any amino acid
  Variant (5)..(5): xaa in position 5 is Ile or Val
  Variant (6)..(6): xaa in position 6 is any amino acid
  Variant (11)..(11): xaa in position 11 is Ile or Val
  Variant (14)..(15): xaa in position 14 to 15 is any amino acid
  Variant (16)..(16): xaa in position 16 is any or no amino acid
  Variant (18)..(19): xaa in position 18 to 19 is any amino acid
  Variant (20)..(20): xaa in position 20 is any or no amino acid
  Variant (22)..(22): xaa in position 22 is Ala, Cys, Gly or Ser
  Variant (23)..(24): xaa in position 23 to 24 is any amino acid
  Variant (25)..(25): xaa in position 25 is Phe, Ile, Leu or Met
RXXVXXGPCSXHDXXXAXXXYXXXX

SEQ ID NO: 27145 - protein, 44 aa, Artificial sequence
  Variant (2)..(3): xaa in position 2 to 3 is any amino acid
  Variant (4)..(4): xaa in position 4 is any or no amino acid
  Variant (7)..(7): xaa in position 7 is Ala, Thr or Val
  Variant (9)..(9): xaa in position 9 is Phe, Leu or Val
  Variant (10)..(10): xaa in position 10 is Glu or Gln
  Variant (15)..(16): xaa in position 15 to 16 is any amino acid
  Variant (21)..(21): xaa in position 21 is any amino acid
  Variant (22)..(22): xaa in position 22 is Ala, Ile or Val
  Variant (23)..(23): xaa in position 23 is any amino acid
  Variant (26)..(26): xaa in position 26 is any amino acid
  Variant (27)..(27): xaa in position 27 is Ile, Leu, Met or Val
  Variant (28)..(28): xaa in position 28 is Asp or Asn
  Variant (29)..(35): xaa in position 29 to 35 is any amino acid
  Variant (37)..(37): xaa in position 37 is Ile, Leu, Met or Val
  Variant (38)..(39): xaa in position 38 to 39 is any amino acid
  Variant (40)..(40): xaa in position 40 is Ala, Gly or Ser
  Variant (42)..(42): xaa in position 42 is any amino acid
  Variant (43)..(43): xaa in position 43 is any or no amino acid
LXXXMRXYXXKPRTXXGWKGXXXDPXXXXXXXXXXGXXXXRXXL

SEQ ID NO: 27146 - protein, 77 aa, Artificial sequence
  Variant (2)..(2): xaa in position 2 is any or no amino acid
  Variant (8)..(8): xaa in position 8 is any amino acid
  Variant (11)..(11): xaa in position 11 is Pro or Gln
  Variant (12)..(12): xaa in position 12 is any amino acid
  Variant (15)..(15): xaa in position 15 is any amino acid
  Variant (16)..(16): xaa in position 16 is Ile, Leu, Met or Val
  Variant (17)..(17): xaa in position 17 is Ala, Ser, Thr or Val
  Variant (19)..(19): xaa in position 19 is any amino acid
  Variant (20)..(20): xaa in position 20 is Phe, Leu, Met or Val
  Variant (21)..(23): xaa in position 21 to 23 is any amino acid
  Variant (24)..(24): xaa in position 24 is Ile, Leu or Val
  Variant (26)..(26): xaa in position 26 is Phe or Tyr
  Variant (29)..(31): xaa in position 29 to 31 is any amino acid
  Variant (33)..(36): xaa in position 33 to 36 is any amino acid
  Variant (38)..(39): xaa in position 38 to 39 is any amino acid
  Variant (40)..(40): xaa in position 40 is Ala or Gly
  Variant (41)..(42): xaa in position 41 to 42 is any amino acid
  Variant (43)..(43): xaa in position 43 is Ala or Ser
  Variant (44)..(44): xaa in position 44 is Ala, Ser, Thr or Val
  Variant (45)..(47): xaa in position 45 to 47 is any amino acid
  Variant (49)..(51): xaa in position 49 to 51 is any amino acid
  Variant (52)..(52): xaa in position 52 is Ala, Gly, Ser or Val
  Variant (53)..(53): xaa in position 53 is any amino acid
  Variant (54)..(54): xaa in position 54 is Ala, Asp, Gly, Asn, Ser or Thr
  Variant (55)..(56): xaa in position 55 to 56 is any amino acid
  Variant (57)..(57): xaa in position 57 is Ala, Asp or Gly
  Variant (58)..(63): xaa in position 58 to 63 is any amino acid
  Variant (64)..(64): xaa in position 64 is Ser or Thr
  Variant (65)..(65): xaa in position 65 is any amino acid
  Variant (68)..(70): xaa in position 68 to 70 is any amino acid
  Variant (71)..(71): xaa in position 71 is Phe or His
  Variant (72)..(72): xaa in position 72 is Ile, Leu or Val
  Variant (73)..(73): xaa in position 73 is Ile or Val
  Variant (74)..(74): xaa in position 74 is Leu or Met
  Variant (77)..(77): xaa in position 77 is Ala, Gly or Ser
AXIGARTXESXXHRXXXSXXXXXXGXKNXXXGXXXXAXXXXXXXXXXHXXXXXXXXXXXXXXXXXGNXXXXXXXRGX

SEQ ID NO: 27147 - protein, 46 aa, Artificial sequence
  Variant (2)..(2): xaa in position 2 is any amino acid
  Variant (5)..(5): xaa in position 5 is Ala or Gly
  Variant (7)..(7): xaa in position 7 is Cys or Ser
  Variant (8)..(8): xaa in position 8 is any amino acid
  Variant (10)..(13): xaa in position 10 to 13 is any amino acid
  Variant (15)..(16): xaa in position 15 to 16 is any amino acid
  Variant (18)..(31): xaa in position 18 to 31 is any amino acid
  Variant (32)..(33): xaa in position 32 to 33 is any or no amino acid
  Variant (35)..(35): xaa in position 35 is Ile, Leu, Met or Val
  Variant (37)..(37): xaa in position 37 is any amino acid
  Variant (40)..(40): xaa in position 40 is any amino acid
  Variant (41)..(41): xaa in position 41 is Ile or Leu
  Variant (42)..(43): xaa in position 42 to 43 is any amino acid
  Variant (45)..(45): xaa in position 45 is any amino acid
DXSHXNXXKXXXXQXXVXXXXXXXXXXXXXXXXGXMXESXXXXGXQ

SEQ ID NO: 27148 - DNA, 1473 bp, Escherichia coli
  CDS (1)..(1473)
atgtcatcgttgcaaattttgcaaggcacgtttcgtcttagcgacacaaaaacgctgcaattgcctcagctaacgttaaacgcgggtgatagttgggcgtttgtcggttcgaatggaagcgggaaatcggccctggcccgcgcgctggcgggggaacttccgcttttgaaaggtgaacggcaaagccagttttcccacatcactcgtctctccttcgagcaattgcaaaaactcgtcagcgacgaatggcagcggaataacaccgatatgctcggccctggcgaagatgacaccggacgcactacggctgagatcattcaggatgaagtaaaggatgcaccgcgttgcatgcaactggcgcagcagttcggtattaccgccctcctcgaccgacgctttaaatacctttccactggcgagacgcgaaaaaccctgctgtgtcaggcgctgatgtcggagcctgacttgttgattcttgatgagccgttcgatggcctggatgttgcctcacgtcagcagctggctgagcgactcgcctcgttacatcagtccggtattactctggtactggtgctcaatcgcttcgatgagatcccggagtttgtccagtttgctggcgtgctggcggattgcacgttagcggaaactggcgctaaagaggaactgctccaacaagcactcgtcgcgcaactggcgcatagtgaacagcttgaaggtgtgcaactgccggagccggatgaaccttcagcacgtcacgccttacccgccaacgaaccgcgcattgtgctgaacaatggcgtggtttcttataacgatcgccccattcttaataaccttagctggcaggtgaatccaggcgaacactggcaaattgtcgggccaaatggtgcaggaaaatcgacgttattaagcctggttactggcgatcatccgcaaggttacagcaacgatttgacgcttttcggacgacgtcgcggcagcggcgaaaccatctgggatatcaaaaagcatatcggttacgtcagcagtagtttgcatctggattaccgggtcagcactaccgtgcgtaatgtgattctttctggctattttgattcgattggcatttatcaggccgtttcggatcgccagcaaaaactggtgcagcagtggctggatattctcggcattgataaacgcacggctgacgctccgttccatagtctttcctggggacagcagcgtctggcgctgattgtccgcgcactggtgaaacatccgacgttgcttattctcgatgaaccactacaggggcttgatccgctgaatcgccagcttatccgccgttttgttgatgtgctgattagcgaaggtgaaacgcaattgttgtttgtttcgcaccacgctgaagatgcgcctgcctgtattacccatcgtcttgagttcgtgccggacggtggactctatcgctatgtgctgacaaaaatatattga

SEQ ID NO: 27149 - protein, 490 aa, Escherichia coli
MSSLQILQGTFRLSDTKTLQLPQLTLNAGDSWAFVGSNGSGKSALARALAGELPLLKGERQSQFSHITRLSFEQLQKLVSDEWQRNNTDMLGPGEDDTGRTTAEIIQDEVKDAPRCMQLAQQFGITALLDRRFKYLSTGETRKTLLCQALMSEPDLLILDEPFDGLDVASRQQLAERLASLHQSGITLVLVLNRFDEIPEFVQFAGVLADCTLAETGAKEELLQQALVAQLAHSEQLEGVQLPEPDEPSARHALPANEPRIVLNNGVVSYNDRPILNNLSWQVNPGEHWQIVGPNGAGKSTLLSLVTGDHPQGYSNDLTLFGRRRGSGETIWDIKKHIGYVSSSLHLDYRVSTTVRNVILSGYFDSIGIYQAVSDRQQKLVQQWLDILGIDKRTADAPFHSLSWGQQRLALIVRALVKHPTLLILDEPLQGLDPLNRQLIRRFVDVLISEGETQLLFVSHHAEDAPACITHRLEFVPDGGLYRYVLTKIY

SEQ ID NO: 27150 - DNA, 1620 bp, Saccharomyces cerevisiae
  CDS (1)..(1620)
atgagtaccaataagttcgttgtacgaataacgaatgcgctcttcaagtcatcactggctagcaacagtccacctgtttaccctaagaggattaggcatttcgagattttacccaacgaaaaatgggttatatggggacctggaaagggcaagttcttggatgtactgaataacaagtatatttgtgagcccccattatctttgaggtttggatttttgaaggaaagttcgaacatcctgccgaggatagagcaagtggccttcaaaggggttatgccaacggctcatttaagtgctagatatgaatacttcaaagatgactacgatcaaacctgcaaacagtttatatttgataaggcaagcggatcaaatgctgtttcatataaagttgagacgaacaatcggcaaataaacatggagctgtacaatgcattagttgaaaatttaaacctctccagtttacaggataggtgggtaatgggattgagtaatggacaaatgaggagagcaaggttagctcgtagtatactcaaggaaccggatctactacttattgacgacccatttttagggttggatccagccgcaatagcaaccatttcacaatttttagccaaatatgatagtatagaagtcagtggcggatgtccaatcgtcattggtttgaggtatcaagataccattccagcatggtgtactcatatatgttgcgttgatgagaaaaacggtatattgtttgaaggcccaatcgaaaaacttcaaagtaaaatggatgaaaccagatcaagggcactaaaagaactagagcagctcaaaaaagcgtctaattccaaagaggacatttccattaacgatttgatttgtatacatcctatgtatggcaagaaagagcacgaaattatcaaaatgcctcatcttatagaattagacgggttgagcgtttcatacaaaggcgaagctgttttggaaaatctgcactggaaagttcagccgggttcgaaatggcatataagaggtgacaatgggtcaggtaagtcgaccttattatctttgcttacggcggaacatccccaatcgtggaattcgagggtgatagataatggcgtcccacgaagaacaggtaaaacaaactactttgacctaaacagcaaaataggtatgtcatcacccgaattacacgcaatttttttgaagaatgctggaggaaggctaaacattcgggaaagtgttgcaactggctatcatgaggcgtcctccaacaattacctacccatatggaagcgcttggacaaaaatagccaagaaatagtgaatatgtatctgaaatattttggcctggacaaagacgccgatagtgttttatttgaacagttgtccgtaagtgaccagaaactagtcctttttgtcaggtctttaattaagatgccgcaaatattgattctcgatgaggcattttctggaatggaggtagaacctatgatgcgttgtcatgaatttttagaggagtggcctggaacagtccttgtagtggcacacgttgccgaagagacaccaaaatgtgcccattacttaaggctcatatctcctggagagtatgaaataggcgatatggaaaattaa

SEQ ID NO: 27151 - protein, 539 aa, Saccharomyces cerevisiae
MSTNKFVVRITNALFKSSLASNSPPVYPKRIRHFEILPNEKWVIWGPGKGKFLDVLNNKYICEPPLSLRFGFLKESSNILPRIEQVAFKGVMPTAHLSARYEYFKDDYDQTCKQFIFDKASGSNAVSYKVETNNRQINMELYNALVENLNLSSLQDRWVMGLSNGQMRRARLARSILKEPDLLLIDDPFLGLDPAAIATISQFLAKYDSIEVSGGCPIVIGLRYQDTIPAWCTHICCVDEKNGILFEGPIEKLQSKMDETRSRALKELEQLKKASNSKEDISINDLICIHPMYGKKEHEIIKMPHLIELDGLSVSYKGEAVLENLHWKVQPGSKWHIRGDNGSGKSTLLSLLTAEHPQSWNSRVIDNGVPRRTGKTNYFDLNSKIGMSSPELHAIFLKNAGGRLNIRESVATGYHEASSNNYLPIWKRLDKNSQEIVNMYLKYFGLDKDADSVLFEQLSVSDQKLVLFVRSLIKMPQILILDEAFSGMEVEPMMRCHEFLEEWPGTVLVVAHVAEETPKCAHYLRLISPGEYEIGDMEN

SEQ ID NO: 27152 - DNA, 1545 bp, Mesorhizobium loti MAFF303099
  CDS (1)..(1545): transl_table=11
atgagcgcgacggcgcagaaacaggcaagcagccatccggtgctggagatgcggcacatctccaagaccttcggtgcgatccgcgccttgcatgatgtttcactcaccgtccatgccggggagctgcatgctcttatgggcgagaacggcgccggcaagtcgacgctgatgaaggtgctgtcgggcgcctatcggccggatgccggcggcgagatcctgatcgatggcgcgcccgccgcaaccggcgatccgatcaaggcgcgtgccgcaggtatcgcggtgatctatcaggagctgtcgctggcgcccaatctgacggtggcgcagaacatcttcctcggcaacgagccgcggcggttcggcattgtcgaccgcgatcagtgcaaccggcgggcgaacgaaatcatcgcgcggctcggcgtctccttctcggcgcgtgcgctggtctccagcctgtcgctcggcgagcgccagctggtcgagattgcgcgcgcgctgtcgaccaatgcgcgcatcatcgtcatggacgagccgacgacgtcgctgacgtcgcgcgagaccgatagcctgtttgaagtgatcgcgacgctgaagacgcaaggcatcgccatcatctacatcagccatcgcatggaagaggtctaccagctcgccgaccgtgtcagcgtgctgcgcgacagcggctatgtcggcacgctggagcgcgccgacctcaacgcctcgcggctggtgtcgatgatggtcggccgcgatctctccgccttctacaagaaggatcatcgtccgccggacgcgaagcgcgccatcgcactctcggtgcgcggcatgtccgacgggcgcctgctgaagaactgctcgttcgacctgcacaagggcgaggtgctggccctggcgggcctcgtcggctccggccgcaccgagctcgcccggctgatcttcggcgccgacaggcgcagcgccggcacgctggagctcgacggcaaaccgatctccattggctcgccgcgcgaagcgctcgacgccggcattgcctacctgaccgaggaccgcaaggaactcggcctgttcctcgacatgtcgatctccgacaacatcagcatgggcgtgctggccagggacgcgctgaccggcggattgcgcgacttcggcgccgccgaaaggcgcgcggcaaaggcgatcgcggacctgtcgatccgcaccagctcggcgcaggccaatgccggctcgctgtcgggcggcaaccagcagaaggtgctgctcgcccggctgctggagaccgagccgaaagtcgtcatcctcgacgagccgacccgcggcgtcgatgtcggcgccaagtcggaaatctaccggctgatcgacaacctcgccaaccggggcatcgccatcctgatgatctcaagcgaattgcccgaggtgatcggcgtcgccgaccgcgtgctggtgatgcgcgacggcgccatagcaggcgaggtgacggcatccggaggcgagccgctgcgtcaggaggcgatcatggaacttgcgacgggagcggcccaggaatga

SEQ ID NO: 27153 - protein, 514 aa, Mesorhizobium loti MAFF303099
MSATAQKQASSHPVLEMRHISKTFGAIRALHDVSLTVHAGELHALMGENGAGKSTLMKVLSGAYRPDAGGEILIDGAPAATGDPIKARAAGIAVIYQELSLAPNLTVAQNIFLGNEPRRFGIVDRDQCNRRANEIIARLGVSFSARALVSSLSLGERQLVEIARALSTNARIIVMDEPTTSLTSRETDSLFEVIATLKTQGIAIIYISHRMEEVYQLADRVSVLRDSGYVGTLERADLNASRLVSMMVGRDLSAFYKKDHRPPDAKRAIALSVRGMSDGRLLKNCSFDLHKGEVLALAGLVGSGRTELARLIFGADRRSAGTLELDGKPISIGSPREALDAGIAYLTEDRKELGLFLDMSISDNISMGVLARDALTGGLRDFGAAERRAAKAIADLSIRTSSAQANAGSLSGGNQQKVLLARLLETEPKVVILDEPTRGVDVGAKSEIYRLIDNLANRGIAILMISSELPEVIGVADRVLVMRDGAIAGEVTASGGEPLRQEAIMELATGAAQE

SEQ ID NO: 27154 - DNA, 1656 bp, Mesorhizobium loti MAFF303099
  CDS (1)..(1656): transl_table=11
atgaccaatctcgtcgaggtcaggaatctgaggatcgaggcgacgaccgacgccggacgtgtcgttgaaatcatcaagggcgtcagcctcgacatcgccgacggcgagatcgtcgccctgatcggcgagagcggctccggcaagacgacggtggcgctctcgctcatgggctatgcgcggcccggctgccggatcatcggcggcgagatcaatgtaaacggcaagaacatggccgcactgtccgaaaagcagcgcgccaaattgcgcggcaccgacattgcctatgttccgcaaagtgccgccgcctcgttcaacccctcgtccaccatcatggagcaggtgatcgaggttacgcgaatccacgggctgatgccgcccgagcaggcgcgaaagcgcgcggtcgagctgttcagggccttgtcgctgccggacccggaaggaattggcgcgcgttatccgcaccaggtttcgggcgggcaattgcagcggctgtcggcggccatggcgctgatcggcgatcccaagctgatgatcttcgacgagccgaccacggcactcgacgtaacgacacagatcgacgtgctgaaggcattcaagtcggtcatgcgggctggcgggatagcgggggtctatgtttcgcacgacctcgccgtcgtcgcccagatcgccgactgcatcgtggtgctgaaaggcggcgaagtgcaggagaccggcaccacggctgagattctttcggccgcccggcacccctatacgcgcgaactgcttgctgccttcgagccgaagccgcggcaggcgcatgccgacgcggatgccggcgcgaagccgttgctgcgtatcgacaatgtgaccgccggctatggcgcggtgcgagataacgggctgccactcatccgggccgtcgattccgtcagcctggtcgtcgagaagggacgaaatctcggcattatcggcgaatccggctgcggaaaatcgacactggcgcgcgtcatcgccggcatccatccggcggcggccggcgacatcatattcgatggcaaagaactgcagcgagccgcagggaggcgcagccaggaccagctgcgcgagatgcagatcgtgttccagtatgccgataccgcgctcaatccggccaagccggtggaggatatcatctcccggccactggccttctatcacgggctcgacaggcaggcgcgctcgaagcgcgtcgacgaactgctcgacatggttcgcctgcccaggacgctgcgctaccgtcgcccgtcggagctctcgggcggccagaagcagcgcgtgaacttcgcacgcgccctggcggccggccctaagctcatcatctgcgacgaaatcacctcggcgctcgacacggtggtggcggccgccgtgatcgaactgctcaaggagctgcagcgcgagctgggcctttcctacattttcatcagccacgacctttcagtcgtcgaagcgatctgcgacgagatcatggtcatgtacaatggcgagcgggtcgagcagatcacgcccgacaaactgaaggcgcccacccacccttattccaagcttctgttctcctccgtcccgaagcttgacccgacgtggctcgacggcctcgtccgcgatcccgagttggtcagccagtacggccatcgctga

SEQ ID NO: 27155 - protein, 551 aa, Mesorhizobium loti MAFF303099
MTNLVEVRNLRIEATTDAGRVVEIIKGVSLDIADGEIVALIGESGSGKTTVALSLMGYARPGCRIIGGEINVNGKNMAALSEKQRAKLRGTDIAYVPQSAAASFNPSSTIMEQVIEVTRIHGLMPPEQARKRAVELFRALSLPDPEGIGARYPHQVSGGQLQRLSAAMALIGDPKLMIFDEPTTALDVTTQIDVLKAFKSVMRAGGIAGVYVSHDLAVVAQIADCIVVLKGGEVQETGTTAEILSAARHPYTRELLAAFEPKPRQAHADADAGAKPLLRIDNVTAGYGAVRDNGLPLIRAVDSVSLVVEKGRNLGIIGESGCGKSTLARVIAGIHPAAAGDIIFDGKELQRAAGRRSQDQLREMQIVFQYADTALNPAKPVEDIISRPLAFYHGLDRQARSKRVDELLDMVRLPRTLRYRRPSELSGGQKQRVNFARALAAGPKLIICDEITSALDTVVAAAVIELLKELQRELGLSYIFISHDLSVVEAICDEIMVMYNGERVEQITPDKLKAPTHPYSKLLFSSVPKLDPTWLDGLVRDPELVSQYGHR

SEQ ID NO: 27156 - DNA, 1518 bp, Mesorhizobium loti MAFF303099
  CDS (1)..(1518): transl_table=11
atgagcgcgccgctgctttccgtcatcggcgcggtcaagcgcttcggcggcgtccaggcgctgcgcggcgtcgacttcgacctcaaggcgggcgagatccatgccttgcttggcgaaaacggcgccggtaaatcgacgctgatgaacctgttgtcgggcgtctacacgccggacgagggcaccatccacatcgacggcaagcaggtagccttcaacaacccgcgcgaggcgcaggcggccggcatcgccaccatctttcaggaactcgacctggtgccgacactcgacgtcgccgccaaccttttccttggccgcgagttgatgcggccgggcggcttcctcgatgtgccggcgatgcgcagcgaggcccgcaaacggctcgaagccatcgaactggccatcgatccggccagcatggtggcgaacctttcgattggccagcgccaggtcgtagcgatcgtcaaggcactgtcctacgcctcgcgtgtgctgatcatggacgagccgacggcggcactcacggtcggcgaggtcgacaggctgttcgacatcatgcgcaagcttgccgccagcggcgtcggcatcgtctacatctcgcatcgcctcgaggaggtgccgcagatcgccgaccgggtgacggtgatgcgcgacggtcgcgtcgcgggcgtcaccgagccgcacgcgccgcaggccgaactggtccggcttctggtcggccggccgctggatgagctttatcccgaacggtcgacgaaggccggcaggacactgctcagtctgcgcgatgccagcttcaggctcgcccatgaaagcgccggctggcagccgccgagcggcgtctcgctcgacgtcaaggcgggcgagatcgtcgggctggccggcatcatgggggcagggcgcaccgaactgctcagcgcgctctatggcaccggcctgtccggccgttgggaaggtgaggtcgccatcgatggccggccggtaagcctggattcgatcagcgcggcccgctcggccggcatcgccttcgtcacggacgaccggcgcggcagcgggctgatgctcagaatggctgtgggcctcaatttggtcatgtcggtgatccgccgcatctcgcccttcggcctgatgtcgcagcgccgccaggcggacgcggtgaagcagtccttcggccagttcgatatcaggccgaaaaatcccgacatcgccgtcggtgcgctgtccggcggcaaccagcagaaggtggtgctggccaaggagattctcggcaatccccggctgctgctgctcgacgagccgacccgcggcgtcgatgtcggtgccaaaggcgagatctacgcgcgcctgaggcagttggcggcgcaggggctcggcatattggttgcgtccagtgagatgccggagctcatcggcctgtgcgaccggatcgtggtgctgcgcgaagggcgcaacgtggcggaattcatcggcggcgtcgacgagcacacggtgcttgacgcggcaaatggcagggaggcctga

SEQ ID NO: 27157 - protein, 505 aa, Mesorhizobium loti MAFF303099
MSAPLLSVIGAVKRFGGVQALRGVDFDLKAGEIHALLGENGAGKSTLMNLLSGVYTPDEGTIHIDGKQVAFNNPREAQAAGIATIFQELDLVPTLDVAANLFLGRELMRPGGFLDVPAMRSEARKRLEAIELAIDPASMVANLSIGQRQVVAIVKALSYASRVLIMDEPTAALTVGEVDRLFDIMRKLAASGVGIVYISHRLEEVPQIADRVTVMRDGRVAGVTEPHAPQAELVRLLVGRPLDELYPERSTKAGRTLLSLRDASFRLAHESAGWQPPSGVSLDVKAGEIVGLAGIMGAGRTELLSALYGTGLSGRWEGEVAIDGRPVSLDSISAARSAGIAFVTDDRRGSGLMLRMAVGLNLVMSVIRRISPFGLMSQRRQADAVKQSFGQFDIRPKNPDIAVGALSGGNQQKVVLAKEILGNPRLLLLDEPTRGVDVGAKGEIYARLRQLAAQGLGILVASSEMPELIGLCDRIVVLREGRNVAEFIGGVDEHTVLDAANGREA

SEQ ID NO: 27158 - DNA, 1563 bp, Thermotoga maritima MSB8
  CDS (1)..(1563): transl_table=11
gtgtttcccctcctcgctttccggggtgatcgaatggagatactgaaagcaaagggcatagtgaaaagattccctggagttgtggctgtggacaacgtcgattttgaggtttacgaaaacgagattgtctctctgataggtgaaaatggtgctggtaaatccaccctcataaaaattctgacgggtgtcctcaaacctgatgcgggagaaattctggtcaacggcgaaagggtagaatttcactctccggtcgacgcgttcaaaaagggcataagtgttatccatcaggagctgaacctgtgcgacaacatgactgtggcggaaaacatctttctcgcctatgaagctgtcaggggacagaaaagaaccctttccagtagagttgatgagaactatatgtacacaagatctaaagaactgctcgatctcatcggcgccaagttctctccagatgctctggtgagaaacctcaccaccgcccagagacagatggtggaaatatgtaaggcactggttaaagaacccaggatcatcttcatggatgaacccacatcgtcgcttactgtcgaagagacagaaagactcttcgaaatcatagaaatgttgaaaagtagaggtatttctgttgttttcgtttcacatagactggacgaagttatgaggataagtgacaggatcgttgtgatgagagacggaaaaagaatcggcgagttgaaaaaaggagaattcgatgtggacacgatcataaaaatgatggtaggacgtgaagtggagtttttcccacacggaatagagaccagacccggagaaattgcccttgaagtcagaaacctgaagtggaaggataaagtgaagaatgtttcttttgaagtgagaaagggagaagttctgggattcgcgggacttgtgggggctggaagaactgaaacgatgctcttggtgttcggagtgaatcaaaaggaatccggagacatatacgttaacggaaggaaagttgaaataaaaaatccggaagatgctattaagatggggataggactcattcctgaggacagaaaacttcaggggcttgttttgagaatgactgtgaaggacaatatcgtgctcccatcactgaaaaaaatcagcagatgggggctcgtgctcgatgaaagaaaagaagaagagatctcagaagactatgtaaaaagactctccataaaaacgccttccatttatcaaataacagaaaatctatcaggtggaaaccagcagaaagtggtccttgccaaatggctcgccacgaacgcggatattctgatcttcgacgagccaacacgcggaatagacgttggtgcaaaggcagaaatacacaggatgatcagagaactcgccgcacagggcaaagctgtgatcatgatctcttcggaactcccagaaatactgaatctcagcgatagaatagtcgtcatgtgggaaggtgaaatcacagccgttctggacaacagagagaaaagagtcactcaggaagaaataatgtactacgcatctggacagaaaaaacagaacgggagggtcgcataa

SEQ ID NO: 27159 - protein, 520 aa, Thermotoga maritima MSB8
MFPLLAFRGDRMEILKAKGIVKRFPGVVAVDNVDFEVYENEIVSLIGENGAGKSTLIKILTGVLKPDAGEILVNGERVEFHSPVDAFKKGISVIHQELNLCDNMTVAENIFLAYEAVRGQKRTLSSRVDENYMYTRSKELLDLIGAKFSPDALVRNLTTAQRQMVEICKALVKEPRIIFMDEPTSSLTVEETERLFEIIEMLKSRGISVVFVSHRLDEVMRISDRIVVMRDGKRIGELKKGEFDVDTIIKMMVGREVEFFPHGIETRPGEIALEVRNLKWKDKVKNVSFEVRKGEVLGFAGLVGAGRTETMLLVFGVNQKESGDIYVNGRKVEIKNPEDAIKMGIGLIPEDRKLQGLVLRMTVKDNIVLPSLKKISRWGLVLDERKEEEISEDYVKRLSIKTPSIYQITENLSGGNQQKVVLAKWLATNADILIFDEPTRGIDVGAKAEIHRMIRELAAQGKAVIMISSELPEILNLSDRIVVMWEGEITAVLDNREKRVTQEEIMYYASGQKKQNGRVA

SEQ ID NO: 27160 - DNA, 1452 bp, Pasteurella multocida subsp. multocida str. Pm70
  CDS (1)..(1452): transl_table=11
atgtgcagtttacagcttaaagaagccaaatttaaattacatcaacatcaatatttgtatgttcctcaattttgtttatccgcggggcaattttgggctgtcgtggggagtaatggtagtggaaaaactgcttttgcgcttgcattgcagcagcaattagcactagagcatggcgaatattgccattcattccggcaggtagcattattgtcctttgaaaaacaacaacatattattgaagccacttttaaggatcgcaatcatgatggaataagccccgatgattttggtaaaagtgcacgagaaaccatattaaatggcacttcagcgacagcggcttgtgagaaatatgcggaaatcttacagattacgtctttattagatcgcccttttattcacctgtctacaggggaaagccgtaaagtcttgttatgccaagcgttagtgagtcaacctgatcttttgatcttagatgaaccctttgaaggattagaccagcagtcagtgcaagactggcggcatttattggagagattaaaagagaaaatgacattaatgctgatcatcaatcgtttctctgatattccgacacaggcgactcatattgcgattttggataatcgagagttagttttgcaaggcgaacgccaatacattgagcagcaaagtttatttcaacagttgtgttatgccgaaaatgcgcggaatgaacctttgccgacaccttttggtacgccaatacatttgccgacagagatcaatccttttgagttaaaaaacgtcaatattcaatatggtgataaaaagattctcagtgcattaacttggacagttgaaccaaaacaacattggtggattaaaggaccaaatggtgcaggaaaatcgacgctattgtctgtgctgacgggtgatcatccgcaatcttatgcgaatcatgtagtattatttggtcaacaacgtggtagcggtgaaaccatttgggatattaaacaaaaaataggctatgtgagtagtcagttgcatatggattaccgagtgaattgtagcgcattagatgttattctctcgggcttttttgatagtattggcgtgtatcaacaggtatcagaggcactgcgtttgaaggctatgcaatggttgacacgtttacatcttgcaacactggcgaaatccccgtttcgttccttgtcttggggacaacagcgacttttgttgatagctagagccatggtgaaacatccaccaatattgattttagatgaaccttttcagggattggatggggtgaatcgtaagctggtaaaacagtttattgaacaactggtagtaaacagccaaacccagctgatatttgtttcccatcaagatcaggacgcgccaaattgcatgacacatcgttttgaatttatagcagataataatcaatattcttatatacaaagtacgctctaa

SEQ ID NO: 27161 - protein, 483 aa, Pasteurella multocida subsp. multocida str. Pm70
MCSLQLKEAKFKLHQHQYLYVPQFCLSAGQFWAVVGSNGSGKTAFALALQQQLALEHGEYCHSFRQVALLSFEKQQHIIEATFKDRNHDGISPDDFGKSARETILNGTSATAACEKYAEILQITSLLDRPFIHLSTGESRKVLLCQALVSQPDLLILDEPFEGLDQQSVQDWRHLLERLKEKMTLMLIINRFSDIPTQATHIAILDNRELVLQGERQYIEQQSLFQQLCYAENARNEPLPTPFGTPIHLPTEINPFELKNVNIQYGDKKILSALTWTVEPKQHWWIKGPNGAGKSTLLSVLTGDHPQSYANHVVLFGQQRGSGETIWDIKQKIGYVSSQLHMDYRVNCSALDVILSGFFDSIGVYQQVSEALRLKAMQWLTRLHLATLAKSPFRSLSWGQQRLLLIARAMVKHPPILILDEPFQGLDGVNRKLVKQFIEQLVVNSQTQLIFVSHQDQDAPNCMTHRFEFIADNNQYSYIQSTL

SEQ ID NO: 27162 - DNA, 1518 bp, Pasteurella multocida subsp. multocida str. Pm70
  CDS (1)..(1518): transl_table=11
atgcaatccgacaatttagaaacgaaatgcttattagatgcgcgtcatatcagcaagtctttttccggtgtagaagtattaaaagccattgatttttcattgtatgccggtgaagtgcatgccttattaggtggaaatggggcaggtaagtccaccttaatgaaaataattgctgggattcagccgccagatagtggcgaattgctcattaaaggcaaacgacaggcagggctttcaccaaataaagcacatcaactcggtatttatttagtaccacaggaacctttattgtttccaaatttaagtgtgaaagagaatattttatttgggctggcgaacacggcggaaaatgagaaaaaactgaccgcacttttatctgaattgaactcacatttgaaattagatatgcaagccggtttgcttgaagtggcggatcagcaaattgtggaaatcatgcgtggtttaatgcgtaatgccgagattttgattttggatgagcctacggcgtcgttgacaccggccgaaacaaataacttttttcgcaaaattaactcattactcaataaaggtgtggggattgtgtttatttctcataaattacccgaagtttggcaaatttcacatcgtattagtgtgatgcgagatggttatattgccttagctggaaaaacagatgaactcaatcgtgatgaggttatcagtgcgattacgccgaaagccaaatcgactcgcttaacggaagcacagaaactgtggttagagctaccggggcatcatcgggttaaatcaacagatcaacccattcttcgtgttgagaacctgacaggcgaagggtttaagcatgtttccttttcaatttatcccggtgaaattttagggttagcaggtgtcgtgggggcgggacgtaccgagctggctgaaaccctgtatggtttgcgccaaaaaaaatcgggtgaaattgttttcaaccaacaagagattagccaaatgagcatcaagcagcgattggaggaagggattgtctatttaccagaagacagacaggcatctggtctttatttagatgcgccactgacctggaatgcttgtgctttaacctataacaacatgggattgtggattaatacggcacgagaaagcgccattttagaacgttaccatcgtgctatcggaattaagtttagcgatgaacaacaagcggcgagaacgttatcgggtggaaatcaacaaaaagtgttaattgctaagtgtttagaggctgatccggctttattgattgtcgatgaaccaacacgtggtgtagatgtaggggcgcgtgccgatatttatcaattaattcaaagtgtggcgaagcaaaatgtggcggtgctttttatttcttcagatctagaggaaattgaaaaaatgtctgatcgcgtgctagtgatgcatgatgggcagcttagtgaatcgctagtgggatcggcgatcaatacagcgaatattatgaatatggcatttggcgcgacaaaggcataa

SEQ ID NO: 27163 - protein, 505 aa, Pasteurella multocida subsp. multocida str. Pm70
MQSDNLETKCLLDARHISKSFSGVEVLKAIDFSLYAGEVHALLGGNGAGKSTLMKIIAGIQPPDSGELLIKGKRQAGLSPNKAHQLGIYLVPQEPLLFPNLSVKENILFGLANTAENEKKLTALLSELNSHLKLDMQAGLLEVADQQIVEIMRGLMRNAEILILDEPTASLTPAETNNFFRKINSLLNKGVGIVFISHKLPEVWQISHRISVMRDGYIALAGKTDELNRDEVISAITPKAKSTRLTEAQKLWLELPGHHRVKSTDQPILRVENLTGEGFKHVSFSIYPGEILGLAGVVGAGRTELAETLYGLRQKKSGEIVFNQQEISQMSIKQRLEEGIVYLPEDRQASGLYLDAPLTWNACALTYNNMGLWINTARESAILERYHRAIGIKFSDEQQAARTLSGGNQQKVLIAKCLEADPALLIVDEPTRGVDVGARADIYQLIQSVAKQNVAVLFISSDLEEIEKMSDRVLVMHDGQLSESLVGSAINTANIMNMAFGATKA

SEQ ID NO: 27164 - DNA, 2733 bp, Pasteurella multocida subsp. multocida str. Pm70
  CDS (1)..(2733): transl_table=11
atgaacacaattcgtgtcgtgaatgtgacccatacttaccaaaaaacgaccgcacttgatcaagtgtcactctcacttcctgcgggcagtacggttggattaattggacctgacggtgtgggcaaatccactttactttccttactcgcaggcgtgaaaatcctacaacaaggacagatcacggtcttcggtctcagccaagccgagaaagcagagcgtgagtgcttactcaaacgcattgcttttatgccacaagggcttggtcgcaacctttacccgactctctcggtgtatgaaaatatcgaatttcatgcctgcttatttggtctcacgcagacacaacgtcaacaacggattcaacgtttattacttgccacaggactcgccccttttcaaaaacgggccgcgggaaacctttctggtggtatgaaacagaaactgagtttatgttgtgccttggtgcataatcccgatttattaatcttagacgaaccgacaaccggtgtggatcccctttcacgccagcagttctggactttagtcaatgaactccgccacgaaaatcccgctatgactgttctcgtagcgactgcatatattgaagaagccgctcaatttgaacatttaattgcgatggatgagggaaaaattttaatgagtgccccgacacaacaggtattagaagccactatgtcggacaacctcgaacaagcttacattaaattattgccagaaaccaagcaaacccattggcatgccgagcaaattccaccgttctgcgcggatccgacgttaccctttgccatcgaagcagaaggactgaccaaaaaatttggcacctttaccgctgttgaccaagtcagctttaacattccacaaggggaaattttcggttttttaggctcgaatggttgtggcaaaagtaccaccatgaaaatgctaaccggcttacttgatgcaacagaaggcacagcaactttgttgggtgaacccattgattcagggaaaatggagacacgccaacaagtaggctatatgtcgcaggcattttctctttatgaagagctgaccattcgccaaaatttactattacatgccaaactctatgatctcaccggtgaacgtgcaactcaggccgtttcgcaagcgcttgatcaatttcaactcatcgacgtcgcggagaaattaccacgtgacttatccttaggcatacgtcaacgcttacagcttgccgctgcttgtttacatcaccccaaagtcttaattttagatgagccgacttccggagttgaccctgctgcacgggatatgttttggcaatacctcattcaactttcaagagaagaaaaaatcacgatttttgtttcaacgcactttatgaatgaagcactacgttgtgaccgtatttcattaatgcatcgcggtaaagtactcgcagttggcacccccgaatccctctgtcaacaacgtcaaaccgataatttagaagaggcattcattgcatttcttgctgactatcccgaaacagaagtgcccgcgaccgcttcacaggcaccttccagcgtagtagcgccatcccataatcaagacatgacacactcaagctcactctggctttggtttaactcgatttggacctttgctcgacgtgaaagcaaagaaattttacgtgatcatatccgcttaattttcatcattctgggaccgattattttactctttgctggcagttggggactgtcttttgataccaacagccagaattttgcagttctcgatcaagatcaaagtgcagagagtcgccaacttattgaagcattcgaacagtctgcttattttaacgccattgcgccgttaaacgtgcggtctgatttagcgacacttctaaaaacagggcaagcgcggctattaattgaaattccacatcattttgggcgagatttattacaacaacgtcaacctgaaattgccttttatattgacggttcaatgccatttacaggggaaaatatcgtttcctacatacaacaaattttacgccaataccaaacgcaactgtatcagcaacaaggcatcgacttaccacaacttgcacagctagaagtgcgttttatgtataaccaaacgttccgcagtgtgaatgccatttcgcccggtctgattatggtcacattgatgttgattccttccatgatgaccgcacttgccgtggtgcgtgaaaaagaaattggttctatcaccaacctctatgggtcacccgcaagcgttttgcagtatgtgcttggtaaacaactcccttatgtgtttttagctttgaccagttattttttgctagttgctatgaccgtttggattattggagtggacatcactggctctttttgggcaatgacattaggcgccttgtgcttaatcttatccgccactgcctttggcttattggtctctgcctttgtgaaatcacaggtcgctgctatttttgctaccgcgattatcagtatcgttccaacgatcaatttttctggtttgctctacccacgctcaactattacaggtttaggttattggatgggtgtaagttttccaaccagttggtatcacttgatcagtttaggcgcttttactaaaggcttgggaatgaagagttttctgcatttatatctgattttactgctcttttttgccgtttatttagggctgacatgcttccttttgaaaaaacaggagaaataa

SEQ ID NO: 27165 - protein, 910 aa, Pasteurella multocida subsp. multocida str. Pm70
MNTIRVVNVTHTYQKTTALDQVSLSLPAGSTVGLIGPDGVGKSTLLSLLAGVKILQQGQITVFGLSQAEKAERECLLKRIAFMPQGLGRNLYPTLSVYENIEFHACLFGLTQTQRQQRIQRLLLATGLAPFQKRAAGNLSGGMKQKLSLCCALVHNPDLLILDEPTTGVDPLSRQQFWTLVNELRHENPAMTVLVATAYIEEAAQFEHLIAMDEGKILMSAPTQQVLEATMSDNLEQAYIKLLPETKQTHWHAEQIPPFCADPTLPFAIEAEGLTKKFGTFTAVDQVSFNIPQGEIFGFLGSNGCGKSTTMKMLTGLLDATEGTATLLGEPIDSGKMETRQQVGYMSQAFSLYEELTIRQNLLLHAKLYDLTGERATQAVSQALDQFQLIDVAEKLPRDLSLGIRQRLQLAAACLHHPKVLILDEPTSGVDPAARDMFWQYLIQLSREEKITIFVSTHFMNEALRCDRISLMHRGKVLAVGTPESLCQQRQTDNLEEAFIAFLADYPETEVPATASQAPSSVVAPSHNQDMTHSSSLWLWFNSIWTFARRESKEILRDHIRLIFIILGPIILLFAGSWGLSFDTNSQNFAVLDQDQSAESRQLIEAFEQSAYFNAIAPLNVRSDLATLLKTGQARLLIEIPHHFGRDLLQQRQPEIAFYIDGSMPFTGENIVSYIQQILRQYQTQLYQQQGIDLPQLAQLEVRFMYNQTFRSVNAISPGLIMVTLMLIPSMMTALAVVREKEIGSITNLYGSPASVLQYVLGKQLPYVFLALTSYFLLVAMTVWIIGVDITGSFWAMTLGALCLILSATAFGLLVSAFVKSQVAAIFATAIISIVPTINFSGLLYPRSTITGLGYWMGVSFPTSWYHLISLGAFTKGLGMKSFLHLYLILLLFFAVYLGLTCFLLKKQEK

SEQ ID NO: 27166 - DNA, 1566 bp, Pseudomonas aeruginosa PAO1
  CDS (1)..(1566): transl_table=11
atgcagttcggcgccaagccgctgttcgagaacgtttccgtcaagttcggcaacggcaaccgctacggcctgatcggcgccaacggttgcggcaagtcgaccttcatgaagatcctcggtaacgacctggagccgagcgccggccaggtcatgctggaacccaacgtgcgcctgggcaagctgcgccaggaccagttcgcctacgaggacttcagcgtcatcgatacggtgatcatgggccacgaggaactctgggcggtgaaggccgaacgcgaccgcatctactccctgccggaaatgagcgaggcagatggcatggcggtggccgagctggaagtccagttcgccgagttcgacggctacaccgccgagtcccgcgccggcgagctgctgctcggcctgggcatcccgctggagcagcacttcggcccgatgagcgccgtcgctcccggctggaagctgcgcgtactgctggcccaggcgctgttctcggacccggacgtgctgctgctcgacgaaccgaccaaccacctggacatcaacaccatccgctggctggaaggcgtgctcaccgcgcgcaacagcaccatgatcatcatttcccacgatcgccacttcctgaacagcgtctgcacccacatggccgacctggactacggcgagctgcgcctgttcccgggcaactacgacgagtacatgaccgccgccgaacaggcccgcgagcgcctgctgtcggacaacgccaagaagaaggcgcagatcgccgagctgcaatccttcgtcagccgcttctcggccaacgcctccaaggccaagcaggccaccagccgcgcccggcagatcgacaagatccagctggaggaggtcaagccgtccagccgggtcagcccgttcatccgcttcgagcaatacaagaagctgcaccgccaggcggtgaccgtggaaaacatcagcaagggctatgacggcaagccgctgttcaagggcctgagcctgcaggtcgaggccggcgagcgcgtcgccatcatcggccccaacggcatcggcaagaccaccctgttgcgctgcctggtcggcgacctgccggtggacggcggcgaggtgaaatggaccgacagcgccgacgtcggctatttcgcccaagaccatgccgacgacttcgccgacgacatgagcctgttcgactggatggcccagtggacccagggcggcgaacaactggtgcgcggcaccctcggccgcatgctgttctccaacgacgagatcaagaagtcggtgaaagtgatctccggcggcgagcagggccgcatgctgttcggccggctgatcctcaagcgccccaacgtgctggtgatggacgagccgaccaaccacctggacatggagtccatcgaggcgctgaacctggcgctggacaactatccgggcacgctgatcttcgtcagccacgaccgcgaattcgtttcctcactggctacccgcatcatcgagctgggcgagaacggcgtgaccgacttcagcggcagctatgacgactacctgcgcagccagggcgtgatcgtctga

SEQ ID NO: 27167 - protein, 521 aa, Pseudomonas aeruginosa PAO1
MQFGAKPLFENVSVKFGNGNRYGLIGANGCGKSTFMKILGNDLEPSAGQVMLEPNVRLGKLRQDQFAYEDFSVIDTVIMGHEELWAVKAERDRIYSLPEMSEADGMAVAELEVQFAEFDGYTAESRAGELLLGLGIPLEQHFGPMSAVAPGWKLRVLLAQALFSDPDVLLLDEPTNHLDINTIRWLEGVLTARNSTMIIISHDRHFLNSVCTHMADLDYGELRLFPGNYDEYMTAAEQARERLLSDNAKKKAQIAELQSFVSRFSANASKAKQATSRARQIDKIQLEEVKPSSRVSPFIRFEQYKKLHRQAVTVENISKGYDGKPLFKGLSLQVEAGERVAIIGPNGIGKTTLLRCLVGDLPVDGGEVKWTDSADVGYFAQDHADDFADDMSLFDWMAQWTQGGEQLVRGTLGRMLFSNDEIKKSVKVISGGEQGRMLFGRLILKRPNVLVMDEPTNHLDMESIEALNLALDNYPGTLIFVSHDREFVSSLATRIIELGENGVTDFSGSYDDYLRSQGVIV

SEQ ID NO: 27168 - DNA, 2751 bp, Pseudomonas aeruginosa PAO1
  CDS (1)..(2751): transl_table=11
atgaccgctggcgggagcggcgtggcgagcctccggggcgtttcgctgcgctacggcgagacgcgtgcggttgacgacgtcagcctggagatcccggccaaccgcatggtcggcctgatcggtccggacggggtcggcaagtccagcctgctggcgctgctggccggcgcacggaagatgcaggatggcgagatccgcgtgctcgatggcgacatgcgcgaccgccgccaccgccgggcggtctgcccgcgcatcgcctacatgccccaggggctgggcaagaacctctacccgacgctctcggtgttcgagaacgtcgacttcttcggtcggctgttcggccacgacaaggccgagcgcgagcggcgcatcgccgatctgctgcaaagcaccggattggcgccgttcgccgagcgtcctgcgggcaagctgtccggcggcatgaagcagaagctcgggctgtgctgcgcgctgatccacgatcccgacctgctgatcctcgacgagccgaccaccggcgtcgacccgctgtcgcgcaaccagttctgggagctgatcggccgtatccgcgcgggccgcgaaggcatgagcgtgctggtcgccaccgcttacatggaggaagccgagcgcttcgactggctggtggcgatggacgacggaaaggtcctggccaccggtacgccgcaggagttgcgcgagcgtaccgggacgcagagcctcgagtcggcgttcatcgccctgctgccggaaagcaagcgcgccggccaccatcgattggtgatcccgccgcgaccgcagagcgaaggcgcgccgcggatcgccatcgaggccgagggcctgacctgtcgtttcggcgacttcgtcgcggtcgatcacgtcagcttccgtatcgagcgtggggaaatcttcggctttctcggctccaacggctgcggcaagtccaccaccatgaagatgctcaccggcctgctgccggccagcgaaggcacgtgcgcgctgttcggccagccggtggacgccagcgacatggcgacccgtcgccgggtcggctacatgtcccaggccttttccctgtatgccgagctgagcgtgcggcagaacctggtgttgcacgcccggctgttccacctgccggcggatggcatcccggcacgggtcggcgaaatgctccggcgcttcgacctggagaaggtggccgacgagctgcccaacgacctgccgctgggcattcgccagcgtctgtcgttggcggtggcggtgatccacaagccggaaatcctgatcctcgacgagcccacttcgggggtcgacccggtggctcgcgacggcttctgggagctaatggtcgagctgtcgcgccgcgacggggtgaccatcttcatttccacccacttcatgaacgaggcccagcgctgcgatcgcatctcgctgatgcatgccggcaaggtactggccagcgatactcccgatgagctggtgcgccagcgcggcctgccgaccctggaggcgaccttcatcgcgtacctggaagaagccgccggcgccgccgcgccagcgcaaccggccgaggcgccggccgtcgcggagcagcccggcgatggccaggagcgccaggcgcaacgcgaacgcttcagccccctgcggctgttcagctatgcgcgccgcgaagccatggagctgcgccgcgacccgatccgcctgaccctggccctgctcggcaccgcgctgctgatgttcatcatcggctatggcatcaacatggacgtcgaggacctctcctgggcggtcctcgaccgtgaccagaccaccaccagccaggcctacgcgctgaacatcgccggctcgcgctatttcgtcgaacatgcgccgatcaccgacccggacgacctcgaccggcgcctgcgcagcggcgagctgagcctggcggtggagattccgccgaacttcgggcgcgatctcaagcgtggctccgatccggccatcggcgtgtggatcgacggagcgatgccgacccgtgccaacaccgtgctcggctacgtgcagggtctgcacaccagctacctggcggacctctcgcggcaggcgggtggggccgaggccagcgcggcggccagcaccgaggtgcgctatcgctacaaccccgacgtggaaagcctgaaggcgatggtgccggcggtgatcccgctgctgctgatcatgatcccggccatgctcaccgccctcggcgtggtgcgcgaaaaggaactgggttcgatcaccaacctctatgtcaccccggtgacgcgcctggagttcctggttggcaagcagctgccctacgtcgccatgggcatgatcaacttcctgctgatgctggtcctggccatcgtggtatttcgcgtgccgctcaagggcagcttcctggcgttgaccatcggcgctttcctctatgtggtcaccagcactggcctcgggctgttcctctcgacgttcatgcgcagccagatcgccgctgtattcggcgtggcgatcgccaccatgatcccggcgatccagttctccgggctgatccacccggtgtcctcgctggagggtgcggcggcctggatcggcaagctctatccgacctcgcatttcctggtggtcagccgcggcgccttttccaaatcgctgggcctgtccgatctctgggcctactacctgccgcttgccgcttccatcgtggtgctgaccctgctcagcgtggcctgcctgaagaagcaggaggactga

SEQ ID NO: 27169 - protein, 916 aa, Pseudomonas aeruginosa PAO1
MTAGGSGVASLRGVSLRYGETRAVDDVSLEIPANRMVGLIGPDGVGKSSLLALLAGARKMQDGEIRVLDGDMRDRRHRRAVCPRIAYMPQGLGKNLYPTLSVFENVDFFGRLFGHDKAERERRIADLLQSTGLAPFAERPAGKLSGGMKQKLGLCCALIHDPDLLILDEPTTGVDPLSRNQFWELIGRIRAGREGMSVLVATAYMEEAERFDWLVAMDDGKVLATGTPQELRERTGTQSLESAFIALLPESKRAGHHRLVIPPRPQSEGAPRIAIEAEGLTCRFGDFVAVDHVSFRIERGEIFGFLGSNGCGKSTTMKMLTGLLPASEGTCALFGQPVDASDMATRRRVGYMSQAFSLYAELSVRQNLVLHARLFHLPADGIPARVGEMLRRFDLEKVADELPNDLPLGIRQRLSLAVAVIHKPEILILDEPTSGVDPVARDGFWELMVELSRRDGVTIFISTHFMNEAQRCDRISLMHAGKVLASDTPDELVRQRGLPTLEATFIAYLEEAAGAAAPAQPAEAPAVAEQPGDGQERQAQRERFSPLRLFSYARREAMELRRDPIRLTLALLGTALLMFIIGYGINMDVEDLSWAVLDRDQTTTSQAYALNIAGSRYFVEHAPITDPDDLDRRLRSGELSLAVEIPPNFGRDLKRGSDPAIGVWIDGAMPTRANTVLGYVQGLHTSYLADLSRQAGGAEASAAASTEVRYRYNPDVESLKAMVPAVIPLLLIMIPAMLTALGVVREKELGSITNLYVTPVTRLEFLVGKQLPYVAMGMINFLLMLVLAIVVFRVPLKGSFLALTIGAFLYVVTSTGLGLFLSTFMRSQIAAVFGVAIATMIPAIQFSGLIHPVSSLEGAAAWIGKLYPTSHFLVVSRGAFSKSLGLSDLWAYYLPLAASIVVLTLLSVACLKKQED

SEQ ID NO: 27170 - DNA, 1698 bp, Lactococcus lactis subsp. lactis Il1403
  CDS (1)..(1698): transl_table=11
atggaagccttaatttcgttcaaagattttacatttaaatatgatttacaaaaaaatccaactttaaaaaagattaatttggaaatatttcctggggaaaaagtactgattgtcggtccttctggttcaggtaaatcaacgattggttcttgtcttaatgggattttgcctcatttacataaaggagaagcaagtggtaaactctcaattgctggtttgccctttgggacttcaattgctgaattatctgaaaaggtgtcgacgattttgcaggatactgatggccagtttattggtttgagcgttgctgaggatattgcttttgctttggaaaatgatggtctgattcatgatgaactggtcagtaaagtggcctattggtcagacaaaacagaaacaaataaactcttgaatcatcgtccccaagatttgtcgggaggacaaaagcagcgggtttctttagctggtgttttgattgatgaatcgccaattttgctttttgatgaacctttagccaatttggacccgcaaacttgcttagaaacaatggctttgattaaggatattcatgaaaataatgaagtcactacgattatcatcgaacaccgaatcgaagaagttttaccgcttggtattgataaaattgtcgtggtcaacgacggcgaaattgttgcaactggaagtcctgctgaattattaaaaacagaaatttttaatgaaaattcattacgcgagcccctctatctctcagcattaaaagctgcaaatgctacaaaattactgacagatttttctgacctaaaaagtttggaagtcctgtcagcaaaaaaattactgacagattttttagacacttataaatttactgacaaggctgtcagcaaaaataatattctttcagtaaaaaatttatcagtaaattttgctcaacatgaagttctaaaaggcattaatttagaagttcaagaaggagaaaaaatttcaattgtcgggaaaaatggagttggtaaatcaacctttgccaatgcactctgtcattttgttgaagcgagtggcgaaattttataccgagagcaatcgattattgctgattctatttctgaacgtgcgaaaaaaattggctatattatgcaaaatccaaatctgatgatttcgcaaaatattgtcagtgatgaggtggcagctggtttacgacttcgccatgttgatgaaaaaatgattcaagataaagttgaagaaattttgaaagtttgtgggctttatccttttagaaattggccaatttcttctttgagttatggtcagaaaaaaagagtgacgattgctagtattttaatactagaacctgaaattttagtccttgacgagccaacagctgctcaggatttacaatcttatcgggaaatcatggattttcttgacgaacttaaccgccgtcttcatttaacaatgattatgattacgcacgatatgtatttaattacagaatatagtgaccggacccttgtttttgctgacgggaaaattattgctgacagcagtccttatcaaattttagaaaatgaagattttgtaaaaatgggcaatttaagtcaaccaagcctttatcaacttgccagacaaacagataccaatcccgttttactgacaaaagctttcatcaattttcagaatcaggagagattaaagcatgaataa

SEQ ID NO: 27171 - protein, 565 aa, Lactococcus lactis subsp. lactis Il1403
MEALISFKDFTFKYDLQKNPTLKKINLEIFPGEKVLIVGPSGSGKSTIGSCLNGILPHLHKGEASGKLSIAGLPFGTSIAELSEKVSTILQDTDGQFIGLSVAEDIAFALENDGLIHDELVSKVAYWSDKTETNKLLNHRPQDLSGGQKQRVSLAGVLIDESPILLFDEPLANLDPQTCLETMALIKDIHENNEVTTIIIEHRIEEVLPLGIDKIVVVNDGEIVATGSPAELLKTEIFNENSLREPLYLSALKAANATKLLTDFSDLKSLEVLSAKKLLTDFLDTYKFTDKAVSKNNILSVKNLSVNFAQHEVLKGINLEVQEGEKISIVGKNGVGKSTFANALCHFVEASGEILYREQSIIADSISERAKKIGYIMQNPNLMISQNIVSDEVAAGLRLRHVDEKMIQDKVEEILKVCGLYPFRNWPISSLSYGQKKRVTIASILILEPEILVLDEPTAAQDLQSYREIMDFLDELNRRLHLTMIMITHDMYLITEYSDRTLVFADGKIIADSSPYQILENEDFVKMGNLSQPSLYQLARQTDTNPVLLTKAFINFQNQERLKHE

SEQ ID NO: 27172 - DNA, 1521 bp, Lactococcus lactis subsp. lactis Il1403
  CDS (1)..(1521): transl_table=11
atggcaaatgaaactgtcattcaaatgattgatgtcaccaaacgttttggtgattttgtcgctaacgacaaagtcaatcttgagttgaagaaaggtgagattcatgctttgctcggcgaaaatggagccggtaagtcaaccttgatgaacattctctcaggactcctcgagcctagcgaaggtgaagtccacgttaagggaaagctcgaaaatatcgactctccgtctaaagcagcaaacctcggtatcggaatggttcaccaacacttcatgttagttgacgccttcacagttactgaaaacatcatccttggtaatgaagttactaaaggaatcaatctcgatttaaagactgctaagaaaaaaatacttgaactttctgagcgttatggtctttctgttgaacctgatgcgctcatccgtgatatttctgtcggtcagcaacaaagggttgaaatcttaaaaacactctatcgtggagctgatatcttaatttttgatgaaccaacagcggttttgactccagctgaaatttctgaattgatgcaaatcatgaagaatttaattaaagaaggcaagtcaatcatcctcatcacacataaattggatgaaatccgtgcggtatctgaccgtatcacagttattcgtcgtggtaaatcaattgatactgttgaacttggtgacaaaacgaatcaagaacttgcagaattgatggtcggacgctcagtttcattcatcaccgagaaagctcccgctcaacctaaagatattgtcctcgaaattaaggacttaaatatcaaagaaagtcgcggttctctaaaagtaaaaggattatcacttgatgttcgtgccggtgaaattgtaggggttgccggaattgatggaaatggtcaaacagaattagtgaaagctattactggtttgacaaaggttgattccggttctatcaaactccacaataaagatatcaccaaccaacgcccccgtaaaatcacagaacaatctgttgggcatgttccagaagacagacatcgggacggacttgttttggaaatgacagtagccgaaaatattgctttgcaaacctactacaaaccaccaatgagcaaatatggttttcttgattataatcaaataaatagtcacgctcgcaaactcatggaagaatttgacgttcgtggtgctggtgaatgggtttctgctgcctctctttctggtggtaatcagcaaaaagcaattatcgcccgtgaaatcgaccgaaatcctgacctcctaatcgtatcacagcccactcgtggactcgatgttggtgcgattgaatatattcataaacgtttaatccaagctcgtgatgaaggaaaagcagttcttgttatttcttttgaacttgacgaaattctaaatgtttccgaccgaatcgctgttattcacgatggtcaaattcagggaattgtaagccctgaaacaaccacaaaacaagagctcggtattttaatggttggaggaaacataaatgaatag

SEQ ID NO: 27173 - protein, 506 aa, Lactococcus lactis subsp. lactis Il1403
MANETVIQMIDVTKRFGDFVANDKVNLELKKGEIHALLGENGAGKSTLMNILSGLLEPSEGEVHVKGKLENIDSPSKAANLGIGMVHQHFMLVDAFTVTENIILGNEVTKGINLDLKTAKKKILELSERYGLSVEPDALIRDISVGQQQRVEILKTLYRGADILIFDEPTAVLTPAEISELMQIMKNLIKEGKSIILITHKLDEIRAVSDRITVIRRGKSIDTVELGDKTNQELAELMVGRSVSFITEKAPAQPKDIVLEIKDLNIKESRGSLKVKGLSLDVRAGEIVGVAGIDGNGQTELVKAITGLTKVDSGSIKLHNKDITNQRPRKITEQSVGHVPEDRHRDGLVLEMTVAENIALQTYYKPPMSKYGFLDYNQINSHARKLMEEFDVRGAGEWVSAASLSGGNQQKAIIAREIDRNPDLLIVSQPTRGLDVGAIEYIHKRLIQARDEGKAVLVISFELDEILNVSDRIAVIHDGQIQGIVSPETTTKQELGILMVGGNINE

SEQ ID NO: 27174 - DNA, 1590 bp, Escherichia coli O157:H7 EDL933
  CDS (1)..(1590): n means a or g or c or t/u, s means g or c
atgacgcaaactctgttagcgattgaagatttgtcggtgggttttcgccatcagcaaaccgtacgtacagtagtcaatgatgtttcactacagattgaggctggcgaaacgctggcgctggtgggtgagtcaggttcaggcaaaagcgttaccgcgctgtcaattttacgcctgctcccttccccgccggttgaatatctctccggcgatattcgttttcatggcgaatcgctgcttcatgccagcgaccaaacgttgcgcggtgtacgcggtaataagatcgccatgatttttcaagagccgatggtgtcgttaaatccattgcataccctggaaaaacagctttatgaagtgctttcactccaccgcgggatgcgtcgggaagcggctcgtggcgaaattcttaactgccttgatcgcgttggtatccgccaggcggcaaaacggctgacagattatccgcatcagctctccggcggcgaacgccagcgggtgatgattgcgatggcgctgttaacgcgaccggaattattaattgccgatgaaccgaccaccgcactggacgtctctgtccaggcgcagattttacagctgttgcgcgaactgcaaggcgagttgaatatgggcatgctgtttattactcataacctcagcattgtcagaaaactggcccaccgcgtggcggtaatgcaaaacggtcgctgtgtcgagcaaaattacgccgctacgctatttgcctcacccactcatccttacacacaaaagctactcaacagtgaaccgtcaggcgatccagtgccgttgccagaacctgcctcaacgttgctggatgttgaacagcttcaggttgccttccccattcgcaaagggattttgaagcgcattgtggatcataatgtggtggtgaaaaacatcagttttacgctacgagcgggtgaaacactgggtttagtgggcgagtccggttccgggaaaagcacgacgggactggcgctgctgcgactgattaattctcagggcagcatcatctttgacggtcagccactgcaaaatttaaatcgccgccagctgttacctattcgtcatcgcattcaggtggtatttcaggatccaaactcctcgctcaacccacgactcaacgttttgcasattattgaggaaggcttacgggttcaccagccgacgctttctgccgcacaacgcgaacaacaagtgatagacgtgatgcatgaagtgggattagatcctgaaacacgccaccgttatccggcggagttctctggtggtcagcgacaacgtattgcgattgccagggcattaattcttaagccctcgctgatcatacttgatgaaccgacatcatcactcgacaaaacggtacaggcgcaaatattgacgctattgaaatcattgcaacaaaagcatcaactggcctatttgtttatcagccacgatttgcacgttgtccgcgcgttatgtcatcaggttatcgtactgcgacaaggggaagtagtggaacaaggaccgtgcgcgcgcgtgtttgccacaccgcagcaggagtatacgcgtcagctactggcgttgagctga

SEQ ID NO: 27175 - protein, 529 aa, Escherichia coli O157:H7 EDL933
  Xaa in position 383 is unknown
MTQTLLAIEDLSVGFRHQQTVRTVVNDVSLQIEAGETLALVGESGSGKSVTALSILRLLPSPPVEYLSGDIRFHGESLLHASDQTLRGVRGNKIAMIFQEPMVSLNPLHTLEKQLYEVLSLHRGMRREAARGEILNCLDRVGIRQAAKRLTDYPHQLSGGERQRVMIAMALLTRPELLIADEPTTALDVSVQAQILQLLRELQGELNMGMLFITHNLSIVRKLAHRVAVMQNGRCVEQNYAATLFASPTHPYTQKLLNSEPSGDPVPLPEPASTLLDVEQLQVAFPIRKGILKRIVDHNVVVKNISFTLRAGETLGLVGESGSGKSTTGLALLRLINSQGSIIFDGQPLQNLNRRQLLPIRHRIQVVFQDPNSSLNPRLNVLXIIEEGLRVHQPTLSAAQREQQVIDVMHEVGLDPETRHRYPAEFSGGQRQRIAIARALILKPSLIILDEPTSSLDKTVQAQILTLLKSLQQKHQLAYLFISHDLHVVRALCHQVIVLRQGEVVEQGPCARVFATPQQEYTRQLLALS

SEQ ID NO: 27176 - DNA, 1590 bp, Escherichia coli O157:H7
  CDS (1)..(1590): transl_table=11
atgacgcaaactctgttagcgattgaagatttgtcggtgggttttcgccatcagcaaaccgtacgtacagtagtcaatgatgtttcactacagattgaggctggcgaaacgctggcgctggtgggtgagtcaggttcaggcaaaagcgttaccgcgctgtcaattttacgcctgctcccttccccgccggttgaatatctctccggcgatattcgttttcatggcgaatcgctgcttcatgccagcgaccaaacgttgcgcggtgtacgcggtaataagatcgccatgatttttcaagagccgatggtgtcgttaaatccattgcataccctggaaaaacagctttatgaagtgctttcactccaccgcgggatgcgtcgggaagcggctcgtggcgaaattcttaactgccttgatcgcgttggtatccgccaggcggcaaaacggctgacagattatccgcatcagctctccggcggcgaacgccagcgggtgatgattgcgatggcgctgttaacgcgaccggaattattaattgccgatgaaccgaccaccgcactggacgtctctgtccaggcgcagattttacagctgttgcgcgaactgcaaggcgagttgaatatgggcatgctgtttattactcataacctcagcattgtcagaaaactggcccaccgcgtggcggtaatgcaaaacggtcgctgtgtcgagcaaaattacgccgctacgctatttgcctcacccactcatccttacacacaaaagctactcaacagtgaaccgtcaggcgatccagtgccgttgccagaacctgcctcaacgttgctggatgttgaacagcttcaggttgccttccccattcgcaaagggattttgaagcgcattgtggatcataatgtggtggtgaaaaacatcagttttacgctacgagcgggtgaaacactgggtttagtgggcgagtccggttccgggaaaagcacgacgggactggcgctgctgcgactgattaattctcagggcagcatcatctttgacggtcagccactgcaaaatttaaatcgccgccagctgttacctattcgtcatcgcattcaggtggtatttcaggatccaaactcctcgctcaacccacgactcaacgttttgcagattattgaggaaggcttacgggttcaccagccgacgctttctgccgcacaacgcgaacaacaagtgatagacgtgatgcatgaagtgggattagatcctgaaacacgccaccgttatccggcggagttctctggtggtcagcgacaacgtattgcgattgccagggcattaattcttaagccctcgctgatcatacttgatgaaccgacatcatcactcgacaaaacggtacaggcgcaaatattgacgctattgaaatcattgcaacaaaagcatcaactggcctatttgtttatcagccacgatttgcacgttgtccgcgcgttatgtcatcaggttatcgtactgcgacaaggggaagtagtggaacaaggaccgtgcgcgcgcgtgtttgccacaccgcagcaggagtatacgcgtcagctactggcgttgagctga

SEQ ID NO: 27177 - protein, 529 aa, Escherichia coli O157:H7
MTQTLLAIEDLSVGFRHQQTVRTVVNDVSLQIEAGETLALVGESGSGKSVTALSILRLLPSPPVEYLSGDIRFHGESLLHASDQTLRGVRGNKIAMIFQEPMVSLNPLHTLEKQLYEVLSLHRGMRREAARGEILNCLDRVGIRQAAKRLTDYPHQLSGGERQRVMIAMALLTRPELLIADEPTTALDVSVQAQILQLLRELQGELNMGMLFITHNLSIVRKLAHRVAVMQNGRCVEQNYAATLFASPTHPYTQKLLNSEPSGDPVPLPEPASTLLDVEQLQVAFPIRKGILKRIVDHNVVVKNISFTLRAGETLGLVGESGSGKSTTGLALLRLINSQGSIIFDGQPLQNLNRRQLLPIRHRIQVVFQDPNSSLNPRLNVLQIIEEGLRVHQPTLSAAQREQQVIDVMHEVGLDPETRHRYPAEFSGGQRQRIAIARALILKPSLIILDEPTSSLDKTVQAQILTLLKSLQQKHQLAYLFISHDLHVVRALCHQVIVLRQGEVVEQGPCARVFATPQQEYTRQLLALS

SEQ ID NO: 27178 - DNA, 1512 bp, Escherichia coli O157:H7
  CDS (1)..(1512): transl_table=11
atgttcacggcaacagaggcagtcccggtagcaaaagtggtggcaggaaataagcgttatcccggcgtcgttgcgttggataacgttaacttcacgctcaataaaggcgaggttcgtgcgctgttaggcaaaaacggcgcgggcaaatcgaccctcattcgaatgcttaccggcagtgaacgtccggatagcggtgaaatctggattggcgagacgcgactggaaggtgacgaagctacgctgactcgccgtgccgctgaactgggggtacgcgcggtttatcaggagttaagtctggtggaagggctgacggtggcggaaaacctctgcctcggtcagtggccccgccgcaacggcatgattgattacctgcaaatggcgcaggatgcccaacgttgcttacaggcgctgggcgttgacgttagtcctgaacaacttgtttcaacactaagcccggcgcataagcagctggtggaaattgcgcgggtgatgaagggcgagccgcgcgtggtcattcttgatgaacctaccagttcgcttgcgagtgcggaagttgaactggtgatcagagcggtgaaaaagatgtcagcactgggcgtggcggtgatttatgtcagccaccggatggaagaaattcgccgcattgcctccagtgccaccgttatgcgcgacgggcaggtggctggcgatgtgatgctcgaaaacacttccacgcatcatattgtgtcgctaatgctagggcgcgatcacgttgatattgcgccggttgcacctcaggaaattgtggatcaggccgtgctggaagtccgtgcgttacgccataagcccaagctggaggatatcagctttacgctacgtcgtggcgaagtgctcggcattgctggtctgctgggggcagggcgcagtgaattgctgaaggcgattgttgggctggagacgtatgaacagggcgaaattgttatcaacggcgagaaaatcacgcgccccgattacggcgacatgctgaaacgcggcattggctatacgccagaaaaccgcaaagaagcggggatcattccctggttgggcgttgacgaaaatacagtgctgaccaatcggcaaaaaatcagcgccaacggagtgctgcaatggtccaccatccgccgcctgaccgaagaagtgatgcagcggatgacggtcaaggccgccagtagcgaaacgcccatcggcacgctttctggcggcaatcagcaaaaagtagtgatcggtcgttgggtctatgccgccagccagattttgttgctcgacgagccaacgcgcggcgtcgatatcgaagccaaacagcagatttaccgtattgtccgtgagctggctgccgaaggaaaaagcgtggtgtttatctccagtgaagtggaggagttgccgttggtgtgtgaccgcatcctgttattacagcacggcacgttctcgcaggagtttcacgctccggtcaatgtggatgagctgatgtccgccattctgtctgtgcactga

SEQ ID NO: 27179 - protein, 503 aa, Escherichia coli O157:H7
MFTATEAVPVAKVVAGNKRYPGVVALDNVNFTLNKGEVRALLGKNGAGKSTLIRMLTGSERPDSGEIWIGETRLEGDEATLTRRAAELGVRAVYQELSLVEGLTVAENLCLGQWPRRNGMIDYLQMAQDAQRCLQALGVDVSPEQLVSTLSPAHKQLVEIARVMKGEPRVVILDEPTSSLASAEVELVIRAVKKMSALGVAVIYVSHRMEEIRRIASSATVMRDGQVAGDVMLENTSTHHIVSLMLGRDHVDIAPVAPQEIVDQAVLEVRALRHKPKLEDISFTLRRGEVLGIAGLLGAGRSELLKAIVGLETYEQGEIVINGEKITRPDYGDMLKRGIGYTPENRKEAGIIPWLGVDENTVLTNRQKISANGVLQWSTIRRLTEEVMQRMTVKAASSETPIGTLSGGNQQKVVIGRWVYAASQILLLDEPTRGVDIEAKQQIYRIVRELAAEGKSVVFISSEVEELPLVCDRILLLQHGTFSQEFHAPVNVDELMSAILSVH

SEQ ID NO: 27180 - DNA, 2685 bp, Escherichia coli O157:H7
  CDS (1)..(2685): transl_table=11
gtgagccagcattatggaaaaaccgttgcgctgaacaatatcacactcgatattccggcccgctgtatggtcgggctgattggtccggatggcgtcgggaagtcgagtttattgtcattgatttccggtgctcgtgtcattgagcagggcaatgtgatcgtgctgggcggcgatatgcgcgacccgaagcatcgccgcgacgtctgcccgcgcatcgcctggatgccgcaggggctgggcaaaaacctctaccacaccttgtcggtgtatgaaaacgtcgattttttcgctcgcctgttcggtcacgacaaagcggagcgggaagtgcgaatcaatgagctgctgaccagcaccgggttagcaccgtttcgcgatcgtccggcagggaaactctccggcgggatgaagcaaaaactggggctgtgctgtgcgttaatccacgacccggaactgttgattcttgatgagcctacgacgggggttgacccgctctcccgcgcccagttctgggatctgatcgacagtattcgccagcggcagagcaatatgagcgttctggtcgccacggcctatatggaagaggcggaacgcttcgactggttggtggcgatgaatgccggagaagtgttggcaactggcagcgccgaagagctgcggcagcaaacgcaaagcgccacgctggaagaagcatttataaatctgttaccgcaagcgcaacgccaggcgcatcaggcggtagtgatcccaccatatcaacctgaaaacgcagagattgccatcgaagcgcgcgatctgaccatgcgttttggttccttcgttgccgttgatcacgtcaatttccgcattccacgcggggagatttttggttttcttggttcgaacggctgcggtaaatccaccaccatgaaaatgcttaccggattgctgcccgccagcgaaggtgaggcgtggctgttcgggcaaccggttgatccaaaagatatcgatactcgccgtcgggtgggctatatgtcgcaggcgttttcgctctataacgagctcaccgtgcggcaaaaccttgagttacatgcccgtttgtttcacatcccggaagcggaaattcccgcaagagtggctgaaatgagcgagcgttttaagctcaacgacgttgaagatgttctgccggagtcattgccgctcggcattcgccagcggctttcgctggcggtggcggtgattcatcgcccggaaatgttaatcctcgatgaacctacttctggcgtcgatccggtggcgagggatatgttctggcagttgatggtcgatctctcgcgccaggacaaagtgactatcttcatctccacccactttatgaacgaagcggaacgctgcgaccgtatctctctgatgcacgccggaaaagtgctcgccagcggtacaccgcaggaactggttgagaaacgcggagccgccagtctggaagaggcatttatcgcctatttgcaggaagcggcaggacagagcaacgaagccgaagcgcctcccgtgatacacgacaccacacacgcgccgcgccagggatttagcctgcgccgtctgtttagctacagccgccgcgaagcgctggaactgcgacgcgatccggtacgttcgacgctggcgctgatgggaacagtgatcctgatgctgataatgggttacggcatcagtatggatgtggaaaacctgcgctttgcggtgcttgaccgcgaccagaccgtcagtagccaggcgtggacgctcaatctctccggttcccgttactttatcgaacagccgctgcttaccagttatgacgagcttgatcgtcggatgcgtgcgggcgatatcacggtggcaattgagatcccgcccaatttcgggcgcgatatcgcgcgtggtacgcctgtggaactcggtgtctggatcgacggtgcgatgccgagccgcgccgaaactgtaaaaggttacgtgcaggccatgcaccagagctggctacaggatgtggcgagccgacaatccacaccctccagccaaagcgggctgatgaatattgagacgcgttatcgctataacccggacgtaaaaagcctgccagcgattgttccggcggtgatcccgcttctgctgatgatgatcccgtcaatgctaagcgcccttagcgtggtgcgggaaaaagagctagggtcgattatcaacctttacgtgacccccaccacccgtagcgaatttttgcttggcaaacagctgccgtacatcgcgctggggatgctgaactttttcctgctctgcggcctgtcggtgtttgtgtttggcgtaccgcataaaggcagtttcctgacgctcaccctggcggcgctgctgtatatcatcatcgccaccggaatggggctgctgatctccacctttatgaaaagccagattgccgccattttcggtacggcgattatcacgttgatcccggcgacacagttttccgggatgatcgatccggtagcttcgctggaagggccgggacgttggatcggcgaggtttacccgaccagtcattttctgactatcgcccgcgggacgttctcgaaagcgctggatctgactgatttgtggcaactttttatcccgttgctgatagccataccgctggtgatgggcttaagcatcctgctgctgaaaaaacaggagggatga

SEQ ID NO: 27181 - protein, 894 aa, Escherichia coli O157:H7
MSQHYGKTVALNNITLDIPARCMVGLIGPDGVGKSSLLSLISGARVIEQGNVIVLGGDMRDPKHRRDVCPRIAWMPQGLGKNLYHTLSVYENVDFFARLFGHDKAEREVRINELLTSTGLAPFRDRPAGKLSGGMKQKLGLCCALIHDPELLILDEPTTGVDPLSRAQFWDLIDSIRQRQSNMSVLVATAYMEEAERFDWLVAMNAGEVLATGSAEELRQQTQSATLEEAFINLLPQAQRQAHQAVVIPPYQPENAEIAIEARDLTMRFGSFVAVDHVNFRIPRGEIFGFLGSNGCGKSTTMKMLTGLLPASEGEAWLFGQPVDPKDIDTRRRVGYMSQAFSLYNELTVRQNLELHARLFHIPEAEIPARVAEMSERFKLNDVEDVLPESLPLGIRQRLSLAVAVIHRPEMLILDEPTSGVDPVARDMFWQLMVDLSRQDKVTIFISTHFMNEAERCDRISLMHAGKVLASGTPQELVEKRGAASLEEAFIAYLQEAAGQSNEAEAPPVIHDTTHAPRQGFSLRRLFSYSRREALELRRDPVRSTLALMGTVILMLIMGYGISMDVENLRFAVLDRDQTVSSQAWTLNLSGSRYFIEQPLLTSYDELDRRMRAGDITVAIEIPPNFGRDIARGTPVELGVWIDGAMPSRAETVKGYVQAMHQSWLQDVASRQSTPSSQSGLMNIETRYRYNPDVKSLPAIVPAVIPLLLMMIPSMLSALSVVREKELGSIINLYVTPTTRSEFLLGKQLPYIALGMLNFFLLCGLSVFVFGVPHKGSFLTLTLAALLYIIIATGMGLLISTFMKSQIAAIFGTAIITLIPATQFSGMIDPVASLEGPGRWIGEVYPTSHFLTIARGTFSKALDLTDLWQLFIPLLIAIPLVMGLSILLLKKQEG

SEQ ID NO: 27182 - DNA, 2793 bp, Agrobacterium tumefaciens str. C58
  CDS (1)..(2793): transl_table=11
gtgagggtggccgcgatggtcacgccctccgcgacgaatactaaaaacgatcccggcgccccggtcgcacggttgacggatgtacggctggcttttggcagcacggttgcgcttgccgatatatcggtcgaaattcccgccggacggatgatcggccttatcgggcctgacggtgtcggcaagtccagtctgctgtctctgatttccggcgcgcgcgccatacagaagggcaatgtggaggttctggccggcgatatgtccgatccgcgccaccgcgaggatacctgcccgcgcatcgcctatatgccgcagggcctcggtaagaacctttatccaaccctctcagtcttcgaaaatatcgactttttcggcaggctgttcgggcaggatggcagggagagaaaggcacgcattgccgagttgctgaaaagtactggtcttgaacgttttgccgaccggccggccatgaagctttccggcggcatgaaacagaagctcgggctctgctgtgcgctgatccacgatcctgacctgctcattctcgatgagccaacaacgggcgtcgatccgctgtcgcgccggcaattctgggaacttatcgattccatccgtgccggtcgtccgggcatgagcgtgattgtcgcgacggcctatatggaagaggccgccggtttcgactggctggtcgccatggatggcggcaagatcctcgccaccggctcccccggcgaacttctcgaacgcacctcgaccgccaatctcgatgccgcctttattgcgcttcttccggaagaaaagcgcaaggactaccacgaggtgcatatcgcgccacgcagggtgacgcatgatggtgactatgccatcgaggcgtcgcatctcagtatgcgcttcggtgatttcaccgccgtcgacaatgtcagcttcaaaatcccgcgcggcgagattttcggctttctcggctctaatggctgcggaaaatccaccaccatgaagatgctgaccgggcttctggctgccagtgaaggcgaggcgaagcttttcggccacaaggtggatgccagcgacatggcgatccgccaccgcgtcggttacatgagccaggccttttcgctctattccgaactcacggtacgacagaacctcgatcttcacgcgcggctgttcaagctgccggaagcgaccattcagccgcgcatcgccgagatggcggagcgctttgatctcggcaccgtcatggatacgctgccggacgacctgccgcttggcatccggcaaagactgtcgcttgcggtggcgatgatccattcgcccgacattcttatcctcgatgagccgacttcgggtgtcgacccggtggcgcgcgacggcttctggcaaatcctcgctgatctctcccgcaacgacaatgtcaccatcttcatctccacccatttcatgaatgaggcggagcgttgcgaccggatttcgttgatgcatgccggcaaggtgctgatcagcgatacgcctgacgcgattaccaaaagccgtaatgccgaaacgctggaagaggcttttgtcgcctatctcgaggatgcctcgggtgtcaaaaaggcggagcctgcaatagcgcccgctccggcaacggaggtggttccgacccaacacgcaacacctgcccgcaaacggtttttcgatgtccggcgcatgttcagctatacccgccgagaggcgctggaactgcagcgagatcccattcgcggcacattggcggttctcggcagcgtcatcctgatgttcgtgatcggttacggcatcaatctcgatgttgaggacctgtccttcgcggtactggaccgtgacgattccaccatcagccgcgattacgtgctcgacatagccggttcccgttatttcatcgagaaagagccgatccgcgactatgccgatatggaccggcgaatgcgcgacggggaactcagcctcgccatcgaaattccacccggtttcggccgcgatgtcctgcgcggcaagacggtggaggtcggcgcctggatcgacggcgccatgccgcagcgggcagaaaccgtgcgcggttacgtgcagggaatgcaccagacatggctggcgcgcaaggcgagcgaaatctatggcaatgcagcgacgcaaagtagtttcagcatcgaaacgcgctatcgttacaatcccgatgtcaaaagcctcgtcgccatggtcccggcggtcattccgctgctgctgatgctcattcctgccatgctggcggccctcagcgtcgtccgggaaaaagagcttggctccatcgtcaacctctacgtgacgccgaccacgcggctggaattcctgataggaaaacagcttccctatgtggcgctcggaatgctcaatttcctgctgctgaccgcatttgcgatattcatcttccaggtgccgtttaccggcagttatctcgcttacgcgacgggagctttgctcttcgtcatcatcgccacgtccatcggtctcgtcatgtcttcctttatgaagagccagatcgcggcgatcttcggcacggccttgctgacgctcattccggccacacaatattcgggcatgatcgatcccgtttcgtcgctgcagggggcgggggcctttatcggtaacatctatcccgccacctatttcatgactatttcacgcggcaccttttccaaggggctggatttcgccggtctttccggttctttcctgccgcttctcattgccattccgctgctgctcatcgccggtgctgctcttttgaggaaacaggcgtcatga

SEQ ID NO: 27183 - protein, 930 aa, Agrobacterium tumefaciens str. C58
MRVAAMVTPSATNTKNDPGAPVARLTDVRLAFGSTVALADISVEIPAGRMIGLIGPDGVGKSSLLSLISGARAIQKGNVEVLAGDMSDPRHREDTCPRIAYMPQGLGKNLYPTLSVFENIDFFGRLFGQDGRERKARIAELLKSTGLERFADRPAMKLSGGMKQKLGLCCALIHDPDLLILDEPTTGVDPLSRRQFWELIDSIRAGRPGMSVIVATAYMEEAAGFDWLVAMDGGKILATGSPGELLERTSTANLDAAFIALLPEEKRKDYHEVHIAPRRVTHDGDYAIEASHLSMRFGDFTAVDNVSFKIPRGEIFGFLGSNGCGKSTTMKMLTGLLAASEGEAKLFGHKVDASDMAIRHRVGYMSQAFSLYSELTVRQNLDLHARLFKLPEATIQPRIAEMAERFDLGTVMDTLPDDLPLGIRQRLSLAVAMIHSPDILILDEPTSGVDPVARDGFWQILADLSRNDNVTIFISTHFMNEAERCDRISLMHAGKVLISDTPDAITKSRNAETLEEAFVAYLEDASGVKKAEPAIAPAPATEVVPTQHATPARKRFFDVRRMFSYTRREALELQRDPIRGTLAVLGSVILMFVIGYGINLDVEDLSFAVLDRDDSTISRDYVLDIAGSRYFIEKEPIRDYADMDRRMRDGELSLAIEIPPGFGRDVLRGKTVEVGAWIDGAMPQRAETVRGYVQGMHQTWLARKASEIYGNAATQSSFSIETRYRYNPDVKSLVAMVPAVIPLLLMLIPAMLAALSVVREKELGSIVNLYVTPTTRLEFLIGKQLPYVALGMLNFLLLTAFAIFIFQVPFTGSYLAYATGALLFVIIATSIGLVMSSFMKSQIAAIFGTALLTLIPATQYSGMIDPVSSLQGAGAFIGNIYPATYFMTISRGTFSKGLDFAGLSGSFLPLLIAIPLLLIAGAALLRKQAS

SEQ ID NO: 27184 - DNA, 1593 bp, Staphylococcus aureus subsp. aureus Mu50
  CDS (1)..(1593): transl_table=11
atgtcaaatttattagaagtcaacagtctgaatgtacaattcaattatgatgaaactacagttcaagcggtaaaaaatgtctctttcgaattacgaaaaaaacatatcctaggtattgttggtgaatcaggatcaggaaaaagtattactgctaaatctattttagggctactaccagattatccagatcacacattaacaggagaaattatttttaatgggcaatcgttaaataatttatcaacttcagcgttacaacaaattcgaggtaaggatatttcaatgatttttcaagatccactctcttcgttgaatccaagattaacgattggcaaacaaattacagaagtactatttcaacataaacgtgtatctaaatctgaagcaaagtcgatgacaataaacattttagaaaaagtaggtataaaacatgcaactcgacaatttgatgcttatccacatgaactttctggtggtatgcgtcaacgtgtcatgatagcaatggcattgattttaaagccacaaattttaatcgcagatgaaccaacaacggcattagatgccagtacacaaaatcaattactgcagttaatgaagtccctttatgagtacacagaaacatctattatttttatcactcacgatttaggcgctgtgtatcaattttgcgacgatgtgattgtaatgaaagatggaagtgtcgttgaaagtggcacggttgaaagtatttttaaatcgccacaacatacctatacaaaacgcttaatagatgcgattcctgatattcatcaaacgcgtccgccaagaccgttaaacaatgatattttattaaaattcgatcgcgtgagcgtggattacacatcaccgagtggcagcctataccgagcagttaatgatattaacttggctattagaaaaggcgaaacattaggcattgtcggtgaatcagggtcagggaaatcgacattagctaagacggtcgtcggtctaaaggaagtgtcagaaggctttatttggtataacgaattaccattaagtttatttaaagatgatgaattgaaatctttacgacaagagatacaaatgatttttcaagatccattcgcatctattaatccaagatttaaagtcattgatgtgattaaacgaccactaatcattcatgggaaagtcaaagataatgatgacattattaaaactgtcgtatcgttgttagaaaaggttggcctagatcaaagtttcttatatcgctatccacacgaattatctggtgggcaacgtcagcgtgtaagtatcgcgagagcacttgctgtagaacctaaagtgattgtttgcgacgaggcagtgtccgctttagacgtttcaattcaaaaagatatcatcgagttattaaaacaattacagttagacttcggcatcacttatttattcatcacacatgacatgggtgttatcaatgaaatatgtgatcgcgttgcagttatgaaaaatggcgaaatcgttgaactgaataacacagaagatattatcaaacatccgcaatcagactatgcaaagcaacttatttcagaagtagcagttattgctaaataa

SEQ ID NO: 27185 - protein, 530 aa, Staphylococcus aureus subsp. aureus Mu50
MSNLLEVNSLNVQFNYDETTVQAVKNVSFELRKKHILGIVGESGSGKSITAKSILGLLPDYPDHTLTGEIIFNGQSLNNLSTSALQQIRGKDISMIFQDPLSSLNPRLTIGKQITEVLFQHKRVSKSEAKSMTINILEKVGIKHATRQFDAYPHELSGGMRQRVMIAMALILKPQILIADEPTTALDASTQNQLLQLMKSLYEYTETSIIFITHDLGAVYQFCDDVIVMKDGSVVESGTVESIFKSPQHTYTKRLIDAIPDIHQTRPPRPLNNDILLKFDRVSVDYTSPSGSLYRAVNDINLAIRKGETLGIVGESGSGKSTLAKTVVGLKEVSEGFIWYNELPLSLFKDDELKSLRQEIQMIFQDPFASINPRFKVIDVIKRPLIIHGKVKDNDDIIKTVVSLLEKVGLDQSFLYRYPHELSGGQRQRVSIARALAVEPKVIVCDEAVSALDVSIQKDIIELLKQLQLDFGITYLFITHDMGVINEICDRVAVMKNGEIVELNNTEDIIKHPQSDYAKQLISEVAVIAK

SEQ ID NO: 27186 - DNA, 1704 bp, Sinorhizobium meliloti 1021
  CDS (1)..(1704): transl_table=11
atgagcgcctccgtcctgtctgtccgcgacctgaccgtgaaggcgcatctccagggagagacgcgcacgctgctggatggcatctcgctcgacctcgccaagggcgagatcctcggcctcgtcggcgaaagcggatcgggcaagagcctgttctgccgcgcgctggttcgcctcctgccatcatccctgctgaagatcgaaggcggtgcggttctcctcggagggcgcgacctcacggccgtcaccgacgccgagatgctggaggtgcgcggcgccgagatcggcatgatcttccagaacccgaccagccacctcgacccggtcatgcgcatcggcgaccagatcgccgagggcatccgctaccatcagggcctcggcggccgcgatgcgcgggcggcagcggtcgagatactggggcagatcgggttccctgaacccgtccgccagtacgacagctacccgcacgagctttccggcggcatgcgtcagcgggccatgatcggcgtggcactgtcctgcaatccgcaaatcctcatagccgacgaaccgacgaccgccctcgacgtgacgatccaggcgcagatcctgaaactcctgatggacatccgcgacaggcgcggcctgtcgatcatcctcattacccatgatctcggcatcgtggcgcagacctgcgaccgcattgccgtgatgcgcggcggaaagctgctggaacagggtcctaaacggacgatcctgtccgcaccgcaggacccgtatacagttcggctcatccacagccatccatccatgcccgaggcggtgctccccgccaccagtctcccagcgccctcacatggagcgacaaggtcgcttctggagatcgatgacttgcatgtgcgcttcccgtcgggcggcagccttttcaggggaaagaacgccagggccgtcagcgccgtttcggggatcagcctgcggatcatgcccggcgaaacggtcggtatcgtcggcgaatccggcagcggcaaaagtacgcttgcccgcgccatgctgggcctgacgccgatttccgccggtcacgtcagcttcgacggtatcgatctttctcagcagaggggtgcgggtctcaccaggctgcgacacgagtccgccatggtctttcaggatccgttcaatgcattgaacccgcgcctgaccatcggccagactcttgctgaagttctgaaagtgcagaaaaagatcggcggagccgacattccggcacgcatcggcgagctgctggaccttgtcggcctcgagcgcgaattcgcccatcgcaaaccgcgcagcatgagcggcggccagtgccagagggcgggcatcgcccgtgcccttgccgtcgacccgagactgattatcgccgacgaatgcgtcgcagcactcgatgtcacgatccaggcgcagatcgtcgacctcttccgcaagctcgcccgcgaccttaacctcacgctgatcttcatcgcccatgacctcgcgatcgtgcgcaacctgtgcgaacgcaccgtggtgatgcatcgcggagagatcatcgaggagggccgctccgaggacgtcttctcccggccgaaacatccctacaccgccgcattgatcgccgcgatccccgacatcgatcccgacaggtcattactcggccataccgatgcgccgccggtggaaccgatccagtccgtcaaacgcctgccataa

SEQ ID NO: 27187 - protein, 567 aa, Sinorhizobium meliloti 1021
MSASVLSVRDLTVKAHLQGETRTLLDGISLDLAKGEILGLVGESGSGKSLFCRALVRLLPSSLLKIEGGAVLLGGRDLTAVTDAEMLEVRGAEIGMIFQNPTSHLDPVMRIGDQIAEGIRYHQGLGGRDARAAAVEILGQIGFPEPVRQYDSYPHELSGGMRQRAMIGVALSCNPQILIADEPTTALDVTIQAQILKLLMDIRDRRGLSIILITHDLGIVAQTCDRIAVMRGGKLLEQGPKRTILSAPQDPYTVRLIHSHPSMPEAVLPATSLPAPSHGATRSLLEIDDLHVRFPSGGSLFRGKNARAVSAVSGISLRIMPGETVGIVGESGSGKSTLARAMLGLTPISAGHVSFDGIDLSQQRGAGLTRLRHESAMVFQDPFNALNPRLTIGQTLAEVLKVQKKIGGADIPARIGELLDLVGLEREFAHRKPRSMSGGQCQRAGIARALAVDPRLIIADECVAALDVTIQAQIVDLFRKLARDLNLTLIFIAHDLAIVRNLCERTVVMHRGEIIEEGRSEDVFSRPKHPYTAALIAAIPDIDPDRSLLGHTDAPPVEPIQSVKRLP

SEQ ID NO: 27188 - DNA, 1491 bp, Yersinia pestis CO92
  CDS (1)..(1491)
atgtctgagttgcaaatatcgcaaggttgttttcgcctgagtgacacacagacactcatcttgccagcgctacatatccaggcgggtgactgttgggcatttgtcggggccaatggcagtggtaaatctgcgttagccaaggccctgtctggagaactggccctgctggagggcagccgccaaagccacttccgccatggtgtgcgtttatcattcgaacaactacagcaactggtcaatgaagagtggcaacgtaataataccgacctgctcagtgctgatgaagatgacactggccgtactaccgccgaaattattcaggaagcggcccgtgacccgcagcgctgtcaacaactggcagcgctatttggaatcagccacttgctttctcgccgcttcaaatacctttctacgggggaaacccgtaaaacattgctgtgtcaggcgctgatgccgcaaccggacctgctgattctggatgagccctttgatggcctggatgtcgcggctcgggcgcagttagccgagatgctatccacactttcggcccaaggcgtcaccctggtattggtcctcaaccgctttgatgatatccctgattttgtgcagtacgttggcgtattggctgattgccacctgacccacatggggccgcgccagcagattctgtcggaagcgttaattgcccaattggcacacagtgaaaatctggatgggctgtcactgccggaaacggaggatccacagcaccacctacgaataccgaaaaatgaacccttgatcatactgaatgacggggtggtggagtacaacgaccgccctatcctgcataacctgagctggcaagtgaaccccggtgaacactggcagattatcggccagaatggtgcagggaaatccaccttactcagcctgataactggcgaccatccccaaggatacagtaatgatttaacgctgtttggccgccgccgtggcagtggtgaaaccatctgggacatcaaacgccatattggttatgtcagcggcagcctccatctggactaccgggttagcacccgtgtacgtaccgtgattttatccggttttttcgattcgattggtctttaccaagcagcctctgatcgtcaacaacaattagcagatcaatggctgtctttactggggttttccacctccgtcgccaaccaacctttccacagcttatcttgggggcaacagcgtctggtcttgatcgcccgagcattggttaagcacccagcgctcctgatcctggatgaacccttacaagggctggatccgcttaaccgtttgttagtgcgccgttttattgatgtgatgatcggtgaaggagaaacccaattattgttcgtttctcaccatgccgaggatgcaccccagtgtattacgcaccgcttaacctttgtgccatttggcgatatttatcactatcaacaagaaaaatcaccaagccaaccacaggtaaaataa

SEQ ID NO: 27189 - protein, 496 aa, Yersinia pestis CO92
MSELQISQGCFRLSDTQTLILPALHIQAGDCWAFVGANGSGKSALAKALSGELALLEGSRQSHFRHGVRLSFEQLQQLVNEEWQRNNTDLLSADEDDTGRTTAEIIQEAARDPQRCQQLAALFGISHLLSRRFKYLSTGETRKTLLCQALMPQPDLLILDEPFDGLDVAARAQLAEMLSTLSAQGVTLVLVLNRFDDIPDFVQYVGVLADCHLTHMGPRQQILSEALIAQLAHSENLDGLSLPETEDPQHHLRIPKNEPLIILNDGVVEYNDRPILHNLSWQVNPGEHWQIIGQNGAGKSTLLSLITGDHPQGYSNDLTLFGRRRGSGETIWDIKRHIGYVSGSLHLDYRVSTRVRTVILSGFFDSIGLYQAASDRQQQLADQWLSLLGFSTSVANQPFHSLSWGQQRLVLIARALVKHPALLILDEPLQGLDPLNRLLVRRFIDVMIGEGETQLLFVSHHAEDAPQCITHRLTFVPFGDIYHYQQEKSPSQPQVK

SEQ ID NO: 27190 - DNA, 1593 bp, Yersinia pestis CO92
  CDS (1)..(1593)
atggcgacctcaccactattggatatccaaaacctcagtgttgcgtttagtcaggcaggcgttcagcgtgaggttgtcagcgaactgtcattacaaatcaacgctggagaaacactggcgctggtcggggaatcaggatcggggaaaagcgtcaccgcgttgtccgtgttacgtttgctaccatcaccgccagtagtgtatcccacaggtgatattctgtttgcgggcagctcattgctacatgctgatgagccaacactacggcgcattcgtggtaatcagatttcgatgatcttccaagaaccgatggtgtcactcaacccgctgcataatattgaaaaacagttggcagaagtgctctcactgcaccggggtatggggcaagaagcggcgcgggctgaaattatccaatgcctcgacagagttggcattcgtaatgccaaagggcgattagccgattttccccatcaactttctggcggtgaacgccagcgagtgatgattgccatggcggtattaacccaacccaaattattgattgccgatgagccaaccaccgcactggatgtttctgttcaggcgcaaattctgagcttgctgaaagagttaaagcaagagatgaacatgagcctgctgtttatcacccataacctgaatatcgtgcgccgattagcggataacgtggcggtgatgcgggaaggccgtaaagtggagcagaacaaccggcaggcgctcttcagtgccccgcaacacccctacactcgccagttactggatgctgagtcacaggatgccccgttgccactcgcgcagaatacccagccactgcttgtggttaaagagttgcaagttgccttcccgatcaaacgtggtttactgcgccgcaccgtcgatcaccactatgcgctaaaaagcctcagttttgacctgaagcccggcgaaagtctgggcttggtgggggagtccggttcgggtaaaagtacctccggtctggccttgttacgcttattgccatcacagggtgaaatctggtttagcgggcaaccgctgcaccaatttacccccaaacagatgctgccctatcgcagccgtattcaggtggtcttccaggacccttactcagcattgaacccacgtttgaatgtgcaacagatcattgcggagggcctggaagtgcatcaaaaactcagtgcagcgcaacgtgaagagcgagtgattaaggcaatggaagaagtcggattggatccagccacccgctctcgttatccaactgaattctcgggggggcagcgtcagcgcattgcgattgcccgcgcgctgatcctgcaaccccaactgttgatccttgatgaaccaacgtcttcactggataaatcggtacaggcgcaaattttggccctactgaaatcccttcagcagcgttaccaactcagctacttgtttattagccatgacttgcaggtcgtgcgttcgctctgccatcaggtgattgtcttaagacaaggagaagtggtggaacaaggtgattgtcaggcaatatttgcggcaccaaaacaactatatactcagcaattattagaattagcagactaa

SEQ ID NO: 27191 - protein, 530 aa, Yersinia pestis CO92
MATSPLLDIQNLSVAFSQAGVQREVVSELSLQINAGETLALVGESGSGKSVTALSVLRLLPSPPVVYPTGDILFAGSSLLHADEPTLRRIRGNQISMIFQEPMVSLNPLHNIEKQLAEVLSLHRGMGQEAARAEIIQCLDRVGIRNAKGRLADFPHQLSGGERQRVMIAMAVLTQPKLLIADEPTTALDVSVQAQILSLLKELKQEMNMSLLFITHNLNIVRRLADNVAVMREGRKVEQNNRQALFSAPQHPYTRQLLDAESQDAPLPLAQNTQPLLVVKELQVAFPIKRGLLRRTVDHHYALKSLSFDLKPGESLGLVGESGSGKSTSGLALLRLLPSQGEIWFSGQPLHQFTPKQMLPYRSRIQVVFQDPYSALNPRLNVQQIIAEGLEVHQKLSAAQREERVIKAMEEVGLDPATRSRYPTEFSGGQRQRIAIARALILQPQLLILDEPTSSLDKSVQAQILALLKSLQQRYQLSYLFISHDLQVVRSLCHQVIVLRQGEVVEQGDCQAIFAAPKQLYTQQLLELAD

SEQ ID NO: 27192 - DNA, 1596 bp, Yersinia pestis CO92
  CDS (1)..(1596)
atgctaagtactaacaatatcaccatgcaattcggcagcaagccgctgtttgaaaacatttcagtcaaattcggtggcggtaaccgctatggcctgatcggcgctaatggttgtggtaaatccacattcatgaagattctggggggcgatctggtccctagcggcggtaacgtcttccttgacccgaatgagcgtctgggtaaacttcgtcaggatcaattcgcctttgaaaacaatacagtgctggataccgttattatgggacacggcgaactgtgggaagtaaaagaagagcgtgaccgcatttatgccatggctgaaatgagcgaagaagatggctataaagttgctgatctggaagttgcctacggtgaaatggatggctacagcgcagaagcccgtgctggtgagttgttgctgggcgtgggtattcccgttgaacagcattatggcttgatgagcgaaatcgcacccggttggaagttacgtgtattgctggcgcaagccctgttctccgatccagaaattttgttacttgatgagccaaccaacaacctggatatcgatactatccgttggttagagcaggtgctaaacgaacgtaacagcaccatgattattatttcccatgaccgtcacttccttaacatggtgtgtacgcatatggcggatctggattacggcgaactgcgcgtttatccaggtaactatgatgagtatatgaccgcagcgactcaagctcgcgagcgtttgttgtcagataatgcgaagaaaaaagcccaaatatctgaactgcaatctttcgttagccgctttagcgccaacgcctctaaatctaagcaggcaacttcacgtgctcgccagattgataaaattcagcttgatgaggtaaaagcctccagccgccagaacccgtttattcgcttcgatcaggatagaaaactgttccgtaatgcgctggaagttgagatgttgaccaaaggttttgataacggtccgctgtttaaaaatctgactctccgcctggaagtgggtgagaaagtggctatcctcgggccgaacggtattggtaagtctactttgctgaaaaccctgctaggggagtatgaatctgatgctgggaccgtaaaatggtctgaaaacagtaagattggttactacgcacaggatcacgccagtgattttgacatcgatctgacggtgtttgactggatgagccagtggaagcaagagaaagacgatgagcaggcggttcgcagtgtgctggggcgtttgttgtttagccaggatgacatcaagaaaaaagttagcgtgctgtctggtggtgagaaagggcggatgttgtttggtaagttgatgatgcagcgccctaacattttagtcatggatgaaccaaccaaccacttggatatggagtccattgaatctctcaatatggcattggaaatgtacgaagggacattaatcttcgtctcccatgaccgcgagtttgtgagttcactggcaacccgcgtgattgaaatgacgccgaataagcttatcgactttaccggtaactacgaagattatctgagtagccaagggattcactcataa

SEQ ID NO: 27193 - protein, 531 aa, Yersinia pestis CO92
MLSTNNITMQFGSKPLFENISVKFGGGNRYGLIGANGCGKSTFMKILGGDLVPSGGNVFLDPNERLGKLRQDQFAFENNTVLDTVIMGHGELWEVKEERDRIYAMAEMSEEDGYKVADLEVAYGEMDGYSAEARAGELLLGVGIPVEQHYGLMSEIAPGWKLRVLLAQALFSDPEILLLDEPTNNLDIDTIRWLEQVLNERNSTMIIISHDRHFLNMVCTHMADLDYGELRVYPGNYDEYMTAATQARERLLSDNAKKKAQISELQSFVSRFSANASKSKQATSRARQIDKIQLDEVKASSRQNPFIRFDQDRKLFRNALEVEMLTKGFDNGPLFKNLTLRLEVGEKVAILGPNGIGKSTLLKTLLGEYESDAGTVKWSENSKIGYYAQDHASDFDIDLTVFDWMSQWKQEKDDEQAVRSVLGRLLFSQDDIKKKVSVLSGGEKGRMLFGKLMMQRPNILVMDEPTNHLDMESIESLNMALEMYEGTLIFVSHDREFVSSLATRVIEMTPNKLIDFTGNYEDYLSSQGIHS

SEQ ID NO: 27194 - DNA, 1515 bp, Yersinia pestis CO92
  CDS (1)..(1515)
atgactcatatttctgatgttgatagagacgtgccgcttatcacgttaaaagcgctgtccaaaagctttggcggtcatcaggcactgaaaaatatcacgttgacgttgaataaaggcgaagttcactgtctggccggggctaatggttgcggaaaaagtacgctgattaagacgattagtggcgtttatgccccagatgacggcagtgaaattatcattgatgaaaaatcttatcaccgcctgacgcctgatcgcgcacgcgctttgggcgtacaggtgatttatcaagacctttcgctgttccctaacctgacggtagccgaaaatattgccttcgaatataacttgaaaggttacttcggctggttcaacaagcagaaaatcaaacaaaaagcctgccagatcttgcatgaactggcttttagtctcgatcccgatgcgctggtacaacatttacccattgcccaacgccagcaggtggctatctgccgtgcgttggttgccgatgcgcgcttggtgattatggatgagcctaccgcctctttgacgcgcaccgaagtgaatcaattattacgcacagtaaattacctgcgagataagcacattaccgtggtcttcgtcagccaccgattagatgaagtgaaagagatttcggatcgcattacggtgatccgcgatggcgaaaaagtggggacctggccagccactgagctttctaccgggcgtattaccgagttgatgaccggcctgaccctcacccacgagcagaaattacccaatgccgaattaggcaaagtggtgctgcaactggaaaacctaagccgtaaagggcaattcgacgatatctcgtttagcctgcatcgcggcgaagtgctcggcctgtgtggtttgctggggtccgggcgaaccgaattggcccttagcctatttggcatcacccatcctgatagcggcaagattaccattgacggtaacccggtgtgcattaaagacaatacccgtgccattgagctaggtattggctatgtatctgaagatcgcctgaccctcggtgccgtattgcaacaatctatcgccgacaacatggtgctgtcgattctgcaacgcatccgtactccactttatctggttgatgacgctaaacagaacgcgctggtgcaagaatgggtgaaggatttggacatcaaaatcacggatgctgataacgcgctgtcaacattgtcagggggcaatcagcaaaaagtggtgctggcaaaatggatcctaaccaaaccgaaagtgttaattctcgattcacctactgtgggggtcgatatcggtgccaaagacagtatttacaagctgatccatcgtctctccggggtgggtatctcggtgttgctgctctctgatgaaatccccgaagcctattacaactgcgatcgcatcctgcatatgcagcaggggcgtatcgtcaatgaactgatcccgaatcaaatgactgaacaacagctggcggaggtcatcaatggctaa

SEQ ID NO: 27195 - protein, 504 aa, Yersinia pestis CO92
MTHISDVDRDVPLITLKALSKSFGGHQALKNITLTLNKGEVHCLAGANGCGKSTLIKTISGVYAPDDGSEIIIDEKSYHRLTPDRARALGVQVIYQDLSLFPNLTVAENIAFEYNLKGYFGWFNKQKIKQKACQILHELAFSLDPDALVQHLPIAQRQQVAICRALVADARLVIMDEPTASLTRTEVNQLLRTVNYLRDKHITVVFVSHRLDEVKEISDRITVIRDGEKVGTWPATELSTGRITELMTGLTLTHEQKLPNAELGKVVLQLENLSRKGQFDDISFSLHRGEVLGLCGLLGSGRTELALSLFGITHPDSGKITIDGNPVCIKDNTRAIELGIGYVSEDRLTLGAVLQQSIADNMVLSILQRIRTPLYLVDDAKQNALVQEWVKDLDIKITDADNALSTLSGGNQQKVVLAKWILTKPKVLILDSPTVGVDIGAKDSIYKLIHRLSGVGISVLLLSDEIPEAYYNCDRILHMQQGRIVNELIPNQMTEQQLAEVING

SEQ ID NO: 27196 - DNA, 1536 bp, Sinorhizobium meliloti 1021
  CDS (1)..(1536): transl_table=11
atgatcccccgcctcgaactgcgcagcattaccaaatgttatcccggcaccgtcgcgaacgacgccgtctcgctgtcgatcctgccgggagagatacacgccgtcctcggagagaacggcgccggcaaatcgacgctgatgaagatcatctatggcgcggctcaagccgattcgggcgagatctattgcgacggcagacggatcgaagcgcacaatcccgcaatctcgcgttcgctcggcatcgagatggtctaccagcatttcgcgctcttcgaatccgtctcggtggtcgagaatatcgccctggcggtcaaaggcactttcgacctcgaccggctcgcggccgagatcaagaccctctcggcacgctacggcatgccgatcgatccgcaccgcagggtgcacgatctctccgtcggcgagcggcagcgcgtggagatcgtgcgatgcctcctgcagtcacccaaacttctgatcctggacgagccgacctcagtgcttacgccgcaagccgtggtgaagctcttcgaaacgcttcgccaactggcaagcgaaggctgcagcatcgtctatatcagccacaagctcgatgaagtgcaggaactttgcgacaccgccacggtgctgcgcaacggcaaggtgaccggcacggcaaaacccaaggaatcgacgtcgctggagctcgcccggatgatggtcggctcgcagcttccgcaaatgcatgtcagtccttcagccccgagcgccaagccgctgctggaagttcgcgggctgtccgctcccgcccgggacaagtacggcaccgagctgacggatgtatccctcgaggtgcatggcggcgagatcgtcggactggccggtgtgtcgggcaatggccaggcggagttgatcgcgctgttgagcggcgagcggacccatccgcgtgcggagacgatcctcatcggcggcagaccgtccggccatctcaacgccggcgaacggcgcaagctcggcatggccttcgtcccggaggaacgcctcggccgtggcgcggttccgccccatgccctatgggaaaacgcagtgctgacggcccaccgggcgggcctcgtgcgcaacgctctcgtcgaccgcaggcgggccggcgagttcgcgaggcacattatcgagcgcttcaaggtgaaggcgaatggaccgcaagcgagcgcgcaaagcctctccggcggcaacctgcagaaattcatcgtcggccgcgaactcaccctggagccgaagattcttctcgtgtcccagccgacctggggcgtggatgtcggtgcagctgccttcatccgccagacgcttgtcgatctaagccgcggcggcgccgcggtgctcgtcgtatcggaggagctcgatgaactgttcgagatttgcgaccgtttgctggtcatttccaacggccgcgtttcccctccattgatcagaaagcagaccaatcgcgaagagatcggcctgttgatgacccgggtcggccatggcgaaacgaggagaagcgaagttgcgcttgaggattga

SEQ ID NO: 27197 - protein, 511 aa, Sinorhizobium meliloti 1021
MIPRLELRSITKCYPGTVANDAVSLSILPGEIHAVLGENGAGKSTLMKIIYGAAQADSGEIYCDGRRIEAHNPAISRSLGIEMVYQHFALFESVSVVENIALAVKGTFDLDRLAAEIKTLSARYGMPIDPHRRVHDLSVGERQRVEIVRCLLQSPKLLILDEPTSVLTPQAVVKLFETLRQLASEGCSIVYISHKLDEVQELCDTATVLRNGKVTGTAKPKESTSLELARMMVGSQLPQMHVSPSAPSAKPLLEVRGLSAPARDKYGTELTDVSLEVHGGEIVGLAGVSGNGQAELIALLSGERTHPRAETILIGGRPSGHLNAGERRKLGMAFVPEERLGRGAVPPHALWENAVLTAHRAGLVRNALVDRRRAGEFARHIIERFKVKANGPQASAQSLSGGNLQKFIVGRELTLEPKILLVSQPTWGVDVGAAAFIRQTLVDLSRGGAAVLVVSEELDELFEICDRLLVISNGRVSPPLIRKQTNREEIGLLMTRVGHGETRRSEVALED

SEQ ID NO: 27198 - DNA, 1647 bp, Sinorhizobium meliloti 1021
  CDS (1)..(1647): transl_table=11
atggctgaacatctgctcgaggtccgtaacctctccgtcgaattccacaccgcggcgggcgtggtccatgcggtgaagtcgatctcctatcacctcgacaaaggcgagacgctggcaatcctcggcgaaagcggttccggcaagtccgtctcgtcctcggcgatcatgaacctcatcgacatgccgccgggccgcatcagtagcggcgaaatcctgctcgacggcagggacctgctgacgatgcctgccgaggaacggcgcgaagtcaacggccgccgggtcgccatgatctttcaggatccgctcagccacctcaatccggtctacagcgtcggctggcagatctccgaagccatgaccactcacgggctcgccggcagcaaggcgcgcgaagaggcgctgcggctccttcgccgcgtcggaatccccgagcccgagcgggcaatgcgcaaatatccgcacgaattctccggcggtcagcgccagcgcgtcatgatcgccatggcgctggcgctccggccggacctcctgatcgccgacgaaccgaccaccgcgctcgacgtgaccgtgcaggcggaagtgctgaagcttctgaaggaactgcagcgcgaaacgggcatggcggtgctgatcatcacccacgatctcggcgtcgtctccgagatcgccgaccgggtcgtcgtgatggaaaagggcgccatcgtcgaagcgggaaccgtgcgcgagatctacaagaacccgcagcatccctatacgcagaagctcatcgccgccgcccccggcaagggcgcgatgcacgaacccggcgcgcgcgccgaacccctgctcagcgtgcgcgacgtgcgcaagacctacggctccttcgaagcgctgaagggcatctccttcgatctgatgcccggcgagaccatggctgtcgtcggagagagcggctccggcaaatcgacgcttgcccgggcccttttgcgtctcgacgagccggacagcggcacggcgctctggaagggccgcgacctgttcgcgctttcgccggcagagctctacaagctcaggcgcgacctccagatggtgttccaggacccgacccagtcgctcaacccgcgcatgacggtctaccagctgatctccgaggcatgggtcatccatccggacatcctgcccaaggcaaagtggcgtgaacgcgtcgcggagctcctggtgcaggtcggtctttcggccgagcacatgagccgctatccgcaccagttttccggcggccagcggcagcgcatcgccattgcccgggcgcttgcgctcgagccgcagctgatcatctgcgacgaggccgtttccgcgctcgacgtctccgtccaggcgcaggtgatcgagcttctcgacaggctgcgccgcgagatggggatcgccttcatcttcatcgcccatgacctgccggtcgttcgcgatttcgccgattacgtcatggtcatgcagcagggagaggtcgtcgagctcggcaccgtccgcgaggtcttcgatacgccgcggcaggcctatacccgcgcccttctcgcggccagcctcagtcccgatccggatgcaaaggccggccacctagcatcggtgccggccgaggctgccgacattcttatcccaaagcggagtcactga

SEQ ID NO: 27199 - protein, 548 aa, Sinorhizobium meliloti 1021
MAEHLLEVRNLSVEFHTAAGVVHAVKSISYHLDKGETLAILGESGSGKSVSSSAIMNLIDMPPGRISSGEILLDGRDLLTMPAEERREVNGRRVAMIFQDPLSHLNPVYSVGWQISEAMTTHGLAGSKAREEALRLLRRVGIPEPERAMRKYPHEFSGGQRQRVMIAMALALRPDLLIADEPTTALDVTVQAEVLKLLKELQRETGMAVLIITHDLGVVSEIADRVVVMEKGAIVEAGTVREIYKNPQHPYTQKLIAAAPGKGAMHEPGARAEPLLSVRDVRKTYGSFEALKGISFDLMPGETMAVVGESGSGKSTLARALLRLDEPDSGTALWKGRDLFALSPAELYKLRRDLQMVFQDPTQSLNPRMTVYQLISEAWVIHPDILPKAKWRERVAELLVQVGLSAEHMSRYPHQFSGGQRQRIAIARALALEPQLIICDEAVSALDVSVQAQVIELLDRLRREMGIAFIFIAHDLPVVRDFADYVMVMQQGEVVELGTVREVFDTPRQAYTRALLAASLSPDPDAKAGHLASVPAEAADILIPKRSH

SEQ ID NO: 27200 - DNA, 1602 bp, Sinorhizobium meliloti 1021
  CDS (1)..(1602): transl_table=11
atgacagagatgaaggactccattctcgctgtacgtggcctgaaggtcgacttttacacccccgacggcaccgtcgaagcggtcaagggcatcgatctcgacgtccgttccggcgagacgctcgcggtcgtcggcgaatccggctcgggcaagagccagaccatgatgggaatcatgggcctgctcgccaagaacggcacggtgaccggttcggcgcgctatcgcggccaggaactcgtagggctcgcaccgaaggccctgaacaaggtgcgcggctcgaagatcaccatgatcttccaggagccgatgacctcgctcgatccgctctacaccatcggccgtcagatcgccgagccgatcgtccatcaccgcggcggcagcttcaaggaggctcgcaggcgcgtcctcgagctcctggagctcgtcggcattcccgagccggggcggcgcatcgacagctatccgcacgagctttccggcggccagcgccagcgtgtcatgatcgccatggcgcttgccaacgagccggatatcctgatcgccgacgagccgacgaccgcccttgacgtgaccatccaggcccagatcctcgatctgctcaaatcgctgcaaaggcgcttcggcatggcgatcgtgctgatcacccacgacctcggcatcgtcaagtacttcgccgaccgtgtcgcggtcatgcgccggggcgaggtcgtggagcaggggatgacggctgatatcttcgagcggccgaagggggactataccaggatgctgctggaggccgaaccgagcgggcgcaaggcttcgccccccgacaacgccccgatcatcctggagggtcgcaatgtcgcggtggactatacgatcccaggcggcctcttccgcggggcctcggccgctttccgtgccgtcgacggcgtcaatcttaggctcaggcagggtcagacgatcggcatcgtcggcgaatccggctccgggaaatcgacgctcggcagggcgctgctgaggcttctgccgagcagcggttactaccgtttcggctcgaccgacatttccggctttgaccgcggcgcgatgcggccgctgcgccgccagctgcagctcgtctttcaggacccctacgggtcgctctcgccgcgccggaccgtgggggagatcatcaccgaaggcctccatgtgcatgagcccgacctgagccgtgccgatcgcgaccgcagggccatcgccgcgttgaaggaagtcggcctcgatcccgcgtcgcgcaaccgctatccgcatgaattctccggcggacagcgccagcgcatcgcaatcgcccgcgcgatcatcctgaagccgaaggtcgtcattctcgacgagccgacttcggccctcgaccggtcggtgcaggggcaggtgatcgaactcctgcgcgatctgcaggaaaagcacggtctctcctacatcttcatcagccacgatctttcggtggtgaaggcgatgtctgactatgtgatcgtgatgaagaacggccggatcgtcgaagagggagaaacggacgcgatcttcgatgcgccgagggagccctatacgaagacgctgatcggcgcggcgttcaacgtgtga

SEQ ID NO: 27201 - protein, 533 aa, Sinorhizobium meliloti 1021
MTEMKDSILAVRGLKVDFYTPDGTVEAVKGIDLDVRSGETLAVVGESGSGKSQTMMGIMGLLAKNGTVTGSARYRGQELVGLAPKALNKVRGSKITMIFQEPMTSLDPLYTIGRQIAEPIVHHRGGSFKEARRRVLELLELVGIPEPGRRIDSYPHELSGGQRQRVMIAMALANEPDILIADEPTTALDVTIQAQILDLLKSLQRRFGMAIVLITHDLGIVKYFADRVAVMRRGEVVEQGMTADIFERPKGDYTRMLLEAEPSGRKASPPDNAPIILEGRNVAVDYTIPGGLFRGASAAFRAVDGVNLRLRQGQTIGIVGESGSGKSTLGRALLRLLPSSGYYRFGSTDISGFDRGAMRPLRRQLQLVFQDPYGSLSPRRTVGEIITEGLHVHEPDLSRADRDRRAIAALKEVGLDPASRNRYPHEFSGGQRQRIAIARAIILKPKVVILDEPTSALDRSVQGQVIELLRDLQEKHGLSYIFISHDLSVVKAMSDYVIVMKNGRIVEEGETDAIFDAPREPYTKTLIGAAFNV

SEQ ID NO: 27202 - DNA, 1476 bp, Salmonella typhimurium LT2
  CDS (1)..(1476): transl_table=11
atgtcatcgttgcaaatttcgcaaggcacgtttcgtctgagcgatacaaaaacacttcatctggattcgctgacgctcaatgcgggcgatagctgggcattcgttggggctaacgggagcgggaagtcggcgctcgcccgcgcgctggcgggcgaactgccgttattaacaggcgagcgccagtgtcggtttacccgcattactcgtctgtcctttgaacaattgcaaaagctggtcagcgatgagtggcaacgtaataacaccgatatgctcagtcctggcgaagacgataccgggcgcactaccgcggaaattattcaggatgatgttcaccatcctgcccgctgtgcgatactggcgcagcagttcggcatttccgctttactcgacaggcgttttaaatacctttctaccggcgagacgcgaaaagcgctgctgtgtcaggcgctgatgtctgagccagagttattgatccttgatgaaccgttcgacgggcttgacgtgaccgcccgtcaacaactggcgcaacgcctgacggcgttgaaccaggcgggtatgaccctggcgctggtactcaaccgttttgatgagatcccggacttcgtgcagtttgccggcgtgcttgccgactgtacgctggcggagaccggaacgacggcggagttgctgcaacgggcgttggttgctcaactcgcgcacagcgagcgtctgaccgacgtacaattacccgaaccggacgaaccttccgcccgccatgcgttacccgatggcgaaccacggatcgtacttaacgatggagtagtctcgtataacgatcgccctatcctccaccacttaagctggcgagtcaatccgggcgaacactggcagatcgtcggtcctaacggagcgggtaagtctacgttgcttagccttattactggcgatcatccgcaaggctacagcaacgatcttacgctgttcgggcggcggcgaggaagcggcgaaacaatctgggatatcaaaaaacatatcggctacgtcagcagcagtttacatctggattaccgcgtcagtaccacggtacgcaatgtcattctctccggctatttcgattctatcggcatttaccaggccgtttcagacaggcaacgaaaactggcgcaacagtggctggatattctgggaatcgataagcgtacggcggatgcccccttccacagtctctcctggggacagcagcggctggcgctaatcgtgcgcgcgctggttaagcatccgacagtgttgattctggatgagccgctgcaagggttggacccgctgaaccgccaactggtacgccgttttgtagatgtattaattcgccagggagagacccaactgctgttcgtttcccatcatgcagaggatgcgcctgcctgtattacccaccggctggaatttgtaccagagggcgaacgttataagtacgtttccggacgatgcaataattaa

SEQ ID NO: 27203 - protein, 491 aa, Salmonella typhimurium LT2
MSSLQISQGTFRLSDTKTLHLDSLTLNAGDSWAFVGANGSGKSALARALAGELPLLTGERQCRFTRITRLSFEQLQKLVSDEWQRNNTDMLSPGEDDTGRTTAEIIQDDVHHPARCAILAQQFGISALLDRRFKYLSTGETRKALLCQALMSEPELLILDEPFDGLDVTARQQLAQRLTALNQAGMTLALVLNRFDEIPDFVQFAGVLADCTLAETGTTAELLQRALVAQLAHSERLTDVQLPEPDEPSARHALPDGEPRIVLNDGVVSYNDRPILHHLSWRVNPGEHWQIVGPNGAGKSTLLSLITGDHPQGYSNDLTLFGRRRGSGETIWDIKKHIGYVSSSLHLDYRVSTTVRNVILSGYFDSIGIYQAVSDRQRKLAQQWLDILGIDKRTADAPFHSLSWGQQRLALIVRALVKHPTVLILDEPLQGLDPLNRQLVRRFVDVLIRQGETQLLFVSHHAEDAPACITHRLEFVPEGERYKYVSGRCNN

SEQ ID NO: 27204 - DNA, 1593 bp, Salmonella typhimurium LT2
  CDS (1)..(1593): transl_table=11
gtgttagtttccagcaacgttaccatgcagttcggcagtaagccgctgttcgaaaacatttccgtcaaatttggcggcggcaaccgttacggcctgatcggcgccaacggtagcggaaagtccacttttatgaaaatcctcggcggcgacctggagccgacgctgggcaatgtttccctcgatccgaatgagcgcatcggtaagctgcgtcaggaccagttcgcttttgaaacattcaccgtacttgatactgtcattatggggcatggcgaactgtgggaagtcaagcaggagcgcgaccgtatctacgccttgccggaaatgagcgaagaagacggctataaagtcgccgatctggaagtaaaatacggcgagatggacggttattccgctgaggcgcgcgcgggcgaactgctgttgggggtgggcatcccgctggagcagcattacggtctgatgagtgaagtcgcgccaggctggaaattacgtgtgctgctggcgcaggcgttattctctaatccggacatcctgttgctcgacgaaccgaccaacaacctggatattgatactatccgttggctggagcaggtgctgaacgagcgcgacagcacgatgatcatcatttcgcacgaccgtcacttcctgaacatggtttgtacgcatatggcggatctggattatggcgacttgcgcgtctatccgggtaactatgatgagtatatgacggcggcgacccaggcgcgtgaacgtctgttggccgataatgcgaagaaaaaagcgcaaattgccgagctgcaatcttttgttagccgttttagcgccaatgcctctaaatcgcgtcaggcaacgtcgcgcgcgcggcagattgataaaatcaagctggaagaggtgaaagcctccagccgtcagaacccgttcatccgttttgagcaggataaaaaactgttccgtaacgctctggaagtggaggcgctgacgaaaggttttgataacggtccgctgtttaaaaatgtcaatttgctgctcgaagtcggcgagaagctggcggtactcggcaccaatggcgtgggtaaatctacgctgctgaagacgctggttggcgatctggacgccgatcacggcaccgttaaatggtcggaaaacgcgcgtattggttactacgcgcaggaccacgaatatgaattcgaaaatgacctgacggtgtttgaatggatgagtcagtggaaacaggaaggcgacgacgagcaggcagtgcgcagtattctgggccgcctgctatttagccaggatgatatcaaaaagcctgccaaagtcctctccggtggcgagaagggccgtatgctgttcggcaaactgatgatgcaaaagccgaatatcctgatcatggacgaaccgactaaccacctggatatggagtcgatcgaatcgctgaatatggcgctggaactgtatcagggcacgctgatctttgtttcgcacgaccgtgagttcgtcagctcgctggcaacccgcgtcattgaaattacgccggagcgcgtggtggacttcagcggcaactacgacgattatttgcgtagtaaagggatcgagtaa

SEQ ID NO: 27205 - protein, 530 aa, Salmonella typhimurium LT2
MLVSSNVTMQFGSKPLFENISVKFGGGNRYGLIGANGSGKSTFMKILGGDLEPTLGNVSLDPNERIGKLRQDQFAFETFTVLDTVIMGHGELWEVKQERDRIYALPEMSEEDGYKVADLEVKYGEMDGYSAEARAGELLLGVGIPLEQHYGLMSEVAPGWKLRVLLAQALFSNPDILLLDEPTNNLDIDTIRWLEQVLNERDSTMIIISHDRHFLNMVCTHMADLDYGDLRVYPGNYDEYMTAATQARERLLADNAKKKAQIAELQSFVSRFSANASKSRQATSRARQIDKIKLEEVKASSRQNPFIRFEQDKKLFRNALEVEALTKGFDNGPLFKNVNLLLEVGEKLAVLGTNGVGKSTLLKTLVGDLDADHGTVKWSENARIGYYAQDHEYEFENDLTVFEWMSQWKQEGDDEQAVRSILGRLLFSQDDIKKPAKVLSGGEKGRMLFGKLMMQKPNILIMDEPTNHLDMESIESLNMALELYQGTLIFVSHDREFVSSLATRVIEITPERVVDFSGNYDDYLRSKGIE

SEQ ID NO: 27206 - DNA, 1872 bp, Salmonella typhimurium LT2
  CDS (1)..(1872): transl_table=11
gtgccgcacagcgatgaactggatagccgcgatgttctgtccgtcagtggcctgaatatcgcgtttcaccacgaagggcaacaggtagacgccgtgcgtaatgtgtcattacgcctgaagcgtggagagactctggcgattgtcggcgagtcgggatcgggaaaatcggtgacggcgctggcgttaatgcggctgattgagcagtcgggcgcgaacgtgcgctgcggcgaaatgctgttgcgtcggcgtaatcgtcaggtgattgagctgtctgagcagagtgacgcgcagatgcggcgtgtgcgcggcgcggatatcgccatgattttccaggagccaatgacctcgctcaacccggtatttaccgttggcgagcaaattgccgaatctattcgtttgcatcagggggccagccacgaagaggcgctggcggaagcgaaacgtatgctcgatcaggtacggatcccggagtcgcaggcgattttatcgcgttatccgcatcagctttccggcgggatgcgccagcgagtcatgatcgcgatggcgctatcctgccgtccggcggtattgattgccgatgaacccaccacggcgctggatgtcactatccaggcgcaaattctgcaacttatcaaagtgttgcagcaagagatgtcgatgggcgtgatttttatcacccacgacatgggcgtcgtggcggatatcgccgatcgcgtgctggtgatgtatcagggcgaggccgtggaaaccggcagcgtagagcagattttccatgcgccgacgcatccttatacccaaacgttactggccgccgtccctcagcttggcgcgatgcgaggccactcgctgccacgccgtttcccgttgatttccgctgacgaaccggccctttatgaatcgcagattgagcaagacacggtggtggaaggcgaacctattctccaggttcgggggctggtgacgcgattcccgctgcgtagcggtctctttaaccgcgttacgcgtgaagttcatgccgttgagaatatcagtttcgatctctggcccggcgaaacgttatcgctggtgggcgagtccggtagcggaaaatcgacgaccggacgcgcgctgctgcggttggttgaatcccggcagggggagattatctttaacggccagcgcattgacacgctgtctgcgggtaaactccagccgttgcgccgcgatattcagtgtattttccaggacccttacgcctcgctcgacccgcgccagaccgtggggtattccattatggaacctttacggattcatggcctggggcagggggacgctgcggcaaagcgcgtggcctggttgcttgagcgtgtcggattacgtcctgaacatgcctggcgttatccgcacgagttttccggcggtcaacgtcagcgcatctgcatagctcgcgcgctggcattgaatcctaaagtgattattgccgatgaggcggtctccgcgctggatgtttccgttcgcgggcagatcattaatttactgctcgatttacaacgggaaatggggatcgcctacctgtttatttcgcatgatatggcggtcgtggagcgaattagccatcgcgtggcggtgatgtatcttggtcaaattgttgagatggggccgcggcgcgccgtttttgaaaatccgcagcatccttatacgcgtaaattgatggcggcggtgccggttgccgatccctccagacaccggccgcggcgcgttctgctatcagatgatatacccagcaatattcataaacgtggcgaagagacgcccgccgtttcattacagttggtcgggccgggacattatgttgcgcggccgctgcaggataatgcgctctcgcgcttataa

SEQ ID NO: 27207 - protein, 623 aa, Salmonella typhimurium LT2
MPHSDELDSRDVLSVSGLNIAFHHEGQQVDAVRNVSLRLKRGETLAIVGESGSGKSVTALALMRLIEQSGANVRCGEMLLRRRNRQVIELSEQSDAQMRRVRGADIAMIFQEPMTSLNPVFTVGEQIAESIRLHQGASHEEALAEAKRMLDQVRIPESQAILSRYPHQLSGGMRQRVMIAMALSCRPAVLIADEPTTALDVTIQAQILQLIKVLQQEMSMGVIFITHDMGVVADIADRVLVMYQGEAVETGSVEQIFHAPTHPYTQTLLAAVPQLGAMRGHSLPRRFPLISADEPALYESQIEQDTVVEGEPILQVRGLVTRFPLRSGLFNRVTREVHAVENISFDLWPGETLSLVGESGSGKSTTGRALLRLVESRQGEIIFNGQRIDTLSAGKLQPLRRDIQCIFQDPYASLDPRQTVGYSIMEPLRIHGLGQGDAAAKRVAWLLERVGLRPEHAWRYPHEFSGGQRQRICIARALALNPKVIIADEAVSALDVSVRGQIINLLLDLQREMGIAYLFISHDMAVVERISHRVAVMYLGQIVEMGPRRAVFENPQHPYTRKLMAAVPVADPSRHRPRRVLLSDDIPSNIHKRGEETPAVSLQLVGPGHYVARPLQDNALSRL

SEQ ID NO: 27208 - DNA, 1590 bp, Salmonella typhimurium LT2
  CDS (1)..(1590): transl_table=11
atgacatctccattgcttgcgattgaaaatttatcggtaggtttccgtcagcaacagcacgtgcgccctgtcgttaacgccatttcgttacaggtgaacgccggggaaacgctggcgctggtcggcgagtcagggtcagggaaaagcgtgacggcgctttccattctgcgtcttttgcctacccctcccgccgtctacctctccggcgatattcgctttcacggcgaatcattgcttcatgccagcgagcagacgttacgcggcgtgcgcggcaataaaatcgccatgatttttcaggaaccgatggtttcacttaacccactgcatacgctggaaaaacagctctatgaagtgctgtcgctccatcggggaatgagtcgggaggcggcaagggcggagatgatcggttgtctggatcgggtcggtatccgccaggcgagccagcgtctgcgcgattatccgcatcagctttccggcggcgaacgccagcgcgtcatgatagccatggcgctgttaacacggccggaattactgatcgccgatgagccgaccaccgccctcgacgtctccgtacaggcgcagatcttatctctactgcgggaactccagcgcgagctcaatatgggattgctgtttatcacccataacctcagcattgtaaaaaaactggcggattcagtggcggtaatgcaacacggcaagtgcgtagagaaccaacgcgccgacacgctgctctccgcgccgacccatccgtacacgcaaaaactactcaacagcgaacccactggcgatccggttccgctccccgccgggcaggcgccgttgctggaagtggacaagctgcgcgtcgccttcccaatccgcaaaggcattctgaagcgcgtcgtggatcataatgtggtggttaacaatatcagtttcaccctgcatccaggcgaaacgctgggtctggtcggcgagtcaggatcgggaaaaagcaccaccggtctggcgctgttacggcttatccgctccgaaggccgcatcgtgtttgacggtcaatcgctggatacgttaaaccgccgccagcttttacctgttcgccaccgtatccaggtcgtattccaggacccgaactcatcgctaaacccgcgtttaaacgtattgcaaattatcgaagaaggcctgcgcgtccaccagcctacgctttcaggcgcgcagcgcgaacagcaggtgaaagcggtcatgatggaagtcggcctggacccggaaacgcggcatcgttaccccgctgagttttccggcggccagcgtcaacgtatcgccgtcgccagggcactgattttaaaaccgtcgcttattattctggatgaaccgacctcatcgctggataaaaccgttcaggcgcagattcttgccctcctgaaatcgctccagcaaaagcaccgtctggcctatatcttcattagccacgatctgcatgtagtacgcgcgctgtgccatcaggttattgtgctgcggcagggggaggtggttgaacaggggcaatgcgagcgcgtgtttaccgcaccgcaacaggcctatacgcgtcagctactcgcgttaagctga

SEQ ID NO: 27209 - protein, 529 aa, Salmonella typhimurium LT2
MTSPLLAIENLSVGFRQQQHVRPVVNAISLQVNAGETLALVGESGSGKSVTALSILRLLPTPPAVYLSGDIRFHGESLLHASEQTLRGVRGNKIAMIFQEPMVSLNPLHTLEKQLYEVLSLHRGMSREAARAEMIGCLDRVGIRQASQRLRDYPHQLSGGERQRVMIAMALLTRPELLIADEPTTALDVSVQAQILSLLRELQRELNMGLLFITHNLSIVKKLADSVAVMQHGKCVENQRADTLLSAPTHPYTQKLLNSEPTGDPVPLPAGQAPLLEVDKLRVAFPIRKGILKRVVDHNVVVNNISFTLHPGETLGLVGESGSGKSTTGLALLRLIRSEGRIVFDGQSLDTLNRRQLLPVRHRIQVVFQDPNSSLNPRLNVLQIIEEGLRVHQPTLSGAQREQQVKAVMMEVGLDPETRHRYPAEFSGGQRQRIAVARALILKPSLIILDEPTSSLDKTVQAQILALLKSLQQKHRLAYIFISHDLHVVRALCHQVIVLRQGEVVEQGQCERVFTAPQQAYTRQLLALS

SEQ ID NO: 27210 - DNA, 1536 bp, Salmonella typhimurium LT2
  CDS (1)..(1536): transl_table=11
atgcaaatcagtcacaatactgcatcccctctgatttgtgtgcagaacatttataaaagttattccggcgtcgaagtactaaagggaattgactttactctgcatgcgggagaggtgcacgcattgcttggcggcaatggtgcgggtaaatcaacattaatgaagattattgccggtatagtcccgccagatggagggactatcgatattgctggtgtgcgttgcagtcatttaacgcctctgaaggcgcaccagtatggcatttacctggttccccaggagcctctgttatttccgagtttatctgtgcgggaaaatatcttgtttggcttgcagggacgtcaggcctccacggaaaaaatgcagcagctattaaaggcgatgggatgccaactcgatccggcgagcgctgcgggtacgcttgatgttgcagaccgccagatcgttgaaattatgcgcggcttgatgcgcgactcgcgaatcttaattcttgatgagcccacggcgtcgttaacgccagccgaaactgatcggttatttacgcgtctgcaagagttgctgaaaaagggtgtcggaattgtatttatttctcataagctaccagaaattagacagttagctcactgcgttagcgtgatgcgtgacggtaaaatcgcattattcggaaaaacgcatgacctttctaccgacgagattattcaagctatcaccccggcaacgcagggcgtcagtctttccgcgaatcaaaagttgtggctggaattgcctggcagccgcccgcagaacgaacgcggcgcgacagtattagcgctggagtcactgacgggcgaaggttttatgaatatcaaccttgaggtgcgggcaggcgaaatccttggtctggccgggttggtcggcgcgggacgcacagaactggctgaaacgctgtacggtattagaccggtcaatgcggggcggatgctgttcaatggtcaagaaattaacgccctgacaacccaacagcggttgcagctcggcctggtctatttgccggaagatcggcagtcatccgggctgtatcttgacgcttccctggcatggaatgtctgttcgctgacccacaaccaaaaaggattttggataaagccccagcgggataacgccacccttgaacgttaccaccgcgcgttaaatatcaaactcaataatgccgaacaggcggcgcgtactttatccggcggtaaccagcaaaaagtattgattgccaaatgcctggaggcctctccgcaattactgattgtcgatgaaccgacccgcggtgtcgatgtctccgcccgcagcgatatttatcagctgttgcgcagtatcgcgcaacaaaatgtcgcggtgctatttatttcctccgatctggaagagatagagcagatggccgatcgcgtatatgtcatgcaccagggggaactgggggggcctgcgttatgcggcgaggaaattaacgttgataccatcatgcacgttgcgtttggcgaacatggtgcgtcggaggcaacatgttga

SEQ ID NO: 27211 - protein, 511 aa, Salmonella typhimurium LT2
MQISHNTASPLICVQNIYKSYSGVEVLKGIDFTLHAGEVHALLGGNGAGKSTLMKIIAGIVPPDGGTIDIAGVRCSHLTPLKAHQYGIYLVPQEPLLFPSLSVRENILFGLQGRQASTEKMQQLLKAMGCQLDPASAAGTLDVADRQIVEIMRGLMRDSRILILDEPTASLTPAETDRLFTRLQELLKKGVGIVFISHKLPEIRQLAHCVSVMRDGKIALFGKTHDLSTDEIIQAITPATQGVSLSANQKLWLELPGSRPQNERGATVLALESLTGEGFMNINLEVRAGEILGLAGLVGAGRTELAETLYGIRPVNAGRMLFNGQEINALTTQQRLQLGLVYLPEDRQSSGLYLDASLAWNVCSLTHNQKGFWIKPQRDNATLERYHRALNIKLNNAEQAARTLSGGNQQKVLIAKCLEASPQLLIVDEPTRGVDVSARSDIYQLLRSIAQQNVAVLFISSDLEEIEQMADRVYVMHQGELGGPALCGEEINVDTIMHVAFGEHGASEATC

SEQ ID NO: 27212 - DNA, 1656 bp, Ralstonia solanacearum GMI1000
  CDS (1)..(1656): transl_table=11
atgacccgcgtcgacctgcgctcggctaagcccgactacgatggcccgctgctgcggctggacgacctgtccgtgcgcttcgaggccgagcacaacgagtggatcgaggccgtcaggcacgtctcgttcgacctgcacgccggcgagcgctttgcgctggtgggcgagtcgggctccggcaagacggtcacggcgctgtcgatcatgcgcctgctggccgacgcgcattacagcggccgcatcctgttcgaggggcgcgacctgctggccgcgagcgagcgccagatgcgcggcctgcgcggcgccgacgtcgcgatggtgttccaggagccgatgacggcgctcaacccgctgtacaccatcggcaaccagatcgtcgagacgctggagctgcacgaaggcctggacaagcgcgccgccaaggcccgcgcgatcgcgctgctggagcacaccggcatcgccgaggcaccgcgccgcttcgatgctttcccgcaccagctgtccggcggccagcggcagcgtgccatgatcgccatggcgctcgcctgcagccccaagctgctggtcgccgacgagcccaccaccgcgctggacgtgaccgtgcgcatgcagatcctgcagctgctgcgcgacctgcaggccgaatacggcatggccgtgatgctgatcacgcacgacctgaacatggtgcgcgcctttgctgagcgcgtgggcgtgatggagcggggcgtgctggtggaaaccggcgagacggcgaccgtcttcagcgcgccgcagcatccctacacagtgcgcctgctggaaagccgcccgcagcgcgatgtgctgccgctggtgccgctcgctcccgtgctgctggaggccgaccaactgacggtcacctacgatcgccatcgccccgggtttgccggctggttccgcgccgatccgttcaccgccgtcgaccaggtctcgctgcagttgcgcgagggcgagaccctgggcatcgtcggcgagtccggttcgggcaagacgacgctggcgcagacgctgctcgggctgcagcgtccgaaggcgggcgatctgcgcttcctcggcagttcgctgctgggccaaacgcgcgacgagcgccgcgcggtgcgtgcccgcatgcaggtggtgtttcaggacccgttcggttcgctctcgccgcgcatgaccatcgagcagatcgtcggcgaggggttggcgctgcatcagccgcacgtcaacgacgccgagcgccgccagcgcgtgatcgaggcgctgcgcgaggtcggcctggaccgcaccgccctgggacgctatccgcatgagttctccggcgggcagcgccagcgcatcgccattgcgcgggtgctgatcctcaagccccaggtcctggtgctggatgagccgacttcggcactcgacgtgtcgatccagcagcaggtgctgtcgttgctgtccgcccttcagaaaaagtacaacctgtcgtacctgttcatcagccacgacctcgccgtgatccgtgccatgtcgcaccgggtgatggtgatgaaggacgggaaggtggtggaggcgggcgacacggaagccgtgctggagtcaccgtcccacccctacacctgcaagctgatggcggctgcggcgctcaagccgcttcagccgccgggctga

SEQ ID NO: 27213 - protein, 551 aa, Ralstonia solanacearum GMI1000
MTRVDLRSAKPDYDGPLLRLDDLSVRFEAEHNEWIEAVRHVSFDLHAGERFALVGESGSGKTVTALSIMRLLADAHYSGRILFEGRDLLAASERQMRGLRGADVAMVFQEPMTALNPLYTIGNQIVETLELHEGLDKRAAKARAIALLEHTGIAEAPRRFDAFPHQLSGGQRQRAMIAMALACSPKLLVADEPTTALDVTVRMQILQLLRDLQAEYGMAVMLITHDLNMVRAFAERVGVMERGVLVETGETATVFSAPQHPYTVRLLESRPQRDVLPLVPLAPVLLEADQLTVTYDRHRPGFAGWFRADPFTAVDQVSLQLREGETLGIVGESGSGKTTLAQTLLGLQRPKAGDLRFLGSSLLGQTRDERRAVRARMQVVFQDPFGSLSPRMTIEQIVGEGLALHQPHVNDAERRQRVIEALREVGLDRTALGRYPHEFSGGQRQRIAIARVLILKPQVLVLDEPTSALDVSIQQQVLSLLSALQKKYNLSYLFISHDLAVIRAMSHRVMVMKDGKVVEAGDTEAVLESPSHPYTCKLMAAAALKPLQPPG

SEQ ID NO: 27214 - DNA, 1524 bp, Agrobacterium tumefaciens str. C58
  CDS (1)..(1524): transl_table=11
atgtccgaaactgcaccacttctggaagcacgcgccatcggtaaatcctttctggggatcacggcgctggacggcgttgatttttcgcttgcacgcggtgaaatccatgcgcttctcggcgaaaacggcgcgggcaagtcgacgctcatcaaaatcctgaccggcgtttaccaccgcgacagcggctcgatctttctcgacggaagcgagatatcgcccgccaatgtcggcgaggcacaggcgctcggtatcggcaccgtttatcaggaagtaaaccttctcgaaaatctcacggttgcggaaaacctatttctcggccgccagccgcatcgcttcggcatgatcgaccgggcctcgatgcagaagcagtcccaggcgctgctaacacaatacgggctttccatcgacgtcaacgccctgctgtccagctattccgtcgccatccgccagatcatcgccattgcccgcgctgtcgatctttccggcaaggtgctggtgctggacgagccgaccgccagtctcgacgcccatgaggtcgagatgttgttcggcgtgctgaaaaacctgcgcgcgcgcggcatcggtatcatcatcatcacccatttcctcaatcaggtctatgatatcgccgaccgcgtgacggttctgcgcaatggtcgtctcgtcggcacgcgcgatatcggcagcctgcccagatccgaactcatcgcgatgatgctgggccgcgaattgcagcacatcacccacgaacatcaggcggcggatgatacggtcgttgatggcgaaccgcctatccatttcgaaggttacggcaaacgcggcagcatcgcccctttcgaccttggcattcgtcccggcgaaatcgtcggcgtcgccggtcttctcggctccggccgcaccgaaacggctttcctgctgttcggcgtcgacaagcccgataccggcaaggccacgatagacggaaagacggtggcgatttcctcacccgaagccgccatcaccgccggcttcggcttctgtccggaagagcgcaagacggacggcatcatcggcgatttttcggtgaccgacaatattgcgctggcacttcaggcccgtcagggctgggcacggccattgtcccgtcggcaaaaagcggagcttgccgaaagcttcatcaaatcgctcgatatccgtcccgccgatcccaaccggccgataaaattcctgtccggcggcaaccagcagaaagccattctggcacgctggctcgccacccatccccggcttctgattctcgatgaaccaacccgcggcatcgatatcggcgcccatgcagaaattctcaaaatgatcgaaaaactctgtaccgagggcatgtcgcttgtggtcatctcgtccgaactcgaagagctgaccgccgttgcccatcgcgtcgtcgtgctctccgaccgccgccacgtcagcgaattgaagggtggtgacgtcaccgccgataacatcatgcgggcgatcgccgaggcggcgaaaacggaggcggcatga

SEQ ID NO: 27215 - protein, 507 aa, Agrobacterium tumefaciens str. C58
MSETAPLLEARAIGKSFLGITALDGVDFSLARGEIHALLGENGAGKSTLIKILTGVYHRDSGSIFLDGSEISPANVGEAQALGIGTVYQEVNLLENLTVAENLFLGRQPHRFGMIDRASMQKQSQALLTQYGLSIDVNALLSSYSVAIRQIIAIARAVDLSGKVLVLDEPTASLDAHEVEMLFGVLKNLRARGIGIIIITHFLNQVYDIADRVTVLRNGRLVGTRDIGSLPRSELIAMMLGRELQHITHEHQAADDTVVDGEPPIHFEGYGKRGSIAPFDLGIRPGEIVGVAGLLGSGRTETAFLLFGVDKPDTGKATIDGKTVAISSPEAAITAGFGFCPEERKTDGIIGDFSVTDNIALALQARQGWARPLSRRQKAELAESFIKSLDIRPADPNRPIKFLSGGNQQKAILARWLATHPRLLILDEPTRGIDIGAHAEILKMIEKLCTEGMSLVVISSELEELTAVAHRVVVLSDRRHVSELKGGDVTADNIMRAIAEAAKTEAA

SEQ ID NO: 27216 - DNA, 1764 bp, Brucella melitensis 16M
  CDS (1)..(1764): transl_table=11
ttgccgacaagcgccaccgccagtcggcttatccgcgcattgcctatatgccgcaagggcttggcaagaacctttatcccacgctttcggtgttcgagaatattgatttcttcgggcggctctttggccacgacagggcggaacggggagtgccgcattgccgatcttctggcgcgcactggtatgtcggcctttgccaaccggccggcgggaaagctttcaggcggcatgaagcagaaaacgagcctctgctgctcgctcatccacgatccggatctcctcattctggacgagcccaccacgggcgtcgatcccttgtcgcgccgccagttctgggagctgatcgacgatatccgcaaggatcgtccgggaatgagcgtcatcgttgcgacggcctatatggaagaagcggagcgtttcgactggctggtggcgatgaatgacggccagattctggcgaccggcacgccgcaggaattgctggagcgcaccgatacgcccaatctcgatgccgctttcatcgcacttctgccggaagaacagcggcggggccatagggaaatacatattccgccgcgcgcgcctgcctctgataccgcaattgccatcgaagcggagcatgtcacggttcggttcggtgattttaccgcagtcgataatgtgagttttcgtattccgcgcggggagatattcggctttctcggctccaacggttgcggcaagaccacaaccatgaaggtcttgaccgggcttttgcccgcaagcgagggcacggcccggcttttcggacgtgaggttgacccgaaggatatcgatatacgccgccatgtcggctacatgtcgcaagcgttttcactttattcggaactgaccgttcatcagaaccttgagcttcatgccaggcttttcggcatggagccggatgtcacggcgcggcggataaaggaactgacggcgcgtttcgaccttgcggatgtgatggatgaattacccgatgccatgccgcttggcattcgccagcgcctgtcgctggctgtggcgctgattcattcgccggatatcctgatcctcgatgagccgacgtcaggtgtcgatcccgtggcgcgggatgccttctggcaaatccttgcggatttgtcgcgccgggacaatgtgacaatttttgtctccacccacttcatgaacgaggcggagctttgcgatcgcatctcgcttatgcacgcgggcaaggtgctgatcagcgatacgccgaaggcaattaccgaaagccgcaatgcggccacgctggaagacgcctttgtcgcctttttgcaggatgcgatcggcgagggtgaacaatccgcgccgcaaaagattgaaaaagatagtgcggagccgaaggcgcaacaccgaaaggcatggccaagctggctgccgaacctgcgccggatgtttgcctatacgcggcgtgaggcgctggaactgaaacgtgatccgatacgggccacgcttgccattctgggcagcgtcattctcatgttcgttatcggctacggcatcaatctcgacgtcgagaagctgacatttgcggttcttgaccgcgatgatacgacgatcagccgcgaatatacgcagcagatcgcgggatcgcgctatttcatcgaaaagccgccgatcaccgattatgacgatctcgaccggcgaatgcgcgaaggcgaaatcagcctcgccattgaaataccgccgaatttcgcagctaatgtcatgcggggggcggcaggttga

SEQ ID NO: 27217 - protein, 587 aa, Brucella melitensis 16M
MPTSATASRLIRALPICRKGLARTFIPRFRCSRILISSGGSLATTGRNGECRIADLLARTGMSAFANRPAGKLSGGMKQKTSLCCSLIHDPDLLILDEPTTGVDPLSRRQFWELIDDIRKDRPGMSVIVATAYMEEAERFDWLVAMNDGQILATGTPQELLERTDTPNLDAAFIALLPEEQRRGHREIHIPPRAPASDTAIAIEAEHVTVRFGDFTAVDNVSFRIPRGEIFGFLGSNGCGKTTTMKVLTGLLPASEGTARLFGREVDPKDIDIRRHVGYMSQAFSLYSELTVHQNLELHARLFGMEPDVTARRIKELTARFDLADVMDELPDAMPLGIRQRLSLAVALIHSPDILILDEPTSGVDPVARDAFWQILADLSRRDNVTIFVSTHFMNEAELCDRISLMHAGKVLISDTPKAITESRNAATLEDAFVAFLQDAIGEGEQSAPQKIEKDSAEPKAQHRKAWPSWLPNLRRMFAYTRREALELKRDPIRATLAILGSVILMFVIGYGINLDVEKLTFAVLDRDDTTISREYTQQIAGSRYFIEKPPITDYDDLDRRMREGEISLAIEIPPNFAANVMRGAAG

SEQ ID NO: 27218 - DNA, 1464 bp, Schizosaccharomyces pombe 972h-
  CDS (1)..(1464)
atggcgtcttttgtcaaatttgccaatacgacattcttagatgcgcgatttccccttttcaagaatgtgtcttttgaactagctcgaaagcaaaattgggccattattggaaacactggaagtggtaggactacattcttgcgctgtatacaaggttcctttacaccctcaccctccactagtttttcatatccattcttgaaaggcaaatctgatagcccatggcaagcaatccaattgcttgattttaaaagttctggacagcagcgtgccgcatactactctgaaagatatcattcctttagagacaaagaacatgacactacattggagaagtggcttttgggcgcttatcgagggaatgagaagtttgcttctcaacatgtacaagaggccgcatctatgactcagttatctcatttacttccttcgagtttaataaatttgagcaatggacaatctagaagagcgatgcttgcatcgaaacttgtgcaaaggccgcagcttcttttacttgatgaaccttacgctggacttgatgttacttcaagatctgttttgtcttcacttttaggtgaaatgtcaaaccattgttcgccaaagattgtactttccttacgtcctcaggacaaaattcccgactttatcacacatgtattggaattgaaaaataaaaaaatcacatatcaagggcccaaggaacagtatattcctatgaccagtcactcaactaacatacctgtcaagccccagatgaaaaaaagcaagcctattacaataggcaagcctttaatttccatggaacatctcaactgtgtttactggggacgaaaagtactctctgacataaattggactattagagaaggagaaagatgggctttaacaggtagcaatggaagcggtaaaactacacttttagcatatgtagttggagaccaccccaagttatttgctagcaatattaaattttttggaaaaagcattgggcccggcactggaatttctatattcgatatccaagaaaacatagggcattgttctccagagatacacaatcatttcccgaagcaacatacatgctttgaagctcttcttagcgcctggagcaccacctttaccatcccaaagttaaccgaaactcggttggcagcaattagtagcatcttagaggaatttgaactaaaggatattaaagataaaccattaagcagtatctcggttggcatgcagagatttattttgttttgtcgtgctattgtcaaacaacctcgcttagttgttttggacgagcctttccagggagtagataccaaatatgtccatatggcgcataattacttaaatgaaaagctctctccttcccaagccatggttataatttctcattacgaagatgaactccctgcctgcgtaaatagaagggctcacattgataatggaaaacttgtcatacatgcttga

SEQ ID NO: 27219 - protein, 487 aa, Schizosaccharomyces pombe 972h-
MASFVKFANTTFLDARFPLFKNVSFELARKQNWAIIGNTGSGRTTFLRCIQGSFTPSPSTSFSYPFLKGKSDSPWQAIQLLDFKSSGQQRAAYYSERYHSFRDKEHDTTLEKWLLGAYRGNEKFASQHVQEAASMTQLSHLLPSSLINLSNGQSRRAMLASKLVQRPQLLLLDEPYAGLDVTSRSVLSSLLGEMSNHCSPKIVLSLRPQDKIPDFITHVLELKNKKITYQGPKEQYIPMTSHSTNIPVKPQMKKSKPITIGKPLISMEHLNCVYWGRKVLSDINWTIREGERWALTGSNGSGKTTLLAYVVGDHPKLFASNIKFFGKSIGPGTGISIFDIQENIGHCSPEIHNHFPKQHTCFEALLSAWSTTFTIPKLTETRLAAISSILEEFELKDIKDKPLSSISVGMQRFILFCRAIVKQPRLVVLDEPFQGVDTKYVHMAHNYLNEKLSPSQAMVIISHYEDELPACVNRRAHIDNGKLVIHA

SEQ ID NO: 27220 - DNA, 1734 bp, Corynebacterium glutamicum ATCC 13032
  CDS (1)..(1734): transl_table=11
atgaccaccaacatcccacaaacccccaaccacgagggtgaacagccactgctcgagctgaaggatctaaagatttccttcacctcctccaccggtgttgtcgacgctgtccgtggcgcaaacctcaccatttatcctggccaatctgttgccatcgtgggtgaatccggttcaggtaaatcgaccacggcaatgtcgatcatcggtctgcttccaggcaccggcaaagtgaccgaaggttccatcatgtttgatggccaagacatcacaggcttgagtaacaagcagatggaaaagtaccgcggttcagaaatcggactggtcccccaggatccgatgaccaacttgaacccggtgtggcgcatcggcacccaggtcaaggaatccctccgagccaaccacgtggttccaggctcagagatggacaagcgcgtggcagaagttctggccgaggcaggtcttcctgatgctgagcgtcgcgcaaagcagtacccacatgagttctctggcggtatgcgccagcgcgcactgatcgccattggtttggcggcacgcccgaagctcttgatcgccgacgagcccacctctgcgctggatgtcaccgtgcagcgccaaatccttgatcaccttgaaacactgaccaaggatctcggcaccgcagtgctatttattacccacgacttgggccttgccgctgagcgcgcggagcacctcgtggtgatgcaccgcggacgcatcgtggagtccgggccatcattgaagattctgcgcaatccacagcacccatatacccaacgcttggttaaggctgcgccgtctctggcttctgcacgtattcaaagtgcgcaggaacaaggcattgaatctgcagaactgctctctgcaacggccgttgctgagggcactattccagagatggaagaaaaagttatcgaggtgaaaaacctcacccgcgaatttgatatccgcggtgcccgtggcgataagaagaagctgaaggccgttgatgatgtgtccttcttcgtacgtaaaggcaccaccaccgcacttgtgggtgaatccggttcgggtaaatccaccgtggccaacatggtgctcaaccttctcgagccaaccagcggagaggtgctctacaacggcaccgatcttacgtccttgagccacaaggaaatcttccaaatgcgacgcaaactgcaggtggtgttccagaacccctacggctcgcttgatccgatgtactccatctaccggtgtattgaggaaccgctgaccatccacaaggttggtggagaccgcaaggcacgcgaagctcgcgtcgctgaacttctcgatatggtgtccatgcccaggtccaccatgcgccgctaccccaacgagctttccggtggccaacgtcagcgcatcgccatcgcccgtgcattggcactgaatccagaagtgatcgtgttggatgaagcggtttccgctttggacgtgttggttcagaaccagatcctcaccctgcttgcagaacttcagcaggaactgaagctcacctatttgttcatcacccacgacttggccgttgttcgacaaaccgccgacgatgttgtggtgatgcaaaagggacgaatcgttgaaaagggtcgtaccgacgacatcttcaacgatcctcagcagcactacacccgcgatttgatcaatgcggtacctggtctgggaatcgagttgggtactggagaaaacctggtttaa

SEQ ID NO: 27221 - protein, 577 aa, Corynebacterium glutamicum ATCC 13032
MTTNIPQTPNHEGEQPLLELKDLKISFTSSTGVVDAVRGANLTIYPGQSVAIVGESGSGKSTTAMSIIGLLPGTGKVTEGSIMFDGQDITGLSNKQMEKYRGSEIGLVPQDPMTNLNPVWRIGTQVKESLRANHVVPGSEMDKRVAEVLAEAGLPDAERRAKQYPHEFSGGMRQRALIAIGLAARPKLLIADEPTSALDVTVQRQILDHLETLTKDLGTAVLFITHDLGLAAERAEHLVVMHRGRIVESGPSLKILRNPQHPYTQRLVKAAPSLASARIQSAQEQGIESAELLSATAVAEGTIPEMEEKVIEVKNLTREFDIRGARGDKKKLKAVDDVSFFVRKGTTTALVGESGSGKSTVANMVLNLLEPTSGEVLYNGTDLTSLSHKEIFQMRRKLQVVFQNPYGSLDPMYSIYRCIEEPLTIHKVGGDRKAREARVAELLDMVSMPRSTMRRYPNELSGGQRQRIAIARALALNPEVIVLDEAVSALDVLVQNQILTLLAELQQELKLTYLFITHDLAVVRQTADDVVVMQKGRIVEKGRTDDIFNDPQQHYTRDLINAVPGLGIELGTGENLV

SEQ ID NO: 27222 - DNA, 1644 bp, Corynebacterium glutamicum ATCC 13032
  CDS (1)..(1644): transl_table=11
atgactactcccttgttagagatcaacgatctggttgtctcctatcaaactgctaaaggtttggtgcatgctgtcaacaatgtcagcctggaggtgcaccctggccaaatcaccgcgattgttggtgagtccggttctggtaagtccaccaccgctcaggccgtgattggtttgctggctgataatgctgaagtggattctggtcggatttctttcaacggccgttcccttgttggcttgaacgcacgtgagtggaaaaacgttcgcggtaccaaaattggtttgattccgcaggaccccaacaactctctgaacccggtgaaaactatcggcgcttcagtgggggagggcttggctatccacaagcgtggaaccgccgccgagcgcaaaaagaaggtcattgagcttctagagcgcgtgggtattgataacccagaggtccgctatgaccagtacccgcatgagctgtctggtggcatgaagcagcgcgcgttgattgccgctgccattgcacttgaaccagagctgatcattgccgatgagcccacatctgcgctggatgtgaccgtgcagaaaattattctcgatctgctggaagacatgcagcgtgaattgggcatgggtattttgttcattactcacgatctagccgtggcaggcgatcgggcggatcgcatcgtcgtcatgcaaaaaggcgaggtgcgcgaaagtggttacgcggcttcggtcttgaccgacccccagcatgagtattccaagaagttgcttgccgacgcgccctccctcaccatcggcgagatccccacgcgagttccggccgtagatccggaggtagcgcaggccaaaggcccgcttctggtagtggataaattccgcaaggaacaccaacgaggcaaagaaggagcatttgttgccgcaaatgatatttccttcgaagtactgcctggcaccacgcatgccatcgtcggtgaatccggttctggtaaaaccacgcttggccgcgcgatcgcgatgtttaatacgccgacctctggttccatttcagtaagtggcaaggacatcaccaacctgtccaaggcccagcagcgggaactgcgccagcaaatccagctggtgtaccaaaacccgtattcttccctggatcctcgccaaaccattggctccaccatcgcggaacctctgcgcaatttcaccaaggtgagcaagcaggaagccgacgaaaaggtggcacactacctggaactggtggcgcttgacccggctcttgccacccgtcgcccacgtgagctctctggtggtcagcgccagcgcgtcgccattgctcgtgccatgattttggaacctgaattggtggttttcgacgaagccgtatccgcgttggatgtgactgtgcaggcacaaatcctgcgcctgctcgacgatctgcaacgagagctaggcttgacttacgtgtttatttcccacgacctggctgtggtccgtgaaatctctgacactgtgtctgtgatgagtcgcggcaaccaggtggaacttggaaaaaccgcagaagtatttaacaacccgcaaaccgatttcactcgccgactcatcgacgcgatcccaggatcgcgctatcgtggtggcgaactcaatcttggactatag

SEQ ID NO: 27223 - protein, 547 aa, Corynebacterium glutamicum ATCC 13032
MTTPLLEINDLVVSYQTAKGLVHAVNNVSLEVHPGQITAIVGESGSGKSTTAQAVIGLLADNAEVDSGRISFNGRSLVGLNAREWKNVRGTKIGLIPQDPNNSLNPVKTIGASVGEGLAIHKRGTAAERKKKVIELLERVGIDNPEVRYDQYPHELSGGMKQRALIAAAIALEPELIIADEPTSALDVTVQKIILDLLEDMQRELGMGILFITHDLAVAGDRADRIVVMQKGEVRESGYAASVLTDPQHEYSKKLLADAPSLTIGEIPTRVPAVDPEVAQAKGPLLVVDKFRKEHQRGKEGAFVAANDISFEVLPGTTHAIVGESGSGKTTLGRAIAMFNTPTSGSISVSGKDITNLSKAQQRELRQQIQLVYQNPYSSLDPRQTIGSTIAEPLRNFTKVSKQEADEKVAHYLELVALDPALATRRPRELSGGQRQRVAIARAMILEPELVVFDEAVSALDVTVQAQILRLLDDLQRELGLTYVFISHDLAVVREISDTVSVMSRGNQVELGKTAEVFNNPQTDFTRRLIDAIPGSRYRGGELNLGL

SEQ ID NO: 27224 - DNA, 1524 bp, Thermoanaerobacter tengcongensis MB4
  CDS (1)..(1524): transl_table=11
atgggtgccccgcttatagagcttgtaaacgtcaataaaagtttctctggtgtgcaggtgttgttcaatgtcaattttagggtatatcctaaagaaattcactgtttggtaggagaaaacggagcaggcaaaagtaccctgatgaagattttaagcggggtctacccttatggcgaatatgaaggagaaatcctcatagagggtaaccctgtgagatttttcagcataaaagacagtgaaagggctggaatttctataattcatcaggagttgtctcttgttccagagatgacagtgtatgaaaacgtatttttgggaaacgaaatcagaaaaggtgcagtggtcgatgtaatggaggaaatagttaggacaaaggaattgcttaaaaaagtcaaaggagaagaaatcagcccaacagcgaaagctaaggatttgagtgtcagcatgcagcagctggtagagatagcaaaagctctttcaaaaaatccaaaagtcctcatattggatgaacctacttctgcccttagtgaaacagaaagtgagaatctactctctctcttgaaagaacttaaagagcagggagtgacgataatactcataagtcacaggttaaaggaagtattaaaagttgcggattctataacggtattaagagacggaaggactgtagcttattttgactgtaaaaaagaagaagtagacgagcaaaagataataaagcacatggtggggagggagataacaaacctgtaccctcctcccctctctaagccttctgatgaggttgtaatggaagtaaaaaactggagtgttgtcgacccaaagacagggcggtatcttgtgaaggatgtgaatttaaaggttagaaaaggagaaatagttgggctatttggtttagtaggggcaggtcgtacagaactggggcttagcctttttggcaatccttacaggtattttgtgcagggagagatatttttaaacggccaaagggttcatttcagaaaaccagcagatgctataaggtataaattgctatacctcacagaggacagaaaacaaaaagggctgattctcataaacacggtcaaagaaaacattacgctttcaaacttaaagactttgacgaagcagatggttatagatgagctggaggaaatagctgttgcacagaatttccaaaaaaaattgggaataaaggctaggcatgtagaggtgaaggtgtctacgctaagcggtgggaatcagcagaaggttttagtggccaaagggctttttgttgagcctgaggtgataatactggatgaacctactagaggcgttgatgttggtgcaaagtacgaaatatacactttgataaggcaactggctatggaaggaaaggcaatcttacttatttcttcggagctgccagagatattggggttgagcgataggatatacgtcatgagcaaaggaaggataacaggagagctcaaaggagacgaagcaaatcaggaaaaagtaatggcctacgcagtcatctga

SEQ ID NO: 27225 - protein, 507 aa, Thermoanaerobacter tengcongensis MB4
MGAPLIELVNVNKSFSGVQVLFNVNFRVYPKEIHCLVGENGAGKSTLMKILSGVYPYGEYEGEILIEGNPVRFFSIKDSERAGISIIHQELSLVPEMTVYENVFLGNEIRKGAVVDVMEEIVRTKELLKKVKGEEISPTAKAKDLSVSMQQLVEIAKALSKNPKVLILDEPTSALSETESENLLSLLKELKEQGVTIILISHRLKEVLKVADSITVLRDGRTVAYFDCKKEEVDEQKIIKHMVGREITNLYPPPLSKPSDEVVMEVKNWSVVDPKTGRYLVKDVNLKVRKGEIVGLFGLVGAGRTELGLSLFGNPYRYFVQGEIFLNGQRVHFRKPADAIRYKLLYLTEDRKQKGLILINTVKENITLSNLKTLTKQMVIDELEEIAVAQNFQKKLGIKARHVEVKVSTLSGGNQQKVLVAKGLFVEPEVIILDEPTRGVDVGAKYEIYTLIRQLAMEGKAILLISSELPEILGLSDRIYVMSKGRITGELKGDEANQEKVMAYAVI

SEQ ID NO: 27226 - DNA, 1593 bp, Staphylococcus aureus subsp. aureus MW2
  CDS (1)..(1593): transl_table=11
atgtcaaatttattagaagtcaacagtctgaatgtacaattcaattatgatgaaactacagttcaagcggtaaaaaatgtctctttcgaattacgaaaaaaacatatcctaggtattgttggtgaatcaggatcaggaaaaagtattactgctaaatctattttagggctactaccagattatccagatcacacattaacaggagaaattatttttaatgggcaatcgttaaataatttatcaacttcagcgttacaacaaattcgaggtaaggatatttcaatgatttttcaagatccactctcttcgttgaatccaagattaacgattggcaaacaaattacagaagtactatttcaacataaacgtgtatctaaatctgaagcaaagtcgatgacaatagacattttagaaaaagtaggtataaaacatgcaactcgacaatttgatgcttatccacatgaactttctggtggtatgcgtcaacgtgtcatgatagcaatggcattgattttaaagccacaaattttaatcgcagatgaaccaacaacggcattagatgccagtacacaaaatcaattactgcagttaatgaagtccctttatgagtacacagaaacatctattatttttatcactcacgatttaggcgctgtgtatcaattttgcgacgatgtgattgtaatgaaagatggaagtgtcgttgaaagtggcacggttgaaagtatttttaaatcgccacaacatacctatacaaaacgcttaatagatgcgattcctgatattcatcaaacgcgtccgccaagaccgttaaacaatgatattttattaaaattcgatcgcgtgagcgtggattacacatcaccgagtggcagcctataccgagcagttaatgatattaacttgggtattagaaaaggcgaaacattaggcattgtcggtgaatcagggtcagggaaatcgacattagctaagacggtcgtcggtctaaaggaagtgtcagaaggctttatttggtataacgaattaccattaagtttatttaaagatgatgaattgaaatctttacgacaagagatacaaatgatttttcaagatccattcgcatctattaatccaagatttaaagtcattgatgtgattaaacgaccactaatcattcatgggaaagtcaaagataatgatgacattattaaaactgtcgtatcgttgttagaaaaggttggcctagatcaaagtttcttatatcgctatccacacgaattatctggtgggcaacgtcagcgtgtaagtatcgcgagagcacttgctgtagaacctaaagtgattgtttgcgacgaggcagtgtccgctttagacgtttcaattcaaaaagatatcatcgagttattaaaacaattacagttagacttcggcatcacttatttattcatcacacatgacatgggtgttatcaatgaaatatgtgatcgcgttgcagttatgaaaaatggcgaaatcgttgaactgaataacacagaagatattatcaaacatccgcaatcagactatgcaaagcaacttatttcagaagtagcagttattgctaaataa

SEQ ID NO: 27227 - protein, 530 aa, Staphylococcus aureus subsp. aureus MW2
MSNLLEVNSLNVQFNYDETTVQAVKNVSFELRKKHILGIVGESGSGKSITAKSILGLLPDYPDHTLTGEIIFNGQSLNNLSTSALQQIRGKDISMIFQDPLSSLNPRLTIGKQITEVLFQHKRVSKSEAKSMTIDILEKVGIKHATRQFDAYPHELSGGMRQRVMIAMALILKPQILIADEPTTALDASTQNQLLQLMKSLYEYTETSIIFITHDLGAVYQFCDDVIVMKDGSVVESGTVESIFKSPQHTYTKRLIDAIPDIHQTRPPRPLNNDILLKFDRVSVDYTSPSGSLYRAVNDINLGIRKGETLGIVGESGSGKSTLAKTVVGLKEVSEGFIWYNELPLSLFKDDELKSLRQEIQMIFQDPFASINPRFKVIDVIKRPLIIHGKVKDNDDIIKTVVSLLEKVGLDQSFLYRYPHELSGGQRQRVSIARALAVEPKVIVCDEAVSALDVSIQKDIIELLKQLQLDFGITYLFITHDMGVINEICDRVAVMKNGEIVELNNTEDIIKHPQSDYAKQLISEVAVIAK

SEQ ID NO: 27228 - DNA, 1497 bp, Yersinia pestis KIM
  CDS (1)..(1497): transl_table=11
atgactcaggccaccgcatttatcactcttgaaaatatcagcaagcgattccctggcgtattagcgctggatggggtgaatctcacgttgaacaaaggagaagtgcactgtctggcaggccaaaatggctgcggcaaaagcaccattatcaaagtgatttcaggagtttatcagccagagaaaggcgcaagtatcctgatagacggcaagctgcttcatcagcttacgccgcaactctcattctattatggcgtgcaggtgatttatcaagatctgtcgctattcccgaatttaaccgtagcagaaaatattgccgtccaccgttatctgcccggcggagatttttgggtaaaacgtaaaagtatgcgtgaacgggcgctggcggcgatgcagcgcgtcggggtgacgctggatctggataaaaaagttgaacagctctctattgctgaccgccaattagtggcaatttgccgtgctatcgccgccgatgcccgcttggtgattatggatgagccaacagcctcactcaccagccaggaagtcaaaggcttgttgaatgtggtccgtgacctgaaatcacaaggcatttgtgtggtgtttgtcagccaccgtctggatgaagtgatggaagtggccgatcggatcagcgtgatgcgcgatggcaaatgggtcgggacctggcaagccagcgagttagacagccatgaactggcgtttctaatgacgggccagcgcttcacttaccgtccgttaccgccgttggcggccaaagcggcaccgctgctggagatcaggaaactgagccgtggtgagcagttccgtaatatcgatctgacgttacatcagggtgaaattgtttctatcaccggtttgctgggggcagggagaacggagttatgcctcagtctgttcggtatgacgcaacccgaaagcggcgaaatattcgtggccggtgagccggtgcgttttcgtcataaccgtgatgcgatccgccatggcatcggttatgtctctgaggatcgcctgactcaggggttgatcatggagcagtcgatctatgacaacactatcgtgtcagtttttgaccaattacacacccgcagtggcttgctggatcacagcaaggccgccgcactggtaaataagctggtgcaggacctgaatatcaaagtctcggacaccgcgctgccggtgaaaaccttgtctggcggtaatgctcagcgcattgctattgccaaatgggtcgcgacacaaccgcgtattttgatccttgattcgcctaccgtcggtgtcgatatcgccaacaaagaagggatttaccatattgccaaggcattggcagagcaagggatggcggtattgatgatttgcgatgagatcccagaggcgtattacaacagccaccgggtgctggtgatgcgtaaaggcgaattgatcgccgagttttatcctcatcagtgtaccgaacaacagatcgccgaggtggtcaatggataa

SEQ ID NO: 27229 - protein, 498 aa, Yersinia pestis KIM
MTQATAFITLENISKRFPGVLALDGVNLTLNKGEVHCLAGQNGCGKSTIIKVISGVYQPEKGASILIDGKLLHQLTPQLSFYYGVQVIYQDLSLFPNLTVAENIAVHRYLPGGDFWVKRKSMRERALAAMQRVGVTLDLDKKVEQLSIADRQLVAICRAIAADARLVIMDEPTASLTSQEVKGLLNVVRDLKSQGICVVFVSHRLDEVMEVADRISVMRDGKWVGTWQASELDSHELAFLMTGQRFTYRPLPPLAAKAAPLLEIRKLSRGEQFRNIDLTLHQGEIVSITGLLGAGRTELCLSLFGMTQPESGEIFVAGEPVRFRHNRDAIRHGIGYVSEDRLTQGLIMEQSIYDNTIVSVFDQLHTRSGLLDHSKAAALVNKLVQDLNIKVSDTALPVKTLSGGNAQRIAIAKWVATQPRILILDSPTVGVDIANKEGIYHIAKALAEQGMAVLMICDEIPEAYYNSHRVLVMRKGELIAEFYPHQCTEQQIAEVVNG

SEQ ID NO: 27230 - DNA, 1515 bp, Yersinia pestis KIM
  CDS (1)..(1515): transl_table=11
atgactcatatttctgatgttgatagagacgtgccgcttatcacgttaaaagcgctgtccaaaagctttggcggtcatcaggcactgaaaaatatcacgttgacgttgaataaaggcgaagttcactgtctggccggggctaatggttgcggaaaaagtacgctgattaagacgattagtggcgtttatgccccagatgacggcagtgaaattatcattgatgaaaaatcttatcaccgcctgacgcctgatcgcgcacgcgctttgggcgtacaggtgatttatcaagacctttcgctgttccctaacctgacggtagccgaaaatattgccttcgaatataacttgaaaggttacttcggctggttcaacaagcagaaaatcaaacaaaaagcctgccagatcttgcatgaactggcttttagtctcgatcccgatgcgctggtacaacatttacccattgcccaacgccagcaggtggctatctgccgtgcgttggttgccgatgcgcgcttggtgattatggatgagcctaccgcctctttgacgcgcaccgaagtgaatcaattattacgcacagtaaattacctgcgagataagcacattaccgtggtcttcgtcagccaccgattagatgaagtgaaagagatttcggatcgcattacggtgatccgcgatggcgaaaaagtggggacctggccagccactgagctttctaccgggcgtattaccgagttgatgaccggcctgaccctcacccacgagcagaaattacccaatgccgaattaggcaaagtggtgctgcaactggaaaacctaagccgtaaagggcaattcgacgatatctcgtttagcctgcatcgcggcgaagtgctcggcctgtgtggtttgctggggtccgggcgaaccgaattggcccttagcctatttggcatcacccatcctgatagcggcaagattaccattgacggtaacccggggtgcattaaagacaatacccgtgccattgagctaggtattggctatgtatctgaagatcgcctgaccctcggtgccgtattgcaacaatctatcgccgacaacatggtgctgtcgattctgcaacgcatccgtactccactttatctggttgatgacgctaaacagaacgcgctggtgcaagaatgggtgaaggatttggacatcaaaatcacggatgctgataacgcgctgtcaacattgtcagggggcaatcagcaaaaagtggtgctggcaaaatggatcctaaccaaaccgaaagtgttaattctcgattcacctactgtgggggtcgatatcggtgccaaagacagtatttacaagctgatccatcgtctctccggggtgggtatctcggtgttgctgctctctgatgaaatccccgaagcctattacaactgcgatcgcatcctgcatatgcagcaggggcgtatcgtcaatgaactgatcccgaatcaaatgactgaacaacagctggcggaggtcatcaatggctaa

SEQ ID NO: 27231 - protein, 504 aa, Yersinia pestis KIM
MTHISDVDRDVPLITLKALSKSFGGHQALKNITLTLNKGEVHCLAGANGCGKSTLIKTISGVYAPDDGSEIIIDEKSYHRLTPDRARALGVQVIYQDLSLFPNLTVAENIAFEYNLKGYFGWFNKQKIKQKACQILHELAFSLDPDALVQHLPIAQRQQVAICRALVADARLVIMDEPTASLTRTEVNQLLRTVNYLRDKHITVVFVSHRLDEVKEISDRITVIRDGEKVGTWPATELSTGRITELMTGLTLTHEQKLPNAELGKVVLQLENLSRKGQFDDISFSLHRGEVLGLCGLLGSGRTELALSLFGITHPDSGKITIDGNPGCIKDNTRAIELGIGYVSEDRLTLGAVLQQSIADNMVLSILQRIRTPLYLVDDAKQNALVQEWVKDLDIKITDADNALSTLSGGNQQKVVLAKWILTKPKVLILDSPTVGVDIGAKDSIYKLIHRLSGVGISVLLLSDEIPEAYYNCDRILHMQQGRIVNELIPNQMTEQQLAEVING

SEQ ID NO: 27232 - DNA, 1557 bp, Yersinia pestis KIM
  CDS (1)..(1557): transl_table=11
ttgacatttttcgtctttccgcttatccctaacatctttactacgttgcaaaatatgggaaagatgatgtctgagttgcaaatatcgcaaggttgttttcgcctgagtgacacacagacactcatcttgccagcgctacatatccaggcgggtgactgttgggcatttgtcggggccaatggcagtggtaaatctgcgttagccaaggccctgtctggagaactggccctgctggagggcagccgccaaagccacttccgccatggtgtgcgtttatcattcgaacaactacagcaactggtcaatgaagagtggcaacgtaataataccgacctgctcagtgctgatgaagatgacactggccgtactaccgccgaaattattcaggaagcggcccgtgacccgcagcgctgtcaacaactggcagcgctatttggaatcagccacttgctttctcgccgcttcaaatacctttctacgggggaaacccgtaaaacattgctgtgtcaggcgctgatgccgcaaccggacctgctgattctggatgagccctttgatggcctggatgtcgcggctcgggcgcagttagccgagatgctatccacactttcggcccaaggcgtcaccctggtattggtcctcaaccgctttgatgatatccctgattttgtgcagtacgttggcgtattggctgattgccacctgacccacatggggccgcgccagcagattctgtcggaagcgttaattgcccaattggcacacagtgaaaatctggatgggctgtcactgccggaaacggaggatccacagcaccacctacgaataccgaaaaatgaacccttgatcatactgaatgacggggtggtggagtacaacgaccgccctatcctgcataacctgagctggcaagtgaaccccggtgaacactggcagattatcggccagaatggtgcagggaaatccaccttactcagcctgataactggcgaccatccccaaggatacagtaatgatttaacgctgtttggccgccgccgtggcagtggtgaaaccatctgggacatcaaacgccatattggttatgtcagcggcagcctccatctggactaccgggttagcacccgtgtacgtaccgtgattttatccggttttttcgattcgattggtctttaccaagcagcctctgatcgtcaacaacaattagcagatcaatggctgtctttactggggttttccacctccgtcgccaaccaacctttccacagcttatcttgggggcaacagcgtctggtcttgatcgcccgagcattggttaagcacccagcgctcctgatcctggatgaacccttacaagggctggatccgcttaaccgtttgttagtgcgccgttttattgatgtgatgatcggtgaaggagaaacccaattattgttcgtttctcaccatgccgaggatgcaccccagtgtattacgcaccgcttaacctttgtgccatttggcgatatttatcactatcaacaagaaaaatcaccaagccaaccacaggtaaaataa

SEQ ID NO: 27233 - protein, 518 aa, Yersinia pestis KIM
MTFFVFPLIPNIFTTLQNMGKMMSELQISQGCFRLSDTQTLILPALHIQAGDCWAFVGANGSGKSALAKALSGELALLEGSRQSHFRHGVRLSFEQLQQLVNEEWQRNNTDLLSADEDDTGRTTAEIIQEAARDPQRCQQLAALFGISHLLSRRFKYLSTGETRKTLLCQALMPQPDLLILDEPFDGLDVAARAQLAEMLSTLSAQGVTLVLVLNRFDDIPDFVQYVGVLADCHLTHMGPRQQILSEALIAQLAHSENLDGLSLPETEDPQHHLRIPKNEPLIILNDGVVEYNDRPILHNLSWQVNPGEHWQIIGQNGAGKSTLLSLITGDHPQGYSNDLTLFGRRRGSGETIWDIKRHIGYVSGSLHLDYRVSTRVRTVILSGFFDSIGLYQAASDRQQQLADQWLSLLGFSTSVANQPFHSLSWGQQRLVLIARALVKHPALLILDEPLQGLDPLNRLLVRRFIDVMIGEGETQLLFVSHHAEDAPQCITHRLTFVPFGDIYHYQQEKSPSQPQVK

SEQ ID NO: 27234 - DNA, 1542 bp, Bifidobacterium longum NCC2705
  CDS (1)..(1542): transl_table=11
atgacagataaaaaccccatcgtcgtaatgaaaggcattacgattgaattcccgggcgtcaaggccttggatggtgttgatttgactctctacccgggcgaagttcacgccctgatgggtgagaacggtgcaggcaagtccaccatgattaaggctctgaccggtgtgtacaagatcaacgccggctccattatggtggacggcaagcctcagcagttcaacggcaccctcgacgcacaaaacgccggtatcgccaccgtgtatcaggaagtgaacctgtgcaccaacctttccgtcggtgagaacgtgatgctgggccacgaaaagcgcggccccttcggcatcgactggaagaagacccacgaggccgccaagaagtatttggcacagatgggcctcgaatccattgacccgcacactccgctgagctccatctccatcgctatgcagcagctggtcgccatcgcccgcgctatggttatcaacgccaaggtgctgattctcgatgagccgacctcttcgctggatgccaacgaggtcagggacctgttcgcgatcatgcgcaaggtgcgtgactcgggcgtggccatcctcttcgtctcccacttcctcgatcagatttatgagattaccgatcgtctgaccattctgcgtaacggccagttcatcaaggaggtcatgaccaaggacaccccgcgcgacgaactcatcggcatgatgattggtaagtccgccgccgagctgtcccagattggtgccaagaaggctcgccgtgaaatcacccctggcgagaagccgatcgtcgatgtcaagggcctcggcaagaagggcaccatcaacccggttgatgttgacatctacaagggtgaggtcgttggcttcgctggcctgctgggctccggtcgtaccgagcttggtcgactcctgtatggtgccgacaagccggattcgggtacctacacgctcaacggcaagaaggtcaacatctccgatccgtacacggctttgaagaacaaaatcgcgtactccaccgaaaaccgtcgtgatgagggcatcatcggcgacctgaccgtccgccagaacatccttatcgccctgcaggcaacgcgcggtatgttcaagccgattcccaagaaggaagcggacgccatcgttgacaagtacatgaaggaactcaacgttcgtcccgccgacccggatcgcccggtcaagaatctctccggcggcaaccagcagaaggtgctcattggccgttggctggccacgcaccccgagctgctgattctggacgagccgacccgtggtatcgatatcggtgccaaggctgaaattcagcaggtcgtgcttgacctggcttctcagggcatgggcgttgtcttcatctcctccgagcttgaagaggtcgtgcgtctgtccgacgacatcgaggttctcaaggaccgccacaagatcgcagaaatcgaaaacgacgacaccgtctctcaggcgaccatcgtcgaaaccatcgctaacaccaacgtaaacaccggaaaggaggcatga

SEQ ID NO: 27235 - protein, 513 aa, Bifidobacterium longum NCC2705
MTDKNPIVVMKGITIEFPGVKALDGVDLTLYPGEVHALMGENGAGKSTMIKALTGVYKINAGSIMVDGKPQQFNGTLDAQNAGIATVYQEVNLCTNLSVGENVMLGHEKRGPFGIDWKKTHEAAKKYLAQMGLESIDPHTPLSSISIAMQQLVAIARAMVINAKVLILDEPTSSLDANEVRDLFAIMRKVRDSGVAILFVSHFLDQIYEITDRLTILRNGQFIKEVMTKDTPRDELIGMMIGKSAAELSQIGAKKARREITPGEKPIVDVKGLGKKGTINPVDVDIYKGEVVGFAGLLGSGRTELGRLLYGADKPDSGTYTLNGKKVNISDPYTALKNKIAYSTENRRDEGIIGDLTVRQNILIALQATRGMFKPIPKKEADAIVDKYMKELNVRPADPDRPVKNLSGGNQQKVLIGRWLATHPELLILDEPTRGIDIGAKAEIQQVVLDLASQGMGVVFISSELEEVVRLSDDIEVLKDRHKIAEIENDDTVSQATIVETIANTNVNTGKEA

SEQ ID NO: 27236 - DNA, 2433 bp, Bifidobacterium longum NCC2705
  CDS (1)..(2433): transl_table=11
atgaccgttgcaccccattccttcgacgccgacgagttccacgattctgccgaacctcacgcttccgccgagcctgcctcccccgccgccgtgctcaaggacattcgtttcagctatgaccgcggcacctcatgggctttggatggcgtttcactcacggtccatgccggcgagcgcctatgcttggtcggtccgaacgggtcgggcaaatccacgttagcccgtctgattgcgggattgaccgcgccggacggtggtgaagtgacgttactggggcaacgcgtgtacgcagccggcccgaatgccgatgcctatcgtgctgcccgccacggcatcggtatggtgttccagaatcccgaggatcagctggtcaccaccgtgttggaggatgacgtggcctttggcccggagaatctcgggctggagcgcgagctcatcggcgagcgtatcgttgattcattgcaggccgtggggttggcgaacttacgccagtccgacccgacccgtatgagcggcgggcagcagcaacgcgcctccatcgccggcatgctggccatgaacccggcaatgctggtattggatgagccgaccgccatgctggacgaatccgcacgcgccgaagttatgcgcattttggatgatttgcaggcgcgcggcaccactattgtgcatgtcacgcatcatccagatgaaaccgttcatgccgatcgcatcgtgcacatggaggccgggcgaatcattggtatcactgcagccgtcgataatcgatccccgctagcggaggctgtctcgcaaagcgagactgagggtagtatcggcacagaagccgcccccagtcgccctacgaacgacagcccccgccagcgggagcgcgaagacggctccgaactgccgctgctctccgatggcatcggtgatatgacgaaccccattattcgcgtctcgcatctgacctatcgctatccttcggccaaacgggcggttatcgatgacctgtcgttcaccatcgcgcgcggtgaaaccgtggcactgatgggcgtgaatggttcgggcaagtcgacgctggtgcgcatgttgtgcgcactgactgcgccgaccgccggcagcatcgaagtggccggtgttccggtggcctcgaccggcaagcgcggtcgcaacgtgcgcccgaagtcggcgaatcgcaagcaattagcgcaattgcgccggcatgtgggttacgtgatgcagcatccagagcatcagctgttcgctgacacggtagccgaggacgtggcgtacggcccacgcaaccaagggcttggcgagaccgaggtagccgaccgcgtgcgcgaatcactggaactgctgcatatcgggcatcttgccgaccgctcccccttcgacctgtccggcgggcaacaacgattggcagccattgccggcgtgctggcttgcaatcctgacgtgctcatcatggacgagccgaccgcgagtctggacgcccaagccaagaagcgtatccatgagctgttgcgcacgctcaaatcgcgtggcgtgaccgtgctcatcatcacccatgaccgggaggaggccgagcaaatcgccgaccgcgtggtccgtatgccgattgccgcccccgcatccggcggccccgtcacggccaccgtcaccgagccggccgtatcctccaacggccctgcgcactcagtgatacaccgacttgacccgcgcgtgaagatggtgggcttcctggccgccatgttcacgatgttcgcggtgaacacgccaacccagctcgcgctgggcatcgccatcaccctggccgttatcgcggcggcacgcctgaacccgttacgggtgcttgaatccattcatccgattctgatcctgctggtgctgatgggcgtggtcaatctgtttgtggtacgcaccggcacgccggtggtggcgcttggcccgctaagcatcaccgatcagggcgtgaccatagccgtgctgtacgcctgccgtttcgcattggtaatcattctgggcgcggtgttcctcactaccaccacgcctaccgccatgaccgacgccttcgccaccttgatcagtccgctcaaccggctcggtatccatgcccaagaaatcgcgctggtcatgagtctggcattgcgattcattccaacgctgaccgacgaaacccgcgccatcgtcgacgcccaatccgcgcgtggcggttccatcgaaaccggttcactggcccagcgcatcaaggcgatgagcgcgattatcgtgccgattttcgccggcacgttgcgtcacgcggacaacctgagcctcgcacttgacgcccgctgctacgaggagggcatccgccgcacccactggcgtgccctgaccatcgccgcgcgagatctcatattcgccgctgccgtcatcatctacatcgcggccatcatcgcgctgtag

SEQ ID NO: 27237 - protein, 810 aa, Bifidobacterium longum NCC2705
MTVAPHSFDADEFHDSAEPHASAEPASPAAVLKDIRFSYDRGTSWALDGVSLTVHAGERLCLVGPNGSGKSTLARLIAGLTAPDGGEVTLLGQRVYAAGPNADAYRAARHGIGMVFQNPEDQLVTTVLEDDVAFGPENLGLERELIGERIVDSLQAVGLANLRQSDPTRMSGGQQQRASIAGMLAMNPAMLVLDEPTAMLDESARAEVMRILDDLQARGTTIVHVTHHPDETVHADRIVHMEAGRIIGITAAVDNRSPLAEAVSQSETEGSIGTEAAPSRPTNDSPRQREREDGSELPLLSDGIGDMTNPIIRVSHLTYRYPSAKRAVIDDLSFTIARGETVALMGVNGSGKSTLVRMLCALTAPTAGSIEVAGVPVASTGKRGRNVRPKSANRKQLAQLRRHVGYVMQHPEHQLFADTVAEDVAYGPRNQGLGETEVADRVRESLELLHIGHLADRSPFDLSGGQQRLAAIAGVLACNPDVLIMDEPTASLDAQAKKRIHELLRTLKSRGVTVLIITHDREEAEQIADRVVRMPIAAPASGGPVTATVTEPAVSSNGPAHSVIHRLDPRVKMVGFLAAMFTMFAVNTPTQLALGIAITLAVIAAARLNPLRVLESIHPILILLVLMGVVNLFVVRTGTPVVALGPLSITDQGVTIAVLYACRFALVIILGAVFLTTTTPTAMTDAFATLISPLNRLGIHAQEIALVMSLALRFIPTLTDETRAIVDAQSARGGSIETGSLAQRIKAMSAIIVPIFAGTLRHADNLSLALDARCYEEGIRRTHWRALTIAARDLIFAAAVIIYIAAIIAL

SEQ ID NO: 27238 - DNA, 1593 bp, Shigella flexneri 2a str. 301
  CDS (1)..(1593): transl_table=11
gtgttagtttccagtaacgtcaccatgcagttcggcagtaagccgttgtttgaaaacatttccgtcaaattcggcggcggcaaccgttacggcctgattggcgcgaacggtagtggtaaatccacctttatgaagattctcggcggcgaccttgagccgacgctgggtaacgtttccctcgatcccaacgagcgcattggtaagctgcgtcaggatcagtttgcctttgaagagttcactgtgctggatacggtgatcatggggcataaagagttgtgggaagtgaagcaggagcgcgaccgcatctatgctttgccggaaatgagtgaagaagacggctataaagtggccgatctggaagtgaaatacggcgaaatggacggttactctgcggaagctcgcgccggtgaactgttgcttggcgtgggaattccagtggaacagcactacggcccgatgagtgaagttgctcctggctggaagctgcgtgtgcttctggcgcaggcgctgtttgctgagccggatattctcctgctcgacgaaccgaccaacaacctcgacatcgacaccattcgctggctggaacaggtgctgaacgagcgtgacagcaccatgatcatcatctcgcacgaccgtcacttccttaacatggtctgtacccacatggcggatctggattacggcgagctgcgcgtttatccgggtaactacgatgagtacatgacggcggcgacccaggcgcgtgaacgtctgctggccgataacgccaagaagaaagcgcagattgctgagttgcaatctttcgttagccgctttagcgccaacgcctcgaaatctcgccaggcaacttcgcgcgcgcgccagattgataaaatcaaactggaagaggtgaaagcctccagccgtcagaacccgtttatccgttttgaacaggataagaaactgttccgtaacgcgctggaagtggaaggtctgaccaaagggtttgataacggtccactgtttaaaaatctcaacctgctgctggaggtcggtgaaaaacttgcggtactgggtaccaacggcgtcggtaaatcaacgctgctgaaaacgctggtgggcgatctgcaaccggacagcggcaccgtaaaatggtctgaaaacgcgcgcattggttactacgcccaggaccacgaatatgagtttgaaaatgatctgaccgtgttcgaatggatgagtcagtggaagcaggaaggcgatgacgagcaggcggtacgcagcattctcggtcgtttgctgttcagccaggacgacatcaaaaagccagctaaagtgctttccggtggggaaaaagggcggatgctgtttggtaagttaatgatgcagaagccgaacattctgatcatggacgaaccgaccaaccacctggatatggaatccatcgagtcactgaacatggcgctggaactgtatcagggcacgctgatctttgtttcacacgaccgtgagttcgtaagctccctggcgacccgcattctggaaatcaccccggaacgcgtgatcgactttagcggtaattacgaagattacctgcgtagtaaagggatcgagtaa

SEQ ID NO: 27239 - protein, 530 aa, Shigella flexneri 2a str. 301
MLVSSNVTMQFGSKPLFENISVKFGGGNRYGLIGANGSGKSTFMKILGGDLEPTLGNVSLDPNERIGKLRQDQFAFEEFTVLDTVIMGHKELWEVKQERDRIYALPEMSEEDGYKVADLEVKYGEMDGYSAEARAGELLLGVGIPVEQHYGPMSEVAPGWKLRVLLAQALFAEPDILLLDEPTNNLDIDTIRWLEQVLNERDSTMIIISHDRHFLNMVCTHMADLDYGELRVYPGNYDEYMTAATQARERLLADNAKKKAQIAELQSFVSRFSANASKSRQATSRARQIDKIKLEEVKASSRQNPFIRFEQDKKLFRNALEVEGLTKGFDNGPLFKNLNLLLEVGEKLAVLGTNGVGKSTLLKTLVGDLQPDSGTVKWSENARIGYYAQDHEYEFENDLTVFEWMSQWKQEGDDEQAVRSILGRLLFSQDDIKKPAKVLSGGEKGRMLFGKLMMQKPNILIMDEPTNHLDMESIESLNMALELYQGTLIFVSHDREFVSSLATRILEITPERVIDFSGNYEDYLRSKGIE

SEQ ID NO: 27240 - DNA, 1512 bp, Shigella flexneri 2a str. 301
  CDS (1)..(1512): transl_table=11
atgttcacggcaacagaggcagtcccggtagcaaaagtggtggcaggaaataagcgttaccccggcgtcgttgcgctggataacgttaacttcacgctcaataaaggcgaagttcgtgcgctgttaggtaaaaacggcgcgggcaaatcgactctcattcgaatgcttaccggcagcgaacgcccggatagcggtgatatctggattggcgagacgcgactggaaggtgacgaagctacgttgactcgccgtgccgctgaactgggggttcgtgcggtttatcaggaattaagtctggtggaagggctgacggtggcagaaaacctctgccttggtcaatggcctcgccgcaacggcatgattgattacctgcaaatggcgcaggatgcccaacgttgcttacaggcgctgggcgttgacgttagtcctgaacaacttgtttcaacgctaagcccggcgcaaaagcaactggtggaaattgcacgggtgatgaagggcgagccgcgcgtggtcattcttgatgaacccaccagctcgcttgccagtgcagaagttgaactggtgatcagtgcggtgaaaaagatgtcggcactgggcgtggcggtgatttatgtcagccaccggatggaagaaatccgccgcattgcctcctatgccaccgttatgcgcgatggtcaggtggcgggcgatgtgatgctcgaaaacacctccacgcatcatattgtgtcgctaatgctagggcgtgatcacgttgatattgcgccggttgcccctcaggaaattgtggatcaggccgtactggaagtccgtgcgttacgccataagcccaagctggaggatatcagctttacgctacgtcgtggcgaagtgcttggcattgctggcctgctgggggcagggcgcagtgaattgctgaaggcgattgttgggctggagacgtatgaacagggcgaaattgttatcaacggcgagaaaatcatgcgccccgattacggcgacatgctgaaacgcggcattggctatacgccagaaaaccgcaaagaagcggggatcattccctggctaggcgttgacgaaaatacagtgctgaccaatcggcaaaaaatcagcaccaacggtgtgctgcaatggtccaccatccgccgcctgaccgaagaggtgatgcagcggatgacggtcaaggctgccagtagcgaaacacccatcggcacgctttctggtggcaatcagcaaaaagtggtgatcggtcgttgggtctatgccgccagccagattttgttgctcgacgagccaacgcgcggcgtcgatatcgaagccaaacagcagatttaccgtattgtccgtgagctggctgccgaaggaaaaagcgtggtgtttatctccagtgaagtggaggaattgccgctggtgtgtgaccgcatcctgttattacagcacggcacgttctcgcaggagtttcactcgccggtcaatgtggatgagctgatgtccgccattctgtctgtgcactga

SEQ ID NO: 27241 - protein, 503 aa, Shigella flexneri 2a str. 301
MFTATEAVPVAKVVAGNKRYPGVVALDNVNFTLNKGEVRALLGKNGAGKSTLIRMLTGSERPDSGDIWIGETRLEGDEATLTRRAAELGVRAVYQELSLVEGLTVAENLCLGQWPRRNGMIDYLQMAQDAQRCLQALGVDVSPEQLVSTLSPAQKQLVEIARVMKGEPRVVILDEPTSSLASAEVELVISAVKKMSALGVAVIYVSHRMEEIRRIASYATVMRDGQVAGDVMLENTSTHHIVSLMLGRDHVDIAPVAPQEIVDQAVLEVRALRHKPKLEDISFTLRRGEVLGIAGLLGAGRSELLKAIVGLETYEQGEIVINGEKIMRPDYGDMLKRGIGYTPENRKEAGIIPWLGVDENTVLTNRQKISTNGVLQWSTIRRLTEEVMQRMTVKAASSETPIGTLSGGNQQKVVIGRWVYAASQILLLDEPTRGVDIEAKQQIYRIVRELAAEGKSVVFISSEVEELPLVCDRILLLQHGTFSQEFHSPVNVDELMSAILSVH

SEQ ID NO: 27242 - DNA, 2736 bp, Shigella flexneri 2a str. 301
  CDS (1)..(2736): transl_table=11
atgacgcatctggaactggttcccgtcccgcctgtcgcgcaactggcgggcgtgagccagcattatggaaaaaccgttgcgctgaacaatatcactctcgatattccggcccgttgcatggtcgggctgattggtccggatggcgtcgggaagtcgagtttattgtcactgatttccggtgcccgcgtcattgagcagggcaatgtggtggtgctgggtggcgatatgcacgacccgaagcatcgccgagacgtctgcccgcgcatcgcctggatgccgcaggggctgggcaaaaacctctaccacaccttgtcggtgtatgaaaatgtcgattttttcgctcgcctgttcggtcacgataaagcggagcgggaagtgcgaattaatgagctgctgaccagcaccgggttagcaccgtttcgcgatcgtccggcaggtaaactctccggcgggatgaagcaaaaacttgggctgtgctgcgcgttaatccacgacccggaactgttgatccttgatgagccaacaacgggggttgacccgctctcccgcgcccagttctgggatctgatcgacagtattcgccagcggcagagcaatatgagcgtgctggtcgccaccgcctatatggaagaggccgaacgcttcgactggctggtagcgatgaatgccggagaagtgctggcaaccggcagcgccgaagagctgcggcagcaaacgcaaagcgccacgctggaagaagcatttattaatctgttaccgcaagcgcaacgccaggcgcatcaggcggtagtgatcccaccgtatcaacctgaaaacgcagagattgccatcgaagcgcgcgatctgaccatgcgttttggttccttcgttgccgttgatcacgtcaatttccgcattccacgcggggagatttttggattccttggttcgaacggctgcggtaaatccaccaccatgaaaatgcttaccggactgctgcccgccagcgaaggtgaggcgtggctatttgggcaaccggttgatccaaaagatatcgatacccgccgtcgtgtgggctatatgtcgcaggcgttttcgctctataacgaactcaccgtgcggcaaaacctggagttacatgcccgtttgtttcacatcccggaagcggaaattcccgcgcgagtggctgaaatgagcgagcgttttaagctcaacgacgttgaagatgttctgccggagtcattgccgctcggcattcgccagcggctttcgctggcggtggcggtgattcatcgcccggagatgttaatcctcgatgagcctacttctggtgtcgatccggtggcgagggatatgttctggcagttgatggtcgatctctcgcgccaggacaaagtgactatcttcatctccacccactttatgaacgaagcggaacgttgcgaccgcatctcactgatgcacgccggaaaagtgcttgccagcggtacaccgcaggaactggttgagaaacgcggagccgccagtctggaagaggcatttatcgcctatttgcaggaagcggcagggcagagcaacgaagccgaagcgccgcccgtggtacacgacaccacccacgcgccgcgtcagggatttagcctgcgccgtctgtttagctacagccgccgcgaagcgctggaactgcgacgcgatccagtacgttcgacgctggcgctgatgggaacggtgatcctgatgctgataatgggttacggcatcagtatggatgtggaaaacctgcgctttgcggtgctcgaccgcgaccagaccgtcagtagccaggcgtggacactcaacctctccggttcccgttactttatcgaacagccgccgctcaccagttatgacgagcttgatcgtcggatgcgtgcgggcgatatcacggtggccattgagatcccgcccaatttcgggcgcgatatcgcgcgtggtacgcctgtggaactcggcgtctggatcgacggagcgatgcccagtcgtgccgaaacggtaaaaggttacgtgcaggcaatgcaccagagttggcttcaggatgtggcgagccgacaatcgacacccgccagccaaagcgggctgatgaacattgagacgcgttatcgctataacccggacgtaaaaagcctgccagcgattgttccggcggtgatcccgcttctgctgatgatgatcccgtcaatgctaagcgcccttagcgtggtgcgggaaaaagagctagggtcgattatcaacctttacgtgacccccaccacccgtagcgaatttttgcttggcaaacagctgccgtacatcgcgctggggatgctgaactttttcctgctctgcggcctgtcggtgtttgtgtttggcgtaccgcataaaggcagtttcctgacgctcaccttggcggcgctgctgtatatcatcattgccactggaatggggctgctgatctccacctttatgaaaagccagattgccgccattttcggaacggcgattatcacattgatcccggcgacacagttttccgggatgatcgatccggtagcttcgctggaagggcctggacgttggatcggcgaggtttacccgaccagtcattttctgactatcgcccgcggaacgttctcgaaagcgctggatctgactgatttgtggcaactttttatcccgttgctgatagccatcccgctggtgatgggcttaagcatcctgctgctgaaaaaacaggagggatga

SEQ ID NO: 27243 - protein, 911 aa, Shigella flexneri 2a str. 301
MTHLELVPVPPVAQLAGVSQHYGKTVALNNITLDIPARCMVGLIGPDGVGKSSLLSLISGARVIEQGNVVVLGGDMHDPKHRRDVCPRIAWMPQGLGKNLYHTLSVYENVDFFARLFGHDKAEREVRINELLTSTGLAPFRDRPAGKLSGGMKQKLGLCCALIHDPELLILDEPTTGVDPLSRAQFWDLIDSIRQRQSNMSVLVATAYMEEAERFDWLVAMNAGEVLATGSAEELRQQTQSATLEEAFINLLPQAQRQAHQAVVIPPYQPENAEIAIEARDLTMRFGSFVAVDHVNFRIPRGEIFGFLGSNGCGKSTTMKMLTGLLPASEGEAWLFGQPVDPKDIDTRRRVGYMSQAFSLYNELTVRQNLELHARLFHIPEAEIPARVAEMSERFKLNDVEDVLPESLPLGIRQRLSLAVAVIHRPEMLILDEPTSGVDPVARDMFWQLMVDLSRQDKVTIFISTHFMNEAERCDRISLMHAGKVLASGTPQELVEKRGAASLEEAFIAYLQEAAGQSNEAEAPPVVHDTTHAPRQGFSLRRLFSYSRREALELRRDPVRSTLALMGTVILMLIMGYGISMDVENLRFAVLDRDQTVSSQAWTLNLSGSRYFIEQPPLTSYDELDRRMRAGDITVAIEIPPNFGRDIARGTPVELGVWIDGAMPSRAETVKGYVQAMHQSWLQDVASRQSTPASQSGLMNIETRYRYNPDVKSLPAIVPAVIPLLLMMIPSMLSALSVVREKELGSIINLYVTPTTRSEFLLGKQLPYIALGMLNFFLLCGLSVFVFGVPHKGSFLTLTLAALLYIIIATGMGLLISTFMKSQIAAIFGTAIITLIPATQFSGMIDPVASLEGPGRWIGEVYPTSHFLTIARGTFSKALDLTDLWQLFIPLLIAIPLVMGLSILLLKKQEG

SEQ ID NO: 27244 - DNA, 1413 bp, Shewanella oneidensis MR-1
  CDS (1)..(1413): transl_table=11
atgcaacattgggccatttttgcaaccgatagctatagcggctcactccttgggcggatgttagcggcggatattcagcccgatgaagggcagatctgcaacttgccagcgcgcgttggttgggtgtctctggggttgcaacaggcactacttgagcgcgagctagcaaaggatgaactggattacggttcaacggtcgaggccttagtgctcgaatgctgtcaagatagcgcacagctacctgcattattacaaaaggtgggtcttgaacctttgcggcagcggggttttcggcagttatccacgggtgaaacgcgacgagtgatgctggcacgtgcgctggcgatgttaccgcaactgctgattttagatgatccttacgcagggcttgatgctgagcatcaagggagtttatccgagctattatgcgaagtcgccgcacatagccagttgcttgttatcacctcccgccaagaagaattaccgccgtgcattagccacgtggcactgtttaatagtgagatgcttaaatctggccagcatgtgcataagctcagtgcacctatgtcgattgagcagtggcatagtcaccctgtgatggcgcagctcaatgcactttcggccagccgcagtgacgagcttttagcgctgatggagcgtcaacgccacaatgccgaagcctttgatcccttagtcgagattaaaaacggcaaggtggagtatgttagctgcttgatttttaaaggcgtgaattggcggattaatgcgggccaacattggcaagtgcggggaccaaatggttgcggtaagagtactttgctcgggctgattttgggggatcatccccaatgctacagtaacgatatcactctctttggccgtccccgtggcagcggtgaaagtatttggcagattaaacaacggattggcatagtgtcatcggccttgcatttgcaataccgagtgagttgttcggcgctcgatgtattgctgtcggggttttatgattccattggcctttaccataaacccactaaacctcaggtcgatttggcgaaggaatggctggcaattttacatatgaatgagtttgccagtacgggttttaagcaattggattacggccagcagcggctattgctgattggtagagccttgattaaacagcccttactgttgattttagacgagccgtatcaaggattagattttattaatcgcactttagtgatgcgggcgctggagatgattgccgagcatcatctgagtcaattgctgtatgtctcccaccatagggaagatgccttgccagccattaaaaactttgtcgattttatcaagcaagataacggctattcggttgaggtgagtcatcgccctaatgagttggctcaaaggatgccaatcccataa

SEQ ID NO: 27245 - protein, 470 aa, Shewanella oneidensis MR-1
MQHWAIFATDSYSGSLLGRMLAADIQPDEGQICNLPARVGWVSLGLQQALLERELAKDELDYGSTVEALVLECCQDSAQLPALLQKVGLEPLRQRGFRQLSTGETRRVMLARALAMLPQLLILDDPYAGLDAEHQGSLSELLCEVAAHSQLLVITSRQEELPPCISHVALFNSEMLKSGQHVHKLSAPMSIEQWHSHPVMAQLNALSASRSDELLALMERQRHNAEAFDPLVEIKNGKVEYVSCLIFKGVNWRINAGQHWQVRGPNGCGKSTLLGLILGDHPQCYSNDITLFGRPRGSGESIWQIKQRIGIVSSALHLQYRVSCSALDVLLSGFYDSIGLYHKPTKPQVDLAKEWLAILHMNEFASTGFKQLDYGQQRLLLIGRALIKQPLLLILDEPYQGLDFINRTLVMRALEMIAEHHLSQLLYVSHHREDALPAIKNFVDFIKQDNGYSVEVSHRPNELAQRMPIP

SEQ ID NO: 27246 - DNA, 1380 bp, Streptococcus agalactiae NEM316
  CDS (1)..(1380): transl_table=11
gtgattgaattaaaaggggttaatttcaaatataaaaacaccaaaaacagctgcttagacaatatagatttggaaataaaaaagggagaattcgtcttaatttccggtgcttcaggttctggaaaaacatctataacgagagttataaataagctgattccttattattacgaaggtgaattagaaggcacagtaaaaataaacaacgatttagtatctagctaccaaatgtttgagctttcagaaatagtaggtagtgtttttcagaatcctagaacacaatttttcaatgtggacacaaatagtgaaatagtttttggtttagaaaatcaaggggtttctagagacattttaaaaaaaagattaaaagagacttgtgagacgttggatataaacaaattgcagaataggaatatctttcatctgtcaggaggggaaaagcagaagattgcttttgcgtcggtgtatgcaatgaatcccgatatttatttactggatgaaccctcatctaatttggatataccaacgatagaggtgctaaaaagacatttgtctgttttaaaaaacagtggcaaaacggttattatatctgaacatcgaatctactatttgatggatttggttgacaaagttatatatatgaaaaatggacaaattcaaaaaagttattcaaaagaagattttttgaatttgtctgaagatgaaattaaagctatggctttaagatgcagaaaaaaaacaaaactgaatatagaaatgtctaataatgaaaaacatccatatttacaagtgaatgatttttctatatacaggaaagataattgcattataaataacatgaacttttctgcgaacaaaggcgatattgttgcggttataggttcgaatggtgttggtaaaacaacatttttaagaactctttgtggtctgcatgacaactataaaggtgatgtgttgttgaattctaaaaaaacagatgcaaaaaaaagaagacaaaaaaactatatggttatgcaagatgtgaattatcaattatttgccgagagtgtctttgctgaatgtaaattaggaatagaaaatgtgagcgatgatcttatagaagaaatactaaatgaatttgatttgagcgactataaaaataatcatccaaacaccttatccggaggacaaaaacaaagattggcaatagccgtaggactaatatgcaaaaaagaaatttttgtgttagatgaaccaactagtggacttgactatacgaatatggtaaagactgtagaattgttaaaacgttattccaaagacaaaattatttttattgctacgcatgataccgaatttgctaatttgatttgtaatcgggtattggacttagaaaaatag

SEQ ID NO: 27247 - protein, 459 aa, Streptococcus agalactiae NEM316
MIELKGVNFKYKNTKNSCLDNIDLEIKKGEFVLISGASGSGKTSITRVINKLIPYYYEGELEGTVKINNDLVSSYQMFELSEIVGSVFQNPRTQFFNVDTNSEIVFGLENQGVSRDILKKRLKETCETLDINKLQNRNIFHLSGGEKQKIAFASVYAMNPDIYLLDEPSSNLDIPTIEVLKRHLSVLKNSGKTVIISEHRIYYLMDLVDKVIYMKNGQIQKSYSKEDFLNLSEDEIKAMALRCRKKTKLNIEMSNNEKHPYLQVNDFSIYRKDNCIINNMNFSANKGDIVAVIGSNGVGKTTFLRTLCGLHDNYKGDVLLNSKKTDAKKRRQKNYMVMQDVNYQLFAESVFAECKLGIENVSDDLIEEILNEFDLSDYKNNHPNTLSGGQKQRLAIAVGLICKKEIFVLDEPTSGLDYTNMVKTVELLKRYSKDKIIFIATHDTEFANLICNRVLDLEK

SEQ ID NO: 27248 - DNA, 1740 bp, Corynebacterium efficiens YS-314
  CDS (1)..(1740): transl_table=11
atgaccgatccacgcaccaccaccccgaacacccctgatcaccccggtgaccagcccctgctggaactccgcgacctggagatctccttcaccagctctaccggtgtggtcaacgccgtgcgcggcgccaacctgaccatctatcccggtcagtccgtggccatcgtgggtgaatccggttccggaaaatccaccaccgccatgtccatcatcggcctgctgcctggtaccggaaaggtcaccggcggcaagatcatcttcaacggcgaggacatcaccggtctgtccaacaaacagatggagaaataccgcggttcggagatcggtctggttccccaggaccccatgaccaacctgaacccggtgtggaagatcggatcccaggtcaaggagtccctcaaggccaacaacgtggtcccgggttcggagatggatgcccgcgtcactgaagtcctggaggaggcgggcctgcccgacgcggagcgtcgtgccaaacagtatccccatgagttctccggcggcatgcgccagcgtgccctgatcgccatcggtctggcagcccgcccgaaactgctcatcgccgatgaacccacctccgccctggatgtcaccgtccagcgccagatcctcgaccacctggagggactgacccgggacctgggcaccgcggtgctgttcatcacccatgacctgggtctggcggcggaacgcgccgagcacctggtggtgatgcaccgtgggcgcatcgtcgaatccggcccgtccctgcagatcctgcgcaacccccggcatccctacacccagcgcctggtccaggcggcgccgtccctggcatccgcccgcatccagagcgcccaggccaagggcatggagtccgctgagctgctcaccgccggtgccactgcagacacggtggacctgacgacggaggaacgtgtcatcgaagtcaggaacctcaccagggagttcaacatccggggttcacgtggggataagaaaaccctccgggccgtggatgatgtgtcgttctatgtccgaaagggcaccaccacggcgctggtcggtgaatcgggttccggtaagtccaccgtggccaacatggtgctgagcctgttggaacccaccagtgggcaggtgctgtacaacggcacggacctgtccacgttgagccgcagggatctgttcaacatgcgccgcaaactgcaggtggtgttccagaacccctatggatcgctggatccgatgtactccatctaccgctgcatcgaggaaccactggtcatccataaagtcggtggggaccgcaaggcacgcgagaagcgggtcgcggagctgctggacatggtgtccatgccgcgttcggcgatgcgccgctacccaaatgagctctccggcgggcagcgccagcgcatcgccatcgcccgcgcactcgccctcaaccccgaggtcatcgtgctcgatgaggcggtgtccgccctggatgtgctggtgcagaaccagatcctgcgtctgttggcggagttgcagcatgaactgtccctgacctacctgttcatcacccatgacctcgcggtggtccgccagaccgccgatgacgtggtggtgatgaagaaggggcaggtggtggaagctggccccaccgatgacatcttcaacgatccccagcaggattacacccgcaacctcatcaactcggttccgggcctgggtattgagctgggcaccggggtgaccgagtag

SEQ ID NO: 27249 - protein, 579 aa, Corynebacterium efficiens YS-314
MTDPRTTTPNTPDHPGDQPLLELRDLEISFTSSTGVVNAVRGANLTIYPGQSVAIVGESGSGKSTTAMSIIGLLPGTGKVTGGKIIFNGEDITGLSNKQMEKYRGSEIGLVPQDPMTNLNPVWKIGSQVKESLKANNVVPGSEMDARVTEVLEEAGLPDAERRAKQYPHEFSGGMRQRALIAIGLAARPKLLIADEPTSALDVTVQRQILDHLEGLTRDLGTAVLFITHDLGLAAERAEHLVVMHRGRIVESGPSLQILRNPRHPYTQRLVQAAPSLASARIQSAQAKGMESAELLTAGATADTVDLTTEERVIEVRNLTREFNIRGSRGDKKTLRAVDDVSFYVRKGTTTALVGESGSGKSTVANMVLSLLEPTSGQVLYNGTDLSTLSRRDLFNMRRKLQVVFQNPYGSLDPMYSIYRCIEEPLVIHKVGGDRKAREKRVAELLDMVSMPRSAMRRYPNELSGGQRQRIAIARALALNPEVIVLDEAVSALDVLVQNQILRLLAELQHELSLTYLFITHDLAVVRQTADDVVVMKKGQVVEAGPTDDIFNDPQQDYTRNLINSVPGLGIELGTGVTE

SEQ ID NO: 27250 - DNA, 1476 bp, Corynebacterium efficiens YS-314
  CDS (1)..(1476): transl_table=11
gtgatggcctgcgtgatgccaccgacccgaaacgtgaggtgggccgtgcttgaggtgagtgatctgaccatcggtgacggcctggtgcgggatgtctccttcaccatcgcacccggggaacgggtgggcctgatcggtgaatccgggtcgggtaagaccctgacggcgctggcggtcatggggttgaccgacctgccgcggtccggcaccacgcttgtcgacggcatctcctcctggacacaccgtgggaggaagatcaccatgatcttccaggaacccatgaccgccctcaaccccctcatgcgggtgggtgcccagatcaaggagatcatgcgcatccacggtgtggggaggcgggaggcgcgtgagcgcaccgcccggatggtggaggatgtcgcgctgccccagcgggcactacgtgcctacccacatgaactctcgggcgggcagcgtcaacgcgccctgatcgccatggcgatggtgaacaacccggatgtacttatctgtgatgaacccaccaccgcactcgatgtcacggtgcaacagcagatcactgacctgctgctgcgcctggcggaccagcggggcacctccctgctgttcatcacccatgatctcggcctggtggcgcgcacctgtcagcgggtgatggtgatgcaacagggccggatcgtcgaacgtgggccggtggcagaggtgctgtcgaccccctcgcatgactacacccgcaccctgctgtctgcctcccggctggacacccccgtcattgaggagaactacggtgggacggtcgtggaggtcgatcgtgtcaccagggtgttcaggaagatgacggcgctggagtcggtgtcgctcacggtgcgttccggtgaacgcctgggcatcgtcggtgggtcagggtccggcaagaccaccctgctgaagctgctggcgggtctggatgaaccgacctccggcaccgtccgggtgcagggcgggacccagatggtgttccaggatccactgtccagtctcaatccccggatgcggatcgcggacatcgtcgccgaacccctcatcgggtggtcggccgcacagaaacacgcccgtgtggtggaggtgctaggtgaggtggggctgggacctgaggtgctgggccgctacccacatgaattctccggtgggcagcgccagcgcatctccatcgcccgggcgctgggcccgaaacccgcgatcctgcttgccgacgaacccgtctccgccctcgatgtctccgtgcgcaaacaggtcctcgatctactggccgacctcgtcgcggaatacggcatcaccctggtgttcgtctcccatgatctcgccgtggtccggcacgtgtgcaccagcgtggtggtcatggatcagggccgcatcatcgaacgcggacgggtggatgaggtctacgccgatccccagcatgactacacccgcaccctcctggaggcggttccccggttgtag

SEQ ID NO: 27251 - protein, 491 aa, Corynebacterium efficiens YS-314
MMACVMPPTRNVRWAVLEVSDLTIGDGLVRDVSFTIAPGERVGLIGESGSGKTLTALAVMGLTDLPRSGTTLVDGISSWTHRGRKITMIFQEPMTALNPLMRVGAQIKEIMRIHGVGRREARERTARMVEDVALPQRALRAYPHELSGGQRQRALIAMAMVNNPDVLICDEPTTALDVTVQQQITDLLLRLADQRGTSLLFITHDLGLVARTCQRVMVMQQGRIVERGPVAEVLSTPSHDYTRTLLSASRLDTPVIEENYGGTVVEVDRVTRVFRKMTALESVSLTVRSGERLGIVGGSGSGKTTLLKLLAGLDEPTSGTVRVQGGTQMVFQDPLSSLNPRMRIADIVAEPLIGWSAAQKHARVVEVLGEVGLGPEVLGRYPHEFSGGQRQRISIARALGPKPAILLADEPVSALDVSVRKQVLDLLADLVAEYGITLVFVSHDLAVVRHVCTSVVVMDQGRIIERGRVDEVYADPQHDYTRTLLEAVPRL

SEQ ID NO: 27252 - DNA, 2721 bp, Pseudomonas putida KT2440
  CDS (1)..(2721): transl_table=11
atgaacgccccggcactgctggccgaaggcatcagccaccgttacggcgacctgatagccctccacccactaggcttcagccttcctgtgggtacccgatgcgcgctgatcggccctgacggggctggcaaatcgaccctgctggggctgatcgccggcgtgaaacgcctacagcagggagagctgcaggtgctgggtggctcgatccgccaacgccgccatcgcacggcgctctaccccaaagtggcgttcatgccgcaggggctgggcaacaacctgtacccggaactgtcgatcagcgagaacatccgttttttcgccaccctgttcgggctgggccgccgcgagtgtgaacagcgcatggccaatctgttgcaggccaccgacctgcagcactttgcccagcgcccggccggcaagctgtcgggtggcatgaagcagaagctgggcctttgctgcgcgctgatccacgagccagacctgcttatcctggacgagccgaccaccggcgttgacccactgtcgcggcggcgcttctgggagctggttgaacaggttcgcgcacaacgcccgcaactgaccctgctggtggctaccgcctacatggaagaagccgaacagttcgagcattgcctgatgctcgatggcggccggctgctggccgccggccctagccacgaactggctgcagtcacctcgagcggcaaactggatgatgcctttacccattaccagggcgcgggcaaggcgcagcatcaaccactggcaatcccgccgcgccaagccacggacggcccggtcgccatcgaggcacacgacctgaccctgcgctttggcgacttcacagcggtgaacaaggtcagtttcgccattggccgcggggagatcttcggcttcctgggttccaacggttgcggcaagaccaccaccatgaaagtgctcaccggcctgatgccggccagcgagggcagcgccagcctgctgggtcgcccggtggacgccagcgacctggctacacgcaagcgggtcggcttcatgtcgcagagtttctctctgtatggcgagctcagcacccggcagaacctggccctgcatgcccgcctgttcgacttgcccaaagccgagagcgcccagcgcatcgatgagctgatcgagcgcttcgacctcgccgctatcgccgaccaaccgtctggcgccctgccccttggtttgcgccagcgcctgtcgctggcagtggcggttctgcatcgcccggaagtcttgatcctcgacgaaccgacctccggcgtcgaccccgccgcccgcgacgacttctggcgcctgctggtagaactgtcccgcgagcagggcgtgaccattttcctctccacccacttcatgaacgaagcccagcgctgcgatcgtatttcgctgatgcacgccgggcgggtgctggcctgcgacacgcccgatgccctgcagcaccagtaccagggcgacacgctggaagacgcgttcgtccgctgcctggaacaggcccaggaactggcgccagccgccaccgacagcaacgtgctggaacaggcgtccacccccaccctaccgctacgccggggcttcagcctgcgccgcctgctggcagtggccgtccgtgagggcaaggagttgctgcgcgacaaggtgcgcctggccttcgccttactgggcgcagtgttcatgatggtgatcttcggctacggcatttcactggatgtggaaaacctcgccttcgccgtgcacgatcaggaccagagcccgcaaagtcgtgcctacctcgaagccttccgtggctcacgctacttcgccgaacaggcgccgatccgcgacagcagcgagctgcaccagcgcctgcaacgctcggaaatcaaactggcactggaaattccgcccggctttggtcgcgacctgtacgcaggacgccagccggtggtggctgcctggctcgacggtggcatgccgttccgcgccgaaaccagccgcaactacgtggaagccgtgcaccaggccaacctggagcaactggcaaaggccagcccacaaccgcagccacgccaggacccggtgcgcctggaaacgcgtttccgctacaaccaggatgtggtcagcgtgaacgccatcggcccgggcgtgatggcactgatactggccttcattccggccatgctcacggcactgggcatcgtgcgcgagaaggagctcggctccatcaccaacttctacgccacacccctcacccgcctggaattcctgcttggcaagcagatgccctacctggctgtgagcctggtcaacctggcgctgctggtggcgatgaaccgctggctgttcgccgtaccgctcaagggcagcgtactggctttggcatgtggcggcgtggcctacctgctggcaaccaccagcctgggcctgctgatttcggcattcacccgcacccagatcgccgccattctcggcaccatgatcattaccagcctgccgaccatccagttttccgggctgatcgtgccacgctcgtcgctggacggcgcggcagcggtgatgggccagttgttcccggcgggctacttcctcgacatcgcagtcggcaccttcaccaaggccttaggcctgcgcgagttgtggccgcagtgcctgatcctgctgagcttctttgccgcgttcaccggcctgagcctggcaatgctgaaaaagcaggaggcctga

SEQ ID NO: 27253 - protein, 906 aa, Pseudomonas putida KT2440
MNAPALLAEGISHRYGDLIALHPLGFSLPVGTRCALIGPDGAGKSTLLGLIAGVKRLQQGELQVLGGSIRQRRHRTALYPKVAFMPQGLGNNLYPELSISENIRFFATLFGLGRRECEQRMANLLQATDLQHFAQRPAGKLSGGMKQKLGLCCALIHEPDLLILDEPTTGVDPLSRRRFWELVEQVRAQRPQLTLLVATAYMEEAEQFEHCLMLDGGRLLAAGPSHELAAVTSSGKLDDAFTHYQGAGKAQHQPLAIPPRQATDGPVAIEAHDLTLRFGDFTAVNKVSFAIGRGEIFGFLGSNGCGKTTTMKVLTGLMPASEGSASLLGRPVDASDLATRKRVGFMSQSFSLYGELSTRQNLALHARLFDLPKAESAQRIDELIERFDLAAIADQPSGALPLGLRQRLSLAVAVLHRPEVLILDEPTSGVDPAARDDFWRLLVELSREQGVTIFLSTHFMNEAQRCDRISLMHAGRVLACDTPDALQHQYQGDTLEDAFVRCLEQAQELAPAATDSNVLEQASTPTLPLRRGFSLRRLLAVAVREGKELLRDKVRLAFALLGAVFMMVIFGYGISLDVENLAFAVHDQDQSPQSRAYLEAFRGSRYFAEQAPIRDSSELHQRLQRSEIKLALEIPPGFGRDLYAGRQPVVAAWLDGGMPFRAETSRNYVEAVHQANLEQLAKASPQPQPRQDPVRLETRFRYNQDVVSVNAIGPGVMALILAFIPAMLTALGIVREKELGSITNFYATPLTRLEFLLGKQMPYLAVSLVNLALLVAMNRWLFAVPLKGSVLALACGGVAYLLATTSLGLLISAFTRTQIAAILGTMIITSLPTIQFSGLIVPRSSLDGAAAVMGQLFPAGYFLDIAVGTFTKALGLRELWPQCLILLSFFAAFTGLSLAMLKKQEA

SEQ ID NO: 27254 - DNA, 1485 bp, Escherichia coli CFT073
  CDS (1)..(1485): transl_table=11
atgggatataaaatgtcatcgttgcaaattttgcaaggcacgtttcgtcttggcaacacaaaaacgctgcaattgcctcggctaacgttaaacgcgggtgatagttgggcgtttgtcggttcgaatggaagcgggaaatcggcgctggcccgcgcgctgtcgggggaacttccgcttttgaaaggtgaacggcaaagccagttttcccacatcactcgtctctccttcgagcaattgcaaaagctcgtcagcgacgaatggcagcggaataacaccgatatgctcggccctggcgaagatgacaccgggcgtaccacggctgagatcattcaggatgaagtaaaggatactccgcgttgcatgcaactggcgcagcagttcggtattaccgccctcctcgaccgacgctttaaatacctttccactggcgagacgcgaaaaaccctgctgtgtcaggcgctgatgtcggagcctgacttgttgattcttgatgagccgttcgatggcctggatgttgcctcacgtcagcagctggctgagctactcgcctcgttacatcagtccggtattactctggtattggtgctcaatcgcttcgatgagatcccagaatttgtccagtttgctggcgtgctggcggattgcacgttagcggaaactggcgctaaagaagaactgctccaacaagcactcgttgcgcaactggcgcatagcgaacagcttgaaggtgtgcaactgccggagccggatgaaccttcagcacgtcacgccttacccgccaacgaaccgcgcattgtgctgaacaatggcgtggtttcttataacgaacgccccattcttaataaccttagctggcaggtgaatccaggcgaacactggcaaattgtcgggccaaatggcgcgggaaaatcgacgttattaagcctgattactggcgatcatccgcaaggttacagcaacgatttgacgcttttcggacgacgtcgcggcagcggcgaaaccatctgggatatcaaaaagcatatcggttacgtcagcagtagtttgcatctggattaccgggtcagcactactgtgcgtaatgtgatcctttctggctattttgattcgattggcatttatcaggccgtttcggatcgccagcaaaaactggtgcagcagtggctggatgttctcggcattgataaacgcacggctgacgctccgttccatagtctttcctggggacagcagcgtctggcgctgatcgtccgcgcgctggtgaaacatccgacgttgcttattctcgatgaaccactacaggggcttgatccgctcaatcgccagcttatccgccggtttgttgatgtgctgattagcgaaggtgaaacgcaattgttgtttgtttcgcaccacgctgaagatgcgcctgcctgtattacccatcgtcttgagttcgtgccggacggtgacttttatcgctatgcgctgacaaaaataaactga

SEQ ID NO: 27255 - protein, 494 aa, Escherichia coli CFT073
MGYKMSSLQILQGTFRLGNTKTLQLPRLTLNAGDSWAFVGSNGSGKSALARALSGELPLLKGERQSQFSHITRLSFEQLQKLVSDEWQRNNTDMLGPGEDDTGRTTAEIIQDEVKDTPRCMQLAQQFGITALLDRRFKYLSTGETRKTLLCQALMSEPDLLILDEPFDGLDVASRQQLAELLASLHQSGITLVLVLNRFDEIPEFVQFAGVLADCTLAETGAKEELLQQALVAQLAHSEQLEGVQLPEPDEPSARHALPANEPRIVLNNGVVSYNERPILNNLSWQVNPGEHWQIVGPNGAGKSTLLSLITGDHPQGYSNDLTLFGRRRGSGETIWDIKKHIGYVSSSLHLDYRVSTTVRNVILSGYFDSIGIYQAVSDRQQKLVQQWLDVLGIDKRTADAPFHSLSWGQQRLALIVRALVKHPTLLILDEPLQGLDPLNRQLIRRFVDVLISEGETQLLFVSHHAEDAPACITHRLEFVPDGDFYRYALTKIN

SEQ ID NO: 27256 - DNA, 1512 bp, Escherichia coli CFT073
  CDS (1)..(1512): transl_table=11
atgttcacggcaacagaggcagtcccggtagcaaaagtggtggcaggaaataagcgttaccccggcgtcgttgcgctggataacgttaacttcacgctcaataaaggcgaagttcgcgcgctgttaggcaaaaacggtgcgggaaaatcgaccctcattcgaatgcttaccggtagcgaacgtccggatagcggtgatatctggattggcgagacgcgactggaaggtgacgaagctacgctgactcgccgtgccgctgaactgggggttcgtgcggtttatcaggagttaagtctggtggaagggctgacagtggcggaaaacctctgcctcggtcagtggccccgccgcaacggcatgattgattacctgcaaatggcgcaggacgcccaacgttgcttgcaggcgttgggcgttgacgttagtcctgaacaacttgtttcaacactaagcccggcgcaaaagcaactggtggaaattgcgcgggtgatgaagggcgagccgcgcgtggtcattcttgatgaacccaccagctcgcttgccagtgcggaagttgaactggtgatcagcgcggtgaaaaagatgtcggcactgggcgtggcggtgatttatgtcagccaccggatggaagaaattcgccgcattgcctcctgtgccaccgttatgcgcgatggtcaggtggcgggcgatgtgatgctcaaaaacacctctacgcatcatattgtgtcgctaatgctcgggcgcgatcacgttgatattgcgccggttgcccctcaggaaattgtggatcaggccgtgctggaagtccgtgcgttacgccataagcccaagctggaggatatcagttttacactacgtcgtggcgaagtgctcggcattgctggtctgctgggggcagggcgcagtgaattgctgaaggcgattgttgggctggagacgtatgaacagggcgaaattgttatcaacggcgagaaaatcacgcgccccgattacggcgacatgctgaaacgcggcattggctatacgccagaaaaccgcaaagaagcggggatcattccctggttgggcgttgacgaaaatacagtgctgaccaatcggcaaaaaatcagcgccaacggtgtactgcaatggtccaccatccgccgcctgaccgaagaggtgatgcagcggatgacggtcaaggccgccagtagcgaaacgcccatcggcacgctttctggcggcaatcagcaaaaagtggtgatcggtcgttgggtctatgccgccagccagattttgttactcgacgagccaacgcgcggcgtcgatatcgaagccaaacagcagatttaccgtattgtccgcgagctggctgccgaaggaaaaagcgtggtgtttatctccagtgaagtggaggagttgccgctggtgtgtgaccgcatcctgttattacagcacggcacgttctcgcaggagtttcactctccggtcaatgtggatgagctgatgtccgccattctgtctgtgcactga

SEQ ID NO: 27257 - protein, 503 aa, Escherichia coli CFT073
MFTATEAVPVAKVVAGNKRYPGVVALDNVNFTLNKGEVRALLGKNGAGKSTLIRMLTGSERPDSGDIWIGETRLEGDEATLTRRAAELGVRAVYQELSLVEGLTVAENLCLGQWPRRNGMIDYLQMAQDAQRCLQALGVDVSPEQLVSTLSPAQKQLVEIARVMKGEPRVVILDEPTSSLASAEVELVISAVKKMSALGVAVIYVSHRMEEIRRIASCATVMRDGQVAGDVMLKNTSTHHIVSLMLGRDHVDIAPVAPQEIVDQAVLEVRALRHKPKLEDISFTLRRGEVLGIAGLLGAGRSELLKAIVGLETYEQGEIVINGEKITRPDYGDMLKRGIGYTPENRKEAGIIPWLGVDENTVLTNRQKISANGVLQWSTIRRLTEEVMQRMTVKAASSETPIGTLSGGNQQKVVIGRWVYAASQILLLDEPTRGVDIEAKQQIYRIVRELAAEGKSVVFISSEVEELPLVCDRILLLQHGTFSQEFHSPVNVDELMSAILSVH

SEQ ID NO: 27258 - DNA, 2736 bp, Escherichia coli CFT073
  CDS (1)..(2736): transl_table=11
atgacgcatctggaactggttcccgtcccgcctgtcgcgcaactggcgggcgtgagccagcattatggaaaaaccgttgcgctgaacaatatcacactcgatattccggcccgttgcatggtcgggctgattggaccggatggtgtcggtaaatcgagcttgttgtcgctgatttccggtgctcgcgtcattgagcagggcggcgtgatggtgctgggcggcgatatgcgcgacccgaagcatcgccgcgacgtctgcccgcgcatcgcctggatgccgcaggggctgggcaaaaatctctaccacaccttgtcggtgtatgaaaacgtcgattttttcgcccgcctgttcggtcacgacaaagcggagcgggaagtgcgaattaatgagctgctgaccagcaccggattagcaccgtttcgcgatcgtccggcagggaaactctccggcgggatgaagcaaaaacttgggctgtgctgtgcgttaatccacgacccggaattgttgattcttgatgagccaacaacgggggttgacccgctctcccgcgcccagttctgggatctgatcgacagcattcgccagcggcagagcaatatgagcgtgctggttgccaccgcctatatggaagaggcggaacgcttcgactggctggtagcgatgaatgccggagaagtgctggcaactggcagcgccgaagagttgcggcagcaaacgcaaagcgccacgctggaagaagcatttataaatctgttaccgcaagcacaacggcaggcgcatcaggcggtagtgatcccaccgtatcaacctgaaaacgcagagattgccatcgaagcgcgcgatctgaccatgcgttttggttccttcgttgccgttgatcacgtcaatttccgcattccacgcggggagatttttggttttcttggttcgaacggctgtggtaaatccaccaccatgaaaatgcttaccggattgctgcccgccagcgaaggtgaggcgtggctgttcgggcaaccggttgatccaaaagatatcgatactcgtcgccgggtgggctatatgtcgcaggcgttttcgctctataacgaactcaccgtgcggcaaaacctggagttacatgctcgtctgtttcatatcccggaagcggaaattcccgcgcgagtggctgaaatgagcgagcgttttaagctcaacgacgtcgaagatgtattgccggagtcattgccgctcggcattcgccagcggctatcgctggcggtggcggtgattcatcgcccggagatgttaatccttgatgaaccgacttctggcgtcgatccggtggcgagggatatgttctggcagttgatggtggatctctcgcgccaggacaaagtgactatcttcatctccacccactttatgaacgaagcggaacgttgtgaccgtatctcactgatgcacgccggaaaagtgctcgccagcggtacaccgccggaactggttgagaaacgcggagccgccagtctggaagaggcatttatcgcttatttgcaggaagcggcagggcagagcaacgaagctgaagcgccgccggtggtacacgacaccacccacgcgccacgtcagggattcagcctgcgccgtctgtttagctacagccgccgcgaagcgctggaactgcgacgcgatccggtacgttcgacgctggcgctgatgggaacggtgatcctgatgctgataatgggttacggcatcagtatggatgtggaaaacctgcgctttgcggtgcttgaccgcgatcaaaccgtcagtagccaggcgtggacgctcaatctctccggttcccgttactttatcgaacagccaccgctcaccagttatgacgagcttgatcgtcggatgcgtgcgggcgatatcacggtggcaattgagatccctcccaatttcgggcgcgatatcgcgcgtggtacgcccgtggaactcggtgtctggatcgacggtgcgatgccgagccgcgccgaaacggtaaaaggttacgtgcaggccatgcaccagagctggctacaggatgtggcgagccgacagtccacacccgccagccaaagcgggctgatgaatattgagacgcgctatcgctataacccggacgtaaaaagcctgccggcgattgttccggcggtgatcccgcttctgctgatgatgatcccgtcaatgctaagcgcccttagcgtggtgcgggaaaaagagctagggtcgattatcaacctttacgtgacccccaccacccgtagcgaatttttacttggcaaacagctgccatacatcgcgctggggatgctgaactttttcctgctctgcgccctgtcggtgtttgtgtttggcgtaccgcataaaggcagtttcctgactctcaccctggcggcgctgctgtatatcatcatcgccaccggaatggggctgctgatctccacctttatgaaaagccagattgccgccattttcggtacggcaattatcacgttgatcccggcgacacagttttccgggatgatcgatccggtagcttcgctggaaggtccaggacgttggatcggcgaggtttatcccaccagtcattttctgactatcgcccgcggaacgttctcgaaagcgctggatctgactgatttgtggcaactttttatcccgttgctgatagccataccgctggtgatgggcttaagcatcctgctgctgaaaaaacaggagggatga

SEQ ID NO: 27259 - protein, 911 aa, Escherichia coli CFT073
MTHLELVPVPPVAQLAGVSQHYGKTVALNNITLDIPARCMVGLIGPDGVGKSSLLSLISGARVIEQGGVMVLGGDMRDPKHRRDVCPRIAWMPQGLGKNLYHTLSVYENVDFFARLFGHDKAEREVRINELLTSTGLAPFRDRPAGKLSGGMKQKLGLCCALIHDPELLILDEPTTGVDPLSRAQFWDLIDSIRQRQSNMSVLVATAYMEEAERFDWLVAMNAGEVLATGSAEELRQQTQSATLEEAFINLLPQAQRQAHQAVVIPPYQPENAEIAIEARDLTMRFGSFVAVDHVNFRIPRGEIFGFLGSNGCGKSTTMKMLTGLLPASEGEAWLFGQPVDPKDIDTRRRVGYMSQAFSLYNELTVRQNLELHARLFHIPEAEIPARVAEMSERFKLNDVEDVLPESLPLGIRQRLSLAVAVIHRPEMLILDEPTSGVDPVARDMFWQLMVDLSRQDKVTIFISTHFMNEAERCDRISLMHAGKVLASGTPPELVEKRGAASLEEAFIAYLQEAAGQSNEAEAPPVVHDTTHAPRQGFSLRRLFSYSRREALELRRDPVRSTLALMGTVILMLIMGYGISMDVENLRFAVLDRDQTVSSQAWTLNLSGSRYFIEQPPLTSYDELDRRMRAGDITVAIEIPPNFGRDIARGTPVELGVWIDGAMPSRAETVKGYVQAMHQSWLQDVASRQSTPASQSGLMNIETRYRYNPDVKSLPAIVPAVIPLLLMMIPSMLSALSVVREKELGSIINLYVTPTTRSEFLLGKQLPYIALGMLNFFLLCALSVFVFGVPHKGSFLTLTLAALLYIIIATGMGLLISTFMKSQIAAIFGTAIITLIPATQFSGMIDPVASLEGPGRWIGEVYPTSHFLTIARGTFSKALDLTDLWQLFIPLLIAIPLVMGLSILLLKKQEG

SEQ ID NO: 27260 - DNA, 1578 bp, Escherichia coli CFT073
  CDS (1)..(1578): transl_table=11
atgccgcgtgaattgattggcttaggtggagtcgttatgccttatctacttgaaatgaagaacattaccaaaaccttcggcagtgtgaaggcgattgataacgtcagcttgcggttgaatgctggcgaaatcgtctcactctgtggggaaaatgggtcaggtaaatcaacgctgatgaaagtgctgtgtggtatttatccccatggttcctacgaaggcgaaattatttttgcgggagaagagattcaggcgagtcacatccgcgataccgaacgcaaaggtatcgccattattcaccaggaattggcgctggtgaaagaactgaccgtgctggaaaatatcttcctgggtaacgaaataacccataatggcattatggattatgacctgatgacgctacgctgtcagaagctgctcgcacaggtcagtttatccatttcacctgatacccgcgttggcgatttaggacttgggcaacaacaactggttgaaattgccaaggcacttaataaacaggtgcgtttgttaattctcgatgagccgacagcctcattaactgagcaggaaacgtcggttttactggatattattcgcgatctacaacagcacggtatcgcctgtatttatatttcgcacaaactcaacgaagtcaaagcgatttccgatacgatttgcgttattcgcgacggtcagcacattggcacgcgtgatgctgctggaatgagtgaagacgatattatcaccatgatggtcgggcgagagttaaccgcgctttaccctaatgaaccacataccaccggagatgaaatattacgtattgaacatctgacggcatggcatccggttaatcgtcatattaaacgagttaatgatgtctcgttttccctgaaacgtggcgaaatactgggtatcgccggactcgttggtgccggacgtaccgagactattcagtgcctgtttggtgtgtggcccggacaatgggaagggaaaatttatattgacggcaaacaggtagatattcgtaactgtcagcaagccatcgcccaggggattgcgatggtacccgaagacagaaagcgcgacggcatcgttccggtaatggcggttggtaaaaatattaccctcgccgcactcaaaaaatttaccggtagtattagccagcttgatgacgcggcagagcaaaaatgtattctggaatcaatccagcaactcaaagttaaaacgtcgtcccccgaccttgctattggacgtttgagcggcggcaatcaacaaaaagcgatcctcgctcgctgtctgttacttaacccgcgcattctcattcttgatgaacccaccaggggtatcgatattggcgcgaaatacgagatctacaaattaattaaccaactcgtccagcagggtattgccgttattgtcatctcttccgaattacctgaagtgctcggccttagcgatcgtgtactggtgatgcatgaagggaaactaaaagccaacctgataaatcataacctgactcaggagcaggtgatggaagccgcattgaggagcgaacatcatgtcgaaaagcaatccgtctga

SEQ ID NO: 27261 - protein, 525 aa, Escherichia coli CFT073
MPRELIGLGGVVMPYLLEMKNITKTFGSVKAIDNVSLRLNAGEIVSLCGENGSGKSTLMKVLCGIYPHGSYEGEIIFAGEEIQASHIRDTERKGIAIIHQELALVKELTVLENIFLGNEITHNGIMDYDLMTLRCQKLLAQVSLSISPDTRVGDLGLGQQQLVEIAKALNKQVRLLILDEPTASLTEQETSVLLDIIRDLQQHGIACIYISHKLNEVKAISDTICVIRDGQHIGTRDAAGMSEDDIITMMVGRELTALYPNEPHTTGDEILRIEHLTAWHPVNRHIKRVNDVSFSLKRGEILGIAGLVGAGRTETIQCLFGVWPGQWEGKIYIDGKQVDIRNCQQAIAQGIAMVPEDRKRDGIVPVMAVGKNITLAALKKFTGSISQLDDAAEQKCILESIQQLKVKTSSPDLAIGRLSGGNQQKAILARCLLLNPRILILDEPTRGIDIGAKYEIYKLINQLVQQGIAVIVISSELPEVLGLSDRVLVMHEGKLKANLINHNLTQEQVMEAALRSEHHVEKQSV

SEQ ID NO: 27262 - DNA, 1542 bp, Vibrio vulnificus CMCP6
  CDS (1)..(1542): transl_table=11
gtgtccggctctttgaccatcaacggtcaagaaacggcgacgttcgccatgcaccaattcaccgaacaggttgggacagtgctgcaagacaccgacagccaatttgtcggtttaagcatcggtgaagacatcgcgtttgcacttgaaaaccagctcacctcgaacattgagatgtactcgctggtcaaagccaccgcgaagatggtggaccttgagcaaatgttgcaacgctcgccacacgatctctcgggcggacagaaacaacgtgtttcactggcaggtattctcgtggatgatgtcgatattctgctgtttgatgaacctttggcagcgctcgatccaaaaaccggcaaacgcaccattgaaatcattgatgagctccatcgcaagacaggcaaaaccgtggtcatcatcgagcaccgtctcgaggatgtgctgcatcgtcacgtcgaccgcatcattctgatggatgacggtgagatcatggctgataccacgccagacgagctgcttgcttcgccattattggcacaatatggtattcgcgagccgctttacctaacggcgctaaaatccgcaggctgccatcttgcgctagacgatcacccctcaagcttaagcgagttgcccttggccaattatcagcacgcaatggcagattggtttcaccaagcgaacacgacaagcaaccacattcgttcagagactttgcttgacgtgcgcaacttaacctactcctacgatggtgagaaaaacgcattagaaggggtaagtttcaatgtgcaacgcggcgaatttgtctcgatattgggcaaaaatggttccggtaaatcgaccatcaccaagctgatcatgggcgtgattgaacccgatgacggcgcgatttacttaaacggccaagatcttagcgagctgaccattttcgagcgcagtcaaaaagtgggtgtggtgatgcaaaaccctaaccacatgatttcgcaccatatgatttttgacgaagtcgcatttggcctgcgcaatcgaggttgggacgagcagcaagtcaacgacaaggtgcttgaagtgctcgaattgtgtggtctaagcaaatatcgtcattggccaattgaagcgctcagctacggccaaaagaaacgcgtcaccatcgcttcgattctcgccctagagcctgaactgttgatcctcgacgagcccactgcaggtcaggactaccgcaactacacctcaatgctgagtttcattgaaaagctcaatcgagagctaggcatcaccgtcgtgatcatttctcatgacatgcacttggtactggaatacaccacacgctcaatcgtgattgcagatagccagcttgtggccgacgcgccgatgacggatgttttcagtaaccctgcattgctagaccaagcgaacctaaccaccaccagcctgtatgagcttgcgacgcgcttaaacatggctgaaaccaacgcctttatgcagcattttattgatgtcgaaaaagcctctcgcttagagaaaaccgttgagagaaatgtggcatga

SEQ ID NO: 27263 - protein, 513 aa, Vibrio vulnificus CMCP6
MSGSLTINGQETATFAMHQFTEQVGTVLQDTDSQFVGLSIGEDIAFALENQLTSNIEMYSLVKATAKMVDLEQMLQRSPHDLSGGQKQRVSLAGILVDDVDILLFDEPLAALDPKTGKRTIEIIDELHRKTGKTVVIIEHRLEDVLHRHVDRIILMDDGEIMADTTPDELLASPLLAQYGIREPLYLTALKSAGCHLALDDHPSSLSELPLANYQHAMADWFHQANTTSNHIRSETLLDVRNLTYSYDGEKNALEGVSFNVQRGEFVSILGKNGSGKSTITKLIMGVIEPDDGAIYLNGQDLSELTIFERSQKVGVVMQNPNHMISHHMIFDEVAFGLRNRGWDEQQVNDKVLEVLELCGLSKYRHWPIEALSYGQKKRVTIASILALEPELLILDEPTAGQDYRNYTSMLSFIEKLNRELGITVVIISHDMHLVLEYTTRSIVIADSQLVADAPMTDVFSNPALLDQANLTTTSLYELATRLNMAETNAFMQHFIDVEKASRLEKTVERNVA

SEQ ID NO: 27264 - DNA, 1485 bp, Bradyrhizobium japonicum USDA 110
  CDS (1)..(1485)
atgatggatatgaggctttcaaaccgggccgtgctcgaagtccgcggtctgaccaagcgcttcggcggcctgaccgcggtgaagaatctcggcttcgaggtcaacagcggcgagatctttggcctgatcgggccgaacggctcgggcaagtcgaccgcgatgaagagcgtgatgggcatcgagcgcccgacatcaggcgaagtggtcttcgagggcgaggacgtcgcgggcctccccgcgcacaagatcgcgcgcaagggctttggcatggtgttccagcactcgcggccgctgaaccggcagaccgtgctggagaacatcatggtggcgctgctgccggacagcctgttcatgctgtttccggacaaggcgctgatcgagcgcgccaagtggatcgccgaccgcgtgggcttaggcaacgtcatgaaccgccgcccgccgacgctgccgttcgctgatctgcgccggctcgagctcgccaaggctatcgcccgcgatccaaaagtcgtgctggtggacgagccctttgccgggctgacgcgggccgaggtcgatatcttctccgacctgatccgcagcttccgcgatgacggccgcgcggtgatgctggttgaccacaacgtcaagagcgtcgcagcgctggtcgaccgcgtgctcgcgatgtatctcggcgaggagatcgtcaccggcagggccgaggacgtcatgaagaacgagacggtgcgacgggtctatctcggcggcgccatcgagacccatgcgcggcccgagaccagcttcaaggacaaggtgccgctgctccaggtcgagaatgtcagcgtgttctacggcaaggcgcaggcgctggacaacgtctcgatccacgtccacgaaggcgagttcgtctcggtcgtcggcctcaacggcgccggcaagaccacgctgttcaacaccatctccggcttcctgccctatagcggcgagatcgtgcgcggcggcgacaggctgcgcggcacgagcccggccaggatcgcgcgcagcggtctcgtgcagtgcccggaatcgcgcgagctgttcggcgagatgagcgtgcgcgaaaatctcgatctcggcggccagcatctgtccgacgacaagcgcgcggcgcagctcgcctggctgttcgagctgttcccgatcctgaaggagcgccagggccagatggcgcagacgctatccggcggcgagcagcagatgctggcgatcggccgcgccctgatgatgcagccgcagatcctgatcctggacgagccgacgctgggccttgcccccgtcatcctcgagcaattgtccaaggcgctgacgaagctgcggcagaccacgtcgatcacggtgctgctcggcgagcagaacgtcactttcgcgctaccgcacgccgatcgcgtctatgtgctcgaacacgccaggatcgtctgggagggcgatcccggccgcttcgcgagcgaggccggcgccgattttctttaa

SEQ ID NO: 27265 - protein, 494 aa, Bradyrhizobium japonicum USDA 110
MMDMRLSNRAVLEVRGLTKRFGGLTAVKNLGFEVNSGEIFGLIGPNGSGKSTAMKSVMGIERPTSGEVVFEGEDVAGLPAHKIARKGFGMVFQHSRPLNRQTVLENIMVALLPDSLFMLFPDKALIERAKWIADRVGLGNVMNRRPPTLPFADLRRLELAKAIARDPKVVLVDEPFAGLTRAEVDIFSDLIRSFRDDGRAVMLVDHNVKSVAALVDRVLAMYLGEEIVTGRAEDVMKNETVRRVYLGGAIETHARPETSFKDKVPLLQVENVSVFYGKAQALDNVSIHVHEGEFVSVVGLNGAGKTTLFNTISGFLPYSGEIVRGGDRLRGTSPARIARSGLVQCPESRELFGEMSVRENLDLGGQHLSDDKRAAQLAWLFELFPILKERQGQMAQTLSGGEQQMLAIGRALMMQPQILILDEPTLGLAPVILEQLSKALTKLRQTTSITVLLGEQNVTFALPHADRVYVLEHARIVWEGDPGRFASEAGADFL

SEQ ID NO: 27266 - DNA, 1518 bp, Clostridium tetani E88
  CDS (1)..(1518): transl_table=11
atgaaaaaagaaaatttagaagagaagccctttttacaaatgaaaggaatttccaagtttttttctggtgtacaagctctagacaatgtagaacttaaagtatatagaggagaagtactagctctattaggagagaatggagcaggtaaatctacattgatgaaaatattaagcggtgtatatacaaaagatgaaggagatatttttatagatgaaaagaaagtagatataaaggggataaaagaagcagaagaattgggaatatctataatacatcaagaattaagtctgctttcaaatttaaaaatatatgaaaatatatttttaggtagcgaaaaatataaaggaatttttaataaacttgataaggattacatgaggtcagagagtgaaaaactgctatcaactataggatttacagcagatgtagatattttagctaaggatataaatataggtgaaatgcaaatgatagaaattattaaggctatttctaagaaatctaaattgataataatggatgaacctactactgctttaactgaagtagaaacagaaaggttatttaaagttataaataaattaaagtcagaaggaatttgtataatatatatatcccatagattagatgaaatctttcaaatatgtgatagagtaaacgtattaagagatggtaaatatgtaggagaggttaaagtaaaagatacaacaaaagatgatttaataactatgatggttggaagaaagctagaagaacaatttccatataaaaaggttaaaaagggagatgcattattagcagtaaataatttatcctacaaaaataaggtgaaaaatatttcttttgaagtaagggcaggagaaatattaggattggcgggacttatgggatctggaagaacagaattagctaagactatatttggagagtataaaaaaagtagtggtgatatatatataaatgataaaaaaattaatataacttcccctaaagaagctatagagaatggcatagcttatttatcagaagatagaaaaaaagaagggcttattttaaatatgtctgtaggtaataatataagtctttgtaacttaaagaaatatgaaaatagtataaaaaagataaataaagaaaaagaatcaaaagaaatagatgattacataaaaaaattatccgtaaaaacaccttcggctaatcagataattaaaaacttaagtggaggtaatcaacaaaaggctattatagcaaaatggattatgatttccccaaatattttaataatagacgaacctacaagaggaatagatgtaggtgctaaaaaagaaatatatgaagttttaaatgaaatcaaaagtttaggtaaagccataattatgatatcttctgatatgcctgaagtattgggaataagtgatagaatattagttatgagtgaaggaaatttgtcaggagaattatcaagagaagaagctacacaggaaaagattatgaaatatgcagtagctttttctaattaa

SEQ ID NO: 27267 - protein, 505 aa, Clostridium tetani E88
MKKENLEEKPFLQMKGISKFFSGVQALDNVELKVYRGEVLALLGENGAGKSTLMKILSGVYTKDEGDIFIDEKKVDIKGIKEAEELGISIIHQELSLLSNLKIYENIFLGSEKYKGIFNKLDKDYMRSESEKLLSTIGFTADVDILAKDINIGEMQMIEIIKAISKKSKLIIMDEPTTALTEVETERLFKVINKLKSEGICIIYISHRLDEIFQICDRVNVLRDGKYVGEVKVKDTTKDDLITMMVGRKLEEQFPYKKVKKGDALLAVNNLSYKNKVKNISFEVRAGEILGLAGLMGSGRTELAKTIFGEYKKSSGDIYINDKKINITSPKEAIENGIAYLSEDRKKEGLILNMSVGNNISLCNLKKYENSIKKINKEKESKEIDDYIKKLSVKTPSANQIIKNLSGGNQQKAIIAKWIMISPNILIIDEPTRGIDVGAKKEIYEVLNEIKSLGKAIIMISSDMPEVLGISDRILVMSEGNLSGELSREEATQEKIMKYAVAFSN

SEQ ID NO: 27268 - DNA, 1407 bp, Lactobacillus plantarum WCFS1
  CDS (1)..(1407): transl_table=11
atggctagtatcgcgctgaataatttaacttacacctatccacaggcgtcgacacccattctggatcgcgttaacctaacactaccacggcaaagcttcatcctattgacagggccatcgggaacaggtaagtcgacgctcctaaagctgattgcaggcttactacccctgactccagatgacggcaccattacctttgatggtcaggcattaactgctagcaccgctaatcagcgcgctcagcacgttgccatgatgtttcagaatcctaatcagcagtttgccatggataccgttgaaaatgaactaattttcgcacttgagaacttacaagtgccccgtgaccaaataccggcccgcttacttagtgcgcttgactttgttggtatccgaaatttacagtcacgactattaaatcatttatccggtggcgagaaacagaaagtggcccttgcaatcattgtcgctatggatagcgatgtcatcctactagatgagccctttgccagtgtcgatccgaccgcacgagccgtcttgttagaccgactcgtggaactacgcaatcaacatgggaagacaatcatcttggcggatcatgacctatcaggttacgaacagctcgtcgatcaagtcgtccaaatcaaggaccagcacttacagctcattgatcgcaccacctggtctgagttattttcagcctttactgagcagccacaacggtcatggtcagcaccgcaacgcgttgaacgcccttgttttcaacttgatcacgtcactttacaggcaggtgatcgtcaactattagtaccgacaacgcgtcaattgttagcacaacacaatacgctgatcacgggtcctaacggtagcggtaaatccacgttatttgaagccctcgtccgtctgcacccttatactggcgaaattcgttacgaagggacacctatcgacaagctaaaacgcaaacgctatgctcgccacgtcgccttgctttttcaggacgctgagacccagtttttaaacatcacggtcgctgaagaactggctcaaagtaaacgctatgcgtatggcgactactttaccgcagaccgtattcaaacggccttagtgcaactcaacttatccggtcgtgatgaacaagtcatctatactttgagtgagggacagaaaaagaaactacaaattctgctcatgttaatcatgcagtcaccagttctactcatggatgaacccttaaaagggctagatttgcattcgatcaatgccctggtcgcgttattacagaccacccaagcggcaactaagcagacgctgattattattagtcaccagttaaccggcctgatgccattgattgactatcagctacactttgaaaatcaccatttagattgggtggtgcgatcatga

SEQ ID NO: 27269 - protein, 468 aa, Lactobacillus plantarum WCFS1
MASIALNNLTYTYPQASTPILDRVNLTLPRQSFILLTGPSGTGKSTLLKLIAGLLPLTPDDGTITFDGQALTASTANQRAQHVAMMFQNPNQQFAMDTVENELIFALENLQVPRDQIPARLLSALDFVGIRNLQSRLLNHLSGGEKQKVALAIIVAMDSDVILLDEPFASVDPTARAVLLDRLVELRNQHGKTIILADHDLSGYEQLVDQVVQIKDQHLQLIDRTTWSELFSAFTEQPQRSWSAPQRVERPCFQLDHVTLQAGDRQLLVPTTRQLLAQHNTLITGPNGSGKSTLFEALVRLHPYTGEIRYEGTPIDKLKRKRYARHVALLFQDAETQFLNITVAEELAQSKRYAYGDYFTADRIQTALVQLNLSGRDEQVIYTLSEGQKKKLQILLMLIMQSPVLLMDEPLKGLDLHSINALVALLQTTQAATKQTLIIISHQLTGLMPLIDYQLHFENHHLDWVVRS

SEQ ID NO: 27270 - DNA, 1629 bp, Tropheryma whipplei str. Twist
  CDS (1)..(1629): transl_table=11
atgaatacggttgagcccccacttctggatgttagaaatctacagatcgaattttctacacctacccgcgcaataaaggccgttgatggcgtcagttttacccttgaaaaaggtgacacgctcgctgttgtcggtgagtcgggttctggaaagtcaacccttgcacattctgtaataggtctcttgccgggtacgggaagaatcaccgaggggcaaataaattatgccgggcgggaccttgtaaagttgtcccagaaacagctcgagggcgtccgcggacataatataggttttgttccacaggacccgatgcagagccttaatcctgttctgcgaatcggcgctcaggtagaggaggccattcgcgcaaatgcgcttgcatcagataataaagagatcagaaagttggcaatccaggctctagagaatgcgggtttgcccaacccctctgacagaatacgctcatatccgcaccaactttcaggtggcatgcaacaaagggtgttgatcggtatagcgctttcctgtcacccaggtcttcttatcgctgacgagccaacaagtgcattggatgtaacagttcagaaggttatccttgatcacatagctgagcgtacttcttctctcggcactgccgttatgctgattacgcacgaccttgccttagctgctgaacgggcgaggcgtcttctggttatgtacaaaggaaaagtagttgaactgggttcatctgaggagattctaaaaaaccctcgccatccttataccaagaaattactgggcgcagctgcaagggcacgacgctctccccttaggtcgaaagagcaagacactgcccctcctgcagttgttgtagacagtctggtaaaaagatatccaatacggtcagggacctttagtacctcacttcttaccgctgttgatggcgtgagcttttcgattcccagcgggtctacggttgctcttgtcggtgagtcgggttctggcaagtccactatcgcaaagataattcttgggtttgaaaagccgacgcgggggactgtaaccatagccggtgttaatacaagctcgctatctgcatctggcttgcgccgtatggctgcgaggatccagccggtatttcaaaatccgtatggcagcctggatccgcttcgcaatattgcatcaattatttctgagcctttgagtatccataaggttggaaacagggccagccgtaaagcccgcgttgtggagcttcttgaccaagtcgcactgccgcagtttattgcgactcgttatcccggtgagttgtctggcggtcagcgccagagggttgcaatagcccgtgctctagccctaaaaccagagataatgattctagatgaggcggtcagcgctctggatgctcttgttcagtcgcagatcttagatcttttggatagcttacagaaacagctttcggttagttatctatttatcacacatgatcttgctgttgcacgggctatctctgactttgtgtgtgttatgcaccagggcaagctggttgaacaaggcccggctgagcgtatcttcaacaatccggagagtaagtatacaaggactcttttggagtcgatacctggacgcctgttttcttggggttga

SEQ ID NO: 27271 - protein, 542 aa, Tropheryma whipplei str. Twist
MNTVEPPLLDVRNLQIEFSTPTRAIKAVDGVSFTLEKGDTLAVVGESGSGKSTLAHSVIGLLPGTGRITEGQINYAGRDLVKLSQKQLEGVRGHNIGFVPQDPMQSLNPVLRIGAQVEEAIRANALASDNKEIRKLAIQALENAGLPNPSDRIRSYPHQLSGGMQQRVLIGIALSCHPGLLIADEPTSALDVTVQKVILDHIAERTSSLGTAVMLITHDLALAAERARRLLVMYKGKVVELGSSEEILKNPRHPYTKKLLGAAARARRSPLRSKEQDTAPPAVVVDSLVKRYPIRSGTFSTSLLTAVDGVSFSIPSGSTVALVGESGSGKSTIAKIILGFEKPTRGTVTIAGVNTSSLSASGLRRMAARIQPVFQNPYGSLDPLRNIASIISEPLSIHKVGNRASRKARVVELLDQVALPQFIATRYPGELSGGQRQRVAIARALALKPEIMILDEAVSALDALVQSQILDLLDSLQKQLSVSYLFITHDLAVARAISDFVCVMHQGKLVEQGPAERIFNNPESKYTRTLLESIPGRLFSWG

SEQ ID NO: 27272 - DNA, 1557 bp, Tropheryma whipplei str. Twist
  CDS (1)..(1557): transl_table=11
ttgcgcgagtcagagggtgtcatgcttcaaatgaccggtataaccaagtcgttttctggggttaaagtccttgaggatatctccttttctctccgaaaaggtgaagtgcacgccatatgtggtgaaaatggcgcaggaaagtctaccttaatgaaaattctctctggcgtgattcctgatggatcatatgatggtgaaataatccttgagaataaaaaaaggcgttttaaaaaccttgctgccagtcaggcggccggggtggttatgattcaccaagagcttaccctcatacccgaaatgtccattgcggagaatatatttttgggtaatgagcagagatattccggacctttttctgggcaaatagactttacaaaaacccgcacaaaagctgtggaacttatgaaacttgttcatctaacagaatccccagacactcttattaaagatctcggggttggaaaacagcagcttgttgagatatgcaaggcgcttggtaaaaatgcaaagattctcgtttttgatgaaccaactgctgttttgaatgagtctgattctgaacatctcctgaatcttatgaagaaattcaagacccaaggtctgtcatccataatgatcagtcacaaattgaatgaggtaaaaaatgttgcagataccgtgactgttttacgagatggcaaaaaaatagataccatacctgccgacgcaacgacggaagatgatatcattcgcaaaatggcaggcagaagcttgtccacgcgcttccctgagctttcaccttctattggtaagggtgcctggcaaataaaggattggactgttatacatcccattaggcgagagatatacgtttcgaataacatctctcttacggttcacgatggtgaaattgtgggtcttgctggccttgtcggtgctgggagaacagagcttgcgcggtcaatatttggtcgtcagttcggaatctatacttctggaaaaatatgcaggaacaacaaagaacttaagataaacaaagtcagccaggcgatcggtaatcatattgcatatgtcacagaagatagaaaatcttttggcttcaatcagtttgatgatgtgaagaatacgattgcctctgcctcactgaaacagtttttaggtaaacaccattttttggatgatggcaaattgcacactgttgctgaggattaccgcaaaaagctaaaaataaagacggccagtgttgctgcaccaattacctctctgtctggaggcaaccagcagaaggttattttggccaaatggatttgtacgggacctgattttttgattcttgatgagccaacacgaggtatagatgtagccgccaaatacgagatttactctatcatcggagaacttgctgcctccgggaagtctattttgtttatttcttcagagcttcccgaactgttaggtatgacaaatcgtatatatactctgtttgagggtaaagtaactggggagtttaaaacttcagaggctagccaggagctacttatgcgttatatgacttcatatggaaataatgaaaattaa

SEQ ID NO: 27273 - protein, 518 aa, Tropheryma whipplei str. Twist
MRESEGVMLQMTGITKSFSGVKVLEDISFSLRKGEVHAICGENGAGKSTLMKILSGVIPDGSYDGEIILENKKRRFKNLAASQAAGVVMIHQELTLIPEMSIAENIFLGNEQRYSGPFSGQIDFTKTRTKAVELMKLVHLTESPDTLIKDLGVGKQQLVEICKALGKNAKILVFDEPTAVLNESDSEHLLNLMKKFKTQGLSSIMISHKLNEVKNVADTVTVLRDGKKIDTIPADATTEDDIIRKMAGRSLSTRFPELSPSIGKGAWQIKDWTVIHPIRREIYVSNNISLTVHDGEIVGLAGLVGAGRTELARSIFGRQFGIYTSGKICRNNKELKINKVSQAIGNHIAYVTEDRKSFGFNQFDDVKNTIASASLKQFLGKHHFLDDGKLHTVAEDYRKKLKIKTASVAAPITSLSGGNQQKVILAKWICTGPDFLILDEPTRGIDVAAKYEIYSIIGELAASGKSILFISSELPELLGMTNRIYTLFEGKVTGEFKTSEASQELLMRYMTSYGNNEN

SEQ ID NO: 27274 - DNA, 1629 bp, Tropheryma whipplei TW08/27
  CDS (1)..(1629): transl_table=11
atgaatacggttgagcccccacttctggatgttagaaatctacagatcgaattttctacacctacccgcgcaataaaggccgttgatggcgtcagttttacccttgaaaaaggtgacacgctcgctattgtcggtgagtcgggttctggaaagtcaacccttgcacattctgtaataggtctcttgccgggtacgggaagaatcaccgaggggcaaataaattatgccgggcgggaccttgtaaagttgtcccagaaacagctcgagggcgtccgcggacataatataggttttgttccacaggacccgatgcagagccttaatcctgttctgcgaatcggcgctcaggtagaggaggccattcgcgcaaatgcgcttgcatcagataataaagagatcagaaagttggcaatccaggctctagagaatgcgggtttgcccaacccctctgacagaatacgctcatatccgcaccaactttcaggtggcatgcaacaaagggtgttgatcggtatagcgctttcctgtcacccaggtcttcttatcgctgacgagccaacaagtgcattggatgtaacagttcagaaggttatccttgatcacatagctgagcgtacttcttctctcggcactgccgttatgctgattacgcacgaccttgccttagctgctgaacgggcgaggcgtcttctggttatgtacaaaggaaaagtagttgaactgggttcatctgaggagattctaaaaaaccctcgccatccttataccaagaaattactgggcgcagctgcaagggcacgacgctctccccttaggtcgaaagagcaagacactgcccctcctgcagttgttgtagacagtctggtaaaaagatatccaatacggtcagggacctttagtacctcacttcttaccgctgttgatggcgtgagcttttcgattcccagcgggtctacggttgctcttgtcggtgagtcgggttctggcaagtccactatcgcaaagataattcttgggtttgaaaagccgacgcgggggactgtaaccatagccggtgttaatacaagctcgctatctgcatctggcttgcgccgtatggctgcgaggatccagccggtatttcaaaatccgtatggcagcctggatccgcttcgcaatattgcatcaattatttctgagcctttgagtatccataaggttggaaacagggccagccgtaaagcccgcgttgtggagcttcttgaccaagtcgcactgccgcagtttattgcgactcgttatcccggtgagttgtctggcggtcagcgccagagggttgcaatagcccgtgctctagccctaaaaccagagataatgattctagatgaggcggtcagcgctctggatgctcttgttcagtcgcagatcttagatcttttggatagcttacagaaacagctttcggttagttatctatttatcacacatgatcttgctgttgcacgggctatctctgactttgtgtgtgttatgcaccagggcaagctggttgaacaaggcccggctgagcgtatcttcaacaatccggagagtaagtatacaaggactcttttggagtcgatacctggacgcctgttttcttggggttga

SEQ ID NO: 27275 - protein, 542 aa, Tropheryma whipplei TW08/27
MNTVEPPLLDVRNLQIEFSTPTRAIKAVDGVSFTLEKGDTLAIVGESGSGKSTLAHSVIGLLPGTGRITEGQINYAGRDLVKLSQKQLEGVRGHNIGFVPQDPMQSLNPVLRIGAQVEEAIRANALASDNKEIRKLAIQALENAGLPNPSDRIRSYPHQLSGGMQQRVLIGIALSCHPGLLIADEPTSALDVTVQKVILDHIAERTSSLGTAVMLITHDLALAAERARRLLVMYKGKVVELGSSEEILKNPRHPYTKKLLGAAARARRSPLRSKEQDTAPPAVVVDSLVKRYPIRSGTFSTSLLTAVDGVSFSIPSGSTVALVGESGSGKSTIAKIILGFEKPTRGTVTIAGVNTSSLSASGLRRMAARIQPVFQNPYGSLDPLRNIASIISEPLSIHKVGNRASRKARVVELLDQVALPQFIATRYPGELSGGQRQRVAIARALALKPEIMILDEAVSALDALVQSQILDLLDSLQKQLSVSYLFITHDLAVARAISDFVCVMHQGKLVEQGPAERIFNNPESKYTRTLLESIPGRLFSWG

SEQ ID NO: 27276 - DNA, 1557 bp, Tropheryma whipplei TW08/27
  CDS (1)..(1557): transl_table=11
ttgcgcgagtcagagggtgtcatgcttcaaatgaccggtataaccaagtcgttttctggggttaaagtccttgaggatatctccttttctctccgaaaaggtgaagtgcacgccatatgtggtgaaaatggcacaggaaagtctaccttgatgaaaattctctctggcgtgattcctgatggatcatatgatggtgaaataatccttgagaataaaaaaaggcgttttaaaaaccttgctgccagtcaggcggccggggtggttatgattcaccaagagcttaccctcatacccgaaatgtccattgcggagaatatatttttgggtaatgagcagagatattccggacctttttctgggcaaatagactttacaaaaacccgcacaaaagctgtggaacttatgaaacttgttcatctaacagaatccccagacactcttattaaagatctcggggttggaaaacagcagcttgttgagatatgcaaggcgcttggtaaaaatgcaaagattctcgtttttgatgaaccaactgctgttttgaatgagtctgattctgaacatctcctgaatcttatgaagaaattcaagacccaaggtctgtcatccataatgatcagtcacaaattgaatgaggtaaaaaatgttgcagataccgtgactgttttacgagatggcaaaaaaatagataccatacctgccgacgcaacgacggaagatgatatcattcgcaaaatggcaggcagaagcttgtccacgcgcttccctgagctttcaccttctattggtaagggtgcctggcaaataaaggattggactgttatacatcccattaggcgagagatatacgtttcgaataacatctctcttacggttcacgatggtgaaattgtgggtcttgctggccttgtcggtgctgggagaacagagcttgcgcggtcaatatttggtcgtcagttcggaatctatacttctggaaaaatatgcaggaacaacaaagaacttaagataaacaaagtcagccaggcgatcggtaatcatattgcatatgtcacagaagatagaaaatcttttggcttcaatcagtttgatgatgtgaagaatacgattgcctctgcctcactgaaacagtttttaggtaaacaccattttttggatgatggcaaattgcacactgttgctgaggattaccgcaaaaagctaaaaataaagaccgccagtgttgctgcaccaattacctctctgtctggaggcaaccagcagaaggttattttggccaaatggatttgtacgggacctgattttttgattcttgatgagccaacacgaggtatagatgtagccgccaaatacgagatttactctatcatcggagaacttgctgcctccgggaagtctattttgtttatttcttcagagcttcccgaactgttaggtatgacaaatcgtatatatactctgtttgagggtaaagtaactggggagtttaaaacttcagaggctagccaggagctacttatgcgttatatgacttcatatggaaataatgaaaattaa

SEQ ID NO: 27277 - protein, 518 aa, Tropheryma whipplei TW08/27
MRESEGVMLQMTGITKSFSGVKVLEDISFSLRKGEVHAICGENGTGKSTLMKILSGVIPDGSYDGEIILENKKRRFKNLAASQAAGVVMIHQELTLIPEMSIAENIFLGNEQRYSGPFSGQIDFTKTRTKAVELMKLVHLTESPDTLIKDLGVGKQQLVEICKALGKNAKILVFDEPTAVLNESDSEHLLNLMKKFKTQGLSSIMISHKLNEVKNVADTVTVLRDGKKIDTIPADATTEDDIIRKMAGRSLSTRFPELSPSIGKGAWQIKDWTVIHPIRREIYVSNNISLTVHDGEIVGLAGLVGAGRTELARSIFGRQFGIYTSGKICRNNKELKINKVSQAIGNHIAYVTEDRKSFGFNQFDDVKNTIASASLKQFLGKHHFLDDGKLHTVAEDYRKKLKIKTASVAAPITSLSGGNQQKVILAKWICTGPDFLILDEPTRGIDVAAKYEIYSIIGELAASGKSILFISSELPELLGMTNRIYTLFEGKVTGEFKTSEASQELLMRYMTSYGNNEN

SEQ ID NO: 27278 - DNA, 1584 bp, Pseudomonas syringae pv. tomato str. DC3000
  CDS (1)..(1584): transl_table=11
atgcaagacaacctgattgaaattcgcgacctgcgggtcgccttcaacggccacgaagtggtgcatggcatcagccttgatatccgccgtggcgaatgcctggcgctggtgggcgaatccggttccggcaaatcagtgaccgcgcattcgattctgcgcttgctgcccccgaaaaacgtcagtacccagggttcgattcgctatgacgggctggatctggtcacggccagcgacaagcaattgcgcagtctgcgcggcaaccgggtggcgatgatttttcaggagcccatgagctcgctgaacccgctgcacacggtcgaaaagcaaattggcgaaatcctcgtcacgcacaagggcctgaagggcaaggccgcgctgagccggacgctggagctgctggagctggtcggcattcgcgaaccgttgttgcggctcaaggcttatccgcatcaactgtcgggcgggcaacgccagcgggtcatgatcgccatggcgctggccaacgaacctgacttgctgatcgctgacgagccgaccaccgcgctggatgtgacggtgcaggtgaagattctcgagttgcttaaatcgctgcaacagcggctgaacatgtcgctgctgctgatcagccacgacctcaatctggtccggcgcatcgctcagcgagtctgtgtgatgcgtgagggcgagatcgtcgagcaggctgattgccaagccctgttcgataacccgcagcacccttacagccgtctgctgatcaatgccgagccggatggcgaaccggtgccgtccacgcacagcaatacgctgctgtcggtgcaggacctgaaggtctggttcccgctgggcaaagcctggttccagcgcgagcagcagtacgtgaaggcggtggacggggtcagtttcgagctgctcaagggcaagacgctgggcattgtcggcgagtccggttcgggcaaatcgacgctgggccaggcgattttgcggctggtggattcagagggcagcatccgctttggcaccaaggaactgagcttgcacagtcagcacctgatgcgcccgttgcgtcgccagctgcaggtggtgtttcaggacccgttcggcagcctgagcccgcgcatgaccgtagagcagatcatcgccgagggcttggtgacgcataaaatcggcacgcccaaagaacgtgagcagacggtgattcgggtgttgcaggaagtggggctcgatccggcgacgcggcatcgttacccgcatgagttttccggtggccagcgccagcgcatttccatcgccagggcattggtgcttgaaccggatctgatcctgctggacgagccgacgtcagccctcgaccgcaccgtgcagaagcagatcgtcgcactgttgcgcgacctgcaaatccgtcatggcctgacgtacctgttcatcagccatgacctggcggtggtgcatgcgctggcccatgacctgatcgtgatcaaggacggcaaagtggtcgaacaaggcccgtcccgcgagatcttcgccgcgccgcagcaggcctacacacaggaactgctgcgctcgtcggggctagtgtttgcctga

SEQ ID NO: 27279 - protein, 527 aa, Pseudomonas syringae pv. tomato str. DC3000
MQDNLIEIRDLRVAFNGHEVVHGISLDIRRGECLALVGESGSGKSVTAHSILRLLPPKNVSTQGSIRYDGLDLVTASDKQLRSLRGNRVAMIFQEPMSSLNPLHTVEKQIGEILVTHKGLKGKAALSRTLELLELVGIREPLLRLKAYPHQLSGGQRQRVMIAMALANEPDLLIADEPTTALDVTVQVKILELLKSLQQRLNMSLLLISHDLNLVRRIAQRVCVMREGEIVEQADCQALFDNPQHPYSRLLINAEPDGEPVPSTHSNTLLSVQDLKVWFPLGKAWFQREQQYVKAVDGVSFELLKGKTLGIVGESGSGKSTLGQAILRLVDSEGSIRFGTKELSLHSQHLMRPLRRQLQVVFQDPFGSLSPRMTVEQIIAEGLVTHKIGTPKEREQTVIRVLQEVGLDPATRHRYPHEFSGGQRQRISIARALVLEPDLILLDEPTSALDRTVQKQIVALLRDLQIRHGLTYLFISHDLAVVHALAHDLIVIKDGKVVEQGPSREIFAAPQQAYTQELLRSSGLVFA

SEQ ID NO: 27280 - DNA, 1455 bp, Vibrio parahaemolyticus RIMD 2210633
  CDS (1)..(1455): transl_table=11
atggctattcgctttagtcagcttgctgtacaaggacataccaccacactttccattgatgaatgggcaatcgataacaatgactcttggggcatcttcagtgcagaaggcgacatcggctccctgctaggcgatctgctttgtggcgaactgaaacccacacaagggacgttggatcttggtgaattgaaagtcgcgcaagtatcgctttcagagcaacaacgactacttgaacgtgagctagaaaaggacgacaccgattttctcgatcgtatcgaccaaggcagtaccgtttatgctttgatttttgagtgctgccaagatgcagcaacaacggaaagactgcttgaagagctcgaccttcaccatttaaaacagagcggttttcgtgttttatcgactggcgagaccagacgagtcatgctcgctagagcgttggcaacccaacctgaccttgtgcttctggataatccttttgtcggtctagatgttgcccaccgcgcttcactcgcaacctatttgcgctcgctttcacaatccgtccagatgttgattacgttttctcgcgagtccgacgtgccagaatggatagatcatgtggcgctatttaatgccggcagtcttgacagcacaatgaataaagaaagttgggacaaccacccgataatcgaacaaatcaagtcacaatcccaaaaacaaagcgaagagatgatggggttgatacgacgtcaccaacactctacgcacttcgatgatcctattttcgaactaaaaaatggccaagttgaatacactgaaaaacgtattttcactgacctgaattggcgcatagataaaggacaacactggcaagttaaaggaccaaacggctgtggtaaaagtacgttattggggctgatatttggcgatcatccacaatgctacagtaacgacatccacatcttcggcaagaagcgaggctctggcgaaagcatctgggagataaaacagcatattggcatggtctcctctgcgctgcatcttcaataccgagtgaattgcagcgcgttagaggtcattctgtctgggttctacgactcgattggcttgtataatcagccttcgcgtaaagagattgacgtagctaaagagtggcttgatatcttacacatgcgtcactacgaaaaaacgtctttcaaacagttggaatacggtcagcaacgtttgctgttgatcgcacgcgctatagtgaagcagccaacactactcattttggatgagccctatcaaggtctcgactttttaggacgacgcttggtaaaaaacacgttggaactgattgcacgtgaaaatctcagccaattgctttacgtctcccattaccaagaagacagccttgagagcatcaaaaacgatcttgagtttgtcttcgatgacgaagcgcagtgttatcgcgctcaaattcatcactggtaa

SEQ ID NO: 27281 - protein, 484 aa, Vibrio parahaemolyticus RIMD 2210633
MAIRFSQLAVQGHTTTLSIDEWAIDNNDSWGIFSAEGDIGSLLGDLLCGELKPTQGTLDLGELKVAQVSLSEQQRLLERELEKDDTDFLDRIDQGSTVYALIFECCQDAATTERLLEELDLHHLKQSGFRVLSTGETRRVMLARALATQPDLVLLDNPFVGLDVAHRASLATYLRSLSQSVQMLITFSRESDVPEWIDHVALFNAGSLDSTMNKESWDNHPIIEQIKSQSQKQSEEMMGLIRRHQHSTHFDDPIFELKNGQVEYTEKRIFTDLNWRIDKGQHWQVKGPNGCGKSTLLGLIFGDHPQCYSNDIHIFGKKRGSGESIWEIKQHIGMVSSALHLQYRVNCSALEVILSGFYDSIGLYNQPSRKEIDVAKEWLDILHMRHYEKTSFKQLEYGQQRLLLIARAIVKQPTLLILDEPYQGLDFLGRRLVKNTLELIARENLSQLLYVSHYQEDSLESIKNDLEFVFDDEAQCYRAQIHHW

SEQ ID NO: 27282 - DNA, 1632 bp, Vibrio parahaemolyticus RIMD 2210633
  CDS (1)..(1632): transl_table=11
atgtcttctcaaaccattctttcggtgaacaacttgtctgtcagctttacgacaaacgatgggatcgtcgatgcagtaaagaatgttagcttcgagctacaagcgggtgaaacgctgtctatcgtcggcgaatctggttccggcaaatcagtttccaccaacgctttaatgacgctgctaccagacaacgccattgtccatccagactcgtcaatcatgtttgaaggcgaatccattctggacaaaactgagcgacaaatgcagcgcattcgcggcgatcgcatcggaatgatattccaagagccgatgacttcactgaatccgtacatgcgggtcggtattcaagtggcggaagccatgatgtgtcatcgctcagtcaatcagcgcaaagccaaagaacgtgtgcttgaactgtttgatttggttcatttgccgaacccgcaacaagcctatgataagtatccacatgagttttctggtggtcagttacaacgcatcatgattgccatggcgctaattaacgaaccagacatcttaattgccgatgaaccgacaaccgcgcttgacgttactgttcaggcggaagtgctactgctgattaaagagattcaagcaaaaatggggatggctattttatttatcacccatgacctaggcgtggtgaaacactttgccgatcgtgtgttggtgatgtgcaaaggtgaggtcgttgaagaaggcatcactgagcacttgttttctgaacctcagcatgaatacaccaaaatgctgattaactcgattccgaaaggaagcaaaacccccgttgatgagaaagcgtcggaattgctcaacgctgaagacattcgtgtgaagtttttggtgaagcctcactttatcgcaagcaaaaacgagtacttcgaagcggtaaaaggcatctcgttacaactaaaacagggcgaaacactaggcattgttggtgaatccggttcgggtaaatccacgttagggcgtgcgttgatcggtttgctaccgtctaccggaaaaattgagtttaaaggtcaaaacatggcctcactcagtgataaagagcggttcgatctgaaaaaagacgtacaaatggtgttccaagatccatacggttcgctttcaccacgtatgaccatcggggaaatcatcactgaaggattaaccgtccaccgaccatatttaaacaagaaagaacgcatgcaaaaagcacgtgatgttctgcgcgaagtacgtttggatcccgcatctataaaccgctatccgcacgaattttccggtgggcaacgtcaacgtattgcgattgcacgagccttgattttggaaccgtcgtttatcttgcttgatgagccgacctcagccttagatcgctcagtacaactcactgtcatcgatcttctcaaagacttgcagaaaaaacacaatatcggttatttgttcataagccatgatttatcagtggttaaggcgctttctgatcgcgtattagtgatgcaaaaaggagaagtgatggagcaaggaagcgcacaagagattttccatcacccaaaaagtgagtacactagaaaactgattgatgcctcatttgatcttgaaaacaatgaaaatcaaaatgatgctgcttag

SEQ ID NO: 27283 - protein, 543 aa, Vibrio parahaemolyticus RIMD 2210633
MSSQTILSVNNLSVSFTTNDGIVDAVKNVSFELQAGETLSIVGESGSGKSVSTNALMTLLPDNAIVHPDSSIMFEGESILDKTERQMQRIRGDRIGMIFQEPMTSLNPYMRVGIQVAEAMMCHRSVNQRKAKERVLELFDLVHLPNPQQAYDKYPHEFSGGQLQRIMIAMALINEPDILIADEPTTALDVTVQAEVLLLIKEIQAKMGMAILFITHDLGVVKHFADRVLVMCKGEVVEEGITEHLFSEPQHEYTKMLINSIPKGSKTPVDEKASELLNAEDIRVKFLVKPHFIASKNEYFEAVKGISLQLKQGETLGIVGESGSGKSTLGRALIGLLPSTGKIEFKGQNMASLSDKERFDLKKDVQMVFQDPYGSLSPRMTIGEIITEGLTVHRPYLNKKERMQKARDVLREVRLDPASINRYPHEFSGGQRQRIAIARALILEPSFILLDEPTSALDRSVQLTVIDLLKDLQKKHNIGYLFISHDLSVVKALSDRVLVMQKGEVMEQGSAQEIFHHPKSEYTRKLIDASFDLENNENQNDAA

SEQ ID NO: 27284 - DNA, 1590 bp, Salmonella enterica subsp. enterica serovar Typhi Ty2
  CDS (1)..(1590): transl_table=11
atgacatctccattgcttgcgattgaaaatttatcggtaggtttccgtcagcaacagcacgtgcgccctgtcgttaacgccatttcgttacaggtgaacgccggggaaacgctggcgctggtcggcgagtcagggtcaggaaaaagcgtgacggcgctttccattctgcgtcttttgcctacccctcccgccgtctacctctccggcgatattcgctttcacggcgaatcattgcttcatgccagcgagcagacgctacgcggcgtacgcggcaataaaatcgccatgatttttcaggaaccgatggtttcacttaacccactgcatacgctggaaaaacagctctatgaagtgctgtcgctccatcggggaatgcgtcgggaggcggcaagggcggagatgatcggttgtctggatcgggtcggtatccgccaggcgagccagcgtctgcgcgattatccgcatcagctttccggcggcgaacgccagcgcgtcatgatagccatggcgctgttaacacggccggaattactgatcgccgatgagccgaccaccgccctcgacgtctccgtacaggcgcagatcttatctctactgcgggaactccagcgtgagctcaatatgggattgctgtttatcacccataacctcagcattgtaaaaaaactggcggattcagtggcggtaatgcaacacggcaagtgcgtagagaaccaacgcgccgacacgctgctctccgcgccgacccatccgtacacgcaaaaactactcaacagcgaacccactggcgatccggttccgctccccgccgggcaggcgccgttgctggaagtggacaagctgcgcgtcgccttcccaatccgcaaaggcattctgaagcgcgtcgtggatcataatgtggtggttaacaatatcagtttcaccctgcatccaggcgaaacgctgggtctggtcggcgagtcaggatcgggaaaaagcaccaccggtctggcgctgttacggcttatccgctccgaaggccgcatcgtgtttgacggtcaatcgctggatacgttaaaccgccgccagcttttacctgttcgccaccgtatccaggtcgtattccaggacccgaactcatcgctaaacccgcgtttaaacgtattgcaaattatcgaagaaggcctgcgcgtccaccagcctacgctttcaggcgcgcagcgcgaacagcaggtgaaagcggtcatgatggaagtcggcctggacccggaaacgcggcatcgttaccccgctgagttttccggcggccagcgtcaacgtatcgccgtcgccagggcgctgattttaaaaccgtcgcttattattctggatgaaccgacctcatcgctggataaaaccgttcaggcgcagattcttgccctcctgaaatcgctccagcaaaagcaccgtctggcctatatcttcattagccacgatctgcatgtagtacgcgcgctgtgccatcaggttatcgtgctgcgacagggggaggtggttgaacaggggcaatgcgagcgcgtgtttaccgcaccgcaacaagcgtatacgcgtcagctactcgcgttaagctga

SEQ ID NO: 27285 - protein, 529 aa, Salmonella enterica subsp. enterica serovar Typhi Ty2
MTSPLLAIENLSVGFRQQQHVRPVVNAISLQVNAGETLALVGESGSGKSVTALSILRLLPTPPAVYLSGDIRFHGESLLHASEQTLRGVRGNKIAMIFQEPMVSLNPLHTLEKQLYEVLSLHRGMRREAARAEMIGCLDRVGIRQASQRLRDYPHQLSGGERQRVMIAMALLTRPELLIADEPTTALDVSVQAQILSLLRELQRELNMGLLFITHNLSIVKKLADSVAVMQHGKCVENQRADTLLSAPTHPYTQKLLNSEPTGDPVPLPAGQAPLLEVDKLRVAFPIRKGILKRVVDHNVVVNNISFTLHPGETLGLVGESGSGKSTTGLALLRLIRSEGRIVFDGQSLDTLNRRQLLPVRHRIQVVFQDPNSSLNPRLNVLQIIEEGLRVHQPTLSGAQREQQVKAVMMEVGLDPETRHRYPAEFSGGQRQRIAVARALILKPSLIILDEPTSSLDKTVQAQILALLKSLQQKHRLAYIFISHDLHVVRALCHQVIVLRQGEVVEQGQCERVFTAPQQAYTRQLLALS

SEQ ID NO: 27286 - DNA, 1596 bp, Salmonella enterica subsp. enterica serovar Typhi Ty2
  CDS (1)..(1596): transl_table=11
gtgttagtttccagcaacgttaccatgcagttcggcagtaagccgctgttcgaaaatatttccgtcaaatttggcggcggcaaccgttacggcctgatcggcgccaacggtagcggaaagtccacttttatgaaaatcctcggcggcgacctggagccgacgctgggcaatgtttccctcgatccgaatgagcgcatcggtaagctgcgtcaggaccagttcgcttttgaaacattcaccgtacttgatactgtcattatggggcatggcgaactgtgggaagtcaagcaggagcgcgaccgtatctatgccttgccggaaatgagcgaagaagacggctataaagtcgccgatctggaagtaaaatacggcgagatggacggttattccgctgaggcgcgtgcgggcgaactgctgttgggggtgggcatcccgctggagcagcattacggtctgatgagtgaagtcgcgccaggctggaaattgcgtgtgctactggcgcaggcgttattctctaatccggacatcctgttgctcgacgaaccgaccaacaacctggatattgatactatccgttggctggagcaggtgctgaacgagcgcgatagcacgatgatcatcatttcgcacgaccgtcacttcctgaacatggtttgtacgcatatggcggatctggattacggtgacttgcgcgtctatccgggtaactatgatgagtatatgacggcggcgacccaggcgcgtgaacgtctgttggccgataatgcgaagaaaaaagcgcaaattgccgagctgcaatcttttgttagccgttttagcgccaatgcctctaaatcgcgtcaggcaacgtcgcgcgcgcggcagattgataaaatcaagctggaagaggtgaaagcctccagccgtcagaacccgttcatccgttttgagcaggataaaaaactgttccgtaacgctctggaagtggaggcgctgacgaaaggttttgataacggtccgctgtttaaaaatgtcaatttgctgctcgaagtcggcgagaagctggcggtactcggcaccaatggcgtgggtaaatctacgctgctgaagacgctggttggcgatctggacgccgatcacggcaccgttaaatggtcggaaaacgcgcgtattggttactacgcgcaggaccacgaatatgaattcgaaaatgacctgacggtgtttgaatggatgagtcagtggaaacaggaaggcgacgacgagcaggcagtgcgcagtattctgggccgcctgttatttagccaggatgatatcaaaaagcctgcgaaagtcctctccggtggcgagaagggccgtatgctgttcggcaaactgatgatgcaaaagccgaatatcctgatcatggacgaaccgactaaccacctggatatggagtcgatcgaatcgctgaatatggcgctggagctgtatcagggcacgctgatctttgtttcgcacgaccgtgagttcgtcagctcgctggcaacccgcgtcattgaaattacgccggagcgcgtggtggacttcagcggtaactacgacgattatttgcgtagtaaagggattgaaagctaa

SEQ ID NO: 27287 - protein, 531 aa, Salmonella enterica subsp. enterica serovar Typhi Ty2
MLVSSNVTMQFGSKPLFENISVKFGGGNRYGLIGANGSGKSTFMKILGGDLEPTLGNVSLDPNERIGKLRQDQFAFETFTVLDTVIMGHGELWEVKQERDRIYALPEMSEEDGYKVADLEVKYGEMDGYSAEARAGELLLGVGIPLEQHYGLMSEVAPGWKLRVLLAQALFSNPDILLLDEPTNNLDIDTIRWLEQVLNERDSTMIIISHDRHFLNMVCTHMADLDYGDLRVYPGNYDEYMTAATQARERLLADNAKKKAQIAELQSFVSRFSANASKSRQATSRARQIDKIKLEEVKASSRQNPFIRFEQDKKLFRNALEVEALTKGFDNGPLFKNVNLLLEVGEKLAVLGTNGVGKSTLLKTLVGDLDADHGTVKWSENARIGYYAQDHEYEFENDLTVFEWMSQWKQEGDDEQAVRSILGRLLFSQDDIKKPAKVLSGGEKGRMLFGKLMMQKPNILIMDEPTNHLDMESIESLNMALELYQGTLIFVSHDREFVSSLATRVIEITPERVVDFSGNYDDYLRSKGIES

SEQ ID NO: 27288 - DNA, 1536 bp, Salmonella enterica subsp. enterica serovar Typhi Ty2
  CDS (1)..(1536): transl_table=11
atgcaaatcagtcacaatactgcatcccctctgatttgtgtgcagaacatttataaaagttattccggcgtcgaagtactaaagggaattgactttactctgcatgcgggagaggtgcacgcattgcttggcggcaatggtgcgggtaaatcaacattaatgaagattattgccggtatagtcccgccagatggagggactatcgatattgctggtgtgcgttgcagtcatttaacgcctctgaaggcgcaccagtatggcatttacctggttccccaggagcctctgttatttccgagtttatctgtgcgggaaaatatcttgtttggcttgcagggacgtcaggcctccacggaaaaaatgcagcagctattaaaggcgatgggatgccaactcgatccggcgagcgctgcgggtacgcttgatgttgcagaccgccagatcgttgaaattatgcgcggcttgatgcgcgactcgcgaatcttaattcttgatgagcccacggcgtcgttaacgccagccgaaactgaccggttatttacgcgtctgcaagagttgctgaaaaagggtgtcggaattgtatttatttctcataagctgccagaaattagacagttagctcactgcgttagcgtgatgcgtgacggtaaaatcgcattattcagaaaaacgcatgacctttctaccgacgagattattcaagctatcaccccggcaacgcagggcgtcagtctttccgcgagtcaaaagttgtggctggaattgcctggcagccgcccgcagaacgaacgcggcgcgacggtattagcgctggagtcactgacgggcgaaggttttatgaatatcaaccttgaggtgcgggcaggcgaaatccttggtttggccgggttggtcggcgcgggacgcacagaattggctgaaacgctgtacggtattagaccggtcaatgcggggcggatgctgttcaatggtgaagaaattaacgccctgacaacccaacagcggttgcagctcggcctggtctatttgccggaagatcggcagtcatccgggctgtatcttgacgcttccctggcatggaatgtctgttcgctgacccacaaccaaaaaggattttggataaagccccagcgggataacgccacccttgaacgttaccaccgcgcgttaaatatcaaactcaataatgccgaacaggcggcgcgtactttatccggcggtaaccagcaaaaagtattgattgccaaatgcctggaggcctctccgcaattactgattgtcgatgaaccgacccgcggtgtcgatgtctccgcccgcagcgatatttatcagctgttgcgcagtatcgcgcaacaaaatgtcgcggtgctgtttatttcctccgatctggaagagatagagcagatggccgatcgcgtatatgtcatgcaccagggggaactgggggggcctgcgttatgcggcgaggaaattaacgttgataccatcatgcacgttgcgtttggcgaacatggtgcgtcggaggcaacatgttga

SEQ ID NO: 27289 - protein, 511 aa, Salmonella enterica subsp. enterica serovar Typhi Ty2 [sequence omitted]

SEQ ID NO: 27290 - DNA, 2742 bp, Salmonella enterica subsp. enterica serovar Typhi Ty2
  CDS (1)..(2742): transl_table=11
atgacgtcgctgacgctggtgcctgttcctcccgtggcgcagcttgagggggtgagccagcattacggaaaaacggtcgcgctgaacaatatcacgctggacattcccgcccgtagtatggtcgggctgattggtccggacggggtgggtaagtcgagcctgctgtcgctgatttctggcgcgcgggtgattgagcaagggaacgttatcgtcctgggcggcgatatgcgcgatgcgaaacatcgccgcgacgtctgtccgcgcatcgcctggatgccgcaggggctggggaaaaacctttatcacacgctatcggtttatgagaacgtcgattttttcgctcgtctctttggtcatgacaaagctgaacgcgaagcgcgtattaccgagctgctgaacagcaccggcctggcgccgtttcgtgatcgtcctgccgggaagctgtccggtgggatgaaacaaaagctggggctgtgctgtgcgctgattcatgacccggaattactgattcttgatgagcctaccaccggcgtggactcgctctcccgcgctcagttctgggacttaatcgacagtatccgccaacggcagaccaatatgagcgtgttggtcgcaacggcctatatggaagaggcggagcgttttgactggctggtggcgatgaatgcgggcgagatactggcaaccggcagcgcgcagcaactgcgggcaaaaacccatagcgcgacgctggagcaggcgtttatcgccctgttgccagaagcgcagcgccaggcgcataagccagtggtgatcccgccgtatcacgctgagcaggaagagattgccattgaggcgaaagatctgaccatgcgcttcggtaagttcgtcgcggttgaccatgttaatttccgcattccgcgcggcgagatttttggcttcctcggttcaaacggctgcggcaaatcgaccaccatgaaaatgctgaccggtctgcttcccgccagcgaaggccaagcctggctatttggccagccggtagacccgaacgacatcgatacccgtcgccgggtcgggtatatgtcgcaggctttttcgctctataacgaactcaccgtgcggcagaatctggaacttcatgcccgcctgtttcatattccgccagcggagatcccggcgcgcgttgcgcagatgatcgaacgctttatgctaacggaggtggaagatacgctccccgcttcgttgccgctcggtatccgccagcgtttatcgttggcggtagcggtgatccatcgcccggaaatgctgattcttgatgagccaacgtccggcgttgatccggtcgccagggatatgttctggcagcttatggtcgatctttcgcgtcaggataaagtgacgatttttatctcgacccattttatgaacgaagcggaacgttgcgaccgaatgtcattgatgcacgccggtaaagtgctcgccagcggtacgccgcaggaattggtgcaacagcggggcgcggccaatctggaagcggcgtttatttcctggctacaggaagctgcgggagcggcgcctgaaaccccaataccgccatcccagacgcccgccgcgtcagataaaccgtcgcggcagggattgagcttccggcgtttgttcagctacagtcgccgcgaagcgctggagctacgccgcgatccggtacgctcgacgctggcgctgctgggaacggtaattctgatgctgattatgggctatggcatcagtatggacgtggagaacctgcgttttgccgtactcgaccgcgatcaaaccgtcagcagccaggcatggtcgctcaatctggcgggatcgcgctattttatcgaacagccgccgctcgccagctatgacgagcttgaccggcggatgcgttcgggagagttggcggttgccattgagatcccgcctaattttggccgcgatattgctcgcggtacgccagcgcagattggcgtctgggtggatggcgccatgcccagccgcgccgagacggtgaaggggtacgttcaggcgatgcaccaaagctggctgcaggaggcggcaagtcgtcagccgaacccggttaaacaaaccgggctgctcaacattgaaacgcgctatcgctataacccggatgtgaaaagtctgcccgctatcgttccggcggtcattccgctgctgctcatgatgatcccgtcaatgcttagcgccctgagcgtggtgcgggagaaagagctggggccgatgattaatctgtacgtaacgccgacgacgcgcagtgaatttttgctgggtaaacaactgccgtatatcgcgctgggtatgctgaacttcttgctactgtgcgcgctgtcggtctttgtgttcggcgtgccgctgaaaggcagctttctcacgcttaccctcgcggcgctgctttacgtcatcatcgccaccggtctggggctgctgatctccacgtttatgaagagccaaatcgccgctatttttgggacgtcgattattaccctcattccggcaacacaattttccggcatgatcgatccggtggcttcgctggaaggaccgggaagatggatcggcgagatctacccgaccagccattttctgacgatcgcgcgcgggacgttttccaaagcgttggatctgtccgatctctggtcgttatttatgccgttactgattgccgtcccggtggtgatgggtctgagcattctgctgctgaaaaaacaggaggggtaa

SEQ ID NO: 27291 - protein, 913 aa, Salmonella enterica subsp. enterica serovar Typhi Ty2
MTSLTLVPVPPVAQLEGVSQHYGKTVALNNITLDIPARSMVGLIGPDGVGKSSLLSLISGARVIEQGNVIVLGGDMRDAKHRRDVCPRIAWMPQGLGKNLYHTLSVYENVDFFARLFGHDKAEREARITELLNSTGLAPFRDRPAGKLSGGMKQKLGLCCALIHDPELLILDEPTTGVDSLSRAQFWDLIDSIRQRQTNMSVLVATAYMEEAERFDWLVAMNAGEILATGSAQQLRAKTHSATLEQAFIALLPEAQRQAHKPVVIPPYHAEQEEIAIEAKDLTMRFGKFVAVDHVNFRIPRGEIFGFLGSNGCGKSTTMKMLTGLLPASEGQAWLFGQPVDPNDIDTRRRVGYMSQAFSLYNELTVRQNLELHARLFHIPPAEIPARVAQMIERFMLTEVEDTLPASLPLGIRQRLSLAVAVIHRPEMLILDEPTSGVDPVARDMFWQLMVDLSRQDKVTIFISTHFMNEAERCDRMSLMHAGKVLASGTPQELVQQRGAANLEAAFISWLQEAAGAAPETPIPPSQTPAASDKPSRQGLSFRRLFSYSRREALELRRDPVRSTLALLGTVILMLIMGYGISMDVENLRFAVLDRDQTVSSQAWSLNLAGSRYFIEQPPLASYDELDRRMRSGELAVAIEIPPNFGRDIARGTPAQIGVWVDGAMPSRAETVKGYVQAMHQSWLQEAASRQPNPVKQTGLLNIETRYRYNPDVKSLPAIVPAVIPLLLMMIPSMLSALSVVREKELGPMINLYVTPTTRSEFLLGKQLPYIALGMLNFLLLCALSVFVFGVPLKGSFLTLTLAALLYVIIATGLGLLISTFMKSQIAAIFGTSIITLIPATQFSGMIDPVASLEGPGRWIGEIYPTSHFLTIARGTFSKALDLSDLWSLFMPLLIAVPVVMGLSILLLKKQEG

SEQ ID NO: 27292 - DNA, 1470 bp, Bacteroides thetaiotaomicron VPI-5482
  CDS (1)..(1470): transl_table=11
atggaaaaaggagaacccatagtcgttgtaaaggaaatcagcaagagctacgggaaagtagaggcactgaaagaggtttcttttgcggtagagcagggagaagttttcgggctgatcggtcctgacggggcggggaagagtaccttattccgcatcctgaccactttactgttggctgataaaggtacggcaactgtcaacggactggatgtggtgacggattacaaacagattcgtacgaaagtaggatatatgcccggacggttctcgctttatcaggacctttccgtagaagagaatctggaattttttgctacggtatttcatacgttgatacaggaaaactatgatttgattaaagatatttatcagcagatcgagccttttaaaaaaagaagggcaggcgctttgtcgggaggtatgaagcagaagctggcattgagctgttccctgattcataaacctgatattttatttctggatgaaccgactacgggtgtagatcctgtgtctcggaaagaattttggcagatgctccgtaatttgagaaaacaggggattacgatcattgtttccactcctattatggatgaggctcgtcaatgcgaccggattgcttttattaatcacgggcaggtgcacggaatcgatacgcccgaacggattcttcagaagtttgcttccattctttgtccgccacccttggaacgggaggaggcgcaacagatggcagctcctgttatcgaggtggagcagctgaccaaatccttcggacattttacggcagtcgatcatatctcttttcaagtgcagcggggagaaattttcggttttcttggagccaatggagcaggtaagacgactgcgatgcgtatgctttgcggattgagccgtccgacttcgggagtaggaaaggtggcaggctatgacatctttcgggaagccgaacaagtcaaaaggcatatcggatatatgagtcagaaattctctttgtatgaggatcttaaagtctgggagaatatccgtctctttgccggaatttatgggatgaaggagatggagattgaagaaaagacagatgaattgttagaacgcctgggatttgcagacgaacgggatacgttggtgaaaaaccttcctttgggttggaaacagaaactggccttttctgtctctatcttccatgagccgaaaatagtcttccttgatgaaccgaccggaggagttgatcctgctactcgcaggcagttctgggagctgatttatcaggctgccgatcgtggaatcactgtatttgttaccacacactatatggatgaagcggaatattgcaaccggatatcgattatggtggacggccagatcaaggcactggatacgccggcccggctgaaagaacagtttggtgtggagacaatggatgatgtgtttcaacaacttgcccgccatgcggtgcgtaaagcggattga

SEQ ID NO: 27293 - protein, 489 aa, Bacteroides thetaiotaomicron VPI-5482
MEKGEPIVVVKEISKSYGKVEALKEVSFAVEQGEVFGLIGPDGAGKSTLFRILTTLLLADKGTATVNGLDVVTDYKQIRTKVGYMPGRFSLYQDLSVEENLEFFATVFHTLIQENYDLIKDIYQQIEPFKKRRAGALSGGMKQKLALSCSLIHKPDILFLDEPTTGVDPVSRKEFWQMLRNLRKQGITIIVSTPIMDEARQCDRIAFINHGQVHGIDTPERILQKFASILCPPPLEREEAQQMAAPVIEVEQLTKSFGHFTAVDHISFQVQRGEIFGFLGANGAGKTTAMRMLCGLSRPTSGVGKVAGYDIFREAEQVKRHIGYMSQKFSLYEDLKVWENIRLFAGIYGMKEMEIEEKTDELLERLGFADERDTLVKNLPLGWKQKLAFSVSIFHEPKIVFLDEPTGGVDPATRRQFWELIYQAADRGITVFVTTHYMDEAEYCNRISIMVDGQIKALDTPARLKEQFGVETMDDVFQQLARHAVRKAD

SEQ ID NO: 27294 - DNA, 1455 bp, Bacteroides thetaiotaomicron VPI-5482
  CDS (1)..(1455): transl_table=11
atgattcaaaatacattcaacatagcggggggcgtagcacgcaacccgcttgtgcgtttagctgctcccatcacggcaacgatttcagccggagaacacattgcgattgtaggtcccaacggaggaggaaaaagtctttttgtcgatacgctgatcggtaaatacccattgcgtgaagggacgctgcaatatgacttttctcctgctgccacccagaccgtctatgataatgtgaagtacatcgctttccgtgacacttacggggctgccgatgctaattattactatcagcaacgctggaacgcccacgatcaggacgaagcacccgatgttcgtgaaatgctgggagaaattaaggacgaacaactgaaacaagaactgtttgagctttttcgcattgagccgatgctcgataagaaaataattcttctctccagtggcgaactgcgtaaattccagctggtcaaaactctgctgacagctccccgtgtattgattatggacaatccgtttattggtctggatgcacctacccgcgagttgctgttttctttactcgatcgcttgacaaaaatgtcgtccgtacagattattctggtattgtcaatgctggatgatattccttcatttattacccatgtaattcctgtggataaaatgacggtgtaccccaaaatggaacgtgaggcctatctggaagcttttcgttccagagatgcagccgtttcttttgatgagttacagcagcgtatcgtcaatttgccctatgatggcaataattacgattctgatgaagtggtcaaactgaataaagtcagcattcgctatgatgaccgcactattctgaaagatctcgactggacggtgcggcgtggtgagaaatgggcattgagcggtgaaaacggggccggaaaatctactttgttaagccttgtctgtgcggataatccgcaatcatatgcttgtgacatcagccttttcgggcggaagcggggtacaggggagagtatttgggaaattaaaaagcatattggctatgtaagtccggagatgcatcgtgcttatctcaaaaatctgccggctattgaaatcgtggccagtgggcttcatgacagcatcgggctttacaaacgtccccagccggaacaaatggccatctgcgaatggtggatggatatatttggtattgcggaattgaaagacaacccttttttgcaactttccagtggagaacaacggctggcattgctggcacgtgcttttgtgaaggacccggagctgctgattctggatgaaccgcttcacggtctggatacttacaaccgtcgtcgggtaaagaagattattgaggctttctgccatcgcaaagacaagacgatgattatggtgactcactacgaatcagagttgccgggcactattacagaccgtattttcctgaagagaaaccgatga

SEQ ID NO: 27295 - protein, 484 aa, Bacteroides thetaiotaomicron VPI-5482
MIQNTFNIAGGVARNPLVRLAAPITATISAGEHIAIVGPNGGGKSLFVDTLIGKYPLREGTLQYDFSPAATQTVYDNVKYIAFRDTYGAADANYYYQQRWNAHDQDEAPDVREMLGEIKDEQLKQELFELFRIEPMLDKKIILLSSGELRKFQLVKTLLTAPRVLIMDNPFIGLDAPTRELLFSLLDRLTKMSSVQIILVLSMLDDIPSFITHVIPVDKMTVYPKMEREAYLEAFRSRDAAVSFDELQQRIVNLPYDGNNYDSDEVVKLNKVSIRYDDRTILKDLDWTVRRGEKWALSGENGAGKSTLLSLVCADNPQSYACDISLFGRKRGTGESIWEIKKHIGYVSPEMHRAYLKNLPAIEIVASGLHDSIGLYKRPQPEQMAICEWWMDIFGIAELKDNPFLQLSSGEQRLALLARAFVKDPELLILDEPLHGLDTYNRRRVKKIIEAFCHRKDKTMIMVTHYESELPGTITDRIFLKRNR

SEQ ID NO: 27296 - DNA, 1425 bp, Enterococcus faecalis V583
  CDS (1)..(1425): transl_table=11
gtgaaagaattgtttgaatttaacaatgtttctttttcatataaggatgttaaggaacaagcgcttgttgaccttaatttttcaataaaaaaaggtagtcttacattgattactggttcttctgggagtgggaaatccacactattaaagttaatgaatggacttattccaagactttatgacggaaaattggttggggaaattttatttgaaaataactcgctacaatccttaacacaagaaagtatatcaaaaaatattggctacgtaagtcaagatcctagaggacaattctttacaacaaatacaacgagtgagttagtattttcgatggaaaactttggatttacaaaagagcatatggataaaagaatcaatgaattagctgaattattagatctttcaaatatattagataaaaacattttttcgctatcaagtggtgaacggcagaaaatttctattggatgtagtttatcgctaaactctaaattaattatattggatgaaccgtcttcaaatttggacttccaagcgactaagaaacttgctgacttactttgtgatttaaaaaataaaggatttactattgttatagctgaacatcgtttttattatttgaaagaattaattgatcaagttctatttgttaaaaatagaactgtaaaaactacaactattcagttgttaaaaactgaaaacaataacgcattaaggaaatttgacatttttaatagttcgattgaagttccctatatcgaaaaggcaagtgcagatgtattaaaagttgaagaaattacttatgaaaatattctaaaagacataaattttgatgtcaaagttggagatgttattggtttggtagggaaaaacggtgtggggaaaacaaccttactaagaatactcatgaagattattcgccctaccaaaggaaagataatcgaaaataaaaaaaatttgtcatcgccgtttttagtaatgcaagaaatggattaccaatttttcacagaatcagttaggagcgagttagccctggggaatgaaatagttagtaaagatcagcaagaaaaaattttaaaaaaaatggaactttataaaatgaaagatcaattaccgtttgatttatccggtggagaaaaacaaagattattggtttctatagcttcattgtcaaaaactaatttatttctatttgatgaacctacaagtgggttggattatatcaatatggaaaggattgctgaccttattaaagatttaaaagaaaagggtgcagtagtcatagccactcatgatccggaatttctttataaaatatgcaatagaattatttatttaaaaaatggtggaataaaaaaagatataaaacttagagtagaagattcaactttgatagaacagatttttaatgacataacgaaatag

SEQ ID NO: 27297 - protein, 474 aa, Enterococcus faecalis V583
MKELFEFNNVSFSYKDVKEQALVDLNFSIKKGSLTLITGSSGSGKSTLLKLMNGLIPRLYDGKLVGEILFENNSLQSLTQESISKNIGYVSQDPRGQFFTTNTTSELVFSMENFGFTKEHMDKRINELAELLDLSNILDKNIFSLSSGERQKISIGCSLSLNSKLIILDEPSSNLDFQATKKLADLLCDLKNKGFTIVIAEHRFYYLKELIDQVLFVKNRTVKTTTIQLLKTENNNALRKFDIFNSSIEVPYIEKASADVLKVEEITYENILKDINFDVKVGDVIGLVGKNGVGKTTLLRILMKIIRPTKGKIIENKKNLSSPFLVMQEMDYQFFTESVRSELALGNEIVSKDQQEKILKKMELYKMKDQLPFDLSGGEKQRLLVSIASLSKTNLFLFDEPTSGLDYINMERIADLIKDLKEKGAVVIATHDPEFLYKICNRIIYLKNGGIKKDIKLRVEDSTLIEQIFNDITK

SEQ ID NO: 27298 - DNA, 1542 bp, Streptomyces avermitilis MA-4680
  CDS (1)..(1542)
atggcgggacccgtcctggaaatgcgctcgatcgtcaagacctttcccggcgtcaaggcgctctcggacgtcaccctgaccgtccgtccgggcgaggtccacgccatctgcggggagaacggcgccggcaagtccaccctgatgaaggtgctctccggcgttcacccgcacgggagttacgagggcgaggtcctcttcgagggggagacctgccgcttcaaggacatccgggcgagcgagcagcacggcattgtgatcatccaccaggagctggcgctggtgccgtacctctccatcgcggagaacatcttcctcggcaacgaacacgccgcgcgcggggtcatcagctggaacgacacgctgaagcacgcgagccggctgatgcgccgggtcggtctcgacgatcacccgcagacccgtgtcgccgacatcggcgtgggcaagcagcagctcgtcgagatcgcgaaggccctggcgaaggaggtgaagctgctgatcctcgacgagccgaccgcggcgctcaacgacgaggacagcggcaaactcatcgatctcatcctggagttgaagaaccagggcatcacctcgatcatcatctcccacaagctcaacgagatcgagcgggtcgccgactcggtgacgatcctccgggacggccggaccatcgagaccctcgatgtgaaggccccggagaccaccgaggagcggatcatcaacggcatggtcggccgtgacctcgaccaccgcttcccggagcgcaccccgcaccagccggaagcggacgcggcaccggccctggagatccgcaactggaccgtgcaccacccgatcgaccagcagcgcaaggtggtcgatgatgtgtcactctccgtgcggcgcggggagatcgtcggcatcgcgggtctgatgggcgcgggccgcaccgagctcgcgatgagcgtcttcgggcgcacctacggccggtacgcgcagggcaccgtcctcaaggacggcaaggagatccgtacgaagaccgtccccgaggcggtcgcccacggcatcgcgtacgtcaccgaggaccgcaagcactacgggctcaacctcatggacaccatcggccgcaacatctcgctcagcgcgctgggcaaggtcgccaaacggggtgtcgtcgacgaccacgaggaacgcaaggtcgccgagggcttccggaagtccatgaacatcaaggcacccaccgtcttcgagccggtcggccggctgtcgggcggcaaccagcagaaggtcgtcctcagcaagtggatcttcgcgggtcccgatgtgctgatcctggacgagccgacccgcgggatcgacgtgggcgccaagtacgagatctacacggtcatcgaccagctggccgccgagggcaaggcggtcgtcttcatctcctccgaactccccgaactgctcggcatgtgcgaccgcatctacaccatggcagccgggcggctcaccggtgaggttccgcgttccgaagcgacgcaggaagtgctgatgcgccacatgaccaaggacaagaggtag

SEQ ID NO: 27299 - protein, 513 aa, Streptomyces avermitilis MA-4680
MAGPVLEMRSIVKTFPGVKALSDVTLTVRPGEVHAICGENGAGKSTLMKVLSGVHPHGSYEGEVLFEGETCRFKDIRASEQHGIVIIHQELALVPYLSIAENIFLGNEHAARGVISWNDTLKHASRLMRRVGLDDHPQTRVADIGVGKQQLVEIAKALAKEVKLLILDEPTAALNDEDSGKLIDLILELKNQGITSIIISHKLNEIERVADSVTILRDGRTIETLDVKAPETTEERIINGMVGRDLDHRFPERTPHQPEADAAPALEIRNWTVHHPIDQQRKVVDDVSLSVRRGEIVGIAGLMGAGRTELAMSVFGRTYGRYAQGTVLKDGKEIRTKTVPEAVAHGIAYVTEDRKHYGLNLMDTIGRNISLSALGKVAKRGVVDDHEERKVAEGFRKSMNIKAPTVFEPVGRLSGGNQQKVVLSKWIFAGPDVLILDEPTRGIDVGAKYEIYTVIDQLAAEGKAVVFISSELPELLGMCDRIYTMAAGRLTGEVPRSEATQEVLMRHMTKDKR

SEQ ID NO: 27300 - DNA, 1533 bp, Bacillus cereus ATCC 14579
  CDS (1)..(1533): transl_table=11
atggaatacgtaattgagatgaataacattacgaaagtattcccaggcattgtagcgaatgatgatattacgctgcaagtaaagcagggtgagatacatgctttacttggagaaaatggtgcagggaaatccacattgatgaatgtactatttggtttgtaccaaccagagcagggtgaaattaaaattaaaggtaaacctgtaaaaatcacaaatccgaatatagcaaatgaccttggtattggaatggtccatcaacactttatgcttgttcataattttacagttacagagaatattattctcggaaatgaaccgaagaaaaaagggaaaattgctgttgaggaagctgctaaagaaattcaaaaactgtctgaacaatacggtttatctgtagatccatatgcgaaaatacaggatatttcagttggtatgcagcagcgtgttgagattttgaaaactctttaccgcggtgcagaaattttaatatttgatgaaccaacagctgtgttaacaccgcaagaaattcatgagctaattcaaattatgaaaaagcttgtgcaagaaggaaaatctattgttcttattacacataagttgaaagaaattatggaagtttgcgatcgttgtacgattattcgtaaaggaaaagggattggaacggttgacgttgcaaatacggatgaaaataaacttgcagaattaatggtcggacgtcaagtgaattttaaaacagaaaaaatagacgcgaagccaaaagaagaggtactttcaattgcaaaccttgttgttcacgatgcacgtcaactacctgctgtaaaaggccttgacttaactgttcgtgcgggggaaattgttgggattgcagggattgatggaaacggacaaagtgaattaatagaagcaattactggtttacgaaaagttgagtcaggttctattgcaattaaaggaaaagaaataacaaattggcttgttagaagaataacagaagaaggaattggtcatattccagaagatcgtcataaacacggactcgttcttgatttttctgttagagataatatagttctgcaaacgtattataaaaatccattttcaaagaaagggattttaaatttcagcaaaattacagaaaaagcaaaggctcttattgaacagtttgatgtgcgtacacctagtgagcaaacgttagcacgcgctctatctggggggaatcaacaaaaagcaattattgcacgtgaagtagaccgaaatccagatttattaattgcggcacagccaacacgtggtttagatgtaggagcaattgaatttattcataagagattaatagagcaaagggataaaggaaaaggtgtattacttttatcattagagttagatgaaatcttaaatgttagcgatcgaattgctgttatttatgaaggggaaattgtagcaatagttgatgcgaaagaaacgaatgaacaacagcttggattgttaatggctggaggaacaaagaaggagcaggtgggtacaaatggctaa

SEQ ID NO: 27301 - protein, 510 aa, Bacillus cereus ATCC 14579
MEYVIEMNNITKVFPGIVANDDITLQVKQGEIHALLGENGAGKSTLMNVLFGLYQPEQGEIKIKGKPVKITNPNIANDLGIGMVHQHFMLVHNFTVTENIILGNEPKKKGKIAVEEAAKEIQKLSEQYGLSVDPYAKIQDISVGMQQRVEILKTLYRGAEILIFDEPTAVLTPQEIHELIQIMKKLVQEGKSIVLITHKLKEIMEVCDRCTIIRKGKGIGTVDVANTDENKLAELMVGRQVNFKTEKIDAKPKEEVLSIANLVVHDARQLPAVKGLDLTVRAGEIVGIAGIDGNGQSELIEAITGLRKVESGSIAIKGKEITNWLVRRITEEGIGHIPEDRHKHGLVLDFSVRDNIVLQTYYKNPFSKKGILNFSKITEKAKALIEQFDVRTPSEQTLARALSGGNQQKAIIAREVDRNPDLLIAAQPTRGLDVGAIEFIHKRLIEQRDKGKGVLLLSLELDEILNVSDRIAVIYEGEIVAIVDAKETNEQQLGLLMAGGTKKEQVGTNG

SEQ ID NO: 27302 - DNA, 2772 bp, Nitrosomonas europaea ATCC 19718
  CDS (1)..(2772): transl_table=11
atgagtgtggatatctctacgaaaccggtcatccgtgtacagaatgtcaatttacgttacggtgacactctcgcactcgatgctctcgacgtagagattcccgcccattgcatggcagggttgatcggtccggatggagtcggcaaatccagtctgatgtcgttactgaccggtgcgcgagtaatgcagcagggtcagatcgaagtcctgggaggcgatatcgcagatccggcacatcgtcgtgtggtctgcccacggattgcttacatgccacagggattgggcaggaatctgtaccacacgctctcggtattcgaaaatatcgatttcttcggtcagttgttcggtcacgaacagatcgaacgtcatcagcgtatcgacgaattgctcgaaagtaccgggctggcccctttccgggatcgccctgccggtaaattatcgggtggaatgaaacagaaactcggcttgtgctgtgcactgattcacgaccccgattttctggtgctggatgaaccgactactggtgtcgatccactatcacgtgcgcagttctgggagctgatcagtcgtttgcgtacacaacacgtcaatatgagtgtactggtttctactgcctatatggacgaggcagaacgctttgactggctggcagcaatggatgccggcaaaattcttgctaccgggactgcagccgagctgcgtacacgtactgacaccgactcgctggaagccgccttcatccggttattgccggcagaaaaacgcagaggttaccgagagatcattatcccgccacgcgatatccgggatgatcaggaaattgccatcgaggcacacgatctgaccatgcgttttggcgattttgtcgcggttgatcgggtcaatctgcatatttcgcgtggtgagatctttggttttctcggctccaacggttgtggtaaatccaccaccatgaaaatgctgaccggcctgctaccccccagtgaaggagaagcgtggctattcggtcaggtcatcgatgccggtaatctggctacccgtaaacgagtcggctatatgtctcaggcgttttcactctactccgagctgactgtgcgacagaatctggagctgcatgcaaagctgttccacctgcctgatgccgatattcctgcgcgtgtcaccgaaatggctgaacgttttctgctcgaagcagtcatggacagctttcccgatgctctgccgctgggtatgcgtcagcggttgtcactggcagtcgcagtcattcatcagccggatctgctgattctcgacgaaccgacctccggtgtcgatccaatcgcacgggacatgttctgggagctgatcatcggcctggctcgccgtgatcaggtaaccatcttcatttccacccatttcatgaacgaggccgagcgctgcgatcgtatctcgctgatgcatgccggcaagattctcgccagtgatacccctgccgcactgatcgagcgtagcggccattccacactggaagctgctttcatcagttacctgaaacaggcaagtggcatcagtgataaaccggtgaaaatgcctgttccctccactacccaggcccaggcgacggttgcgccagaggagactcacgctgtcatgacactcaatacccgtttcagtctgttacgcctgttcagctacaccttgcgcgaagcactggaactgcgccgtgatccgatccgcggttcaatcgcattattcgggactgtattactgatgttcatcatgggatacggtatcagtatggatgtcgagaatctgcgctttgccgtactggatcgcgaccagaccacactcagccggaactatatactcgatctcagcggctcacgttatttcatcgaacagccaccaatcactgattatggcgagctcgatcaacgtatgcgcagcggtgagttgagtctcgcattggaaattcccccgaatttcgcacgtgatctggcacgcggtgataacgtcagaatcggcgcctggatcgatggcgcaatgcccacacgcgccgagaatatacttggttatgtacaggcgatgcatcaaaactggctgctcgagcaggcacgccatcatgccacagatcatttacctgccgggctgatgacgatcgaaacacgttttcgctataaccctgacgtcaaaagtttgccggctatcgtccctgcggtgatacctatgttgctgatgctgattctggccatgctcagcgcactcagtgtcgtacgggaaaaggagctgggttccattctcaatctgtatgtcacgcccgtgaccagactggaatttctccttggcaagcagcttccttacattgccctggggatgatcaacttttttctattgtgcatactggctgtattcgttttcggcgtaccgcacaagggggatttcctgttactgacagtggcagcattattgtatgtgaccgccgctaccggtctcggcttgctggtttcagcctttacacgcagccagattgccgccatcttcgcgacatcgctggctaccatcatcccttcttcacgcttttccggcatgatcgatccggtttcttcgctggaaggcggtgcacgactggttggtgagatttttcccgccacgtactttctgacgatcagtcgaggaactttttccaaagcgctgggatttgctgagcttggctctttgttgctgccccttgcactcgccattcctgtcatcaccagtctggcggtcatactgttgaagaaacaggaacgttag

SEQ ID NO: 27303 - protein, 923 aa, Nitrosomonas europaea ATCC 19718
MSVDISTKPVIRVQNVNLRYGDTLALDALDVEIPAHCMAGLIGPDGVGKSSLMSLLTGARVMQQGQIEVLGGDIADPAHRRVVCPRIAYMPQGLGRNLYHTLSVFENIDFFGQLFGHEQIERHQRIDELLESTGLAPFRDRPAGKLSGGMKQKLGLCCALIHDPDFLVLDEPTTGVDPLSRAQFWELISRLRTQHVNMSVLVSTAYMDEAERFDWLAAMDAGKILATGTAAELRTRTDTDSLEAAFIRLLPAEKRRGYREIIIPPRDIRDDQEIAIEAHDLTMRFGDFVAVDRVNLHISRGEIFGFLGSNGCGKSTTMKMLTGLLPPSEGEAWLFGQVIDAGNLATRKRVGYMSQAFSLYSELTVRQNLELHAKLFHLPDADIPARVTEMAERFLLEAVMDSFPDALPLGMRQRLSLAVAVIHQPDLLILDEPTSGVDPIARDMFWELIIGLARRDQVTIFISTHFMNEAERCDRISLMHAGKILASDTPAALIERSGHSTLEAAFISYLKQASGISDKPVKMPVPSTTQAQATVAPEETHAVMTLNTRFSLLRLFSYTLREALELRRDPIRGSIALFGTVLLMFIMGYGISMDVENLRFAVLDRDQTTLSRNYILDLSGSRYFIEQPPITDYGELDQRMRSGELSLALEIPPNFARDLARGDNVRIGAWIDGAMPTRAENILGYVQAMHQNWLLEQARHHATDHLPAGLMTIETRFRYNPDVKSLPAIVPAVIPMLLMLILAMLSALSVVREKELGSILNLYVTPVTRLEFLLGKQLPYIALGMINFFLLCILAVFVFGVPHKGDFLLLTVAALLYVTAATGLGLLVSAFTRSQIAAIFATSLATIIPSSRFSGMIDPVSSLEGGARLVGEIFPATYFLTISRGTFSKALGFAELGSLLLPLALAIPVITSLAVILLKKQER

SEQ ID NO: 27304 - DNA, 1533 bp, Bacillus anthracis str. Ames
  CDS (1)..(1533): transl_table=11
atggaatacgtaattgagatgaacaatattacaaaagtattcccaggcattgtagcgaatgacgatattacgctgcaagtaaaacagggagagatacatgctttacttggagaaaatggtgcagggaaatcaacgctgatgaatgtgttgttcggtttgtatcaaccagaacagggagagattaaaattaaaggaaatcctgttaaaattacaaatccgaatatagcaaatgaccttggtattgggatggtccatcagcattttatgcttgttcataattttacagttacagagaatattattctgggaaatgaaccgaagaaaaacgggaaaattgctgttgaagaggctgcaaaagaaattaagcaattatctgaacagtacggtttagctgttgatccacatgcgaaaattgaagatatttctgttgggatgcagcaaagggttgaaatattaaagactctttatcgtggtgcggagattttaatatttgatgaaccaactgcggtgttaactcctcaagaaattcatgagttgattcaaattatgaaaaagcttgtgcaagaggggaaatctatcattcttattacacataagttaaaagaaattatggaagtttgcgatcgttgtacaattattcgtaaaggtaaggggattggtactgttaatgtagcggaaactgatgagcataaacttgcagagttaatggtcggacgtcaagtgaattttaaaacagaaaaaatagaagctaaaccaaaggaagaagtactatctattgcaaacctaattgttcatgatacgcgcaagttacctgctgtaaaaggccttgacttaactgttcgtgcaggagaaatcgttgggattgcagggattgatggaaatggtcaaagtgaattaatagaggcgattactggtttacgaaaagttgagtcaggttctattgcaattaaaggaaaagaaataacaaattggcctgttcgaagaataacagaagaggggattggtcatattcctgaagaccgtcataaacacggacttgttctcgatttttctgttcgggacaatattgttttacaaacatactataaaaatccattttcaaagaaagggattttaaattttagtaaaatcacacaaaaagcaaaagcgcttattgaacagtttgatgtacgtacacctagtgaacaaacgttagctcgcgctctatctggtggaaaccaacaaaaggcaattattgcacgtgaagtagatcgtaatccagatttattaattgcagcgcagccaacccgtggtttagatgtaggtgccattgaatttattcataaaaaattgattgagcagagagataatggtaaggcagtattgcttttatctttagagctagatgaaattttaaatgtaagtgatcgagttgctgttatatatgaagggaaaattgtagcaattgtggatgcaaaagagacaaacgaacaacagcttggattattaatggccggcgggacagggaaagagaaggtgaacacaaatggctaa

SEQ ID NO: 27305 - protein, 510 aa, Bacillus anthracis str. Ames
MEYVIEMNNITKVFPGIVANDDITLQVKQGEIHALLGENGAGKSTLMNVLFGLYQPEQGEIKIKGNPVKITNPNIANDLGIGMVHQHFMLVHNFTVTENIILGNEPKKNGKIAVEEAAKEIKQLSEQYGLAVDPHAKIEDISVGMQQRVEILKTLYRGAEILIFDEPTAVLTPQEIHELIQIMKKLVQEGKSIILITHKLKEIMEVCDRCTIIRKGKGIGTVNVAETDEHKLAELMVGRQVNFKTEKIEAKPKEEVLSIANLIVHDTRKLPAVKGLDLTVRAGEIVGIAGIDGNGQSELIEAITGLRKVESGSIAIKGKEITNWPVRRITEEGIGHIPEDRHKHGLVLDFSVRDNIVLQTYYKNPFSKKGILNFSKITQKAKALIEQFDVRTPSEQTLARALSGGNQQKAIIAREVDRNPDLLIAAQPTRGLDVGAIEFIHKKLIEQRDNGKAVLLLSLELDEILNVSDRVAVIYEGKIVAIVDAKETNEQQLGLLMAGGTGKEKVNTNG

SEQ ID NO: 27306 - DNA, 1623 bp, Prochlorococcus marinus subsp. marinus str. CCMP1375
  CDS (1)..(1623): transl_table=11
ttgctaaaatttatgaattgttctcaaaaggatgtcttaaatattaaagatttgagtatccgttatgtagatagcaaaacatgggtacttgaaggactgaacttgaaacttgggcgtggagaacgtcttgctctaattggtagttctgggtctggcaaaagtacttttgcaaaggttttgttacagatcattccttcaggcagtttttgtagaggagaacttcttttaaatggggtcgatcttatgagcttgtctcataatgatttagaaaagttgagaggtgaaatgatcgggttggtttttcaggaccctggctcaagacttaacccattaatgaccattggagaacatcttctggatactctgcgtgctcatcaacctgatcaatcttcttcgtggatgaaaaatagatcagaagaattgttggaaaaggttgggattaatccacttcgctttgatgcttatcctcacgaatttagtggagggatgcgtcaacgagttgctattgctttggccatagcattaaacccacctttgatcattgctgatgaaccaacatcaagtcttgatgttgcaatagctcatcagatcatgggtgaattaagtaatctttgtgatgagattgggagctctctgttattaataagtcacgacttggcacttgcttctagatggtgtcaaaaaatggctatccttgacgaaggtaaaattgttgaagaaggatacactcacaaaatattaactgctcctaaatctctttttgctaataggttgataaatgctgctagagccagggaagatttaatgcttctttctgagccaactcaagaagttgttttagaagtagaaagcttacgttgttggcatcctgtaggaggtgtgccatggcgagtgaactggttaaaagctattaatgaagttagttttgttttgaaagtaggagaaactcttgggattgtaggagtttcaggctgtggaaaaagtactttatgtagagctcttttaggactcttgccaacaaggggtgggcaggtgaaattgcttggaaaaaatcttgaaaatttgaaaggaaaagctttgaaagtcgctagacaatcagtgcaaatggtttttcaagacccttttgcttctttaaatcccaagatgaatgtcttggaaacagttgctgaccctcttttgattcataatataactagtcgagtcgctgcaaaagaacgagccagagatctcttgaaacaagtagggttatttccagttgaaaactttcagaaacgtttcccacatcagctttcaggaggtcagcaacaaagagtagctattgcacgtgcacttgctctaaatcctaaaatccttctttgcgatgaaagtgtcagtatgttagatgctgagattcaggcggatatattaaatttgttacgttctttgcaagagaagcttggcttggcaattatttttattacgcacgatctttctgtggcaagttcgttttgccatagagtaattgttttagatcaaggaagaattgcagaagaaggccctgctgatcaaataattcgtagccctaagtctgttcttgctagaaaattagtgagtgcttctccaagaataatttcaattaattag

SEQ ID NO: 27307 - protein, 540 aa, Prochlorococcus marinus subsp. marinus str. CCMP1375
MLKFMNCSQKDVLNIKDLSIRYVDSKTWVLEGLNLKLGRGERLALIGSSGSGKSTFAKVLLQIIPSGSFCRGELLLNGVDLMSLSHNDLEKLRGEMIGLVFQDPGSRLNPLMTIGEHLLDTLRAHQPDQSSSWMKNRSEELLEKVGINPLRFDAYPHEFSGGMRQRVAIALAIALNPPLIIADEPTSSLDVAIAHQIMGELSNLCDEIGSSLLLISHDLALASRWCQKMAILDEGKIVEEGYTHKILTAPKSLFANRLINAARAREDLMLLSEPTQEVVLEVESLRCWHPVGGVPWRVNWLKAINEVSFVLKVGETLGIVGVSGCGKSTLCRALLGLLPTRGGQVKLLGKNLENLKGKALKVARQSVQMVFQDPFASLNPKMNVLETVADPLLIHNITSRVAAKERARDLLKQVGLFPVENFQKRFPHQLSGGQQQRVAIARALALNPKILLCDESVSMLDAEIQADILNLLRSLQEKLGLAIIFITHDLSVASSFCHRVIVLDQGRIAEEGPADQIIRSPKSVLARKLVSASPRIISIN

SEQ ID NO: 27308 - DNA, 1635 bp, Bordetella pertussis Tohama I
  CDS (1)..(1635): transl_table=11
atgactgagaacacaccgaagcaacgggtgctggaggtgtccggcctggccatccgcgccggcgcgcggacactggtgcaggacgtcacgctgagcctggcccagggagaaatcctgtgcctggtgggcgaatcggggtcgggcaagtcgctgacggcgtcggccgtcatggggctgctgccgggcaacctgggcgtgggcgccggcagcatccggctcgatggcgaagacctgaccgcggcgtcgccggcgcgcatgcaggcgctgcgcggcgaccgcatggccatggtgttccaggaacccatgacctcgctcaatccgctgatgcgcgtgggacgccagatcgcggaggtgttgcaggtgcaccggccggacctgggcgccgggcaagtgcgggcacgggtgctggagctgatgggcgatgtgcacctgcccacccccgaggcgctcatggacgccttcccgcatcagttgtcgggcgggcagcgccagcgcatcatgatcgcgatggcgctggcgctggagcctgcgctgatcatcgccgacgaacccaccacggcgctcgacgtcacgacccaggtgcaggtgctcaagctgtttcgccagttgctggccaagcattcgagcgcggtgctgttcatcacgcatgacttcgatgtggtgcgcgatatcgccgaccacgtggccgtgatgcagctgggccgcatcgtcgaacaggggccggccgggcaggtgctggacgcgccccgccacgactacacccgcaagctgctggccgcggtgccgagcggcgtgcccaagacgcagcagaacgcgtcgtccgatgaactgctgtcggtaagcggcctgaacctggtctacgagtcgcgcggcctgctgggcccggcgcggcgcacgcatgccgtcgccgatgtcggcttcacgctgaaaaagggcgagaccctgggcgttgtcggcgagtcgggctcgggcaagtccaccctggggcgctgcatcacgcgggcgcatgcccccacgtcgggccggatcgtcttcgacggcgtggacatcgcggggctgtcgggcaaggcgctgcgggcggtgcgccgccgcgtgcagatggtgttccaggatccctaccggtcgctgaacccgcgccgcaggattctgcatgccttgatcgaaggcccgatcgaaagcggggtggaccgcaagacggcctgcgcgcgcgcggccgagctgatggccctggtgggcttgccggccgacggcctgcagcgttatccgcaccagttctcgggcgggcagcggcaacgcatctgcattgcgcgcgccctggcgatggagcccgacctgatcgtcgcggacgaggccgtgtcggcgctggacgtgtcggtgcaggcgcaggtgctggagctgttcgaagacctccagaagcggctgggattcgccatgatcttcattacccacgacttgcgcgtggccgcgcaggtctgcgaccgcatcggcgtgatgcagaaaggacgcctgctcgagctgggcccggtgcggcaggtcatccatgcgccccagcacccctatacccgccacttgttcgattcgctgcccggccgcgtgggccagacggcggaacccgccatggagctacaggcatga

SEQ ID NO: 27309 - protein, 544 aa, Bordetella pertussis Tohama I
MTENTPKQRVLEVSGLAIRAGARTLVQDVTLSLAQGEILCLVGESGSGKSLTASAVMGLLPGNLGVGAGSIRLDGEDLTAASPARMQALRGDRMAMVFQEPMTSLNPLMRVGRQIAEVLQVHRPDLGAGQVRARVLELMGDVHLPTPEALMDAFPHQLSGGQRQRIMIAMALALEPALIIADEPTTALDVTTQVQVLKLFRQLLAKHSSAVLFITHDFDVVRDIADHVAVMQLGRIVEQGPAGQVLDAPRHDYTRKLLAAVPSGVPKTQQNASSDELLSVSGLNLVYESRGLLGPARRTHAVADVGFTLKKGETLGVVGESGSGKSTLGRCITRAHAPTSGRIVFDGVDIAGLSGKALRAVRRRVQMVFQDPYRSLNPRRRILHALIEGPIESGVDRKTACARAAELMALVGLPADGLQRYPHQFSGGQRQRICIARALAMEPDLIVADEAVSALDVSVQAQVLELFEDLQKRLGFAMIFITHDLRVAAQVCDRIGVMQKGRLLELGPVRQVIHAPQHPYTRHLFDSLPGRVGQTAEPAMELQA

SEQ ID NO: 27310 - DNA, 1761 bp, Bordetella bronchiseptica RB50
  CDS (1)..(1761)
atgaacgaggcgcccgtcatcgaggcgcgggacctggccaagcgccttggccagacgctcgcgctcgatgcgctgacgctgtcggtcgcgcgcggccggctgaccgcgctggtcgggcccgacggagcgggcaagaccaccttgctgcggctgatcgcgggcctgatgcggcccgacgccggcacgctgcgcgtgctgggcatcgatgccgtccaatcgccccaggcggtgcaggaccgcatcagctacatgccgcaacgcttcggcctgtacgaagacctcagcgtgcaggaaaacctcgacctgtacgccgacctgcacggcgtgcccgcgcgcgagcgccgcgaacgctacgcgcgcctgctggccatgaccgacctggcgcgctttaccgagcggccggccggcaagctgtcgggcggcatgaagcagaagctggggctggcctgcaccctggtgcgctcgcccgacctgctgctgctggacgaaccgaccgtgggcgtggatccgctgtcgcgccgcgagctgtggcagatcgtccagcaactggtcgagcaaacgcggctcagcgtgctggtcagcaccgcctacctcgacgaagcgcagcattgcgcgcaagtccacgtgctgtaccgcggcacgctgctcgcgcagggcgcgccgcaggccttgcgcgagccggcccagggcctgtgctttctcgccgcgccgccggcaggcgtgccggcgcgcaccttgcaggcgcgcctgctcgacgacagcgcgcagatcatcgacgccgtgcccgagggcggcgcggtgcgctacatccagcgccccgacgccgacccggcacgcctgcgcgccctgctcggcggcgcgcaggcccacgccacgccggcgcgcctggaagacggcgtgcagatgctgctgcgcgcgcgcctggcggccgacgcgcccgcggccacggccgcgccgcgcccggtcccgccggcgccgcgcgccagcgacgccccggacgcggcccagcccgccatcgaagtccatgacctggtgcgcaagttcggcgcgttcaccgccgtggccagcacctcgttcagcgtgcgccgcggcgagatcttcggcctgctcggccccaacggcgccggcaagaccaccacgttccgcatgctgtgcggcctgctgccggccagcagcggccagctgcgggtggccggcgtgaacctgcgcaacgcgccggcgcgggcgcggcgccacatcggctatgtatcgcagaagttcgccctgtacggcaacctgacggtggccgagaacctcgccttcttcggcggcgtctacgggctgggcggcgcggcgctgcgccggcgcatcgacgccgtgctggacgagttcggcctgcgcggccatgcccaggcgcgcagcggcgagctgcccggcggctaccagcaacgcctggccatggccaccggcctgctgcacgaacccgagatcctgttcctggacgaacccaccagcggcatcgacccgctggcgcggcgcgcgttctggcgccgcatcaccgcgctggccctggacggcaccaccatcatcgtcaccacgcacttcatggaggaggccgaatactgcgaccgcatcgccatccaggacgccggccggctgctggcgctgggcacgcccgacgcggtgcgccgccaggcgggcaatgccggcgacatgaacacggccttcatcggcatcgtcgaacaggcgcgcgcccgccagggccgggagacgcggccatga

SEQ ID NO: 27311 - protein, 586 aa, Bordetella bronchiseptica RB50
MNEAPVIEARDLAKRLGQTLALDALTLSVARGRLTALVGPDGAGKTTLLRLIAGLMRPDAGTLRVLGIDAVQSPQAVQDRISYMPQRFGLYEDLSVQENLDLYADLHGVPARERRERYARLLAMTDLARFTERPAGKLSGGMKQKLGLACTLVRSPDLLLLDEPTVGVDPLSRRELWQIVQQLVEQTRLSVLVSTAYLDEAQHCAQVHVLYRGTLLAQGAPQALREPAQGLCFLAAPPAGVPARTLQARLLDDSAQIIDAVPEGGAVRYIQRPDADPARLRALLGGAQAHATPARLEDGVQMLLRARLAADAPAATAAPRPVPPAPRASDAPDAAQPAIEVHDLVRKFGAFTAVASTSFSVRRGEIFGLLGPNGAGKTTTFRMLCGLLPASSGQLRVAGVNLRNAPARARRHIGYVSQKFALYGNLTVAENLAFFGGVYGLGGAALRRRIDAVLDEFGLRGHAQARSGELPGGYQQRLAMATGLLHEPEILFLDEPTSGIDPLARRAFWRRITALALDGTTIIVTTHFMEEAEYCDRIAIQDAGRLLALGTPDAVRRQAGNAGDMNTAFIGIVEQARARQGRETRP

SEQ ID NO: 27312 - DNA, 1476 bp, Photorhabdus luminescens subsp. laumondii TTO1
  CDS (1)..(1476): transl_table=11
atgtctgaattgcaaataacgcaaggctgtttccgtttaagtgatacccgtaccttgcagttatcatcactaaaaatagcctccggcgaaaattgggcttttattggtgcaaatggtagcggaaaatcatcattggcccgtgcgctttcaaatgaattagtcctgctttccggcgaacgaaattgctcatttcgcaagtgcgcccgcgtctctctagaacaattacaaaaactgacggaagaagagtggcaacgtaataatagtgatatgctcagtgatgatgaagatgataccggccgcactgcggcagaaattatccagctttatcataaagataatgaactttgcctggaactggcaaaacagttcggtattatggatttactttcccgtcgttttaaatatctttctactggtgaaacccacaagacattactttgccaggcactgatgacttcacctgatttgctgattcttgatgaaccttttaatggccttgatctattttcccgtggtcaattcactgaattactggaaaaattgtcatcaaaaggaatcgttttggtacttatccttaaccggttcagtgaaatcccagattttgttgatcagattggcgtactagcagattgccagctaacctctattggcaccaaagaaaaagtgatggcagattccttggtggctcaactggcacacagtgaaaaactgaacggtattcatttacctgaaacagatgaatttcctgtcgataatcagctaccgcccgatcaaccgctgattattctacgtaatggtatcgttcagtataatgatcagccaattttgcatgggctagattggcaagtgaattcaggtgaacattggcaaattattggcccaaatggtgccggaaaatcaacgcttctgagtttgattaccggagatcatcctcaaggctacagtaataagctgatcctgtttggccgtcaacgcggtagcggcgaaaccatttgggatatcaaacgccatattggctatattagcaacagcattcatctggaatatcgtgtcagtatcagcgttcgtaatgtgattctgtccggtttcttcgattcaattggtctttatcagacagtatcagatcgccagcagcaacttgctgatgaatggctggctttactgggcttatctgctcagattgccaacggcccgtttcaccgcctttcatggggacaacaacgacttgttctgatagctcgcgcactggttaaacatccggctttattaatccttgatgaacctctccaagggcttgatccactcaaccgccagttagtattacgttttattgatgtcatgatcgctgacggtgatactcagctactgtttgtttctcatcatcaagaagatgcgccgcaatgcattactcaccgactaatatttatccctgatggtgatctatactgctacaaaacagagaaagtttctgattga

SEQ ID NO: 27313 - protein, 491 aa, Photorhabdus luminescens subsp. laumondii TTO1
MSELQITQGCFRLSDTRTLQLSSLKIASGENWAFIGANGSGKSSLARALSNELVLLSGERNCSFRKCARVSLEQLQKLTEEEWQRNNSDMLSDDEDDTGRTAAEIIQLYHKDNELCLELAKQFGIMDLLSRRFKYLSTGETHKTLLCQALMTSPDLLILDEPFNGLDLFSRGQFTELLEKLSSKGIVLVLILNRFSEIPDFVDQIGVLADCQLTSIGTKEKVMADSLVAQLAHSEKLNGIHLPETDEFPVDNQLPPDQPLIILRNGIVQYNDQPILHGLDWQVNSGEHWQIIGPNGAGKSTLLSLITGDHPQGYSNKLILFGRQRGSGETIWDIKRHIGYISNSIHLEYRVSISVRNVILSGFFDSIGLYQTVSDRQQQLADEWLALLGLSAQIANGPFHRLSWGQQRLVLIARALVKHPALLILDEPLQGLDPLNRQLVLRFIDVMIADGDTQLLFVSHHQEDAPQCITHRLIFIPDGDLYCYKTEKVSD

SEQ ID NO: 27314 - DNA, 1596 bp, Photorhabdus luminescens subsp. laumondii TTO1
  CDS (1)..(1596): transl_table=11
gtgttaagtacaaacaacatcaccatgcagtttggcagtaagcccctgtttgaaaacatttctgtcaagtttggcaacggtaaccgttatggtctgattggcgctaatggttctggtaaatccacttttatgaaaattctgggaggtgatctgacaccctctgtcggcaatgtcagcaccgatcccaatgaacgtattggtaaactgcgtcaggatcagtttgcttttgaagagttcacggtgttggataccgtgattatggggcacacggaactgtggcaggtaaagcaggagcgtgaccgcatctatgccatggcagaaatgagtgaagaggatggctatcgcgttgccgatctggaagtcgcttatggcgagatggatggttatagtgccgaagcgcgtgccggagagttgttgttaggtgttggtattccagtagaacagcattacggtttgatgagcgaagtggcaccaggctggaaattgcgtgtattgctggctcaagcgctgttttctaatcctgatgttctgttattggatgaaccgacgaataacctggatattgatactattcgttggttagagcaaatactgaatgaacgaaacagcaccatgattattatttcccatgatcgtcacttcctgaatacagtttgtactcatatggccgatcttgattacggtgagttgcgtctgttccccggtaattatgatgaatatatggttgccgccactcaggctcgtgaacgtctgctagctgataatgcgaagaagaaagcacagattgcggaattgcagtcttttgtcagccgttttagtgctaatgcttctaaatcaaaacaggcgacttcgcgtgctcgtcagattgataaaatccagttggaagaagttaaagcatccagccgtcagaatccttatatccgttttgagcaagataagaaattgttccgtaatgctctggaattggaaggttttactaaaggctatgataatggccctctgtttaaaaatcttaatctcctgctggaagttggtgaaaaactcgctgttattggtgctaacggtattggtaaaacaactttcttgaaaacgctcgttggtgaaacagagccaaccagtggtgtagttaagtggtctgaaaatagtagcattgggtactatgctcaggatcatgccagtgattttgactgtgatctgacagtttttgactggatgagtcaatggaagagagaaggggatgatgaacaagctgttcgtagtgtattaggccgtttgttgttcagccaggatgacattaagaaaaaagtcaaagtattatcgggtggcgaaaaaggacggatgttatttggtaagttgatgatgcaacagccaaatattctgataatggatgaaccaacaaaccacttggatatggaatctattgaatctttgaaccttgcgcttgaattgtataaaggtactttgatatttgtttctcatgatcgggaatttgttagctcattggcaagccgagtgatggaaattaaatctgataaggtcattgatttcaaaggtacttatgatgaatatctaagaagtcagggaattattgagtaa

SEQ ID NO: 27315 - protein, 531 aa, Photorhabdus luminescens subsp. laumondii TTO1
MLSTNNITMQFGSKPLFENISVKFGNGNRYGLIGANGSGKSTFMKILGGDLTPSVGNVSTDPNERIGKLRQDQFAFEEFTVLDTVIMGHTELWQVKQERDRIYAMAEMSEEDGYRVADLEVAYGEMDGYSAEARAGELLLGVGIPVEQHYGLMSEVAPGWKLRVLLAQALFSNPDVLLLDEPTNNLDIDTIRWLEQILNERNSTMIIISHDRHFLNTVCTHMADLDYGELRLFPGNYDEYMVAATQARERLLADNAKKKAQIAELQSFVSRFSANASKSKQATSRARQIDKIQLEEVKASSRQNPYIRFEQDKKLFRNALELEGFTKGYDNGPLFKNLNLLLEVGEKLAVIGANGIGKTTFLKTLVGETEPTSGVVKWSENSSIGYYAQDHASDFDCDLTVFDWMSQWKREGDDEQAVRSVLGRLLFSQDDIKKKVKVLSGGEKGRMLFGKLMMQQPNILIMDEPTNHLDMESIESLNLALELYKGTLIFVSHDREFVSSLASRVMEIKSDKVIDFKGTYDEYLRSQGIIE

SEQ ID NO: 27316 - DNA, 1536 bp, Photorhabdus luminescens subsp. laumondii TTO1
  CDS (1)..(1536): transl_table=11
atgttacataacaacaccgcagtaccaccgctattagaagtcagtggcatcagtaagcaattttccggcgtaatggtactgaaacatattgattttactctgtttccagggcagatacaggctctgttagggggtaatggtgcgggcaaatcaacactgatgaagattattgctggtctcgaacagccggataaaggcacgctcaagattagcggtcatcatgttagccatcttaatcccactaaagcccaccaattcggtatttatctgataccacaagaaccactgttatttccgaatttgtctgtacaggaaaacatcctgtttcgtttgccaaagcatcaggtagataagtctaaaatgaaacagctactggcattacttggctgtcaattagatctacatgtcagtgctggcagccttaatgttgccgatcaacaactggtcgaaattatgcgtggcctgatgcgtaattcgaaaatcttaatccttgatgaacctaccgcctccctgacaccagtagaaaccgaacgcttatttgcccagctccgtgagctacaacagcaaggtgtcggcatcatttttatttcccacaaaatccctgaaatttaccaactagcagatcaggtcagtgtcatgcgtgacggcactattgccttaagtggcaaaatccgcgattacacaacggatgacattattcaggctattacaccggccgcaaaagatcagccattaaatggcaccccaaaattgggtctggatcttagcaataaccagcaccagacagtacctgatcgaccaatactgacagtcaccaagctgagcggtgagggtttcagcaatatctcattctcagtgaaaccgggtgaaattcttggtttggccggggttgttggtgctggccgtacagaactggctgaaacactttatggcctgcgccctgcggtatccggcgaaattaagttaaaacaacatactgttaatgggctaaaaactgctcaacgtctggcccaaggtttggtttatttgccggaagatcgacagtcatcaggattatttctggattcatcactcggctggaatatctgctcactaacccacaaccgcaatacattctggatacgccctgcctatgatacagcggtacttgaacgctattgccaaatcctaaatatcaaattcagccatatcaaccaaccaatcaaaacgctgtccggtggtaatcaacaaaaaattctgattgctaaatgtctggaagctcaccccgccgtcctgattattgatgaacctacacgtggtgtggatgtcgcggcacgcaatgatatttaccaactgattcgtcatatcgcccaacagcaagtggccattatttttatttcatcggatctggatgaagtggttcgaatcgctgatcgggtattagtcatgcatcagggagaaatcaatggcgagttaactaagcaacagatggatgttgacaccattatgcatatcgctttcggcgaacataaaccacaacaggcggcatcatgttga

SEQ ID NO: 27317 - protein, 511 aa, Photorhabdus luminescens subsp. laumondii TTO1
MLHNNTAVPPLLEVSGISKQFSGVMVLKHIDFTLFPGQIQALLGGNGAGKSTLMKIIAGLEQPDKGTLKISGHHVSHLNPTKAHQFGIYLIPQEPLLFPNLSVQENILFRLPKHQVDKSKMKQLLALLGCQLDLHVSAGSLNVADQQLVEIMRGLMRNSKILILDEPTASLTPVETERLFAQLRELQQQGVGIIFISHKIPEIYQLADQVSVMRDGTIALSGKIRDYTTDDIIQAITPAAKDQPLNGTPKLGLDLSNNQHQTVPDRPILTVTKLSGEGFSNISFSVKPGEILGLAGVVGAGRTELAETLYGLRPAVSGEIKLKQHTVNGLKTAQRLAQGLVYLPEDRQSSGLFLDSSLGWNICSLTHNRNTFWIRPAYDTAVLERYCQILNIKFSHINQPIKTLSGGNQQKILIAKCLEAHPAVLIIDEPTRGVDVAARNDIYQLIRHIAQQQVAIIFISSDLDEVVRIADRVLVMHQGEINGELTKQQMDVDTIMHIAFGEHKPQQAASC

SEQ ID NO: 27318 - DNA, 1683 bp, Corynebacterium diphtheriae NCTC 13129
  CDS (1)..(1683): transl_table=11
atgtctgagaaaaaacaacagccgcttctagagatgcgagacgttcgcatcgcgtttacgtccaccaccggaaccgttgaagcagtccgtggaattgatctaactatttacccaggacaatcggtcgcaatcgttggtgagtctggatcaggtaaatctacaacggcgatgtccatcatcgggttgctgcccggtaccggcaaagttaccgatggtcagatcatttttgatggccaagacatcaccaaatacagcgaaaagcagatgcaggagctgcgtggctcccatattggtctggtgccgcaggacccgatgagcaacctcaaccctgtgtggcgcattggcacgcaggtgaaagaatccctcaaagccaacaatgtggtgccgggctcccaaatggacgagcgtgtaacccagctattggaagaagcagggcttcccgacgctgcccgccgcgctaagcagtaccctcacgaattttctggtggtatgcgccagcgcgccttgatcggtatcggcctggccgcacgtcctaagctcttgattgccgacgagccgacctctgctctcgacgttaccgtgcaaaagcgtatcctcgatcacttggaaaatctcacccacgagctaggcaccgcggtgcttttcattacccacgacctcggactagctgccgagcgtgcagagcacctcgtggtcatgcaccgtggtcgtatcgtggaatcaggcccgtcgcttgatatcttgcgaaaccctcagcacccctacacccgtcgattggtcaaagctgcaccatcattggcatcagcgcgcatccaatctgctcaagaaaagggcgttgaaagctcggagatccttgcaacggaaaagaagaccgatgaggaaatcatccgcgttgaaaacctcaccaagattttcaacgttcgcggccaacgcggagacaaagctgaactcaaagcagttgatgacgtcagcttcagtctgaaaaagggcaccacattggcgctggtgggtgagtcaggatccggaaaatccaccgtggccaacatggtgctcaacctcatcgatcccacgacgggcaaggtctattacaaaggcaccgatctttccacactaggaaagaaggagcttttcgacatgcgccgcaaactccaagtggtgttccagaacccttatggatccctagacccgatgtattcgattttccgctgtatcgaagaacccctcctagtgcacaaggtgggtagccgaaaagagcgggagaagcgtgtagctcagctgctcgacatggttgctatgccacgctctgcgatgcgtcgataccccaacgagctctctggtggtcagcgccagcgcatcgccgtcgcgcgagcactcgcgctgaaccccgaggtgatcgttctcgatgaggcagtctcggcccttgacgttcttgttcagaaccagatcctgcagctgctggcggatctccagcaggagctggatttgagctacttgtttatcacccatgaccttgcggttgtgcgtcaaacagcagatcaagtcgtggtgatgcaaaaaggtcgcgtcgtagaacaaggaaccaccgatgagttgttcctcaacgcacgcgaagattacacccgtgatctgatcaactctgttccaggtcttggcgttgagctcggtacgggagaaaacctgtaa

SEQ ID NO: 27319 - protein, 560 aa, Corynebacterium diphtheriae NCTC 13129
MSEKKQQPLLEMRDVRIAFTSTTGTVEAVRGIDLTIYPGQSVAIVGESGSGKSTTAMSIIGLLPGTGKVTDGQIIFDGQDITKYSEKQMQELRGSHIGLVPQDPMSNLNPVWRIGTQVKESLKANNVVPGSQMDERVTQLLEEAGLPDAARRAKQYPHEFSGGMRQRALIGIGLAARPKLLIADEPTSALDVTVQKRILDHLENLTHELGTAVLFITHDLGLAAERAEHLVVMHRGRIVESGPSLDILRNPQHPYTRRLVKAAPSLASARIQSAQEKGVESSEILATEKKTDEEIIRVENLTKIFNVRGQRGDKAELKAVDDVSFSLKKGTTLALVGESGSGKSTVANMVLNLIDPTTGKVYYKGTDLSTLGKKELFDMRRKLQVVFQNPYGSLDPMYSIFRCIEEPLLVHKVGSRKEREKRVAQLLDMVAMPRSAMRRYPNELSGGQRQRIAVARALALNPEVIVLDEAVSALDVLVQNQILQLLADLQQELDLSYLFITHDLAVVRQTADQVVVMQKGRVVEQGTTDELFLNAREDYTRDLINSVPGLGVELGTGENL

SEQ ID NO: 27320 - DNA, 1443 bp, Corynebacterium diphtheriae NCTC 13129
  CDS (1)..(1443): transl_table=11
atgaccttgctgaacatgtccaacgttcagatcatggacgttgtccaagccctatctctgtctatcgaacgcggcgaacgcgtcggcctgatcggggaatctggctcgggtaaaaccatcaccgcgatgtctatcctgcggttaattccctcaagcggcagcattgtattcgatggtgctgatatccaagggctcagcgaaaaacaaatgtgtgccctgcgtggaaagcgcatctccatggtgttccaagaacccatgacagcgctcgatccgctgatgaaagtgggaacccagatcagtcacgccatcaggattcactcctcagtatctcgtgctcaagcccgcaaaaaggcggacgctttgctgcacagtgttgaacttgatcccgagctgcgatcgcgctacccacacgagctttccggcgggcaacgccaacgcatactcattgccatggcgctcgcccacgatcctgatttgctcatttgcgacgagcccaccacagccttggatgtgacttcccaaaaagcaatcgtggatctcattttgagactcgtcgccgaacgcggcaccggattgctatttattacccacgacctggggcttgtggcacgcacctgtgaacgtgtgctcgtcatgcgcgaggggcgcattattgaatcgggcacggttgaagacgtattgaaaaacccgcgtgaagactacaccgccatgctcgtccaagcatcgacactagctcctgcaccccaggtagcgcttagtgacgacgaagtgctgcacatcgacaatgtgaccaaaaagtatcgcggcaccacagcggtcgaagatgtgactcttacagttcaccgtggcgaacgcctcggaatcgttggtggctccggctccggaaaaaccaccctgctgaaaatgatctcaggacttagctctcctaccagcggacacattaacactgaaggatctatgcgcattgtcttccaagaccccatgcaatccctcgacccccacatgtccatcgccgacatcgtatccgagccactagggcatcgggacctcaaggctgtggaacgtgcgctcgaagaagtggggctcgatgcaggcatgatgaatcgtttgcctcatgagttttccggtggtcagcgtcaacgcatttctattgcgcgtgcgctcgtgtcctcccccgacattttgcttgccgacgaacccgtctcagcactcgatgtttccgtgcgagccaaagtgctagccctcctcgaccgattggtcagcgaacgccacctcaccatgctttttgtctcgcacgacctgcacgtggtgcggtccctttgcaccaccgtcgcggtcatgcgagaaggaaaaatcgtagaatacggccccaccgaggatgtgtttaacaatcctcaacacgagtacacaaaggcactcatcgaggcgatccctagcctttaa

SEQ ID NO: 27321 - protein, 480 aa, Corynebacterium diphtheriae NCTC 13129
MTLLNMSNVQIMDVVQALSLSIERGERVGLIGESGSGKTITAMSILRLIPSSGSIVFDGADIQGLSEKQMCALRGKRISMVFQEPMTALDPLMKVGTQISHAIRIHSSVSRAQARKKADALLHSVELDPELRSRYPHELSGGQRQRILIAMALAHDPDLLICDEPTTALDVTSQKAIVDLILRLVAERGTGLLFITHDLGLVARTCERVLVMREGRIIESGTVEDVLKNPREDYTAMLVQASTLAPAPQVALSDDEVLHIDNVTKKYRGTTAVEDVTLTVHRGERLGIVGGSGSGKTTLLKMISGLSSPTSGHINTEGSMRIVFQDPMQSLDPHMSIADIVSEPLGHRDLKAVERALEEVGLDAGMMNRLPHEFSGGQRQRISIARALVSSPDILLADEPVSALDVSVRAKVLALLDRLVSERHLTMLFVSHDLHVVRSLCTTVAVMREGKIVEYGPTEDVFNNPQHEYTKALIEAIPSL

SEQ ID NO: 27322 - DNA, 2715 bp, Rhodopseudomonas palustris CGA009
  CDS (1)..(2715): transl_table=11
atgaccggcttcgccgcgcgtctcacgcatgtcactcacacctatggtgcgacacatgcgctggacgacgtcacgctggaattgcctgccggcaagatggtcggtctgatcgggcccgacggcgtcggcaaatcgacgctgctggccttgatcgccggcgtgcgccggatccagagcggcgaggtgctggcgctggacggcgatatgcgtgacgcccgccatcgagcccagagtgcggcgcggatcgcctatatgccgcagggcctcggacgtaatttgtatccgacgctgtcggtgttcgagaatctggatttcttcggccggctgtttggccagggcgctgccgagcgcaacgcgcgcattgccgacctgctccgcgccaccgggctgtcgccattcggtgatcggccggcgggcaaattgtccggcggcatgaagcagaagttgtcgctgtgctgcgcgctgatccacgatccagatctgctcatcctcgatgagccgacgaccggcgtcgacccgctgtcgcgacggcagttctgggagctgatcgatcgcatccgcaaacggcggccgcagatgagcgtcctggttgccaccgcctatatggaagaggccgaacggttcgattggctcgctgctctgaatgacggcaaggtcatcggcgccggtacgcccgccgagctgcgggcgcagaccaagcaaccgacactggacgccgccttcatcgcgctgctgccggccgagatgcgcgccaactacgccgacgtggtactgccgccgctgccgaacagcggcgatggctacgcgatcgaagccgagaacctgacctgtcggttcggcgatttcaccgcggtcgaccacgtcaacttccagatcaagcgcggcgagatcttcggcttcctcggctccaacggttgcggcaagtcgacgacgatgaagatgctcaccggcctgctgacgccgaccgaaggcgaggcgcggctgttcggcgaggtgctcgacgcctccgacatggcgacccgcaagcgcgtcggctacatgtcgcagagcttctctctctactcggaactgacggtccggcagaacctgttgctacacgcgcaactgttcgaacttccgagcgcgcagattcctgatcgcgttgccgaaatgctgacgcggttcgaccttgccgacgccgccgattcccggcccgacagcctgccgctcggtatgcgccagcggctgcagctcgcggttgcggtgatccatcgccccgaggtgctgattctcgacgagccgacttccggcgtagatccggtggctcgggattcgttctggcggatgctgattgcgctgtcgcgggaggatggcgtcaccatcttcatctcgacccacttcatgaacgaggccgagcgctgcgatcggatttcactgatgcacgccggcaaggtgctggcggtcggtgcgccgcatgaactggtcgagcgccgcggcgctgccgatctcgaacagacctttatcgcttacctcgaagaagcgaccggcgcgcagcgcgacggcgaagagaccagcttcgcagcaccgcgcgaggccgacaccaggcagcgctggttcgatccggcgcggctctgggcctatgcccgccgcgagaccatggagatcctccgcgaccggttgcgacttgctttcgcgatccttggcccgctggtgctgatgctgaccttcggcttcggcatctcgttcgacgtcgagaacctgacctacgcggtgtacgaccaggacaacacgctggaaagcagagaactgctcgagagcttctccgggtcgcgctacttccagcaggcaccggatatcaaatccgcggcggagatcgatcgccgacttgccagcggtgaattgaagctggtgatcgaagtcccccacggtttcggacgcgacctgttgaccaacaagtcgccggaagtggcggtgtggatcgacggtgcgatgccgttccgcgccgagaccattcgatcctacgtcaccggcttgtcgcaggcctatctggccgagcagtatcggcggcatgcaatggcctcgccgaccgcgccgatcaacatcgaaacccggttccgctacaaccaggcattcaagagcgtgtactcgatcattcccggcgtgattacgctgatcctgatgctgatcccggcgatgctcaccgccgtcggcgtggtccgcgagaaggaagtcggctcgatcacgaacttccgttcgacacctgtgaccgcgacggaattcctgctcggcaagcagatcccttacgcgctgctgtcgttcttcagcttcctgctgttgctgctcggggcaatcgtgatcttcggtgttccggtgcgaggctcggtcattgcactggtcggcggcgcgctgctctatgtgttctccactacggcgctgggtgtgctgttctcatcgttcctgagcacccagatcgctgcgatcttcatcgtcgcgatcatctcgatcattccggccgtcaacttctcgggtctgttggtgccagtgtcgtcgttgtcgcaggtcgggcggctgttcggcgaggcgttccctgccgcctggtttcaagaggttagcatcggcgccttcaccaaaggcatgggtttctggatgctggcgccgaacctgctgatcctgttcggttttggcctcgtctatctgattggtgcgatccttgcgttgcgcaagcaggaggcatga

SEQ ID NO: 27323 - protein, 904 aa, Rhodopseudomonas palustris CGA009
MTGFAARLTHVTHTYGATHALDDVTLELPAGKMVGLIGPDGVGKSTLLALIAGVRRIQSGEVLALDGDMRDARHRAQSAARIAYMPQGLGRNLYPTLSVFENLDFFGRLFGQGAAERNARIADLLRATGLSPFGDRPAGKLSGGMKQKLSLCCALIHDPDLLILDEPTTGVDPLSRRQFWELIDRIRKRRPQMSVLVATAYMEEAERFDWLAALNDGKVIGAGTPAELRAQTKQPTLDAAFIALLPAEMRANYADVVLPPLPNSGDGYAIEAENLTCRFGDFTAVDHVNFQIKRGEIFGFLGSNGCGKSTTMKMLTGLLTPTEGEARLFGEVLDASDMATRKRVGYMSQSFSLYSELTVRQNLLLHAQLFELPSAQIPDRVAEMLTRFDLADAADSRPDSLPLGMRQRLQLAVAVIHRPEVLILDEPTSGVDPVARDSFWRMLIALSREDGVTIFISTHFMNEAERCDRISLMHAGKVLAVGAPHELVERRGAADLEQTFIAYLEEATGAQRDGEETSFAAPREADTRQRWFDPARLWAYARRETMEILRDRLRLAFAILGPLVLMLTFGFGISFDVENLTYAVYDQDNTLESRELLESFSGSRYFQQAPDIKSAAEIDRRLASGELKLVIEVPHGFGRDLLTNKSPEVAVWIDGAMPFRAETIRSYVTGLSQAYLAEQYRRHAMASPTAPINIETRFRYNQAFKSVYSIIPGVITLILMLIPAMLTAVGVVREKEVGSITNFRSTPVTATEFLLGKQIPYALLSFFSFLLLLLGAIVIFGVPVRGSVIALVGGALLYVFSTTALGVLFSSFLSTQIAAIFIVAIISIIPAVNFSGLLVPVSSLSQVGRLFGEAFPAAWFQEVSIGAFTKGMGFWMLAPNLLILFGFGLVYLIGAILALRKQEA

SEQ ID NO: 27324 - DNA, 2796 bp, Rhodopseudomonas palustris CGA009
  CDS (1)..(2796): transl_table=11
atgaccgttcaaacgtccgccgccgggctggtcggatcgactcaacccgtcgtacgtcttgccgcggtcgatcttgcctatggcggcaaccacgcgcttcagggcatcacgctcgacgtgcccgccggttgcatggtcggcttgattggccccgatggcgtgggaaagtccagcctgttgtcgctgatcgcgggcgcgcgcgccatccagactggaaccgtggcggtgctcggcggcgatatggccgataccgcccatcgtcgctcggtttgtccgcggatcgcctacatgccgcaggggctcggcaagaacctctatccgacgctgtcggtattcgacaatgtcgatttcttcggacggttgttcggccagggcaaggaggagcgggagcgtcgaattcgtgaactcctgcaaagcaccggtctggccgcatttgctgacaggccagcgggcaagctttcgggcggcatgaaacagaagttgggtctctgctgcgcgttgatccacgatccggatctgctgatcctggacgaacccaccaccggcgttgacccgctatcgcgccgccagttctgggaactcatcgacagcattcgcgccgaacgcgccggcatgagcgtcatcgttgcgacggcctacatggaagaggccgcacgcttcgattggctggcggcgatggacgccggccgggttctcgccaccggcggcccggccaatctgctgacgcagaccggtgccgtcacgctcgatgccgccttcatcgcgctacttccggagcagcaacgccgcggctataccgaggtggtgatcccgccgcgtccggtgggcgtcgacgacgacattgccattgaagccgaacacctcaccatgcggttcgacgatttcaccgctgtcgatgacgtgagtttccggatcggccgcggcgaaatcttcggctttctcggttcgaacggttgcggcaagaccacgaccatgaagatgctgacaggactgctgccagccagcgaaggcaaagccaagctgtttgggcgcgaggtcgatccccaagacatggaggtccgccgccgcgtcggctacatgtcgcaggcgttctcgctgtattccgaactcacggtacggcagaatctcgagctgcacgcgcggctgttccggatgacgcccgcggctattccggggcggatcgacgagatgttgcaaggtttcgacctggccgaggtgatcgatcaactgcccgacgcgctgccgctcggcattcggcagcggctgtcgctggcggtggcgatgatccactcgcccgacatcctgattctcgacgagccgacctccggcgtcgatccggtcgcacgtgacggcttttggcggatcctgtccgacctctcgcgcaaggacaacgtcaccatctttgtctcgacccatttcatgaacgaggccgagcgctgcgaccgcatctcactgatgcacgccggcagggtgctggtcagcgacacgccgcgggcgatcgtcgcggggcgcaacgcgtcgaatctcgaagaggcgttcatcaactatctcgaggacgcgatcggtgcgacgcccggcgaagcgccagcaacggccgcgccgaagccttccgctgacgccgttgagcccggcggcgacggcgccgttgcgcgaaaggcctcccgacgctggttcgatctgcgacggatgttcgcctacacgaggcgcgaggcgctggaattgcgccgcgatccgatccgcgccacgctggcactgatcggcagcgtggtgctgatgttcgtgcttggttatggcatcaacctcgacgtcgaacacctgtcgttcgcggcactcgatcgcgacgacacggcaatcagccgcgactacatcctgcagatctccggctcgcgctacttctccgaacaggctccgatcgtcgattatgccgacctagaccgccgcatgcgcagcggcaaattgaccctggcaatcgagattccgcccgggttcggtcgtgatgtggcgcgcggccgtaatgtcgagatcggcgcctggatcgacggcgcgctgccggcgcgggcggagaccacgcagggctatgtgcaggccatgcatctgagttggctgacccaaaaggcccgcgaactctatggcgccgccgccgttgccggcagtttcgagatcgcgctgcgctaccgttacaatcccggcatcaagagtctggtcgcgatggcgccagcggtgatcccgctcttgctgatgatgatcccggcgatgctggcggtgctgagcgtggttcgcgagaaagagctcggctcgatcatcaatttctacaccacaccgacaacgcgcctggaattcctaatcggcaagcagttgccttacgtcgcattggcgatgttgaactgcctgctgctcacggcgtttgccatcctggtgtttcaggtgccgttcaccggaagcttcctcgccttcgcttgcggcgcgctgctttatgtcgtgatcgcgacggggatcgggctgcttctctcgaccttcatgagcagccagatcgccgcgattttcggcaccgcgctgatcacgctgattccggccatccaattctccggactgatcgacccggtgtcttcgctgcagggattcggcgccgtcgttggcaggatctatccgaccacctatttcgtcaacatcacccgcggtaccttctcgaaggggctggactttgtcgatctgtggggctcgttcctgccgctgctgatcgcggtgccgtcgctgctcggcctcggtgcgctgttgctcaagaagcaggcgcgctga

SEQ ID NO: 27325 - protein, 931 aa, Rhodopseudomonas palustris CGA009
MTVQTSAAGLVGSTQPVVRLAAVDLAYGGNHALQGITLDVPAGCMVGLIGPDGVGKSSLLSLIAGARAIQTGTVAVLGGDMADTAHRRSVCPRIAYMPQGLGKNLYPTLSVFDNVDFFGRLFGQGKEERERRIRELLQSTGLAAFADRPAGKLSGGMKQKLGLCCALIHDPDLLILDEPTTGVDPLSRRQFWELIDSIRAERAGMSVIVATAYMEEAARFDWLAAMDAGRVLATGGPANLLTQTGAVTLDAAFIALLPEQQRRGYTEVVIPPRPVGVDDDIAIEAEHLTMRFDDFTAVDDVSFRIGRGEIFGFLGSNGCGKTTTMKMLTGLLPASEGKAKLFGREVDPQDMEVRRRVGYMSQAFSLYSELTVRQNLELHARLFRMTPAAIPGRIDEMLQGFDLAEVIDQLPDALPLGIRQRLSLAVAMIHSPDILILDEPTSGVDPVARDGFWRILSDLSRKDNVTIFVSTHFMNEAERCDRISLMHAGRVLVSDTPRAIVAGRNASNLEEAFINYLEDAIGATPGEAPATAAPKPSADAVEPGGDGAVARKASRRWFDLRRMFAYTRREALELRRDPIRATLALIGSVVLMFVLGYGINLDVEHLSFAALDRDDTAISRDYILQISGSRYFSEQAPIVDYADLDRRMRSGKLTLAIEIPPGFGRDVARGRNVEIGAWIDGALPARAETTQGYVQAMHLSWLTQKARELYGAAAVAGSFEIALRYRYNPGIKSLVAMAPAVIPLLLMMIPAMLAVLSVVREKELGSIINFYTTPTTRLEFLIGKQLPYVALAMLNCLLLTAFAILVFQVPFTGSFLAFACGALLYVVIATGIGLLLSTFMSSQIAAIFGTALITLIPAIQFSGLIDPVSSLQGFGAVVGRIYPTTYFVNITRGTFSKGLDFVDLWGSFLPLLIAVPSLLGLGALLLKKQAR

SEQ ID NO: 27326 - DNA, 2793 bp, Geobacter sulfurreducens PCA
  CDS (1)..(2793): transl_table=11
atgaacgcgcgggaaccggcagccgccgagcagccccccgtggtccggctgaagggggtcggtctccgttacggcaagaccccggcgcttgagaatatctcccttgatctccccgccggctgcatggtcggattcatcggccccgacggggtgggtaaatcgagcctcttctcgctcatcgccggttcccgggcggtccagtccggtgccgtggaggtgctcggggggagcatggccgaccgtggccaccggcgcacagtctgcccccgggtggccttcatgccccaggggctcggcaggaatctctatcccaccctgtcggtcttcgagaatgccgatttcttcgcccgccttttcggccacggccgccgggagcgggagcgccgcatccttgagctgttgcgggcaacgggccttgagcctttttccgatcggccggcgggcaaactgtccggcggcatgaagcagaagctgggtctgtgctgcgccctgattcacgaccctgatcttctggtcctggacgagcccaccaccggcgtcgaccccctgtcgcgccgccaattctgggagctcatcgaccgcatccgcgccaaacggccagggatgagcgtgctggtggccaccgcctacatggaagaagcggcacgtttcgactggctggtggccatgaacggggggcgagtcctggccacgggctctccggccgaacttctggcccaaaccggcactgccgccctggaagaggcgttcatcgcccttcttcccccatcccagcgggaaggtcatcggccggtagaggtttttccccgggaaaccgacgtttccgccgaggcagccatcgaggcccatggccttaccatgcgctttggcgagttcacggccgtcgaccacgtgagcttccgcatcgggcggggggagatcttcggcttcctgggctccaacggctgcggcaaaacgaccaccatgaagatgctgaccggcctcctgccggccagcgaaggggaggcgtggctcttcggccgtcccgtggactcccaggacatcgatacccgccgccgggtcggctacatgacccagtctttctccctttacggcgaactgacggtgcggcagaacctggtgctccacgcccgtctcttcaggctgccggaaaaggggatcccggcccgggtgaaggagatggcggagcgattcggtttggtggaggtgatggagagcctccccgatgccctgcccctggggcagcgccagcggctttccctggcggtggccatgatccacggcccggagatgctgattctggacgagcccacctcgggggtcgatccggtggcccgcgatgcgttctggcatatcatgctcgacctggcgcgccgggacggggtcaccatcttcatctcaacccacttcatgaacgaggccgagcgttgcgaccgcatctcgttgatgcacgcggggcgggtgctggtgagcgacaccccggctgccctgatcgaaagacggggggcagcgagcctggaagaggccttcatcggctaccttgaggaggcggccacggactccgatgccatggcgccgcctctgcaagagcacgccctttcccctcaaccgcgcgctccctctgacctcggtccggccagggagggaggacccgaagggggcggcttcttcagcctgcgccgcctgttcagctacacccggcgcgaggcattggaactgcgccgggatccgatccgcctgaccctggcgctcctggggagcgttatcctcatgctcgtcataggatatggcatcaacctggacgtggagaatctttccttcgcggtcctcgaccgggaccagaccaccctcagccgcgattacgcccttaacctcgccggttcacgctacttcaacgaacgtcctcccatcatcgactatggcgacctggaccggcgcatgcgggccggcgagatcagcctggccatcgagatcccccccggcttcggccgagacctgcgcaggggggctccggtgacggtgggggcctggatcgacggcgccatgcccacccgtgccgagacggtgcgcggctacgtgcaggggatgcatgcgcagtggctgtcggtcctggcccgggagcatgccacggctctctccggggccggggctgccaccattgaaacgcgcttccgctacaaccccgacgtgaaaagcctgccggccatggtgccggcggtcattccgctgctgctcatgatgattccggccatgctgaccgctctgtccgtggtgcgggaaaaggagctgggctccatcgtcaatctctacgtcactccggtcacccggctggaattcctcctcggcaagcagggtccatacgtggcactggccatgctcaactttctcctcctcaccgccctggccgtcttcgtgttccaggttcccctgaaggggagcttcccaacccttgccacggccgcgttcctctacgtaaccgctgccaccgcgctgggactggtgatctccaccttcatgcggagccagatagcggccctcttcggaacggcgctcctgaccctcctgcctgcggtccagttttccggcatgatcgacccggtttcctccctcgaaggggcaggggccatgatcggcagggcgtaccccaccacccatttcctgaccatcgcccggggcaccttttcaaaagggctcgatttccatgacctctactcctcattcctttccctggcactggctgtccccatcctgaccggcctcgggggagcattgctcaggaaacaggagcactga

SEQ ID NO: 27327 - protein, 930 aa, Geobacter sulfurreducens PCA
MNAREPAAAEQPPVVRLKGVGLRYGKTPALENISLDLPAGCMVGFIGPDGVGKSSLFSLIAGSRAVQSGAVEVLGGSMADRGHRRTVCPRVAFMPQGLGRNLYPTLSVFENADFFARLFGHGRRERERRILELLRATGLEPFSDRPAGKLSGGMKQKLGLCCALIHDPDLLVLDEPTTGVDPLSRRQFWELIDRIRAKRPGMSVLVATAYMEEAARFDWLVAMNGGRVLATGSPAELLAQTGTAALEEAFIALLPPSQREGHRPVEVFPRETDVSAEAAIEAHGLTMRFGEFTAVDHVSFRIGRGEIFGFLGSNGCGKTTTMKMLTGLLPASEGEAWLFGRPVDSQDIDTRRRVGYMTQSFSLYGELTVRQNLVLHARLFRLPEKGIPARVKEMAERFGLVEVMESLPDALPLGQRQRLSLAVAMIHGPEMLILDEPTSGVDPVARDAFWHIMLDLARRDGVTIFISTHFMNEAERCDRISLMHAGRVLVSDTPAALIERRGAASLEEAFIGYLEEAATDSDAMAPPLQEHALSPQPRAPSDLGPAREGGPEGGGFFSLRRLFSYTRREALELRRDPIRLTLALLGSVILMLVIGYGINLDVENLSFAVLDRDQTTLSRDYALNLAGSRYFNERPPIIDYGDLDRRMRAGEISLAIEIPPGFGRDLRRGAPVTVGAWIDGAMPTRAETVRGYVQGMHAQWLSVLAREHATALSGAGAATIETRFRYNPDVKSLPAMVPAVIPLLLMMIPAMLTALSVVREKELGSIVNLYVTPVTRLEFLLGKQGPYVALAMLNFLLLTALAVFVFQVPLKGSFPTLATAAFLYVTAATALGLVISTFMRSQIAALFGTALLTLLPAVQFSGMIDPVSSLEGAGAMIGRAYPTTHFLTIARGTFSKGLDFHDLYSSFLSLALAVPILTGLGGALLRKQEH

SEQ ID NO: 27328 - DNA, 1347 bp, Lactobacillus johnsonii NCC 533
  CDS (1)..(1347): transl_table=11
atgtcatccaaacaaatcaaaattaaccaactctcttttcaataccaagacaaattaatttttaagaatttagattttactattaaccaaggcgactttatcttattaacgggtccaagtggcagcggaaaatctacccttttaaaattagttgctggtcttgaacctacttctaacagcaaaattactactggctctttaaatcagccatttactaattggggtatggtctttcaagaccctaatcgtcaattcaccatggcaacaccaagagaagagttaatttttgctttagaaaatagactaattgatcgagttactgctcaaaagattatcgatgaggttagccataaaacgaatatttcgcatttgttagaccgtcccttccttcatctctcaggcggtgaaaagcagcatgtagccttagccgtcttaattgcaatgcaaagtgacctcttcttattagatgagccatttgctaattgcgactctcataatcgaaattttctgcttaactgcttagattcactccatcaagaaggtaaaacgattttgattagtgatcataactttgctaattatgaaaaaatcgatcccaaaatttttgctatcaaaaatcaaagaattcaaactactcctctaccttctcaagaagaagtagtaaccaatttttctcttcctcatccaaagcaagaatcagtatattcttttaattctttttcactatcatttccagaaaaagagttactttcttcaactaatttaaaaatctattctgggaaagcaaccctcttaactggagagaatggtagtggtaaaacttctttatttaaggccttaagcaaggttattacttatcagggagaactactctttaaagataaagaggttaaaaaatggcgtcgccgcccttatttgtcaaaagtaggacaaatttttcaaaatccagacgaccaattcttaaatgttacggtaaaagaagaattagattttagcttaaaatacaatcaaaatccttctttaaatgagtctaaacttcagtctatcctaactaaacttaatttagaaaatatggatgatcaagtcgtttattctctctctggtggtcaaaaaaggaagcttcaaattctcgtcatgttaatggcctatccggacgttttattactagatgaaccatttagtggtttagatcaaaaaagcgtctcagaagtcatttttttactaaagaactacttcttagatgaaaaccatagcttaatcgtaattagtcaccagctcgatcagattcaaaatctatgtgactatcatcttgttttaaaagaccaacaacttttctacgctaaatag

SEQ ID NO: 27329 - protein, 448 aa, Lactobacillus johnsonii NCC 533
MSSKQIKINQLSFQYQDKLIFKNLDFTINQGDFILLTGPSGSGKSTLLKLVAGLEPTSNSKITTGSLNQPFTNWGMVFQDPNRQFTMATPREELIFALENRLIDRVTAQKIIDEVSHKTNISHLLDRPFLHLSGGEKQHVALAVLIAMQSDLFLLDEPFANCDSHNRNFLLNCLDSLHQEGKTILISDHNFANYEKIDPKIFAIKNQRIQTTPLPSQEEVVTNFSLPHPKQESVYSFNSFSLSFPEKELLSSTNLKIYSGKATLLTGENGSGKTSLFKALSKVITYQGELLFKDKEVKKWRRRPYLSKVGQIFQNPDDQFLNVTVKEELDFSLKYNQNPSLNESKLQSILTKLNLENMDDQVVYSLSGGQKRKLQILVMLMAYPDVLLLDEPFSGLDQKSVSEVIFLLKNYFLDENHSLIVISHQLDQIQNLCDYHLVLKDQQLFYAK

SEQ ID NO: 27330 - DNA, 1425 bp, Treponema denticola ATCC 35405
  CDS (1)..(1425): transl_table=11
atgatacggatggaaaatgtaagttttcattatgaaaacagtgaaagaggtgtatcaaacataaaccttacaattaacgaaggcgaatgtacggttctaaccgggccgtcgggcggcggaaaaacgacaatattgcgccttttaaacggattagcaccgggttattacagtggagcgctttcaggaaatatctctatcggcggaaaagatatgtcttctaccccattatgggagaggggcaaatttataggcagcgtatttcaggagccgcagagccagtttttttcttccgagcttgcaggtgagattgctttttcatgcgaaaattacggactggcacaacacgagatcatcgcccgcacggagggggcaatcgaagcatttcatcttgcaacattacgagaccatacgcttgacacattttcaagcggagaaaaacagcgcgctgcaatcgcttcggtctatgccctctcgccttcaatatacgtatgtgatgagccgactgctaatctcgatgaagaaagcgccgtaaggctttctcatgttttaaagaagctcaaagaagaagggcgtactctgattattgcagaacataggttaagctggctgtatggaattgccgaccgttttatctatatagatggagggacaatacagtggtcgcatacggctgaagaaatgcagaaaatgacgcttgagcaaaaaaagctttttggattgaggtcatttacgcctgctttaaaaccggatcttccccctccttcatcaagagccttatcttccggtacggcaaacgaacccttactgcaagcagacgggatataccgcaaagaaaaggggaaccttattttgcaaacagtatcttttcccgtatcgcgcggacagattattgcgcttaccggtaaaaacggagttggaaaaacaacgctcggccttattttgagcgggcttaataaagagtcgggcggcacggtattccttaacggaaaaaaatgcgggctttgggcgcgccgcaaagcggtatggtacagcgccaacgatactggaacgcaattctttaccgaaagcgtttccgaagaaattttattgagtatgatgaacacccctgataagcttgaacgggcgcggaatatcttacagaccatggggctctatgacctcaaagatgttcaccctgcaacgctttccggaggacaaaaacagagactttccgttgcctgcgccctgctgtccggccgcgatatcctcattttcgatgagccgaccagcggtttggacggctatcatgcggacatccttgcaaaagcttttttggacgcggcagctcgcggtaaaacgattatcgttattacgcacgactttgaacttatcgctgcatgctgcagctttgaaatcatgcttgaggaagaagctcaaacgaaataa

SEQ ID NO: 27331 - protein, 474 aa, Treponema denticola ATCC 35405
MIRMENVSFHYENSERGVSNINLTINEGECTVLTGPSGGGKTTILRLLNGLAPGYYSGALSGNISIGGKDMSSTPLWERGKFIGSVFQEPQSQFFSSELAGEIAFSCENYGLAQHEIIARTEGAIEAFHLATLRDHTLDTFSSGEKQRAAIASVYALSPSIYVCDEPTANLDEESAVRLSHVLKKLKEEGRTLIIAEHRLSWLYGIADRFIYIDGGTIQWSHTAEEMQKMTLEQKKLFGLRSFTPALKPDLPPPSSRALSSGTANEPLLQADGIYRKEKGNLILQTVSFPVSRGQIIALTGKNGVGKTTLGLILSGLNKESGGTVFLNGKKCGLWARRKAVWYSANDTGTQFFTESVSEEILLSMMNTPDKLERARNILQTMGLYDLKDVHPATLSGGQKQRLSVACALLSGRDILIFDEPTSGLDGYHADILAKAFLDAAARGKTIIVITHDFELIAACCSFEIMLEEEAQTK

SEQ ID NO: 27332 - DNA, 1509 bp, Treponema denticola ATCC 35405
  CDS (1)..(1509): transl_table=11
atggcagatagtattgttgattttgatgatgtaagttttagctatggaacacaaacagagggttctttaaagcatatcaatcttaaaatagaagaaggagaatgtattgtcctcacaggacaatccggctgcggaaaaacaactattatgaggttgataaacggtttaatacctcatttttttgaaggcagtttgacaggatgtgtgaaaattcttggtaaagacacaaaaactacttctgtaggagagctcggcagaaacattgcttccatatttcaaaatccgaggagtcaattttttacaacaaacaccacggcagaagcggcatttgcttgtgaaaattacggaatagagagagccgaaatgataaagggcgttgacaatgcgttttatgattttgacgctaaatgccttatgaatagagatatgttctctttgtcaagcggagaaaaacaaaagattgctattattgctgcaaaaactttaaatcctaacatatatgtttttgatgagccatctgccaacttggatattcatgcaattatgcagttacaagaaatgatacggaagctgaaagaagcaggacatacggttattgtttcggaacatcgcttattttatttaaaaaacttatgtgatagatgttttatcatgagtaacggaaatatcgttaaagaattatgtaaaagtgatattgaaaatatgaatacagccgatttgacaaactataaactgagaacatttaatatagaagaaatcgggttgaatagggaaaataaaacagaatatgagagaagcgacaacataaaacttgaaattaaaaaattatctttttcatataaccattctaagaagcttttagacaatatcaatataacggcttatgcaggggagaccattgcaattatcggacaaaacggtgaaggtaaaactactttagggaaaattattgcaggcttattaaaatccgctcatggccgatttttccttgacggcaaacaggtaaaacaaaaagaattatataaaagtgtttattttgtcatgcaggaatctgattatcaattatattcagattctgttttatccgagctatatgtaagttccggattatccagcaaaaggaatacgcaaaaaatcgaatgtataatgaaattattacatatctttgcatataaagaaaagcatccatgggcactatcagggggtcagaagcagcgggtaactattgcggcagcgatggcttcaaataaatctattcttatttttgatgagccgacttccgggcttgattacgaaaatatgaaagcagtttcaaaagcaataaacattctgagccgacaaggaaccgtaaactttgttatttcccatgatttggaatttcttagccgagttgcaacaagagccgtttttatagcaaacggtacaatcggcggaagtatcagtttaaaaaacaatcgagactttagaaccgtaaaagattttttgttacggaatggggttgcaaagtaa

SEQ ID NO: 27333 - protein, 502 aa, Treponema denticola ATCC 35405
MADSIVDFDDVSFSYGTQTEGSLKHINLKIEEGECIVLTGQSGCGKTTIMRLINGLIPHFFEGSLTGCVKILGKDTKTTSVGELGRNIASIFQNPRSQFFTTNTTAEAAFACENYGIERAEMIKGVDNAFYDFDAKCLMNRDMFSLSSGEKQKIAIIAAKTLNPNIYVFDEPSANLDIHAIMQLQEMIRKLKEAGHTVIVSEHRLFYLKNLCDRCFIMSNGNIVKELCKSDIENMNTADLTNYKLRTFNIEEIGLNRENKTEYERSDNIKLEIKKLSFSYNHSKKLLDNINITAYAGETIAIIGQNGEGKTTLGKIIAGLLKSAHGRFFLDGKQVKQKELYKSVYFVMQESDYQLYSDSVLSELYVSSGLSSKRNTQKIECIMKLLHIFAYKEKHPWALSGGQKQRVTIAAAMASNKSILIFDEPTSGLDYENMKAVSKAINILSRQGTVNFVISHDLEFLSRVATRAVFIANGTIGGSISLKNNRDFRTVKDFLLRNGVAK

SEQ ID NO: 27334 - DNA, 1446 bp, Treponema denticola ATCC 35405
  CDS (1)..(1446): transl_table=11
atgggcatagtagaagcaagaataaaaaacttcacctatgaaaatgatgaaagtcccacgctccatgccattgatttgagcattgaagaaggcgagctcgttgtgcttacgggtttttccggctgcgggaagactaccttaacgcggatattaaacggcttaattccctatcattacggcggaatactcgacggtgaggtgcgcattttagggaagaacatcttggattataaaaagggcgaattggcaaagtacatcggcaatgtgtttcaaaatccgagtgatcagttttttgctaccattgcagaggaagaggttgcctttgccggagaaaatctcggtatggattctcaaaccctgtgcgaaaaaaccgatgctgcttttcaaacgatgcagatagaatcgcttaaaggtgcaaaactttcagagctttccggcgggcaaaaacaaaaggtcgccatcgcttccacactcatctatgacacaaagctgctttttttcgatgagccttcttccaatctcgactatgagggtattgtgcaatttcaagcgatgatacgggatttaaaggcgatgggaaaaacgattatcattgccgagcaccgtttatttttcttaaatgaattgtacgataagctcatctacatgaaagacggcactatcgaaaaaatctttttgaaaggtgaactgacaacagaggattgcaggcggtacggactgagggcaatacggtatgacagtcttgtctgcgaaaacccttcggtaccgaaacaagcggttacgcatatcgagggtttgagcgtttctatcggcagacgagaacttatcaaaaatctttcgtttgatgtacacgcaggagagattaccgccgttatcggaaaaaacggtataggaaagaccacactcggcaaagctttaggcgggcttttgtcttgcaaggggcagatcggttacgggaagcggcggcggcagcgcttaagaaatgcgtattatatgatgcaggatgttgactatcagattttttttgatacggtagaaaacgagcttattccttcttcaaaacggaaggatgaatcctatttgcaacaagcggctgagtacctgcgcacaattgacctttgggaaaaaaggcttgaccatccgcaggaactttcaggcggacaaaagcagcggctcgcccttgcaacggcatttttgagcggcaggcgcatcatcatcttagacgagccgaccagcggcctcgactacaaacgcatggacgaaatcgcaaagctcatcttacactgcgctcaagaagtttccgtcctcatcatcacccacgacttggaactcttattcaaagtctgcaacaccgccctcctgctcggtgaaaacgcatacaagaaaattccggtaaacggaaatgaaggtgaaattattgggtttatggggaaactttcaatataa

SEQ ID NO: 27335 - protein, 481 aa, Treponema denticola ATCC 35405
MGIVEARIKNFTYENDESPTLHAIDLSIEEGELVVLTGFSGCGKTTLTRILNGLIPYHYGGILDGEVRILGKNILDYKKGELAKYIGNVFQNPSDQFFATIAEEEVAFAGENLGMDSQTLCEKTDAAFQTMQIESLKGAKLSELSGGQKQKVAIASTLIYDTKLLFFDEPSSNLDYEGIVQFQAMIRDLKAMGKTIIIAEHRLFFLNELYDKLIYMKDGTIEKIFLKGELTTEDCRRYGLRAIRYDSLVCENPSVPKQAVTHIEGLSVSIGRRELIKNLSFDVHAGEITAVIGKNGIGKTTLGKALGGLLSCKGQIGYGKRRRQRLRNAYYMMQDVDYQIFFDTVENELIPSSKRKDESYLQQAAEYLRTIDLWEKRLDHPQELSGGQKQRLALATAFLSGRRIIILDEPTSGLDYKRMDEIAKLILHCAQEVSVLIITHDLELLFKVCNTALLLGENAYKKIPVNGNEGEIIGFMGKLSI

SEQ ID NO: 27336 - DNA, 1509 bp, Treponema denticola ATCC 35405
  CDS (1)..(1509): transl_table=11
atgaatacggcagtagaattaaaagatgtttcttttatatatgaatcctcaaaagacggaagagcaaatttaaaaaagacttctcttaatatcaaaaaaggagaattcttacttgttacgggcataagcggctgcggaaaatctacgctgacaaaatgcatcaatggccttattcctcggttttacgaaggagaattttcaggttccgtttttatcaatgaaaaagatatttcgaatttcagcatagatgaaatttcaaaagacataggctcggtttttcagtctcccaagagtcagttttttaccgatgacgtaatttcggaactcagctttccttgcgaaaactacggaatttcccgcgatgaaattatagaaaggattgccgaagtttgttccattttacatatcgaaaatcttttaaccgaaaaacttgagagcctctcgaacgggcaaaaacaaaaaatagccattgcctcgattttaaccttgaggcctaagattatagtccttgatgaaccctcgtccaatctggattttaactctatccttatcctggccgatattttaaaaattttaaaacaaagaggttttaccgtaatcatagcggagcaccgccttcattatctaaaagatctttttgacagagttatctatataaatgaaggaagtatacaaaacgaatacactcgtgaagaatttttagcccttacaaatacggagttaaattctaaaggtttaagaagtttacatctttttacaaatgaaaatgaagcggaacccatcggccctgtacataataaatttaactccgatacggaagccgaaaaaatatgcagcctttcggatatttcgttttcgtttaaggacggaaccgaaattttaaactcggttaatttagacctttacaaaaacgacattgccgcccttaccggaaaaaacggagcgggaaaaacaactctcgcaaaaatcatatcgggtatttaccgccaatctgccggaagcattaaattcggagaaaaaattttaaacgaaaaggaaagagtgagccgcacaaattttgttcttcaagatgttgaatatcagcttttcggtgccgatgttttttccgagcttttgataggaaacaaacagcttgaaaacgtaaacgaaaaaatagaaaaagccttaaagaaactcaacctttacgattataaagatgagcatcccttttctctttcgatgggacaaaaacagaggcttataatagcggccacctatgttcgaggctgcccgcttacaattctcgatgaaccgacaagcggcttggattacggaaatatggtcagggtaggagaacttatcgaagagatagccgagacttcggcagtgcttataataacccatgattttgaatttatctcgaagatatgcaacaggctgattcttttaaaggataaaaaaatagccttagattcaaggcttgaaaaaaacgataaaaaactggaaagtattttttccacatatttataa

SEQ ID NO: 27337 - protein, 502 aa, Treponema denticola ATCC 35405
MNTAVELKDVSFIYESSKDGRANLKKTSLNIKKGEFLLVTGISGCGKSTLTKCINGLIPRFYEGEFSGSVFINEKDISNFSIDEISKDIGSVFQSPKSQFFTDDVISELSFPCENYGISRDEIIERIAEVCSILHIENLLTEKLESLSNGQKQKIAIASILTLRPKIIVLDEPSSNLDFNSILILADILKILKQRGFTVIIAEHRLHYLKDLFDRVIYINEGSIQNEYTREEFLALTNTELNSKGLRSLHLFTNENEAEPIGPVHNKFNSDTEAEKICSLSDISFSFKDGTEILNSVNLDLYKNDIAALTGKNGAGKTTLAKIISGIYRQSAGSIKFGEKILNEKERVSRTNFVLQDVEYQLFGADVFSELLIGNKQLENVNEKIEKALKKLNLYDYKDEHPFSLSMGQKQRLIIAATYVRGCPLTILDEPTSGLDYGNMVRVGELIEEIAETSAVLIITHDFEFISKICNRLILLKDKKIALDSRLEKNDKKLESIFSTYL

SEQ ID NO: 27338 - DNA, 1743 bp, Yersinia pestis biovar Medievalis str. 91001
  CDS (1)..(1743): transl_table=11
atgaatggaattcaacatatcattactctggaggcggttgaaaaacggttcagcggactggatcaccctgcggttgccagcctgactacggagatccgcagcggagctgtgacgggattagtcgggccggacggtgccggtaaaaccacgttattacgtatgctggccgggttgctaaaacccactcagggtaagataaccgtggtcgggctagatccgttgaaagatgatcgccagctacatgccattctcggttatatgccgcagaaatttggcctgtatgaagatttaacggtcatggaaaacctgtcgctgtatgccgatttgcgtggcgtgaccggtgaacttcggcgccagacatttgagcgcctgctgacatttaccgatttaacccgcttcacatcacgtctggcgggtaagttgtcgggtggcatgaagcaaaagttagggttagcctgtaccttggtcggccaacccaaagtgctcctcttggatgagccgggtgttggtgtcgatcccatctctcgccgtgaactgtggcgcatggtgcatgagctggcagacgacggcatgctcattttgtggagtacctcttatctggatgaagcagaacaatgtcgtgaagtgttgctgcttaatgaaggcaaattcctgtacagcggcgcaccacaaaccctgacgcagcgcatgagcgggcggactattttggtggccgcccaacgtggcaccaatcgccagttgctacaacatgccctgaccctgccccaagtcagtgacggggtgatccaaggtaaatatgtccggctgatccttaagccagatgtcgatcacagccagttattacaatggctaaatcaacccgatgcagaaatgaaggaggcggaaccccgttttgaagacgcctttattgacctgttaggtggtggcccggacagcgagtccgcactggcaaaaattatgcccagagtggctggcaaccctggtgaaaccgttattgaagcacaagcgctaaccaagaaatttggcgattttgccgcgactgaccatgtgaattttcaggttaaacgcggtgaaatatttggcctgctcgggccaaatggggccggtaaatccacgacgtttaaaatgatgtgtggcttattggtacccagtgatggaaaagccttggtactggggatggatctgaaaaccagctcgggtaaagctcgccaacatctgggctatatggcacaaaaattttcgctgtacggcaacctgaccgttgagcaaaatctgaaatttttctccggggtttatggtctgaaaggcaaaatccagcgcgacaaaattgccgatatgatttcggcatttaacttcaccccgatcctgaaacaaacaccagactccctgccattagggtttaagcagcggcttgcactggcctgcgccttgatgcatgagccagatatcctgtttcttgatgagccaacctccggtgtcgatccgctcactcgccgtgaattctggttacacatcaatggaatggtagacaaaggcgtcaccgtcatggtgaccacccactttatggatgaagcggaatattgtgaccgtattgggctggtttatcgcggcaagattatcgccgccggtacgcccgatgaactgaaacaacaggttgccagtgatgatgaccccaatccgtcaatggaaacggcgtttatcgaattggttctgcgttatgaccaacagcatgataaggagtaa

SEQ ID NO: 27339 - protein, 580 aa, Yersinia pestis biovar Medievalis str. 91001
MNGIQHIITLEAVEKRFSGLDHPAVASLTTEIRSGAVTGLVGPDGAGKTTLLRMLAGLLKPTQGKITVVGLDPLKDDRQLHAILGYMPQKFGLYEDLTVMENLSLYADLRGVTGELRRQTFERLLTFTDLTRFTSRLAGKLSGGMKQKLGLACTLVGQPKVLLLDEPGVGVDPISRRELWRMVHELADDGMLILWSTSYLDEAEQCREVLLLNEGKFLYSGAPQTLTQRMSGRTILVAAQRGTNRQLLQHALTLPQVSDGVIQGKYVRLILKPDVDHSQLLQWLNQPDAEMKEAEPRFEDAFIDLLGGGPDSESALAKIMPRVAGNPGETVIEAQALTKKFGDFAATDHVNFQVKRGEIFGLLGPNGAGKSTTFKMMCGLLVPSDGKALVLGMDLKTSSGKARQHLGYMAQKFSLYGNLTVEQNLKFFSGVYGLKGKIQRDKIADMISAFNFTPILKQTPDSLPLGFKQRLALACALMHEPDILFLDEPTSGVDPLTRREFWLHINGMVDKGVTVMVTTHFMDEAEYCDRIGLVYRGKIIAAGTPDELKQQVASDDDPNPSMETAFIELVLRYDQQHDKE

SEQ ID NO: 27340 - DNA, 2085 bp, Neurospora crassa
  CDS (1)..(2085)
atgcgcttcccaccaccagggaccactgtccgtccccccatcatacgcatcaccaacggcaccttctaccggcaccaaccttcctcccacggccacggtcatggtcaccccaacccaccactcttctctaacctcaccctcgatatcccctcccacccttcgtctccgcacaactgggccatcctcggtccctcccaatccggcaagaccagcttcctgcaactcctccgcggccaatacctctgcttcccacccaccgctcgctcctttccctatctctctaccgaagacgtccccacccggctgagaggaaacccagccaaagcgattcagtatgtcgggttcgacgccacttccacgtccgggggtcttggggcagcggcatccagttacatctctgcgcggtacgaaagtcacagggaacagacggacttttcagtgaaggattggttgttgggcaacacggaacttaacccgacttcgatgccgggggattacaaagtggacgaaaagttgtttgaacgggtggttgttgatttgcggctggacacccttctcgacctccccgtctcgtttctttccaacggacagggccgtagggccaggatcgcgcgagcactcttcaaagacccggaggtcttgttgctggatgaacccttcatgggactcgacccagctacggtcgcgggcttgagtcccttgctgcaaagtctagcggagaagaagagcccacggctggtgctggccgcgagaccacaggatcccttgccggagtggatcacgcacctggtgtatctgcggacggacagccaggtgggcgcgatgggcgagcgggggaccgtactggatggtttgagggcctacgtgcgcggagtatggaagggtggactttctgaagacgaaacaatgcctgttcatgctctcatcgacatcggccgcaccttgacgaaagagggtatcaaaggggagggcctagccgaggcacttacccgctccccgaccaaccaagcacccatcatcgactccgcgcctggtcccgagaagaccgcaccagaagaagcagaaaaagaacctctagtcgaaatgtccggcgtcaccgtccgctacggctccaagaccgtccttggcaactggccttcgggcctccactggaccgtccgccgcggctcccgctggggtgtcttcggtcccaacggtagcggcaaaaccaccatcgtctcgctactctgctccgaccatccacagacttactccctccccatcaaactctttggacgatcccgcttgcctgaacccggatccggtcaacgccccttaaccttctgggacatccaatcgcgcgtcggccactccagtcccgaaatccaccagtacatgcctcgccggctaaccgtccgctccgttctcgagtccgcatgggccgacacgttcagctctgtccccaaactcacccctgaagcaacgggaaaagtagacgctactctatcctggttcgcacacgaactgaacccgtcctttgccaaacgttcgcaccacactcccgtcgaactcgcagagaccgatgccgacgacgaagcaagtctgaagtgggcaaaagattaccaattcggcgaattacctttttcttctcagcgcttactcctctttttgcgcgctatcgtcaaaaaccccgatattgtcgttctcgacgaggcgtttagcgggatggacgatgccgtccgcgacaaatgcatgttgtttctcatgcacggagagaacaagacttttgcttcttcttcttcttcttcttcttctagtacttctgctcctacgaccaagaccaagaatggtctatcggtagctcctgtggaagtagtagatagcgagcaagccaaggctggtaaagtcaaggtgcacgggttgacggacgagcaggccttgatttgcattagccacattaaggaggaagtgcctgattgcgtaagggagtgggtgtgtttgccggaggcgagcagtgggcaggaggcgaggtttgggaggttggatggcccgttgaggttgagtggtagaaggtggggggaggtttggggggttaatgggaattaa

SEQ ID NO: 27341 - protein, 694 aa, Neurospora crassa
MRFPPPGTTVRPPIIRITNGTFYRHQPSSHGHGHGHPNPPLFSNLTLDIPSHPSSPHNWAILGPSQSGKTSFLQLLRGQYLCFPPTARSFPYLSTEDVPTRLRGNPAKAIQYVGFDATSTSGGLGAAASSYISARYESHREQTDFSVKDWLLGNTELNPTSMPGDYKVDEKLFERVVVDLRLDTLLDLPVSFLSNGQGRRARIARALFKDPEVLLLDEPFMGLDPATVAGLSPLLQSLAEKKSPRLVLAARPQDPLPEWITHLVYLRTDSQVGAMGERGTVLDGLRAYVRGVWKGGLSEDETMPVHALIDIGRTLTKEGIKGEGLAEALTRSPTNQAPIIDSAPGPEKTAPEEAEKEPLVEMSGVTVRYGSKTVLGNWPSGLHWTVRRGSRWGVFGPNGSGKTTIVSLLCSDHPQTYSLPIKLFGRSRLPEPGSGQRPLTFWDIQSRVGHSSPEIHQYMPRRLTVRSVLESAWADTFSSVPKLTPEATGKVDATLSWFAHELNPSFAKRSHHTPVELAETDADDEASLKWAKDYQFGELPFSSQRLLLFLRAIVKNPDIVVLDEAFSGMDDAVRDKCMLFLMHGENKTFASSSSSSSSSTSAPTTKTKNGLSVAPVEVVDSEQAKAGKVKVHGLTDEQALICISHIKEEVPDCVREWVCLPEASSGQEARFGRLDGPLRLSGRRWGEVWGVNGN

SEQ ID NO: 27342 - DNA, 2052 bp, Magnaporthe grisea 70-15
  CDS (1)..(2052)
atgagggctttatattcatcggtccgcgcaccgatattacgcatcagtagaggcacgttctaccgacaccatccttctgcgcaggtgtcgcaccctaacccgccgctgttcaaggatctcgactttgagctttcctccaccgcccagttggccaatggagaaaagcaacagcactggtgcatagtcggtccttctctcagcgggaagaccacatttcttgaggttctgcgtggttttcacctcagcatacctcccacggccaggtcgtacccgtacctgtcaacagatgccttcccttgccacctgaggacgccgcaccaggcgattcagtatgtggggtttgatgcaagcagctcgtccggccttggccctccgacgagcacttatctcgctgcgaggtacgaatctcgccgtgaggatacagacttttcgctccgggactatctgctcggaaacaccgagcttaaccccgctgagaaacccggtcagtccgccgctgaagaggagaagctcctggggcgcgttgttcacgacttgaagcttgcgcccctactcgaactcccggtttcatttctctccaacggccaaggttgtagggcacgtattgctagggcattgctgcgaacccctgaggtcctgttgttggacgagccgttcatgggcctcgaccctcccactgtggtagctcttagtccgttcctgcgtggattggcagagcaagcggctcccaggctagtcctcagcattcgaccccaggatcccttgccatcatggattagccatatcgtgtatttgggcaacaactgtcaggttgcttcgataggtcagaaggaggatgtcatggaccaactaaggtcctatgttagtcgagtagctgactccaagacacccgaggaccctacgctccctgtatctgcgctgagggagatggggaggacattaacggacgacggggttgagggggtcgttttcgatgctgttgggttgcagagcagtatcgccatgcctgaacttcccagagcggccatcaatggggcaactagtattggagagcccttggtagagatgaatggggttcaagtcgggtatggcgataagattgtactcggcaactgggacaacgatactataactggccaaaccggtcaaaagggcttggtttggacagttcgtcggggcgaacgctggggtatctttggagcaaacggctcgggcaagacaactctcttcagcctgctgggctcagaccatcctcagtgttattcacaaccggtgaaactgtttgggcgcagtcgacttcccgagccagggtctggccagccgccgttgactttctgggacatacaagaacgcatcgggcactccagtcctgagatacacggcgctataccccggcgactcagcgtgcgccgtgtactcgagacggcatgggccgagacgttcatcagcacaccgaagttggaaaagaacgctagtgagaaggtggaagcgactcttgtctggttcgaacgagagctgaaccccgcggtgcgccgcgagaatgagcaaacaaaccatggctcaggctctagcactttgaaatgggccgacgattatctgttcggtgagctttccttcagcgctcaacgcgtgttactactccttagggcaatcatcaaaagcccagacattgtggtgctcgatgaggccttcagcggcatggacgaggcggtccgggacaagtgcatgcttttcatcgcgcacggcgaggagaagattctcgctgccagaggcggcaggcaggttatggtggacagtcaagccaagcaggatggcaatgtccgcgtcacgggtctctcggatcggcaggcgttcatctgcatcagtcatgtcaaggaggaagtgccagactttgtgagggagtggctttgtctgccagaggccacttctcggttgccggcgcgattcgggcgtctggacgggcctttgaggctggatgggaagcgatgggatgatatatggggaatgggacgaggtgcaaggaaaggcttagaaaacggccagcttttctag

SEQ ID NO: 27343 - protein, 683 aa, Magnaporthe grisea 70-15
MRALYSSVRAPILRISRGTFYRHHPSAQVSHPNPPLFKDLDFELSSTAQLANGEKQQHWCIVGPSLSGKTTFLEVLRGFHLSIPPTARSYPYLSTDAFPCHLRTPHQAIQYVGFDASSSSGLGPPTSTYLAARYESRREDTDFSLRDYLLGNTELNPAEKPGQSAAEEEKLLGRVVHDLKLAPLLELPVSFLSNGQGCRARIARALLRTPEVLLLDEPFMGLDPPTVVALSPFLRGLAEQAAPRLVLSIRPQDPLPSWISHIVYLGNNCQVASIGQKEDVMDQLRSYVSRVADSKTPEDPTLPVSALREMGRTLTDDGVEGVVFDAVGLQSSIAMPELPRAAINGATSIGEPLVEMNGVQVGYGDKIVLGNWDNDTITGQTGQKGLVWTVRRGERWGIFGANGSGKTTLFSLLGSDHPQCYSQPVKLFGRSRLPEPGSGQPPLTFWDIQERIGHSSPEIHGAIPRRLSVRRVLETAWAETFISTPKLEKNASEKVEATLVWFERELNPAVRRENEQTNHGSGSSTLKWADDYLFGELSFSAQRVLLLLRAIIKSPDIVVLDEAFSGMDEAVRDKCMLFIAHGEEKILAARGGRQVMVDSQAKQDGNVRVTGLSDRQAFICISHVKEEVPDFVREWLCLPEATSRLPARFGRLDGPLRLDGKRWDDIWGMGRGARKGLENGQLF

SEQ ID NO: 27344 - DNA, 1965 bp, Gibberella zeae PH-1
  CDS (1)..(1965)
atgagacctcttacaagttgtcctccgatcattcggatcgccaatggcactttctatcgccatcacccaaacactactactacatcattgcggccaaatccacctctttttagtgacttgaatttcgagctgccttctacatcaaactcgcctcggaattggtgtatcgttggaccatcgctatcaggaaagactacattcctacaggctttgaaaggaagatatctttgcgacccacccatcgcaagatcctatccatacctttcttctgagaacgttcctaaacggttacgcacgccgcaaaaggcgattcagtatgtgggtttcgatgcagaacaaactggtggcggcttaggcagtagtgttgccacaagtgcgtacttgtcggcgaggtatgagtcgagacgtgagattacagacttttctctcagggactttcttctaggaaacacagagcttaatcctatgaagacggaacaaggcgatgacgatgcttccataccacttggcctactgtcccgagttattaaggatttaaagttggagaaccttcttgatctgcctgtctcgtttcttagcaatggccaaggtcgaagagcacgtattgctcgtgctcttctgacgaagccggaagttctattactcgacgagccttttatgggactggatcctcctacagtctctggtttaagtcctctgctatattcactatctgaaaaggcaagtcctcgtctcgttctaagcgcgagaccgcaggaccccgtgcctgactggattactcacttggtgtatctgagaacagactgccaagtaggctcaatgggccccaaggaggaggtccttgaaggtctgaagaaatatgtacatggtgttcgcaaaggaggtcttgttgaggacgagaaacttccattgcactcgcttgtcgacattggccgtgtgctaccctcagctgcttctacggaaggctcaggtcatacagagcaatcatcgttcaaggagctagaaccaagtaagcctggtgctgagcctctcgttgagatggatggctgcagggttcagtatcgtggaaaggttgcccttggtaactgggcacagcaaactgctgatggttccaaagatggcttgatttggacggttcgacgtggcgagcggtggggtgttttcggtcccaacgggtcaggcaagacgacgatagtctcactgctctgctctgatcaccctcaatcttactccctccccatcaagttattcggacgatctcgtcttccagaacctggctctagtcaacggccgctcactttctgggatatccaatcacgaatcggacactctagtcccgaggttcatcagcatatgcctcgaagcctgactattcgtcagactatcgagaatgcatggtcggaaacgttccgtgcgaagccgaaattaaatgacgctgctaaggaaaaggtcgaggcggctctccgatggtttgcgcctgagctacatccagcttattcttcatcgtcgcacgagaacctctcgtgggcggatgattacatgtttggtggtctctcattcagtgcacagcgtatcgcgctttttatccgctccatgatcaagagtccagatgtcgtggtcctcgatgaggccttcagtggcatggatgatgcagtgcgggacaagtgcacactgttcctcgaacaaggcgaatctaggacataccgtggcgaagatatcgttgagagtgacgcatcaaagtctggtcaggtcaaaatcactggtctttctgacgagcaggcgctgatttgcattgcccatgttaaggaggaagtgccggactgtgtgagggagtggttatgtcttcctgaggctaatacgggaagtccagcgaggtttggaagattggatggcccattgagaaccgatgagaagagatggcatgagcacaccgtgaagttgaaggtgattcatgtcatggaatag

SEQ ID NO: 27345 - protein, 654 aa, Gibberella zeae PH-1
MRPLTSCPPIIRIANGTFYRHHPNTTTTSLRPNPPLFSDLNFELPSTSNSPRNWCIVGPSLSGKTTFLQALKGRYLCDPPIARSYPYLSSENVPKRLRTPQKAIQYVGFDAEQTGGGLGSSVATSAYLSARYESRREITDFSLRDFLLGNTELNPMKTEQGDDDASIPLGLLSRVIKDLKLENLLDLPVSFLSNGQGRRARIARALLTKPEVLLLDEPFMGLDPPTVSGLSPLLYSLSEKASPRLVLSARPQDPVPDWITHLVYLRTDCQVGSMGPKEEVLEGLKKYVHGVRKGGLVEDEKLPLHSLVDIGRVLPSAASTEGSGHTEQSSFKELEPSKPGAEPLVEMDGCRVQYRGKVALGNWAQQTADGSKDGLIWTVRRGERWGVFGPNGSGKTTIVSLLCSDHPQSYSLPIKLFGRSRLPEPGSSQRPLTFWDIQSRIGHSSPEVHQHMPRSLTIRQTIENAWSETFRAKPKLNDAAKEKVEAALRWFAPELHPAYSSSSHENLSWADDYMFGGLSFSAQRIALFIRSMIKSPDVVVLDEAFSGMDDAVRDKCTLFLEQGESRTYRGEDIVESDASKSGQVKITGLSDEQALICIAHVKEEVPDCVREWLCLPEANTGSPARFGRLDGPLRTDEKRWHEHTVKLKVIHVME

SEQ ID NO: 27346 - DNA, 2004 bp, Ustilago maydis 521
  CDS (1)..(2004)
atgccagtaaagatggcatctatatccagggccgcatctgtgaatatcagagttggtggtcgtccgcccaatcgttggctgccacgctcaatcacatcaaccaccccgactgttagcccctctcgtttctcatcgacagctccatcccagacacgaccgccgatcctcaagcttgacaatgctcttctcagaactcagacctccccaacagtctcaagcacctcaacgagcccaccatcaactctgcaatggaccgtcaacgatgcgggcgccgatgaatgctgggccatcatcgcaccagcctccgaacaaggcggggctgttcgtgctgaactcatcgatatcctctctggtcgccttcgccctcgcaagcatccaaacaatttgcagcatccgcccgtacatccgttcttacaagacgcatcacagcccgatactagtccacgctcctccgtcaaggcaatcaagcacgtctcattcgcaaccaaaatcggctccacctcgtcctctgccgacttcaccaactactctgcccgctacggtgctatccgcgaccaagatcgtgtgacgctctacgagcggctgatggatatcctagactgccctgttggcctcgtggctgctgccaaactcgttcctgacccctttgcccctccagacgcgtcgagccaagtaggacggttcaagtacaaatccgaatgtgagcgaaaagctgctctgtcaaaagcgcagcaagctgacaaggtcatcaaacagatggcgccgctggtgctcatcacggacgagctgctgcatcgacctgtaatcgcgctctcaaacggtcaaacaagacgcgcaaggattttgagcagcttgatcacgggcgcagagctggtggtactggaagagcctttttctggcatcgatctggagacgagacagaaattgagcgttctgtttgcacaactgcatgcggctaggaggccgaggctcgtgctagtgctgagggagcaggattccataccggagcttgtcacacatatcctcaaagtggacgatgaggggcgaatcacttggattggcccgcgaaaaagtgatactgcttttcctcacgataccaactctgctgcaaacagcgacaactcgccagcgcaaggaggctaccatcttgtcctctccaactctaaatcatcgatcggtgtcggtgacacatgctcggcaccgctcgtctcgctttgctcggtctcgattcagtacggctcgaaacttgtgctcgattccatcaacctctctctctacccggggctccgcctcattctggctggagacaacggttccggcaagacaacgttgctcgcgcttctgcttggcgatcatccaaagtcgttctccttctcggcctcttctttgtcgctcttctcacacgcacgcgaccacgctcttaacgcacgagcgctgctcaaccgtcgattgggccacgtctcacccgagctgttcaacgcattcccacgcaagccgttgagcgccggtggcttgacggtgggcgaagtggtggcatctggtttcgagaatgtgtttgcgcgacgaaagtactcggaccaacaaaaacagagggtctggtcgttgttggcgttatttggcgacttgatcaagtcgcgtcagcgaggttgcatgaccgatagcgcggatggtgtgcaggcgatatccgatcttgcattttcgtcgttgagccatggaagtcaagcggtggtcctgttcctgcgcgctgtggtgggcaatcctcctgtattggtgttggacgaaccgtttcaagggatggataccaagcaggtacagaggacgagagcgttcattgactttcccgagcacttttccatcgggcctactccactggacaagcaaaacgacttgcacgagagacgaagaatggcaatcgtgctcgtcagccattacgaatccgagtggcccaccagctttggttcgctgctgcgtctgcgtcaaggaaaggcggtggaacacttttga

SEQ ID NO: 27347 - protein, 667 aa, Ustilago maydis 521
MPVKMASISRAASVNIRVGGRPPNRWLPRSITSTTPTVSPSRFSSTAPSQTRPPILKLDNALLRTQTSPTVSSTSTSPPSTLQWTVNDAGADECWAIIAPASEQGGAVRAELIDILSGRLRPRKHPNNLQHPPVHPFLQDASQPDTSPRSSVKAIKHVSFATKIGSTSSSADFTNYSARYGAIRDQDRVTLYERLMDILDCPVGLVAAAKLVPDPFAPPDASSQVGRFKYKSECERKAALSKAQQADKVIKQMAPLVLITDELLHRPVIALSNGQTRRARILSSLITGAELVVLEEPFSGIDLETRQKLSVLFAQLHAARRPRLVLVLREQDSIPELVTHILKVDDEGRITWIGPRKSDTAFPHDTNSAANSDNSPAQGGYHLVLSNSKSSIGVGDTCSAPLVSLCSVSIQYGSKLVLDSINLSLYPGLRLILAGDNGSGKTTLLALLLGDHPKSFSFSASSLSLFSHARDHALNARALLNRRLGHVSPELFNAFPRKPLSAGGLTVGEVVASGFENVFARRKYSDQQKQRVWSLLALFGDLIKSRQRGCMTDSADGVQAISDLAFSSLSHGSQAVVLFLRAVVGNPPVLVLDEPFQGMDTKQVQRTRAFIDFPEHFSIGPTPLDKQNDLHERRRMAIVLVSHYESEWPTSFGSLLRLRQGKAVEHF

SEQ ID NO: 27348 - DNA, 1635 bp, Candida glabrata CBS138
  CDS (1)..(1635)
atgagcaaaagcgtattgaagatatccaatgcgctgtttaggtcttctctgatgaagaatgtgccgccagtgttcagcaagccggttaaagatttcgagatactcactggtgagaaatgggtcatctggggtaacggtaaggccaaattcatgaatgtgttgtctaacaagtacctatgtgaccccccactgtcgttacagtacaatgtctcaaaagatggtgttacgctgcctcgcattgagcaggttcaatttaaaggtgccattccaactgcgcatctcagtgctcgttatgagttcttcaaggatgaattcgatcagacttgtaagaagtttatcctagacaatgccattggctcgaatgcagtggagtacgatgtcagtacaactgatagggtagtggatatgggactctatgattttttggtccgggaactcaagcttgaagagttacagaatagatgggccatgggactgagtaatgggcagatgaggagagcccgtttggctagaagtttactgaaacagccagatttgatactggtggatgatcctttcttagggctggatcccacagccacagcaatcatctccaagttcttgagcaattggggtggtgctggcaaagaaaacagctatcattctcctgttgtgataggtctacggtaccaggatacaattccaagttggtgtacacacatatgctgtgtcgaccccgagtctggcatcaagttccaaggaccaattaacgaatatagagacgctatcgaaaacaagagggcctctgtgattgaggacttaaagaatgccaaaacgcaaaggaggaaagagattggactttctggtgcgagtgaggaatactctattgacgatctgatatcgccacacccaatgtacaattgtgcctcccacgagatgatcaagatgccacccacaattgaattgaaggggctaggtgttacatacaagggtgagcccgtgttggaaaatctgcattggcaagtcaaaccgggatccaagtggcatatcaggggcgacaacggtactggcaagtctacgctgctgtcgcttttgaccgctgagcacccgcaatcgtggaactccaaagttgtagagaacggggagccccgccggacaggcaaatccaactacttcgacatcaacagcaggatcggcatgtcctctcctgaactgcatgccattatcctgaacaactgcgccgacagactaacggtccgcgaattcatagccactgggttccaccaggggtcatccaacaacttcctccccctttgggacaagctggacgatagccagaagcgcatagtgaatatgtacatgaactactttgagctggacctgatcgcgcgcgacaagaccatcaaccagctcagtgtcagtgagcagaaactggcgctcctggtgagaagtctagtgaagatgccagagatactggtcctagacgaagcattctctggtatggaagtcacgccaatgttgaaatgccacgagttcctagaccactggcccggcacagtgcttgtggtcgcacacgtcgcggaagagacaccggcctgccaccactacctccgcctgatctccccaggccagtacgagattggagacatagtatga

SEQ ID NO: 27349 - protein, 544 aa, Candida glabrata CBS138
MSKSVLKISNALFRSSLMKNVPPVFSKPVKDFEILTGEKWVIWGNGKAKFMNVLSNKYLCDPPLSLQYNVSKDGVTLPRIEQVQFKGAIPTAHLSARYEFFKDEFDQTCKKFILDNAIGSNAVEYDVSTTDRVVDMGLYDFLVRELKLEELQNRWAMGLSNGQMRRARLARSLLKQPDLILVDDPFLGLDPTATAIISKFLSNWGGAGKENSYHSPVVIGLRYQDTIPSWCTHICCVDPESGIKFQGPINEYRDAIENKRASVIEDLKNAKTQRRKEIGLSGASEEYSIDDLISPHPMYNCASHEMIKMPPTIELKGLGVTYKGEPVLENLHWQVKPGSKWHIRGDNGTGKSTLLSLLTAEHPQSWNSKVVENGEPRRTGKSNYFDINSRIGMSSPELHAIILNNCADRLTVREFIATGFHQGSSNNFLPLWDKLDDSQKRIVNMYMNYFELDLIARDKTINQLSVSEQKLALLVRSLVKMPEILVLDEAFSGMEVTPMLKCHEFLDHWPGTVLVVAHVAEETPACHHYLRLISPGQYEIGDIV

SEQ ID NO: 27350 - DNA, 1566 bp, Kluyveromyces lactis NRRL Y-1140
  CDS (1)..(1566)
atgacacttaataagcaagttgttaagatcactgatgcctttttcaaatcatccttaaggaaaggttctccatatgtatttccgaacaagatccggtttgagatcaatgaaggtgagaagtggtgtatttggggtccatcaaaggagaagttcattgatattttgtctaacaagtacataagtgatcctttttcggcagttacttatgcgaaagttgtaaagggtcggttaccacggattgaacaagttaaatttaaaggtgtgatgcctacagcccatttgagtgcccgttatgagttcttcaaggacgaatttgatcagacatgcgagaagtttattcttgataattcaatgggatctcgtgcagtaaattatgaggttgagactacgaacagatacgtggatccagagctattaacgtatttgttgaaagagttaaaacttattgacatcaaagataggtgggctatggggttgagtaatggacaaatgagacgtactaggcttgcgcgctcgttattgaaggaacctgacttaacaattattgacgatccatttttgggattggatccatctgcgtgttcgatcatatcaaaattcttgtccaaatatgataaaggtacatcagtcatcatagggttgaggtatcaagatcaaataccagactggtgtacgcacgtggtgtgtgtggacaaggatggtatagagttccaaggtcccatggagcagtatagagaccaagttgaatcaatgaggttgcaattgttagaagtactacagctaaacaaacctaagagtaagtatactattgaggatttgatttcgccacataagtactataaaagcccacatcatgatgtgatgaagattccatcagtagtcacgctagaaggtctgtcggttacatacagtggcgaaccagtattaaaagatatttactgggatgtcaaacaaggttccaaatggcatattcaaggaaataatggtgctggtaagtcaaccttgctatctttgatcactgcagaccatccacagtcttggaactccaaatttgttgaccacggcgttcctagaagaaccggaagcactaacttctttgacattaataaaaggattggtctttcttcgccagagatgcacgctctctttttgaagaacgctggtgacctctctgtgttagaaacagtggcatcagggttccatgcagtcagttccaacaactttttaaaagcgcataacacacttacagacgaacagaaaagaattgttgatatgtatatcgattatttccatttggacccgaagaaaacattcgcatccctatctgttagcgaacagaagattgcattattcgttagggctgcggttaagatgccggaaattatgatacttgacgaagcgttctccggaacagagactgatcaactcataagggcccatgagttcctcgagcaatggccaggaactgtttttgtcgtatcgcatgttcaggaagagacaccaaaatgcaatcactacctaagattaatcgaacctggacaatacgaaatcggagacgtcaattga

SEQ ID NO: 27351 - protein, 521 aa, Kluyveromyces lactis NRRL Y-1140
MTLNKQVVKITDAFFKSSLRKGSPYVFPNKIRFEINEGEKWCIWGPSKEKFIDILSNKYISDPFSAVTYAKVVKGRLPRIEQVKFKGVMPTAHLSARYEFFKDEFDQTCEKFILDNSMGSRAVNYEVETTNRYVDPELLTYLLKELKLIDIKDRWAMGLSNGQMRRTRLARSLLKEPDLTIIDDPFLGLDPSACSIISKFLSKYDKGTSVIIGLRYQDQIPDWCTHVVCVDKDGIEFQGPMEQYRDQVESMRLQLLEVLQLNKPKSKYTIEDLISPHKYYKSPHHDVMKIPSVVTLEGLSVTYSGEPVLKDIYWDVKQGSKWHIQGNNGAGKSTLLSLITADHPQSWNSKFVDHGVPRRTGSTNFFDINKRIGLSSPEMHALFLKNAGDLSVLETVASGFHAVSSNNFLKAHNTLTDEQKRIVDMYIDYFHLDPKKTFASLSVSEQKIALFVRAAVKMPEIMILDEAFSGTETDQLIRAHEFLEQWPGTVFVVSHVQEETPKCNHYLRLIEPGQYEIGDVN

SEQ ID NO: 27352 - DNA, 1641 bp, Debaryomyces hansenii CBS767
  CDS (1)..(1641)
atgatacctacagtaaggttgttgaactcacaggtagatcaatgtttgttgagaattaaggatgggtttttcaagaacagtggaaagaaaacgctggatttgaaagattatgtctttagaaagcccattgaaaaatttgaaatttacagacttaataatgagaataagccatcgttatggtcaataacaggtccagcgaaatcgcaattcttaggtgtggtatcgggaaagtatattccgtatcctccactttccagaacatatccatttatgctggacagctacaaatacgaccagatccaatttttgaatttcaaagaggcttccgggttggataaagtacatttatccgctagatatgaatcttattcttacaagggaagcttggaaatgtcggatgacgtcaattctgtccgcaattatattactggtgctaataattataatagtaatacgacttctggtgtgagggaagatttcgtgaatcaacttttggatttattcaacttgaatcacttgtcgaacaagtggattaactcgttatctaatgggcaattgagaagggcaaggttagcgaaagcattgattaacaagcccagcttattcataattgatgatccgtttttgggattggaccctcaagcaaccaagttagtatccaattcgttgcttagagtcagccaggacttgaacacgagtgttgttttaggattgagaattcaggacgatattccggagtggcttacccatgttggctatgtcactacagaggatggattaaaaatgtcaggtgctaaggaagatatacttcctcttctcgaacaggaattgaagtctgccacttctattcatcaccaacacgaaataaagctgaaaaataaaaagagtactccaatctccaacgagactttatgtacttctggtgaaactccccacatagaattccgcaatgcatcggttgtctacaaagatttgcccatattcgccaactttgactggaaaattcctcgtgggtcgaaatggcgtatcttaggagataacggtaccgggaagacaacgttgctctcgttgatcacggccgaccatccgcagtcgtggagatcagtgttgagcatagacggtgttctcaggaaaaccggaaacggagtgtcattttttgacgtcaatgacaagataggcatttcgtcacccgaactccacgctctagttcccggaaacaagactatgatgcaggtcatcatgaacggtctagttccaaacgtcgccaactcaaatttcacgtttattgcacccaaagaactgctcactccccatgcccgcacccttctcggcaaattcgacgacattcttgcggcccatgctaacgacagcttctctgacttgtccgtcaccaaccagaagcttacattgttccttagggccgtcataaaaaatcccgaaattctcattctcgacgaagccttctcttgcatggacgaagaacaaattatggtcagatgccacgacatcgtagaaaacgacttgaaagatactacagttctagcaatagcccacatagactgggagatccccgcctgcgactacgttttgaagctacatggtgatgaactgagatcatacggaatcctgaagtatggttga

SEQ ID NO: 27353 - protein, 546 aa, Debaryomyces hansenii CBS767
MIPTVRLLNSQVDQCLLRIKDGFFKNSGKKTLDLKDYVFRKPIEKFEIYRLNNENKPSLWSITGPAKSQFLGVVSGKYIPYPPLSRTYPFMLDSYKYDQIQFLNFKEASGLDKVHLSARYESYSYKGSLEMSDDVNSVRNYITGANNYNSNTTSGVREDFVNQLLDLFNLNHLSNKWINSLSNGQLRRARLAKALINKPSLFIIDDPFLGLDPQATKLVSNSLLRVSQDLNTSVVLGLRIQDDIPEWLTHVGYVTTEDGLKMSGAKEDILPLLEQELKSATSIHHQHEIKLKNKKSTPISNETLCTSGETPHIEFRNASVVYKDLPIFANFDWKIPRGSKWRILGDNGTGKTTLLSLITADHPQSWRSVLSIDGVLRKTGNGVSFFDVNDKIGISSPELHALVPGNKTMMQVIMNGLVPNVANSNFTFIAPKELLTPHARTLLGKFDDILAAHANDSFSDLSVTNQKLTLFLRAVIKNPEILILDEAFSCMDEEQIMVRCHDIVENDLKDTTVLAIAHIDWEIPACDYVLKLHGDELRSYGILKYG

SEQ ID NO: 27354 - DNA, 1503 bp, Yarrowia lipolytica CLIB99
  CDS (1)..(1503)
atgactcgattgccgctgatatcgataaaagacgcgaagttccgcatgattggggccctggcctcgtcaggatccaacccttacattttccccaatcccatttcgctgacaatcaacccggatgagaaatgggtcatcagtggacctcgaaagtcgcaattgatgtccattctggccgccaaacatgtatcagatccacctctgggccggcagtaccctttcctcaagaaaaaacgggttcccagccaagtcatccagacgctggagttccgaggatcaatcaacatgggtcacttgtcagctcgatatgagttcttcaaggacgagttcgacatgactctcatcgaggagctcaagcgagcctcccgtgatcccgcaaccgcgatggacgacattccccagttgctgaagatgttggagctggaccaaattggtgatcgatggtttggagctctttccaacgggcagacccggcgatctcgaatcgccaaggctctcatgaagcatcccgagcttctgctcatcgacgaccccttccttggtctcgatcccggtgccgctgaccttgtcagcaatgtctgcaaggaattgcctgagaccagaggtacacacgccattctgggtctgagatcccacgagacggtccccgactggatcacccacgtggcttacgccgataagtctggaatcgtggttgcaggagagaaatctctttctggtgagcttctcgagaaggcaaagactaagcatgacgaaaagatctttctccgaggagaacgagccaaacaggcccgggagaaactggcctctgatcaggacgccccctctgtactgaccatgaactccgtggatgtaacttactccggaaagcctgttctctccagcctgtcgtgggacgtcaagcctggacaaaagtggcatctgcgaggagtcaatggagctggaaaatctactctcctatctctgatcacagctgaccaccctcagtcctggaacgagaagattgtcatgtgcggaactcctcgagaagttggaaaccactcttacttctctatcaataatagaattggccatacctctcccgaaatccacgctctgttccccaagactcagaccgtgactgaagctattgacacggggtacattgttggaagtaacattcctcccaagaacctcactcccgagcagaaagagaagcgagatagtcttatttcgcactttgagcttgacgctgagcgagacacgcccttcaacgacctgactgttagccagcagaaggtggttctcttcatcagagctgtcatcaaaaacccagacattctgattctcgatgaggctctttctggtatggacgacgacgctgtcgatctctgtaaggagatgatggagtcttggcctggctctgtgattgccgttgctcatctggacgaagagctccccagctgcacccattatatccagctcaagcccaacgctgagcctgccgaaaccggccagctgtaa

SEQ ID NO: 27355 - protein, 500 aa, Yarrowia lipolytica CLIB99
MTRLPLISIKDAKFRMIGALASSGSNPYIFPNPISLTINPDEKWVISGPRKSQLMSILAAKHVSDPPLGRQYPFLKKKRVPSQVIQTLEFRGSINMGHLSARYEFFKDEFDMTLIEELKRASRDPATAMDDIPQLLKMLELDQIGDRWFGALSNGQTRRSRIAKALMKHPELLLIDDPFLGLDPGAADLVSNVCKELPETRGTHAILGLRSHETVPDWITHVAYADKSGIVVAGEKSLSGELLEKAKTKHDEKIFLRGERAKQAREKLASDQDAPSVLTMNSVDVTYSGKPVLSSLSWDVKPGQKWHLRGVNGAGKSTLLSLITADHPQSWNEKIVMCGTPREVGNHSYFSINNRIGHTSPEIHALFPKTQTVTEAIDTGYIVGSNIPPKNLTPEQKEKRDSLISHFELDAERDTPFNDLTVSQQKVVLFIRAVIKNPDILILDEALSGMDDDAVDLCKEMMESWPGSVIAVAHLDEELPSCTHYIQLKPNAEPAETGQL

SEQ ID NO: 27356 - DNA, 1632 bp, Cryptococcus neoformans var. neoformans JEC21
  CDS (1)..(1632)
atgcccccctcatctctacctctcgtaaggctacccccaaaagctgtcgtacatcgtttcggtgcacctacttcagctcctccttcatcggctttacttagatttccggttcaaggatggactatcaacagagaatcagcaaaacctgaaggatgggcaatcgtaggagatgctgacggtcgcaaggttgctgtggagacgctgttgagcagacatcgaatccaacctttttccccgcctccaggcccgttcccttatataacctcgctcatctcctcttccacagactcctggtcttctactactgaagcaccctcgaaacctatccgtcacctggcatttgcacgcccaccaacgacaggtgaatttacagattttactgctcgctatggagctctccttgaagaagacaggctgtcttacagggaaaacttgcagaaccttcacccgagaccgagtgatgaggatattgagagggttgcaaagctcatgaggatagggcacttgctcgatctccctactgtttcattctcatctggtcagactagacggggtagaatcgcaagtgccctgttgacaagacctgttttgttgctgttggaggatcctatggcaggtttggatgttcccagtcgaaaggaagtctccaaccttttgggagagctcaatgcaagtgaaactatcaagattgtcctcatccttagaggtaagggtggtgaagagatgccaacgtggatcacggatgtggccgaggtcagaaatggagaagtatggattggcaaacgggatgaatatgagcagaagcatgcagaagagcaggtccggaatcaggcgaaggtcgagcaggtggctgagaagagtgatgaagttcctggagaacccgtcatcaaacttgatggagtgtctgtatcatatggagagggcaccagacaagttctcaaggatatcaaatggaccgtcaagcccggagagaaatggcatctcattggggccaacggctccggtaagacgacactcctctcgctcattttaggacaccatccacgctcatactccttgcctgcttcatccctccttctcttctccaagcctcgtcgctccatccctagccctactcttcggactttgattggacacacctctccggaaatcttcgcctctttcccaagagggatggggctgagtgctttggaggctgtcggcagtggttttgaaggcattttctctaggagaaatcttacctcggagcaaaaggaacgagttaaatatcttttgggacaatttaaagaccttttgaaaccgtcttctctttctgggaagcccgcaccggatgtgactgtccaagaaattgccaaccgaaactttgctcacttcactccccctcagcaaggtctccttcttttcctccgtgccattgtacggaaaccaaagcttcttatccttgacgaacctagtcagggcatggacgaagtaatctgggaacgatgtaagggcttattggagaaagagtgggaagatgagggtaagggtatggctgttatcgtggtgagccattatgaagacgaggttccatggaaaaagggtagaggaaaggtcctcaaactcgatcaaggagtcgctactgtacaataa

SEQ ID NO: 27357 - protein, 543 aa, Cryptococcus neoformans var. neoformans JEC21
MPPSSLPLVRLPPKAVVHRFGAPTSAPPSSALLRFPVQGWTINRESAKPEGWAIVGDADGRKVAVETLLSRHRIQPFSPPPGPFPYITSLISSSTDSWSSTTEAPSKPIRHLAFARPPTTGEFTDFTARYGALLEEDRLSYRENLQNLHPRPSDEDIERVAKLMRIGHLLDLPTVSFSSGQTRRGRIASALLTRPVLLLLEDPMAGLDVPSRKEVSNLLGELNASETIKIVLILRGKGGEEMPTWITDVAEVRNGEVWIGKRDEYEQKHAEEQVRNQAKVEQVAEKSDEVPGEPVIKLDGVSVSYGEGTRQVLKDIKWTVKPGEKWHLIGANGSGKTTLLSLILGHHPRSYSLPASSLLLFSKPRRSIPSPTLRTLIGHTSPEIFASFPRGMGLSALEAVGSGFEGIFSRRNLTSEQKERVKYLLGQFKDLLKPSSLSGKPAPDVTVQEIANRNFAHFTPPQQGLLLFLRAIVRKPKLLILDEPSQGMDEVIWERCKGLLEKEWEDEGKGMAVIVVSHYEDEVPWKKGRGKVLKLDQGVATVQ

SEQ ID NO: 27358 - DNA, 1638 bp, Candida albicans SC5314
  CDS (1)..(1638): transl_table=12
atgagtaagacctcaactttaaaaaaatgtttggtgtcttttcaaaatgccaaatttaaaaaggatactttactgaaaactccttacatttaccccaatccaatatcaaatataaacatttatccagctaatgtccaaaatggctcgtcaatgtgggccgttactggtaactctaaaaccacaatgttaaaaattatagctggtgaatatattctgtacccaccattatcaaggcaatatccattaattaacgatcgaccaacacaattacagtttctcaattttagagatggatctgggttggataaagtgcatatgtcggcgagatacgaaacgtattcgtataaaggtgtattggaaatgctggatgatgtgaactcagtgtataattatgtcacagggttgaacaattataacactcagcacacatcaatatcccaggaatttgtcaatgaattgttggattatttcaagttacaacacttgaaacacaaatggattaacagtttgagtaatggacaattaagacgtgcaagaattgccaaatcgttgattaataaacccaagttgttaatcattgatgatccgtttttaggcttagatcccattaacactcaaggagttagtgaagcattgaagacagtgagtgaagaattggatacaagtattgttttaggattacgagtacaggacgatatacctgattggatcaatagtttatgttatgttgatgaatcaggggttaaattatctgggaataaactggaaattttaaatgagtataacgaattagtgagtcaaattacgacaacccataaatcacacgttagtcgtcacaataaacaacaacaacaacaacaatcaaaaccaattgaaatttcaaaaaataatcatttcacagagaatgacatccatattgagtttcaaaatgcttcagttgcctataaacaattagttatatttgatgattttaattggaaaataccaagggggagtaaatggagaattttaggagacaatggtactggaaaaacaacattattatctattattactgctgatcatcctcaatcatggaaatcggtgattaaagtgaatggtatattaaggaaaactggatcaggagttacatttttcgatatcaataacaaaataggtatttcatcccctgaattgcatgcattggttcctcaacacaataaaactatgaaagatattatttataatggattagttaaaaatgtgggtaattccaatttttatttcaaaggtgatcctaataatatcactgcaagaggacaaaagtatctacaatattttgcggacagaattgataaatacggagataccatatttaacgaattgagtttaacggatcagaaattagcattgtttttaagagcaattattaaagaaccagaattgttgattttggatgaagcattttcttgtatggacgatgaaaatgtaatgatcaaatgtcatgaattgatagaaaaagaattaaacgatactacagtgatatctattggtcatttagaatgggaattgtgcaaatacgattatatgatccaattgattaacgataataatggtagagattacaaaacattcaaaatcaattgggagatggcttag

SEQ ID NO: 27359 - protein, 545 aa, Candida albicans SC5314
MSKTSTLKKCLVSFQNAKFKKDTLSKTPYIYPNPISNINIYPANVQNGSSMWAVTGNSKTTMLKIIAGEYISYPPLSRQYPLINDRPTQLQFLNFRDGSGLDKVHMSARYETYSYKGVLEMSDDVNSVYNYVTGLNNYNTQHTSISQEFVNELLDYFKLQHLKHKWINSLSNGQLRRARIAKSLINKPKLLIIDDPFLGLDPINTQGVSEALKTVSEELDTSIVLGLRVQDDIPDWINSLCYVDESGVKLSGNKSEILNEYNELVSQITTTHKSHVSRHNKQQQQQQSKPIEISKNNHFTENDIHIEFQNASVAYKQLVIFDDFNWKIPRGSKWRILGDNGTGKTTLLSIITADHPQSWKSVIKVNGILRKTGSGVTFFDINNKIGISSPELHALVPQHNKTMKDIIYNGLVKNVGNSNFYFKGDPNNITARGQKYLQYFADRIDKYGDTIFNELSLTDQKLALFLRAIIKEPELLILDEAFSCMDDENVMIKCHELIEKELNDTTVISIGHLEWELCKYDYMIQLINDNNGRDYKTFKINWEMA

SEQ ID NO: 27360 - DNA, 1899 bp, Desulfovibrio vulgaris subsp. vulgaris str. Hildenborough
  CDS (1)..(1899): transl_table=11
atgaaacaactgaccgttcctctggtcgtggcccatcggcttcgcgtcactctcggtggacgcacggccctcgatggcgtcgacctcgtggtgcacgaaggcgcacaccttgccgtgctggggcccaacggggcgggcaagtccacgttgctacgcgccctgcgcggccagatgcagccggacatgcgccacggcggccgcctgctgtggcgcgccgtatccgcccctgacgggggtgtgcccgtatccggccagaggcgacacgcagggcagacggaccagacagggaaggcagggcacggcggggcacatcccacgcccggactctcgtcgcagaccgacgctggcacgtccgcctgggcggattccatccatggcgtgtcgtggcaggacaccatccccgcctccggtcacgtccacggcatggatgacgcgccactcacgggccgcgccctcgccgccctcgtgtctgcggcccagcaggaacagcatgtcaggcgagggtggaacatcacaggcgaagaactcgtactcggtggcctcttcgacacgcccatgccctacgaggaaccgacgccggaacaacacgcacgtctcgcgcccctcatggcacgcctcgacgcccacgacctcatgcacaccgccgtcccctcgctttcgcaggggcagctgcggctgttgctggtcgcccgcgccctgatacgtgccccccgcctgctgcttctcgacgaagtctgcgacgggctggacgccatggcacgtgcacgggtgctctacgccctgacgcaggccgcggatatgggcacgacactggtcgtggccgcccaccgtgccgtcgacctgccagaatgcgtcgtcgacggcatacggcttcacgccggacgcatcgtggcgcgtggtcctgcgacgtcgctgcttgcatcggaagagacccacgcaacgccccctccgggcatcgacgctggaaccccgcctcaccccgacaccgacaccgaagaatgctccgggcaatccgcagagacatcaccacgtaaggtcggcactccggatacggcacaccctgccccccccgaccgtcatgcaggtacacggcccggtgcgcggcaaggcggcgggcatgacgaccggtcagacgtccttccagatgaagagcacgacggcggacaggacgacatcctcgtgctggtgtcgaacgccaccgtcttcgtggaacgaacccccgtgctgcacaacgtggactggaccatccgccggggcgagcagtggctggtggccgggcccaacggggcgggcaagtcgacgctcctgcgcctgctggcgggcgaggagttcgctgcagcgggtggcgatgtccgcctcatgccccggacgtgcggcgaggcggcccgtggactcatggccttgcgccgtcatgtttccatcgtatccgacaggttgcaggccacctacgcctacgatgtcagcgtggaggattgtgtcctctcaggtgtcgaaggcaccatcggcctctacgaacagccttctcccgaagaacacgacagggccatgtactggatggacatcctcggcatcacgcatctggctggcagacacatccgcagcctttcgacagggcaggctcgccgtgtgttccttgcgcgtgccctgactgggtctccggtgctgcttctgctcgatgaaccgtgttccggccttgacgacgcaaaccgccacgccctgctgcaaacccttggcacacttacccgccacggggtgcacctcgtactggtaacacatcatgaggccgacatcatcccggagacgacacaccggctgcaactcgaagcggggcgcgtcgtgcacgccgggccatggaacccgctcaacggcggaggcatcgccgggggtgaaagagcatga

SEQ ID NO: 27361 - protein, 632 aa, Desulfovibrio vulgaris subsp. vulgaris str. Hildenborough
MKQLTVPLVVAHRLRVTLGGRTALDGVDLVVHEGAHLAVLGPNGAGKSTLLRALRGQMQPDMRHGGRLLWRAVSAPDGGVPVSGQRRHAGQTDQTGKAGHGGAHPTPGLSSQTDAGTSAWADSIHGVSWQDTIPASGHVHGMDDAPLTGRALAALVSAAQQEQHVRRGWNITGEELVLGGLFDTPMPYEEPTPEQHARLAPLMARLDAHDLMHTAVPSLSQGQLRLLLVARALIRAPRLLLLDEVCDGLDAMARARVLYALTQAADMGTTLVVAAHRAVDLPECVVDGIRLHAGRIVARGPATSLLASEETHATPPPGIDAGTPPHPDTDTEECSGQSAETSPRKVGTPDTAHPAPPDRHAGTRPGARQGGGHDDRSDVLPDEEHDGGQDDILVLVSNATVFVERTPVLHNVDWTIRRGEQWLVAGPNGAGKSTLLRLLAGEEFAAAGGDVRLMPRTCGEAARGLMALRRHVSIVSDRLQATYAYDVSVEDCVLSGVEGTIGLYEQPSPEEHDRAMYWMDILGITHLAGRHIRSLSTGQARRVFLARALTGSPVLLLLDEPCSGLDDANRHALLQTLGTLTRHGVHLVLVTHHEADIIPETTHRLQLEAGRVVHAGPWNPLNGGGIAGGERA

SEQ ID NO: 27362 - DNA, 1527 bp, Bacillus anthracis str. Sterne
  CDS (1)..(1527): transl_table=11
atggaatacgtaattgagatgaacaatattacaaaagtattcccaggcattgtagcgaatgacgatattacgctgcaagtaaaacagggagagatacatgctttacttggagaaaatggtgcagggaaatcaacgctgatgaatgtgttgttcggtttgtatcaaccagaacagggagagattaaaattaaaggaaatcctgttaaaattacaaatccgaatatagcaaatgaccttggtattgggatggtccatcagcattttatgcttgttcataattttacagttacagagaatattattctgggaaatgaaccgaagaaaaacgggaaaattgctgttgaagaggctgcaaaagaaattaagcaattatctgaacagtacggtttagctgttgatccacatgcgaaaattgaagatatttctgttgggatgcagcaaagggttgaaatattaaagactctttatcgtggtgcggagattttaatatttgatgaaccaactgcggtgttaactcctcaagaaattcatgagttgattcaaattatgaaaaagcttgtgcaagaggggaaatctatcattcttattacacataagttaaaagaaattatggaagtttgcgatcgttgtacaattattcgtaaaggtaaggggattggtactgttaatgtagcggaaactgatgagcataaacttgcagagttaatggtcggacgtcaagtgaattttaaaacagaaaaaatagaagctaaaccaaaggaagaagtactatctattgcaaacctaattgttcatgatacgcgcaagttacctgctgtaaaaggccttgacttaactgttcgtgcaggagaaatcgttgggattgcagggattgatggaaatggtcaaagtgaattaatagaggcgattactggtttacgaaaagttgagtcaggttctattgcaattaaaggaaaagaaataacaaattggcctgttcgaagaataacagggattggtcatattcctgaagaccgtcataaacacggacttgttctcgatttttctgttcgggacaatattgttttacaaacatactataaaaatccattttcaaagaaagggattttaaattttagtaaaatcacacaaaaagcaaaagcgcttattgaacagtttgatgtacgtacacctagtgaacaaacgttagctcgcgctctatctggtggaaaccaacaaaaggcaattattgcacgtgaagtagatcgtaatccagatttattaattgcagcgcagccaacccgtggtttagatgtaggtgccattgaatttattcataaaaaattgattgagcagagagataatggtaaggcagtattgcttttatctttagagctagatgaaattttaaatgtaagtgatcgagttgctgttatatatgaagggaaaattgtagcaattgtggatgcaaaagagacaaacgaacaacagcttggattattaatggccggcgggacagggaaagagaaggtgaacacaaatggctaa

SEQ ID NO: 27363 - protein, 508 aa, Bacillus anthracis str. Sterne
MEYVIEMNNITKVFPGIVANDDITLQVKQGEIHALLGENGAGKSTLMNVLFGLYQPEQGEIKIKGNPVKITNPNIANDLGIGMVHQHFMLVHNFTVTENIILGNEPKKNGKIAVEEAAKEIKQLSEQYGLAVDPHAKIEDISVGMQQRVEILKTLYRGAEILIFDEPTAVLTPQEIHELIQIMKKLVQEGKSIILITHKLKEIMEVCDRCTIIRKGKGIGTVNVAETDEHKLAELMVGRQVNFKTEKIEAKPKEEVLSIANLIVHDTRKLPAVKGLDLTVRAGEIVGIAGIDGNGQSELIEAITGLRKVESGSIAIKGKEITNWPVRRITGIGHIPEDRHKHGLVLDFSVRDNIVLQTYYKNPFSKKGILNFSKITQKAKALIEQFDVRTPSEQTLARALSGGNQQKAIIAREVDRNPDLLIAAQPTRGLDVGAIEFIHKKLIEQRDNGKAVLLLSLELDEILNVSDRVAVIYEGKIVAIVDAKETNEQQLGLLMAGGTGKEKVNTNG

SEQ ID NO: 27364 - DNA, 1593 bp, Staphylococcus aureus subsp. aureus MRSA252
  CDS (1)..(1593): transl_table=11
atgtcaaatttattagaagtcaacagtctgaatgtacaattcaattatgatgaaactacagttcaagcggtaaaaaacgtctctttcgaattacgaaaaaaacatatcctaggtattgttggtgaatcaggatcaggaaaaagtattaccgctaaatctattttagggctactaccagattatccggatcacacgttaacaggagaaattatttttaatgggcaatcgttaactaatttatcaacttcagcgttacaacaaattcgaggcaaggatatttcaatgatttttcaagatccactctcttcgttgaatccaagattaacgattggcaaacaaattacagaagtactatttcaacataaacgtgtatctaaatctgaagcaaagtcgatgacaatagacattttagaaaaagtaggtataaaacatgcaactcgacaatttgatgcttatccgcatgaactttctggtggtatgcgtcaacgtgtcatgatagcaatggcattgattttaaagccacaaattttaatcgcagatgaaccaacaacggcattagatgccagtacacaaaatcaattactgcagttaatgaagtccctttatgagtacacagaaacgtctattatttttatcactcacgatttaggtgctgtgtatcaattttgcgacgatgtgattgtaatgaaagatggaagtgtcgttgaaagtggcacggttgaaagtatttttaaatcgccacaacatacctatacgaaacgcttaatagatgcgattcctgatattcatcaaacgcgtccgccaagaccgttaaacaatgatattttattaaaattcgatcgcgtgagcgtggattacacatcaccgagtggcagcctataccgagcagttaatgatattaacttggctattagaaaaggcgaaacgttaggcattgtcggtgaatcagggtcagggaaatcgacattagctaagacggtcgtcggtctaaaggaagtgtcagaaggctttatttggtataacgaattaccattaagtttatttaaagatgatgaattgaaatctttacgacaagagatacaaatgattttccaagatccattcgcatctattaatccaagatttaaagtcattgatgtgattaaacgaccactaatcattcatgggaaagtcaaagataatgacgacattattaaaactatcgtatcgttgttagaaaaagttggcctagatcaaagtttcttatatcgctatccacacgaattatctggtgggcaacgccagcgtgtaagtatcgcaagagcacttgctgtagaacctaaagtgattgtttgcgacgaggcagtatcagctttagacgtttcaattcaaaaagatatcatcgagttattaaaacaattacagttagacttcggcatcacttatttattcatcacacatgacatgggtgttatcaatgaaatatgtgatcgagttgcagttatgaaaaatggcgaaatcgttgaacttaataacacagaagatattatcaaacatccgcaatcagactatgcaaagcaacttatttcagaagtagcagttattgctaaataa

SEQ ID NO: 27365 - protein, 530 aa, Staphylococcus aureus subsp. aureus MRSA252
MSNLLEVNSLNVQFNYDETTVQAVKNVSFELRKKHILGIVGESGSGKSITAKSILGLLPDYPDHTLTGEIIFNGQSLTNLSTSALQQIRGKDISMIFQDPLSSLNPRLTIGKQITEVLFQHKRVSKSEAKSMTIDILEKVGIKHATRQFDAYPHELSGGMRQRVMIAMALILKPQILIADEPTTALDASTQNQLLQLMKSLYEYTETSIIFITHDLGAVYQFCDDVIVMKDGSVVESGTVESIFKSPQHTYTKRLIDAIPDIHQTRPPRPLNNDILLKFDRVSVDYTSPSGSLYRAVNDINLAIRKGETLGIVGESGSGKSTLAKTVVGLKEVSEGFIWYNELPLSLFKDDELKSLRQEIQMIFQDPFASINPRFKVIDVIKRPLIIHGKVKDNDDIIKTIVSLLEKVGLDQSFLYRYPHELSGGQRQRVSIARALAVEPKVIVCDEAVSALDVSIQKDIIELLKQLQLDFGITYLFITHDMGVINEICDRVAVMKNGEIVELNNTEDIIKHPQSDYAKQLISEVAVIAK

SEQ ID NO: 27366 - DNA, 1476 bp, Erwinia carotovora subsp. atroseptica SCRI1043
  CDS (1)..(1476)
atgtcattgttgaaaatcacgcaaggattgtttcgtctcagcgatacccgcatgttgcgtttggacgaactgacgcttgaacaaaaccagtgctgggcctttgtcggggccaacggaagtggtaaatcggcactggcgcgggcgctatctggcgaactgccattattgagtggtgaacgaacaacggggtttcagcatcctgttcgcctgtcgtttgaacaattgcaaaagctggtttccgacgaatggcaacgcaataacaccgatctcctgagtgaaggtgaagatgacaccggccgcactacggcagaagtgattcaggatagcctcaacgatcccacacgttgccaacagttggcatgccagtttggtattgcgcatttgctagagcgtcgcttcaagtacctctcgacgggggaaacacgcaaggcaatgctttgtcaggcactgatgcctcagcccgatctgctgatccttgatgagccttttgatgggctggacgtcacctcccgccagcagcttgccgatgagctacggaagctggtagacacgggctatacgctggtactcattctgaaccggtttgacgacatccctgattttatcaaccatattggtgtgctggcagactgtacgctgacccgcattggtgagcgtgaagctattctctctgaagcgctggtggcacagctcgcttttagcgaaaaactgtcgggaagttcgctgccagaacccgaagatccacaacggcatgtgacacttcccgccgatgaagcacatattctgctacgcaacggcgtggtgcagtacaacgatcgccccattctgcatgagctgacatgggaagtgtttcccggccagcattggcagattatcgggccaaatggcgcagggaaatcgacgctgctcagcctgattaccggcgatcacccgcaaggctatagcaatgatctcaccctatttggccgtaagcgcggcagcggtgaaaccatctgggatatcaagcgccacatcggctacgttagcagcagcttgcatttggattaccgcgtcagcaccagcgtacgcaacgtcatcctgtctggtttttttgactctatcggtatttatcaggccgtctccgatcgtcaacgtcacctgaccgaacagtggctaatcctgcttgggctcagtggcgcgatcgccgatacgccgtttcaatcgctctcctggggccagcagcgtctgacgctgattgcccgcgcgttagtcaaacacccagcgctgctcatccttgacgaacctctacaggggcttgatccgctcaatcgccaactggttcgccgctggctggatatcttgattggcgagggagaaacgcagctactctttgtctctcaccacgcagaagacgcgcccgagtgcatcacacaccggctcactttcgtcccacacaatgacatctatcgctaccagattgatgaattatgtaaataa

SEQ ID NO: 27367 - protein, 491 aa, Erwinia carotovora subsp. atroseptica SCRI1043
MSLLKITQGLFRLSDTRMLRLDELTLEQNQCWAFVGANGSGKSALARALSGELPLLSGERTTGFQHPVRLSFEQLQKLVSDEWQRNNTDLLSEGEDDTGRTTAEVIQDSLNDPTRCQQLACQFGIAHLLERRFKYLSTGETRKAMLCQALMPQPDLLILDEPFDGLDVTSRQQLADELRKLVDTGYTLVLILNRFDDIPDFINHIGVLADCTLTRIGEREAILSEALVAQLAFSEKLSGSSLPEPEDPQRHVTLPADEAHILLRNGVVQYNDRPILHELTWEVFPGQHWQIIGPNGAGKSTLLSLITGDHPQGYSNDLTLFGRKRGSGETIWDIKRHIGYVSSSLHLDYRVSTSVRNVILSGFFDSIGIYQAVSDRQRHLTEQWLILLGLSGAIADTPFQSLSWGQQRLTLIARALVKHPALLILDEPLQGLDPLNRQLVRRWLDILIGEGETQLLFVSHHAEDAPECITHRLTFVPHNDIYRYQIDELCK

SEQ ID NO: 27368 - DNA, 1617 bp, Erwinia carotovora subsp. atroseptica SCRI1043
  CDS (1)..(1617)
atgtccagttcacctttattgcagatagatgatctcagcattgccttccgcaaaggcgatcaggagcagcgtgttgtcgaccagctttcactggcggtgaatgcgggtgagacgctggcgctggtcggcgagtcaggttcggggaaaagcgtcactgcactgtcggttttacgcttgctcccttccccacccgtggtttatccgcagggagatatccgctttgcggggcaatcgctgctacatgccgatgaaaaaacactgcgtcagatacgcggtaaccgaattgcgatgatctttcaggaaccgatggtgtcgcttaaccccctgcaaagcattgagaaacagctaattgaagtgctttcgctccattgtggcatgcgcaccgaggcggcccgtagcgaagtcatctcctgtctggatcgcgtgggtattcggcaggctaaaagccgattgaatgatttcccacaccagctttccggcggggaacgccagcgcgtcatgattgcaatggcgctgctgactcagcccgatttactcattgctgatgagccgacaacagcactggacgttaccgttcaggcgcaaatactgaaattgctgaacgagctgaagcgggaaatggggatgagcttactgttcatcacccacgatctgaatatcgtccgtcaattggcggataacgtgtcggttatgaaatcgggtaaagccgtggagcacaacagctgtcagcagcttttcagcgctccgcagcatccttacacacgccaattactggacgcagagccatcaggcgagccgcttccggtagaggatgacggtggccccctcctgcgggtggagcatttgcacgtttcattccctatcaaacgcggccttttgcgccgtaccgttgacgaaaagcaggtcgttaataatattagtttcaccttacggcgcggtgaaagcctgggtttggtaggggaatcgggttcagggaaaagcactaccggattagcgctacttcgcctgattcaatcacgcggtgatatctggtttgatggtcaacccttgcaagggctaacccgtaagcaaatgctgcccttccgtcaccggattcaggtcgtttttcaggacccgaactccgcgctgaacccacggctgaatgtggagcaaatcattgctgagggattgatcgttcatcacaaattgagtaaagaggcgcaagaacaacgcgtggtggcggtgatgcaggaagtcgggctggatcccaccactcgttaccgttatccctccgagttttccggcggtcagcgccagcgtatcgctatcgctcgggcactaatactgcaaccggaactgctgattctcgatgaacctacgtcgtcgctggacagaacggttcaggcgcaaattctggccctgctgaagtcattacaggaaaagcacaaaatcgcctacctgttcatcagccatgatttacaagttatccgctcactgtgtcatcaggttatcgtgttacgacagggtgaagtcgtcgaacagggggagtgtaaacaggtattcacgcatcctgccgagcattacacgcgggagctgctacagttttcatctggcatgacggaaacgcaatcggcataa

SEQ ID NO: 27369 - protein, 538 aa, Erwinia carotovora subsp. atroseptica SCRI1043
MSSSPLLQIDDLSIAFRKGDQEQRVVDQLSLAVNAGETLALVGESGSGKSVTALSVLRLLPSPPVVYPQGDIRFAGQSLLHADEKTLRQIRGNRIAMIFQEPMVSLNPLQSIEKQLIEVLSLHCGMRTEAARSEVISCLDRVGIRQAKSRLNDFPHQLSGGERQRVMIAMALLTQPDLLIADEPTTALDVTVQAQILKLLNELKREMGMSLLFITHDLNIVRQLADNVSVMKSGKAVEHNSCQQLFSAPQHPYTRQLLDAEPSGEPLPVEDDGGPLLRVEHLHVSFPIKRGLLRRTVDEKQVVNNISFTLRRGESLGLVGESGSGKSTTGLALLRLIQSRGDIWFDGQPLQGLTRKQMLPFRHRIQVVFQDPNSALNPRLNVEQIIAEGLIVHHKLSKEAQEQRVVAVMQEVGLDPTTRYRYPSEFSGGQRQRIAIARALILQPELLILDEPTSSLDRTVQAQILALLKSLQEKHKIAYLFISHDLQVIRSLCHQVIVLRQGEVVEQGECKQVFTHPAEHYTRELLQFSSGMTETQSA

SEQ ID NO: 27370 - DNA, 1380 bp, Desulfotalea psychrophila LSv54
  CDS (1)..(1380): transl_table=11
atggactttattaacttttctcactcaggcctgaaaatcaaagaactcaccattactccgggggatacctggtgcttttatggaggaaatctctcgggcagtgaagcgttcctccaactacttactggcaacctcggtcacgaaggaaaaaaacacccagccgtcctgcctcaggcgagcgtggtctcctttgataaactccaagaggtttttgaagcggaactggccaaggatgattcagatttccttgactaccttgatcccggtacagttgccggagacttcctgccccatggtagcctctaccacccccttgtcagcatcctgggaatgaaggaaaagctggaaaccggttttaagcagctcagctcaggtcaggcaagaaaactgcttctcctggaggccatccttggtgggaaaaaacatattattctgcacaccccctacgacggtttagacagcaaaagttgcctagagctcaaccttgccctccaggccctacccgaaaacctgaccctgctcctctttgttcataacatagatgacatacctgactggtgcagccacattggctggtttaaggacaatgccctctaccgccagggagactacaaagagattatcggcgatattcgaagtgaagagctggagatacgagagataaacctgcccagccagagccgtccctcctccgaagagctactctatcttcgggcaggatttggcagctaccagggaaaaaatgtctttaccggccttaatctacacatccactccggcgaccacctccttattaccggggccaacggctgcggcaagtcgaccctcctccagatcatcaccggagaccatcccgactgctacgtcaacgacctccgtctctttgcccataaacgaggcagcggcgagtctatctgggatatcaaaaaacagatgggtattgtctcccctgatctacatcgaaaccacagatgcccgggttctgccctgcatattgttatcagcggtctctatgacaccataggtctttatgtacgtcccagtcagcaggagattaaagagggattaaaatggattgcctggttgggcctagaggagaaagcggaaaagccatttcgcagcctgagctttgccgagcaacgactgatcctcatcgcccgaggtctaataaagattcctcgcctcctcatcctcgacgaggcaagtcagggactggacgaaagctaccgggaacagtttatgaccgttatagaaaaaattgcccgggaacagctctccaccatcctctttgtcagccaccgggaagatgaacatcgcgattttttcaaataccacataaaactgggtcagtatagcccgctaaacagagaggagaagtaa

SEQ ID NO: 27371 - protein, 459 aa, Desulfotalea psychrophila LSv54
MDFINFSHSGLKIKELTITPGDTWCFYGGNLSGSEAFLQLLTGNLGHEGKKHPAVLPQASVVSFDKLQEVFEAELAKDDSDFLDYLDPGTVAGDFLPHGSLYHPLVSILGMKEKLETGFKQLSSGQARKLLLLEAILGGKKHIILHTPYDGLDSKSCLELNLALQALPENLTLLLFVHNIDDIPDWCSHIGWFKDNALYRQGDYKEIIGDIRSEELEIREINLPSQSRPSSEELLYLRAGFGSYQGKNVFTGLNLHIHSGDHLLITGANGCGKSTLLQIITGDHPDCYVNDLRLFAHKRGSGESIWDIKKQMGIVSPDLHRNHRCPGSALHIVISGLYDTIGLYVRPSQQEIKEGLKWIAWLGLEEKAEKPFRSLSFAEQRLILIARGLIKIPRLLILDEASQGLDESYREQFMTVIEKIAREQLSTILFVSHREDEHRDFFKYHIKLGQYSPLNREEK

SEQ ID NO: 27372 - DNA, 1491 bp, Yersinia pseudotuberculosis IP 32953
  CDS (1)..(1491): transl_table=11
atgtctgagttgcaaatatcgcaaggttgttttcgcctgagtgacacacagacactcatcttgccagcgctacatatccaggcgggtgactgttgggcatttgtcggggccaatggcagtggtaaatctgcgttagccaaggccctgtctggagaactggccctgctggagggcagccgccaaagccacttccgccatggtgtgcgtttatcattcgaacaactacagcaactggtcaatgaagagtggcaacgtaataataccgacctgctcagtgctgatgaagatgacactggccgtactaccgccgaaattattcaggaagcggcccgtgacccgcagcgctgtcaacaactggcagcgctatttggaatcagccacttgctttctcgccgcttcaaatacctttctacgggggaaacccgtaaaacattgctgtgtcaggcgctgatgccgcaaccggacctgctgattctggatgagccctttgatggcctggatgtcgcggctcgggcgcagttagccgagatgctatccacactttcggcccaaggcgtcaccctggtattggtcctcaaccgctttgatgatatccctgattttgtgcagtacgttggcgtattggctgattgccacctgacccacatggggccgcgccagcagattctgtcggaagcgttaattgcccaattggcacacagtgaaaatctggatgggctgtcactgccggaaacggaggatccacagcaccacctacgaataccgaaaaatgaacccttgatcatactgaatgacggggtggtggagtacaacgaccgccctatcctgcataacctgagctggcaagtgaaccccggtgaacactggcagattatcggccagaatggtgcggggaaatccaccttactcagcctgataactggcgaccatccccaaggatacagtaatgatttaacgctgtttggccgccgccgtggcagtggtgaaaccatctgggacatcaaacgccatattggttatgtcagcggcagcctccatctggactaccgggttagcacccgtgtacgtaccgtgattttatccggttttttcgattcgattggtctttaccaagcagcctctgatcgtcaacaacaattagcagatcaatggctgtctttactggggttttccacctccgtcgccaaccaacctttccacagcttatcttgggggcaacagcgtctggtcttgatcgcccgagcattggttaagcacccagcgctcctgatcctggatgaaccattacaagggctggatccgcttaaccgtttgttagtgcgccgttttattgatgtgatgatcggtgaaggagaaacccaattattgttcgtttctcaccatgccgaggatgcaccccagtgtattacgcaccgcttaacctttgtgccatttggcgatatttatcactatcaacaagaaaaattaccaagccaaccacaggtaaaataa

SEQ ID NO: 27373 - protein, 496 aa, Yersinia pseudotuberculosis IP 32953
MSELQISQGCFRLSDTQTLILPALHIQAGDCWAFVGANGSGKSALAKALSGELALLEGSRQSHFRHGVRLSFEQLQQLVNEEWQRNNTDLLSADEDDTGRTTAEIIQEAARDPQRCQQLAALFGISHLLSRRFKYLSTGETRKTLLCQALMPQPDLLILDEPFDGLDVAARAQLAEMLSTLSAQGVTLVLVLNRFDDIPDFVQYVGVLADCHLTHMGPRQQILSEALIAQLAHSENLDGLSLPETEDPQHHLRIPKNEPLIILNDGVVEYNDRPILHNLSWQVNPGEHWQIIGQNGAGKSTLLSLITGDHPQGYSNDLTLFGRRRGSGETIWDIKRHIGYVSGSLHLDYRVSTRVRTVILSGFFDSIGLYQAASDRQQQLADQWLSLLGFSTSVANQPFHSLSWGQQRLVLIARALVKHPALLILDEPLQGLDPLNRLLVRRFIDVMIGEGETQLLFVSHHAEDAPQCITHRLTFVPFGDIYHYQQEKLPSQPQVK

SEQ ID NO: 27374 - DNA, 1743 bp, Yersinia pseudotuberculosis IP 32953
  CDS (1)..(1743): transl_table=11
atgaatggaattcaacatatcattactctggaggcggttgaaaaacggttcagcggactggatcaccctgcggttgccagcctgactacggagatccgcagcggagccgtgacgggattagtcgggccggacggtgccggtaaaaccacgttattacgtatgctggccgggttgctaaaacccactcagggtaagataaccgtggtcgggctagatccgttgaaagatgatcgccagctacatgccattctcggttatatgccgcagaaatttggcctgtatgaagatttaacggtcatggaaaacctgtcgctgtatgccgatttacgtggcgtgaccggtgaacttcggcgtcagacatttgagcgcctgctgacatttaccgatttaacccgcttcacatcacgtctggcgggtaagttgtcgggtggcatgaagcaaaagttggggttagcctgtaccttggtcggccaacccaaagtgctcctcttggatgagccgggggttggtgtcgatcccatctctcgccgtgaactgtggcgcatggtgcatgagctggcagacgacggcatgctcattttgtggagtacctcttatctggatgaagcagaacaatgtcgtgaagtgttgctgcttaatgaaggcaaattcctgtacagcggcgcaccacaaaccctgacgcagcgcatgagcgggcggactattttggtggccgcccaacgtggcaccaatcgccagttgctacaacatgccctgaccctgccccaagtcagtgacggggtgatccaaggtaaatatgtccggctgatccttaagccagatgtcgatcacagccagttattacaatggctaaatcaacccgatgcagaaatgaaggaggcggaaccccgttttgaagacgcctttattgacctgttaggtggtggcccggacagcgagtccgcactggcaaaaattatgcccagagtggctggcaaccctggtgaaaccgttattgaagcacaagcgctaaccaagaaatttggcgattttgccgcgactgaccatgtgaattttcaggttaaacgcggtgaaatatttggcctgctcgggccaaatggggccggtaaatccacgacgtttaaaatgatgtgtggcttattggtacccagtgatggaaaagccttggtactgggtatggatctgaaaaccagctcgggtaaagctcgccaacatctgggctatatggcacaaaaattttcgctgtacggcaacctgaccgttgaacaaaatctgaaatttttctccggggtttatggtctgaaaggcaaaacccagcgcgacaaaattgccgatatgatttcggcatttaacttcaccccgatcctgaaacaaacaccagactccctgccattagggtttaagcagcggcttgcactggcctgcgccttgatgcatgagccagatatcctgtttcttgatgagccaacctccggtgtcgatccgctcactcgccgtgaattctggttacacatcaatggaatggtagacaaaggcgtcaccgtcatggtgaccacccactttatggatgaagcggaatattgtgaccgtattgggctggtttatcgcggcaagattatcgccgccggtacgcccgatgaactgaaacaacaggttgccagtgatgatgaccccaatccgtcaatggaaacggcgtttatcgaattggttctgcgttatgaccaacagcatgataaggagtaa

SEQ ID NO: 27375 - protein, 580 aa, Yersinia pseudotuberculosis IP 32953
MNGIQHIITLEAVEKRFSGLDHPAVASLTTEIRSGAVTGLVGPDGAGKTTLLRMLAGLLKPTQGKITVVGLDPLKDDRQLHAILGYMPQKFGLYEDLTVMENLSLYADLRGVTGELRRQTFERLLTFTDLTRFTSRLAGKLSGGMKQKLGLACTLVGQPKVLLLDEPGVGVDPISRRELWRMVHELADDGMLILWSTSYLDEAEQCREVLLLNEGKFLYSGAPQTLTQRMSGRTILVAAQRGTNRQLLQHALTLPQVSDGVIQGKYVRLILKPDVDHSQLLQWLNQPDAEMKEAEPRFEDAFIDLLGGGPDSESALAKIMPRVAGNPGETVIEAQALTKKFGDFAATDHVNFQVKRGEIFGLLGPNGAGKSTTFKMMCGLLVPSDGKALVLGMDLKTSSGKARQHLGYMAQKFSLYGNLTVEQNLKFFSGVYGLKGKTQRDKIADMISAFNFTPILKQTPDSLPLGFKQRLALACALMHEPDILFLDEPTSGVDPLTRREFWLHINGMVDKGVTVMVTTHFMDEAEYCDRIGLVYRGKIIAAGTPDELKQQVASDDDPNPSMETAFIELVLRYDQQHDKE

SEQ ID NO: 27376 - DNA, 1593 bp, Yersinia pseudotuberculosis IP 32953
  CDS (1)..(1593): transl_table=11
atggcgacctcaccactattggatatccaaaacctcagtgttgcgtttagtcaggcaggcgttcagcgtgaggttgtcagcgaactgtcattacaaatcaacgcaggagaaacactggcgctggtcggggaatcaggatcggggaaaagcgtcaccgcgttgtccgtgttacgtttgctaccatcaccgccagtagtgtatcccacaggtgatattctgtttgcgggcagctcattgctacatgctaatgagccaacactacggcgcattcgtggtaatcagatttcgatgatcttccaagaaccgatggtgtcactcaacccgctgcataatattgaaaaacagttggcagaagtgctctcactgcaccggggtatggggcaagaagcggcgcgggctgaaattatccaatgcctcgacagagttggcattcgtaatgccaaagggcgattagccgattttcctcatcaactttctggcggtgaacgccagcgagtgatgattgccatggcggtattaacccaacccaaattattgattgccgatgagccaaccaccgcactggatgtttctgttcaggcgcaaattctgagcttgctgaaagagttaaagcaagagatgaacatgagcctgctgtttatcacccataacctgaatatcgtgcgccgattagcggataacgtggcggtgatgcgggaaggccgtaaagtggagcagaacaaccggcaggcgctcttcagtgccccgcaacacccctacactcgccagttactggatgctgagtcacagggtgccccgttgccactcgcgcagaatacccagccactgcttgtggttaaagagttgcaagttgcattcccgatcaaacgtggtttactgcgccgtaccgttgatcaccactatgcgctaaaaagcctcagttttgacctgaagcccggcgaaagtctgggcttggtgggggagtccggttcgggtaaaagtacctccggtctggccttgttacgcttattgccatcacagggtgaaatctggtttagcgggcaaccgctgcaccaatttacccccaaacagatgctgccctatcgcagccgtattcaggtggtcttccaggacccttactcagcattgaacccacgtttgaatgtgcaacagatcattgcggagggcctggaagtacatcaaaaactcagtgcagcgcaacgtgaagagcgagtgattaaggcaatggaagaagtcggattggatccagccacccgctctcgttatccaactgaattctcgggggggcagcgtcagcgcattgcgattgcccgcgcgctgatcctgcaaccccaactgttgatccttgatgaaccaacgtcttcactggataaatcggtacaggcgcaaattttggccctactgaaatcccttcagcagcgttaccaactcagctacttgtttattagccatgacttgcaggtcgtgcgttcgctctgccatcaggtgattgtcttaagacaaggagaagtggtggaacaaggtgattgtcaggcaatatttgcggcaccaaaacaactatatactcagcaattattagaattagcagactaa

SEQ ID NO: 27377 - protein, 530 aa, Yersinia pseudotuberculosis IP 32953
MATSPLLDIQNLSVAFSQAGVQREVVSELSLQINAGETLALVGESGSGKSVTALSVLRLLPSPPVVYPTGDILFAGSSLLHANEPTLRRIRGNQISMIFQEPMVSLNPLHNIEKQLAEVLSLHRGMGQEAARAEIIQCLDRVGIRNAKGRLADFPHQLSGGERQRVMIAMAVLTQPKLLIADEPTTALDVSVQAQILSLLKELKQEMNMSLLFITHNLNIVRRLADNVAVMREGRKVEQNNRQALFSAPQHPYTRQLLDAESQGAPLPLAQNTQPLLVVKELQVAFPIKRGLLRRTVDHHYALKSLSFDLKPGESLGLVGESGSGKSTSGLALLRLLPSQGEIWFSGQPLHQFTPKQMLPYRSRIQVVFQDPYSALNPRLNVQQIIAEGLEVHQKLSAAQREERVIKAMEEVGLDPATRSRYPTEFSGGQRQRIAIARALILQPQLLILDEPTSSLDKSVQAQILALLKSLQQRYQLSYLFISHDLQVVRSLCHQVIVLRQGEVVEQGDCQAIFAAPKQLYTQQLLELAD

SEQ ID NO: 27378 - DNA, 1764 bp, Yersinia pseudotuberculosis IP 32953
  CDS (1)..(1764): transl_table=11
atgtctgcttgtcacacccgtcttcacctacttttctgccactctgctgagatttcgtgcaaaactggaggcgatactctcgccatcttgtggcataatgcgcgccgaatcacattttttattcttcttgaatatccctattcagtcatcaaatcgagagcgagctctgtgctaagtactaacaatatcaccatgcaattcggcagcaagccgctgtttgaaaacatttcagtcaaattcggtggcggtaaccgctatggcctgatcggcgctaatggttgtggtaaatccacattcatgaagattctggggggcgatctggtccctagcggcggtaacgtcttccttgacccgaatgagcgtctgggtaaacttcgtcaggatcaattcgcctttgaaaacaatacagtgctggataccgttattatgggacacggcgaactgtgggaagtaaaagaagagcgtgaccgcatttatgccatggctgaaatgagcgaagaagatggctataaagttgctgatctagaagttgcctacggtgaaatggatggctacagcgcagaagcccgtgctggtgagttgttgctaggcgtgggtattcccgttgaacagcattatggcttgatgagcgaaatcgcacccggttggaagttacgtgtattgctggcgcaagccctgttctccgatccagaaattctgttacttgatgagccaaccaacaacctggatatcgatactatccgttggttagagcaggtgctaaacgaacgtaacagcaccatgattattatttcccatgaccgtcacttccttaacatggtgtgtacgcatatggcggatctggattacggcgaactgcgcgtttatccaggtaactatgatgagtatatgaccgcagcgactcaagctcgcgagcgtttgttgtcagataatgcgaagaaaaaagcccaaatatctgaactgcaatctttcgttagccgctttagcgccaacgcctctaaatctaagcaggcaacttcacgtgctcgccagattgataaaattcagcttgatgaggtaaaagcctccagccgccagaacccgtttattcgcttcgatcaggatagaaaactgttccgtaatgcgctggaagttgagatgttgaccaaaggttttgataacggcccgttgtttaaaaatctgactctccgcctggaagtgggtgagaaagtggctatcctcgggccgaacggtattggtaagtctactttgctgaaaaccctgctaggggagtatgaatctgatgctgggaccgtaaaatggtctgaaaacagtaagattggttactacgcacaggatcacgccagtgattttgacatcgatctgacggtgtttgactggatgagccagtggaagcaagagaaagacgatgagcaggcggttcgcagtgtgctggggcgtttattgtttagccaggatgacatcaagaaaaaagttagcgtgctgtctggtggtgagaaagggcggatgttgtttggtaagttgatgatgcagcgccctaacattttagtcatggatgaaccaaccaaccacttggatatggagtccattgaatctctcaatatggcattggaaatgtacgaagggacattaatcttcgtctcccatgaccgcgagtttgtgagttcactggcaacccgcgtgattgaaatgacgccgaataagcttatcgactttaccggtaactacgaagattatctgagtagccaagggattcagtcataa

SEQ ID NO: 27379 - protein, 587 aa, Yersinia pseudotuberculosis IP 32953
MSACHTRLHLLFCHSAEISCKTGGDTLAILWHNARRITFFILLEYPYSVIKSRASSVLSTNNITMQFGSKPLFENISVKFGGGNRYGLIGANGCGKSTFMKILGGDLVPSGGNVFLDPNERLGKLRQDQFAFENNTVLDTVIMGHGELWEVKEERDRIYAMAEMSEEDGYKVADLEVAYGEMDGYSAEARAGELLLGVGIPVEQHYGLMSEIAPGWKLRVLLAQALFSDPEILLLDEPTNNLDIDTIRWLEQVLNERNSTMIIISHDRHFLNMVCTHMADLDYGELRVYPGNYDEYMTAATQARERLLSDNAKKKAQISELQSFVSRFSANASKSKQATSRARQIDKIQLDEVKASSRQNPFIRFDQDRKLFRNALEVEMLTKGFDNGPLFKNLTLRLEVGEKVAILGPNGIGKSTLLKTLLGEYESDAGTVKWSENSKIGYYAQDHASDFDIDLTVFDWMSQWKQEKDDEQAVRSVLGRLLFSQDDIKKKVSVLSGGEKGRMLFGKLMMQRPNILVMDEPTNHLDMESIESLNMALEMYEGTLIFVSHDREFVSSLATRVIEMTPNKLIDFTGNYEDYLSSQGIQS

SEQ ID NO: 27380 - DNA, 1689 bp, Symbiobacterium thermophilum IAM 14863
  CDS (1)..(1689): transl_table=11
atgagccgtctgaccgccgaacaggtgaccctcgcctacggatcccaccccgtgatcaccggcctgagcctgtgcatcccggacggcgccgtgaccaccctcatcgggcccaacgggtgcggcaagtccaccctgctccgggcgctggcacgcctcttgcgcccccggggcggggcggtgctgctggacgggcaggccatccaccggctgcccacgaagcaggtggcccggcagctgggcctgctcagccaggaggccgccgtgcccgaggcgctgacggtggaggagctggttgagcgggggcggtacccccaccagtccccgcttcagccggcgacggccgtggaccgggcggcggtggagcgcgcccttgccctggtcgggctggccgacctccgggaccggcccgtcgaccggctctcgggcggccagcggcagcgggcctggatcgccatggccctggcccaggagacgccgatcctgctgctggatgagcccaccacctacctggacgtcgcccagcagcaggaggtcctctccctggtccagcagctgagccggaccgaaggccgcacggtggtgatggtgctgcacgacgtgaacgaggccgcccgggcgagcgaccacctggtggcgctgcgtgacggtgcggtcgtcgcggagggtccccccggggacgtcctgcagccggagctgctggagcagctcttcggcgtgccgtgctatgtggtctgccatccgcgcacgggtgcgcgcctctgcgtgccctgcggacgttggacagagatgctgcggaagggcatccccgtctcgacggcggagcggccgcccggggactcgccgtcccggggggcggcgctgcaggcggaagggctccgggtgggttacgaggggcgcatcgtcgtgaacgacctgtccgtctcgttcccggcgggccgggtgagcgccatcatcgggccgaacggctgcgggaagtcgacgctcctgaaggcgctggcccgcctcctcccccacgccgggggaaccgccctcctggacgggcggcccatcaccgccggcagccagcggtccttcgcccggcggctggccgtcctgagccagggcgccgcggcgccgccggaggtcacggtggaagagctggtggccatgggccgcttcccccaccagacctggtaccggcagtggagccgggccgaccaggaagccgtggagcgcgccctggaggccaccggcctcacgcacctgcggtcgcggccgctggcgagcctctccggcggccagcggcagcgggcctggctggcgatggccctggcccaggagaccccggtgctcctgctggacgagccgaccaccttcctggacgtcgtccaccaggtggaggtgctggatctggtacgggagctcaaccggaccgacaggaagacgatcatcatggtgctgcacgacctgtcccaggcgagccagtacgccgactacctggtggccatgaaggacggccgcgccgtcgcggcgggcactccccaggaggtactgtcctaccacctggtgcgggaggtgttcggcgtggaaagcgtggtgattccggacccgctgacccggcgccccctcgtcctgccgggccggtctgcggcgccctgcggtgagccgcaactccttcccctgcaggcggcggcccgggacgggggctga

SEQ ID NO: 27381 - protein, 562 aa, Symbiobacterium thermophilum IAM 14863
MSRLTAEQVTLAYGSHPVITGLSLCIPDGAVTTLIGPNGCGKSTLLRALARLLRPRGGAVLLDGQAIHRLPTKQVARQLGLLSQEAAVPEALTVEELVERGRYPHQSPLQPATAVDRAAVERALALVGLADLRDRPVDRLSGGQRQRAWIAMALAQETPILLLDEPTTYLDVAQQQEVLSLVQQLSRTEGRTVVMVLHDVNEAARASDHLVALRDGAVVAEGPPGDVLQPELLEQLFGVPCYVVCHPRTGARLCVPCGRWTEMLRKGIPVSTAERPPGDSPSRGAALQAEGLRVGYEGRIVVNDLSVSFPAGRVSAIIGPNGCGKSTLLKALARLLPHAGGTALLDGRPITAGSQRSFARRLAVLSQGAAAPPEVTVEELVAMGRFPHQTWYRQWSRADQEAVERALEATGLTHLRSRPLASLSGGQRQRAWLAMALAQETPVLLLDEPTTFLDVVHQVEVLDLVRELNRTDRKTIIMVLHDLSQASQYADYLVAMKDGRAVAAGTPQEVLSYHLVREVFGVESVVIPDPLTRRPLVLPGRSAAPCGEPQLLPLQAAARDGG

SEQ ID NO: 27382 - DNA, 1533 bp, Bacillus cereus E33L
  CDS (1)..(1533): transl_table=11
atggaatacgtaattgagatgaacaatattacaaaagtattcccaggcattgtagcgaatgacgatattacgctgcaagtaaaacagggagagatacatgctttacttggagaaaatggtgcagggaaatcaacactgatgaatgtgttgttcggtttgtatcaaccagaacagggagagattaaaattaaaggaaatcctgttaagattacaaatccgaatatagcaaatgaccttggtattgggatggtccatcagcattttatgcttgttcataattttacagttacagagaatattattctgggaaatgaaccgaagaaaaacggaaaaattgctgttgaagaggctgcaaaagaaattaagcaattatctgaacagtacggtttagctgttgatccacatgcgaaaattgaagatatttctgttgggatgcagcaaagggttgaaatattaaagactctttatcgtggtgcggagattttaatatttgatgaaccaactgcggtgttaactcctcaagaaattcatgagttgattcaaattatgaaaaagcttgtgcaagaggggaaatctatcattcttattacacataagttaaaagaaattatggaagtttgcgatcgttgtacaattattcgtaaaggtaaggggattggtactgttaatgtagcggaaactgatgagcataaacttgcagagttaatggtcggatgtcaagtgaattttaaaacagaaaaaatagaagctaaaccaaaggaagaagtactatctattgcaaacctaattgttcatgatacgcgcaagttacctgctgtaaaaggccttgacttaactgttcgtgcaggagaaatcgttgggattgcagggattgatggaaatggtcaaagtgaattaatagaggcgattactggtttacgaaaagttgagtcaggttctattgcaattaaaggaaaagaaataacaaattggcctgttcgaagaataacagaagaggggattggtcatattcctgaagaccgtcataaacacggacttgttctcgatttttctgttcgggacaatattgttttacaaacatactataaaaatccattttcaaagaaagggattttaaattttagtaaaatcacacaaaaagcaaaagcgcttattgaacagtttgatgtacgtacacctagtgaacaaacgttagctcgcgctctatctggtggaaaccaacaaaaggcaattattgcacgtgaagtagatcgtaatccagatttattaattgcagcgcagccaacccgtggtttagatgtaggtgccattgaatttattcataaaaaattgattgagcagagagataatggtaaggcagtattgcttttatctttagagctagatgaaattttaaatgtaagtgatcgagttgctgttatatatgaagggaaaattgtagcaattgtggatgcaaaagagacaaacgaacaacagcttggattattaatggccggcgggacagggaaagagaaggtgaacacaaatggctaa

SEQ ID NO: 27383 - protein, 510 aa, Bacillus cereus E33L
MEYVIEMNNITKVFPGIVANDDITLQVKQGEIHALLGENGAGKSTLMNVLFGLYQPEQGEIKIKGNPVKITNPNIANDLGIGMVHQHFMLVHNFTVTENIILGNEPKKNGKIAVEEAAKEIKQLSEQYGLAVDPHAKIEDISVGMQQRVEILKTLYRGAEILIFDEPTAVLTPQEIHELIQIMKKLVQEGKSIILITHKLKEIMEVCDRCTIIRKGKGIGTVNVAETDEHKLAELMVGCQVNFKTEKIEAKPKEEVLSIANLIVHDTRKLPAVKGLDLTVRAGEIVGIAGIDGNGQSELIEAITGLRKVESGSIAIKGKEITNWPVRRITEEGIGHIPEDRHKHGLVLDFSVRDNIVLQTYYKNPFSKKGILNFSKITQKAKALIEQFDVRTPSEQTLARALSGGNQQKAIIAREVDRNPDLLIAAQPTRGLDVGAIEFIHKKLIEQRDNGKAVLLLSLELDEILNVSDRVAVIYEGKIVAIVDAKETNEQQLGLLMAGGTGKEKVNTNG

SEQ ID NO: 27384 - DNA, 1470 bp, Mannheimia succiniciproducens MBEL55E
  CDS (1)..(1470): transl_table=11
atgagtaagttggctatgcggaatgcgcaattcgagctgcaccaaaataatttattaagtataccgcactttgaaattcattcttgtgatttctgggttgttatgggttataacggcagcggcaaaacggcattttctttggcgttggaaaagaaactttctttatacaacggagaatatcaaaatcagtttgacagcatcagtttgctctcttttgagaaacaacagaaaattctggagcagacatttaaagacttaaataatgatgaggcgcccgatgatttcggtaaaaccgctcgtgaaattattttaaacggtacggataaaaataatttatgtgaattttatgcgcagtatttgcatattgaaaaattattagaccgtccttttaccaagctttcaacgggtgaaagccgtaaggtgttattagcgcaggcattggtcagtgagcctgatttgttaattttagatgatccgtttgaaggcttagatcggcaatccgtgcaggattggctcaaattacttgaatcgttaaaaggcaaattggcattagttttgattgtaaatcggttttccgacattccaagtatagcggattttgtggcgattttagataataagcaaatgattttagcgggcaaacggcaggatattgaagggcaaagcgtttaccaacagttgaaatatgccgaagatgccgaagatgtgccgctaccaggcagcgcctcaccgttaatccgcttgccggaagggcagaatccttttgaattgaaaaatgtgactattcaatatggcgataaagttattttgaataacttaaactggacggtaaaagcaaaacagaattggtggattaaaggccctaatggtgcgggaaaatccaccttgctttcaattatcaccggcgatcatccgcaggcttttgccaatcatgtggttttgttcggtaagcggcgaggcagcggcgaaaccctgtgggatattaaacagaaaatcggttatgtcagcagtcagcttcatatggattaccgggtaaacagtaccgcgattgatgtgattatttcgggtttctttgatagtatcggagtataccggcaggttcccgacgctttacgtatcaaagcgatgcaatggttgtcccgtttaaatatggattcgctcgccaagaaaccttttcgttccctttcctgggggcaacaacgtttattattgattaccagagcgatggtgaagcatccgccggttttaatccttgacgaaccgctgcaagggctggacggcataaaccgtaaattggttaaaagttttattgaacagttggtctcaaacagtgaaacccaattactgtttgtttcccatcaagatcaggacgcgccgaattgcattacccatttatttgagtttataccgcaggaagaaggctattgctatcaacaaaaaacattggaatctgcggatattatggaataa

SEQ ID NO: 27385 - protein, 489 aa, Mannheimia succiniciproducens MBEL55E
MSKLAMRNAQFELHQNNLLSIPHFEIHSCDFWVVMGYNGSGKTAFSLALEKKLSLYNGEYQNQFDSISLLSFEKQQKILEQTFKDLNNDEAPDDFGKTAREIILNGTDKNNLCEFYAQYLHIEKLLDRPFTKLSTGESRKVLLAQALVSEPDLLILDDPFEGLDRQSVQDWLKLLESLKGKLALVLIVNRFSDIPSIADFVAILDNKQMILAGKRQDIEGQSVYQQLKYAEDAEDVPLPGSASPLIRLPEGQNPFELKNVTIQYGDKVILNNLNWTVKAKQNWWIKGPNGAGKSTLLSIITGDHPQAFANHVVLFGKRRGSGETLWDIKQKIGYVSSQLHMDYRVNSTAIDVIISGFFDSIGVYRQVPDALRIKAMQWLSRLNMDSLAKKPFRSLSWGQQRLLLITRAMVKHPPVLILDEPLQGLDGINRKLVKSFIEQLVSNSETQLLFVSHQDQDAPNCITHLFEFIPQEEGYCYQQKTLESADIME

SEQ ID NO: 27386 - DNA, 2736 bp, Mannheimia succiniciproducens MBEL55E
  CDS (1)..(2736): transl_table=11
atggcggatacattacttgccgtgcaggtggataagcttaaacatagttacggaaaaaccaccgcactttgcgacctgtcattacagattccgcgcggtaaaatcatcggcttgatcggtcccgacggcgtgggtaaatccacgctgttgtcgctgattgccggcgtaaaaattattcaatccggcagcgtaaccgtcttcggtctcaatgtagcggaaaaaaaggcgcgcgacctgttatcccacaaaattgcctttatgccgcagggtctgggtaaaaatctttatctgactttatcaatttatgaaaatattgattttcacgcccgtcttttcgggctgcccaaagcccatcgcaaagcgcgcatcgaacgtcttttaaacgcgaccggtctggcgccctttgcggatcgcgcggcgggcaaactgtccggcgggatgaaacaaaaactcagtctttgttgcgccttggtacacagtcccgatttacttattttagacgaacctaccaccggtgtagaccccctctcccgtcgccaattctggcaattggtggaggatctgcgtcgggaaacgccgggcatgacggtgatcgtcgcgaccgcctatattgacgaggcggaaggttttgaacaggtcattgccatggatgacggcaagctgattgcctataagccgaccaaacagctgattgcggaaaccgaaagcgaaaatctggaacaggcctatgtaaaattgctgccggcggacaaacgcgggtcggggaagggcttgaccattccgcctttcgaagtcgatgcgaacgagccgcccgttattgttgcgaaaggattaaccaaacgtttcggtgattttacttcggtggataatgtcagttttaccattcctaaaggagaaatcttcggctttttgggttccaacggctgcggcaaatccaccaccatgaaaatgctcaccggtttactcgaccctagcgaaggtacggcaaccttattgggacagcccattgacgccagcaatatagatacccgcaaacgagtgggttatatgtcgcaggcattctcgttatatgaagaattgacggtacgcgagaacctggaattgcacgcaaaactgttccagattccgccggcacaatggaatacctatgttcattccgccatggaacaattcgatctcgccgatctggcggatgaaaaaccctcttccctgcccttgggcattcgtcagcgtttacaactcgccgccgcctgtttgcacaaacccgaactgttaattttagacgaacccacctccggcgtggatcctgcggcacgggatatgttctgggaatatttgatcaaactctcccgcgaggatcgcatcaccattttcgtcaccacccattttatgaacgaagcggcacgctgcgaccgcatttcctttatgcaccgcggacgcgtactggctgtaggaacgccggaagaattacgaaccggcaaaaacgcagcgaccctggaagaagcttttatcatttatctggaagaacaggcggacgacatcaccgcgccaagcaatgaaaccggccaaagtgcggtcaaaaatgacgaagttttaccgcccgctgaaggattatgggcatggtggtctttaatctggacctttgccgtgcgtgaaggtaaagagctgctgcgggataatatccgcttattctttgctttattaggtccgattattatgcttatcgccatggcatccagcatttcttttgatattaatccgatgaaatttgccgtattggatcatgacaattcttcggcaagccgtcacttagttgaatattttagcggttcgagatatttcattcgtcaggcggatttgcattcggtggatgaaatcaactccaatattcaaagtgcaaaagttaaaatggtgcttgaaattccgacggattacggtaaaaaattacttaactggcagcaaccggaaataggtgtttttatagacggtgccttcccttctacggctgaaaatcttaacggttcggttatcggtgtgttgacccaatatcaacgggaaatatcgaaacatatcgacatgtcggtttcctctaccgtcttattggaacctcgctttgtatataatcaggatttcaaaagtatttttgccatgacgccgggcattattatgcttgccatgattttagtaccttcaatgatgaccgcgctcggtgtagtgcgtgaaaaagaaatgggctccattatgaatctttacggttcccccgcaagccctttgcaatttctactcggcaaacagatcccctacattattcttgcttttgtaagttatttagccgccgtttgcgtcgcgattatagtctttaaggtgccgattaaaggttcggtccttgcgatgttcttcggcgtgattctcgctttgctcgccaccacggcattcggcttattcgtttccgcttttgtgaaaacgcaaattgcagcgatctttgctacggcaattatttccatgatccctgccctgaacttttcaggcatgatttatcccgttaccacactaccggatacaatttatacggctgctcgtacctttcccggttattggttgcagcttgtgagtttgggcggttttaccaagggcctgaactttaccgatttcttcgattgttatttggctttaagtactatttttgccgtctacatcacattggcaacattattgctgaaaaaacaggaggtataa

SEQ ID NO: 27387 - protein, 911 aa, Mannheimia succiniciproducens MBEL55E
MADTLLAVQVDKLKHSYGKTTALCDLSLQIPRGKIIGLIGPDGVGKSTLLSLIAGVKIIQSGSVTVFGLNVAEKKARDLLSHKIAFMPQGLGKNLYLTLSIYENIDFHARLFGLPKAHRKARIERLLNATGLAPFADRAAGKLSGGMKQKLSLCCALVHSPDLLILDEPTTGVDPLSRRQFWQLVEDLRRETPGMTVIVATAYIDEAEGFEQVIAMDDGKLIAYKPTKQLIAETESENLEQAYVKLLPADKRGSGKGLTIPPFEVDANEPPVIVAKGLTKRFGDFTSVDNVSFTIPKGEIFGFLGSNGCGKSTTMKMLTGLLDPSEGTATLLGQPIDASNIDTRKRVGYMSQAFSLYEELTVRENLELHAKLFQIPPAQWNTYVHSAMEQFDLADLADEKPSSLPLGIRQRLQLAAACLHKPELLILDEPTSGVDPAARDMFWEYLIKLSREDRITIFVTTHFMNEAARCDRISFMHRGRVLAVGTPEELRTGKNAATLEEAFIIYLEEQADDITAPSNETGQSAVKNDEVLPPAEGLWAWWSLIWTFAVREGKELLRDNIRLFFALLGPIIMLIAMASSISFDINPMKFAVLDHDNSSASRHLVEYFSGSRYFIRQADLHSVDEINSNIQSAKVKMVLEIPTDYGKKLLNWQQPEIGVFIDGAFPSTAENLNGSVIGVLTQYQREISKHIDMSVSSTVLLEPRFVYNQDFKSIFAMTPGIIMLAMILVPSMMTALGVVREKEMGSIMNLYGSPASPLQFLLGKQIPYIILAFVSYLAAVCVAIIVFKVPIKGSVLAMFFGVILALLATTAFGLFVSAFVKTQIAAIFATAIISMIPALNFSGMIYPVTTLPDTIYTAARTFPGYWLQLVSLGGFTKGLNFTDFFDCYLALSTIFAVYITLATLLLKKQEV

SEQ ID NO: 27388 - DNA, 1461 bp, Bacteroides fragilis YCH46
  CDS (1)..(1461): transl_table=11
atgaaaccagctgtatctgtaaatgacgtgacgaaacgttacggggaggtagaagccctgaaaagtgctaccttttctgtaaatcccggcgaattattcggtattatcggcccggacggagcaggtaagagcactctcttccggatattgaccacattgttgctggccgatagcgggacagctacagtgaacggactcgatgtcgtgaaagactacaaacaaatccggcaacaagtgggatatatgcccggacgcttttcgctctatcaggatctgacagtggaggagaatcttgactttttcgctaccgtgtttcatacgaccattcgtgaaaactacgatctggtgaaagatatctatcagcaaatagagcctttccgtaaacgcagggcaggagctttatccgggggaatgaagcaaaaacttgctctgagttgtgcgttgattcataagccggagattctttttctggacgagccgactaccggtgtggatcctgtttcgcgcaaggagttctgggaaatgctgaggcatcttaaggatcaaggtatcacaattcttgtttccactccgatcatggacgaagcccgtcaatgcgaccgtatcgcttttatcaatgagggcgagatacaaggtatcgatgtgccggaacgtatcctgcaacgtttcagccatattctttgcccgcccggtctggaacgtacggaagtgcacgccggaaacgattttgccatcgaggtggatcaattgaccaagtgtttcggtcattttaccgcagtcgatcatatctcctttcgggtaaaccgtggagagatcttcggatttctcggagcaaacggtgcagggaagaccactgctatgcgcatgctttgcggactgagtaagcctacttcgggcatggcgcgggtagcaggttttgatgtagcggctcaccccgaagaggtaaagaagaatatcggttatatgagccagaagttttcgttgtatgaggaccttaaagtgtgggagaacatccgcctctttgccggaatttacggaatgcaggatcgggaaatagccgaaaagacagatgctcttcttgatcgcttgggcttcagcggagagcgtgacacacttgtgaaaagcctgcctttgggatggaaacagaaactggccttttccgtttcaatcttccacaatccccggatcgtgtttcttgatgaaccgacgggaggagtcgatccggctacccgccgtcagttctgggaactgatttatcaggctgccgaccgggggataacggtctttgtgactacccattacatggatgaagcagaatattgtaaccgtgtatctatcatggtggacggacgtatcgaagcacttgacaccccccgtgggttgaaggcgcattttcatgccgatacgatggatgatgtattccaacaactggcccgtaaggcagtgcgtaaagctgattag

SEQ ID NO: 27389 - protein, 486 aa, Bacteroides fragilis YCH46
MKPAVSVNDVTKRYGEVEALKSATFSVNPGELFGIIGPDGAGKSTLFRILTTLLLADSGTATVNGLDVVKDYKQIRQQVGYMPGRFSLYQDLTVEENLDFFATVFHTTIRENYDLVKDIYQQIEPFRKRRAGALSGGMKQKLALSCALIHKPEILFLDEPTTGVDPVSRKEFWEMLRHLKDQGITILVSTPIMDEARQCDRIAFINEGEIQGIDVPERILQRFSHILCPPGLERTEVHAGNDFAIEVDQLTKCFGHFTAVDHISFRVNRGEIFGFLGANGAGKTTAMRMLCGLSKPTSGMARVAGFDVAAHPEEVKKNIGYMSQKFSLYEDLKVWENIRLFAGIYGMQDREIAEKTDALLDRLGFSGERDTLVKSLPLGWKQKLAFSVSIFHNPRIVFLDEPTGGVDPATRRQFWELIYQAADRGITVFVTTHYMDEAEYCNRVSIMVDGRIEALDTPRGLKAHFHADTMDDVFQQLARKAVRKAD

SEQ ID NO: 27390 - DNA, 1455 bp, Bacteroides fragilis YCH46
  CDS (1)..(1455): transl_table=11
atggaacaatacacattcaatatagcgggtggcgtggcacgcaacccgcttgtgcgtttggcacaacctgtcacagcacaaatcgctaccggcgaacatatcgccatcgtaggacccaatgggggagggaaaagcttgtttgtagacacgcttttgggtaaatatcctttgcgtgagggtacattggactacgatttttctccttcttctacccggacggtatatgataacgtgaaatatattgctttccgtgacacctatggggcggcggatgccaactattactatcagcaacgctggaatgcccacgatcaggaagatgcccctacggtgcgggagatgttgggagagatcaaggatgaaagactgaaagaggaattgttcgaacttttccacatcgagccattgttggacaagaagatcattcttctttccagtggcgaattacgtaaatttcaactgactaaaaccctcctgacagctccccaggtattgattatggacaatccttttatcggtttggatgcacctacccgtgaattgcttttctcgctgctcgaacgtctcacccgcttgtcatccgtgcaaatcattcttgtgctttcgatgctcgatgatatcccttcgttcattacccatgtgattccggtagaagacctgcacgtgcttccgaaaatggaaagggaggcttatctggcttcattttgtgtgaccgatgaggcagaagtcctggacgcactgcaacagcgtatagccgaattaccttatgacggagcaaactatgactccggggaggtggtaaaattaaataaggtaagtattcgttatgatgaccgcaccatcctgaaggagctcgactggacagtccgccgaggtgaaaagtgggcattgagtggagaaaacggtgccggtaaatctacactgctcagcttggtttgtgcggacaaccctcagtcgtacgcctgtgacatcagtcttttcggacgtaagcggggtacgggcgaaagcatttgggagattaaaaaacacatcggttacgtcagtcctgaaatgcaccgtgcctatctcaaaaatctgccggccattgagattgtggcttccggattgcatgacagcatcggtttgtacaaacgcccgcaggaaagccagatggctgcctgcgagtggtggatggatgtgttcggcattgtggctctgaaggacaaaccttttcttcagctgtcgagcggtgagcagcgcctggcattattggcccgtgcttttgtgaaagatccggaattgcttattctggacgagccgctgcacggactcgatacgtacaatcgccggcgggtgaaaaagattatcgaagctttttgccgtcggcaggacaagacgatgattatggtaacccattacgaatcggaactcccttctaccatcaccgaccgccttttcctgaaaagaaatcgttga

SEQ ID NO: 27391 - protein, 484 aa, Bacteroides fragilis YCH46
MEQYTFNIAGGVARNPLVRLAQPVTAQIATGEHIAIVGPNGGGKSLFVDTLLGKYPLREGTLDYDFSPSSTRTVYDNVKYIAFRDTYGAADANYYYQQRWNAHDQEDAPTVREMLGEIKDERLKEELFELFHIEPLLDKKIILLSSGELRKFQLTKTLLTAPQVLIMDNPFIGLDAPTRELLFSLLERLTRLSSVQIILVLSMLDDIPSFITHVIPVEDLHVLPKMEREAYLASFCVTDEAEVLDALQQRIAELPYDGANYDSGEVVKLNKVSIRYDDRTILKELDWTVRRGEKWALSGENGAGKSTLLSLVCADNPQSYACDISLFGRKRGTGESIWEIKKHIGYVSPEMHRAYLKNLPAIEIVASGLHDSIGLYKRPQESQMAACEWWMDVFGIVALKDKPFLQLSSGEQRLALLARAFVKDPELLILDEPLHGLDTYNRRRVKKIIEAFCRRQDKTMIMVTHYESELPSTITDRLFLKRNR

SEQ ID NO: 27392 - DNA, 1650 bp, Burkholderia mallei ATCC 23344
  CDS (1)..(1650): transl_table=11
atgagcgccgcgcagatcgcgcgcggcgccggcgcgccgccgtcgccgtcgacgccgccgcatgagccgttgctgtcgatcgagcggctgcgcgtgcgcttcggcggcacgctcgccgtcgacgacgtatcgcttgcgatcggccgcggcgagcgcgtcgcgctcgtcggcgaatcgggctccggcaagagcgtcaccgcgctggcgatcctgcgcctgctgcgcgacgccgacgtgagcggcgcgatccgcttcgcgggcgagacgctcgccgacaagagcgagcgcgagatgcgcgcgctgcgcggcgcggacatcgcgatgatcttccaggagccgatgaccgcgctcaatccgctcttcacgatcggcgagcagatcggcgagacgatcgagttgcacgatggcgtatcgaagcgcgacgcgcgcgcgcgggcgatcgcgctgctcgcgcgcaccgggatcgaccggccggacgagcgcgtcgacagctacccgcaccagttgtcgggcggccagcggcagcgcgcgatgatcgcgatggcgctcgcatgccggccgcgcctgttgctcgccgacgagccgaccaccgcgctcgacgtgacgatccgcgcgcagatcgtcgagctgctgctcgaactgcagcgtgacgcggcggccgagcgcgggatggcggtgctgctcatcacgcacgatctgaatctcgtgcggcgcttcgccgagcgggtcgcggtgatggagaagggccggctcgtcgagtgcgggccggtcgagcggatcttcgatgcgcccgagcacccgtacacgcagcgcctgttgcacagccggccgcagcgcacggtgtcgcccgtgttgccgatcgcgcccgtcgtgctcgacgcgcgcggggtcaccgtgcagttcaggcagaagctgccgggcttcgcgggctggctccgctcggggcgcttcaccgcggtgtcggacgcgagcgtgtcggtgcggcagggcgagacgctcggcatcgtcggcgaatcgggctccggcaagtcgacgctcgcgatggcgctcctcgggctgcagcgggtcgcgcacggcgacatcgaattcgagggccgttcgctcgcgagctttcgcgggcgcgagcgcgtcgcgctgcgcgcgaacatgcaggtggtatttcaggatcccttcagctcgctttcgccgcggcagacgatcgggcggatcgtgtccgaagggctcgaactgcatcgccctcggctcacggccgacgcgcgccgcgacaaggtgatcgcggtgctgcgcgaagtcggcctcgatcggacggtgctgcatcgctatccgcacgagttctcgggcggccagcgccagcggatcgcgatcgcgcgcgcgctcgtgctggagccgcgcgtgctcgtgctcgacgagccgacgagcgcgctcgacgtgtcgatccaacaacaagtgttgaagctgctgtcgaatctgcaacgaaagtacaacctgggctacgtgttcatcagccacgatctggaggtgatcggcgcgatggcgcaccgggtggcggtgatgcagggcggggcgatcgtcgagacgggcgacgtcgagcgcatcttcaccgaaccggtgcatccttacacgcaaaaattgctgaaagccgttcgttaa

SEQ ID NO: 27393 - protein, 549 aa, Burkholderia mallei ATCC 23344
MSAAQIARGAGAPPSPSTPPHEPLLSIERLRVRFGGTLAVDDVSLAIGRGERVALVGESGSGKSVTALAILRLLRDADVSGAIRFAGETLADKSEREMRALRGADIAMIFQEPMTALNPLFTIGEQIGETIELHDGVSKRDARARAIALLARTGIDRPDERVDSYPHQLSGGQRQRAMIAMALACRPRLLLADEPTTALDVTIRAQIVELLLELQRDAAAERGMAVLLITHDLNLVRRFAERVAVMEKGRLVECGPVERIFDAPEHPYTQRLLHSRPQRTVSPVLPIAPVVLDARGVTVQFRQKLPGFAGWLRSGRFTAVSDASVSVRQGETLGIVGESGSGKSTLAMALLGLQRVAHGDIEFEGRSLASFRGRERVALRANMQVVFQDPFSSLSPRQTIGRIVSEGLELHRPRLTADARRDKVIAVLREVGLDRTVLHRYPHEFSGGQRQRIAIARALVLEPRVLVLDEPTSALDVSIQQQVLKLLSNLQRKYNLGYVFISHDLEVIGAMAHRVAVMQGGAIVETGDVERIFTEPVHPYTQKLLKAVR

SEQ ID NO: 27394 - DNA, 3216 bp, Burkholderia mallei ATCC 23344
  CDS (1)..(3216): transl_table=11
gtgagcgcgccgagcgtcgttcgtttttccgacgtcagcctgcgctacggcaagaccgtcgcgctcgagcggatcacgctcgagatcccggccggtctcacgatcgggctgatcgggccggacggcgtcggcaaatcgagcctgctcgcgctcgcggccggcgcgcgcgcgctgcagacgggcgcggtcgacgcgctcggcggcgacatgcgctcgcgccgccatcgcgagcgcgtgtgccggcgcatcgcgtacatgccgcaggggctcggcaagaacctgtatccgacgctctccgtcgaggaaaacctgcagttcttcgcgcgcctgttcggccacgacgccgacgagcgccgccgccggatcgacgcgctcacgcggagcaccggcctctttgcgttcctgtcgcggcccgcgggcaagctctcgggcgggatgaagcagaagctcggcctatgctgcgcgctgatccacgatcccgacctgctgatcctcgacgagccgacgaccggcgttgatccgctcgcgcgcgcgcagttctgggatctgatcgcgcgcattcgctcggagcggccggcgatgagcgtgatcgtcgcgaccgcgtacatggacgaggcgcaacgcttcgactggctgatcgcgatggacgcgggccgcgtgctcgcgacgggcgcgcccgccgagctgctcgcgcgcaccggctgcgattcgctcgaggcggccttcatcgcactgttgcccgaagacgaacggcgcggccacaagccggtgacgctcgagccgctgcgcgccgacgcgcaaaccggcaccgcgatcgaggcgcgcgggctgacgatgcgcttcggcgatttcaccgcggtcgatcacgtgagcttccggatccggcgcggcgagatcttcggctttctcggctcgaacggctgcggcaagtcgacgacgatgaagatgctcaccggcctgctgcccgcgaccgagggcaccgcgcagctgttcggcaagacagtcgatccgaaggacatcaatacgcgccggcgcgtcggctacatgtcgcaggccttctcgctgtatagcgaactgacggtgcggcagaacctcgtgctgcacgcgcggctgttcggcgtgccggccgccgagatcgacgcgcgcgtcgacgagatggcgcgccgcttcggcctcgccgacatctacgacatgctgccggacagcctgccgctcgggatgcggcagcggctgtcgctcgcggtggcgatggtgcacaagccggagctgctgatcctcgacgagccgacctcgggcgtcgatcccgtcgcgcgcgacagcttctggcagttgatgatcgacctcgcgcgccgcgatcgggtgacgatcttcatctcgacgcacttcatgaacgaggcgcagcgctgcgaccggatctcgctgatgcacgcgggccgcgtgctcgcgagcgatgcgccggcggcgctcgtgcgcgcgcgcggcgcggcgacgctcgaggaggccttcatcggctatctcgtcgacgcttcggcgcaggaggcgcaggaggcgcagggcggcgcgggcgagcgccccggcgcgggcgagcgcgcggcgggcgaaagcgtggccggtcgcggcgcggcgaccgatggcgatgccgacggcgcgcatgcgcggcccgccgcgtacgcgaacggcgcggcgcaacatcgcgcgcccgatgcggacgcggccggcaccgacgtcgccgccgagacgggcgcacgcgacgacgcgcgcaccgcacacgcggccggacattccgccggaaacgacgtacgcgccacggtgggctccgaagtcggctccgaagtcgcctccgaagccggcctcgcagccagcgccgaaagcggctccgaacgcggcgtcgcccacggcgccgaacgtgcacgcgaacccgcggcggatgccggcgccgcaatcgacgtcgaaccgggcgcgagcgcggaatcggccacggccgccgtcgccccggctcgccacgccgaatccgccgccacgtcaccccgcgcagggaacgcgccggccggcacgccgttcgccgccgcgccggccgagccgccccatcgcgcattcagcgcgcagcgcgcgctcagctacatgtggcgcgagatgctggagctgcgccgcgatcccgttcgcgcgacgctcgcgctgatcggctcgctcgtgctgatgtgcgtgatcggcatcggcatcagcctcgacgtcgaggatctgacctacgcggtgctcgaccgcgatcaaaccgagctgagccacgactacgcgctgaacctgtccggctcgcgctacttcgtcgagcggccgccgatcgccgattacgcggcgctcgaccgccggatgcgcgacggcgagctgtcgctcgcgatcgagattccgccgaacttcgcgcgcgacgtcgagcgcggcgcgcccgcgcagatcggcatgtggatcgacggcgcgatgccgcagcgcgccgagacgatccgcggctacgcgatcggcatgcacacgatgtggctcgccgacaaggcgcggcaccgcctcggcgtgacgctcgcgccgcgcgcggaagtggtcacgcgctaccgctacaacccggacgtgaagagcctgccggcgatgatccccgccgtgatgccgctgctgctgctgatgttgcccgcgatgctcaccgcgctcgccgtcgttcgcgaacgcgagctcggctcgatcctgaatctgtacgtgacgcccgtcacgcgcaccgagttcctgatcggcaagcaggtgccgtacgtcgtgctggcgatgctgaacttcctgctgatgacgatgctcgcgcgcatcgcgttcgacgtgcccgtcaagggcagcttcatgacgctgctgctcgcggtgctgatcttcaacgtcgtcgccacgggcatcggcctgctcgcgtcgacgttcacgcgcagccaggtggccgcgatcgtgatgacgatcatcggcacgatgatcccgaccgtgcagttcgcggggctgctcacgccgctgtcgtcgctcgagggcaccgggcgcttgatcggcctcgtctatccggccacctacatgctgtcgatcagccgcggcgtgttcaacaaggcgctgtcgctccacgagctctactcgcagttctggccgctcgccgcctgcgtaccggtgatcctcggcgcgaccatactgctcttgaaaaaacaggaacgctga

SEQ ID NO: 27395 - protein, 1071 aa, Burkholderia mallei ATCC 23344
MSAPSVVRFSDVSLRYGKTVALERITLEIPAGLTIGLIGPDGVGKSSLLALAAGARALQTGAVDALGGDMRSRRHRERVCRRIAYMPQGLGKNLYPTLSVEENLQFFARLFGHDADERRRRIDALTRSTGLFAFLSRPAGKLSGGMKQKLGLCCALIHDPDLLILDEPTTGVDPLARAQFWDLIARIRSERPAMSVIVATAYMDEAQRFDWLIAMDAGRVLATGAPAELLARTGCDSLEAAFIALLPEDERRGHKPVTLEPLRADAQTGTAIEARGLTMRFGDFTAVDHVSFRIRRGEIFGFLGSNGCGKSTTMKMLTGLLPATEGTAQLFGKTVDPKDINTRRRVGYMSQAFSLYSELTVRQNLVLHARLFGVPAAEIDARVDEMARRFGLADIYDMLPDSLPLGMRQRLSLAVAMVHKPELLILDEPTSGVDPVARDSFWQLMIDLARRDRVTIFISTHFMNEAQRCDRISLMHAGRVLASDAPAALVRARGAATLEEAFIGYLVDASAQEAQEAQGGAGERPGAGERAAGESVAGRGAATDGDADGAHARPAAYANGAAQHRAPDADAAGTDVAAETGARDDARTAHAAGHSAGNDVRATVGSEVGSEVASEAGLAASAESGSERGVAHGAERAREPAADAGAAIDVEPGASAESATAAVAPARHAESAATSPRAGNAPAGTPFAAAPAEPPHRAFSAQRALSYMWREMLELRRDPVRATLALIGSLVLMCVIGIGISLDVEDLTYAVLDRDQTELSHDYALNLSGSRYFVERPPIADYAALDRRMRDGELSLAIEIPPNFARDVERGAPAQIGMWIDGAMPQRAETIRGYAIGMHTMWLADKARHRLGVTLAPRAEVVTRYRYNPDVKSLPAMIPAVMPLLLLMLPAMLTALAVVRERELGSILNLYVTPVTRTEFLIGKQVPYVVLAMLNFLLMTMLARIAFDVPVKGSFMTLLLAVLIFNVVATGIGLLASTFTRSQVAAIVMTIIGTMIPTVQFAGLLTPLSSLEGTGRLIGLVYPATYMLSISRGVFNKALSLHELYSQFWPLAACVPVILGATILLLKKQER

SEQ ID NO: 27396 - DNA, 3225 bp, Burkholderia pseudomallei K96243
  CDS (1)..(3225): transl_table=11
gtgagcgcgccgagcgtcgttcgtttttccgacgtcagcctgcgctacggcaagaccgtcgcgctcgagcggatcacgctcgagatcccggccggtctcacgatcgggttgatcgggccggacggcgtcggcaaatcgagcctgctcgcgctcgcggccggcgcgcgcgcgctgcagacgggcgcggtcgacgcgctcggcggcgacatgcgctcgcgccgccatcgcgagcgcgtgtgccggcgcatcgcgtacatgccgcaggggctcggcaagaacctgtatccgacgctctccgtcgaggaaaacctgcagttcttcgcgcgcctgttcggccacgacgccgacgagcgccgccgccggatcgacgcgctcacgcggagcaccggcctctttgcgttcctgtcgcggcccgcgggcaagctctcgggcgggatgaagcagaagctcggcctgtgctgcgcgctgatccatgatcccgacctgctgatcctcgacgagccgacgaccggcgtcgatccgctcgcgcgcgcgcagttctgggatctgatcgcgcgcattcgctcggagcggccggcgatgagcgtgatcgtcgcgaccgcgtacatggacgaggcgcaacgcttcgactggctgatcgcgatggacgcgggccgcgtgctcgcgacgggcgcgcccgccgagctgctcgcgcgcaccggctgcgattcgctcgaggcggccttcatcgcactgttgcccgaagacgaacggcgcggccacaagccggtgacgctcgagccgctgcgcgccgacgcgcaaaccggcaccgcgatcgaggcgcgcgggctgacgatgcgcttcggcgatttcaccgcggtcgatcacgtgagcttccggatccggcgcggcgagatcttcggctttctcggctcgaacggctgcggcaagtcgacgacgatgaagatgctcaccggcctgctgcccgcgaccgagggcaccgcgcagctgttcggcaagacagtcgatccgaaggacatcaatacgcgccggcgcgtcggctacatgtcgcaggccttctcgctgtatagcgaactgacggtgcggcagaacctcgtgctgcacgcgcggctgttcggcgtgccggccgccgagatcgacgcgcgcgtcgacgagatggcgcgccgcttcggcctcgccgacatctacgacatgctgccggacagcctgccgctcgggatgcggcagcggctgtcgctcgcggtggcgatggtgcacaagccggagctgctgatcctcgacgagccgacctcgggcgtcgatcccgtcgcgcgcgacagcttctggcagttgatgatcgacctcgcgcgccgcgatcgggtgacgatcttcatctcgacgcacttcatgaacgaggcgcagcgctgcgaccggatctcgctgatgcacgcgggccgcgtgctcgcgagcgatgcgccggcggcgctcgtgcgcgcgcgcggcgcggcgacgctcgaggaggccttcatcggctatctcgtcgacgcttcggcgcaggaggcgcagggcggcgcgggcgggcgccccggcgcgggcgagcgcgcggcgggcgaaagcctggccggtcgcggcgcggcgaccgatggcgatgccgacggcgcgcatgcgcggcccgccgcgtacgcgaacggcgcggcgcaacatcgcgcgcccgatgcggacgcggccggcaccgacgtcgccgccgagacgggcgcacgcgacgacgcgcgcaccgcacacgcggccggacattccgccggaaacgacgtacgcgccacggtgggctccgaagtcggctccgaagtcgcctccgaagccggcctcgcagccagcgccgaaagcggctccgaacgcggcgtcgcccacggcgccgaacgtgcacgcgaacccgcggcggatgccggcgccgcaatcgacgtcgaaccgggcgcgagcgcggaatcggccacggccgccgtcgccccggctcgccacgccgaatccgccgccacgtcaccccgcgcagggaacgcgccggccggcacgccgttcgccgccgcgccgccgtcgcacgccgcgccggccgagccgccccatcgcgcattcagcgcgcagcgcgcgctcagctacatgtggcgcgagatgctggagctgcgtcgcgatcccgttcgcgcgacgctcgcgctgatcggctcgctcgtgctgatgtgcgtgatcggcatcggcatcagcctcgacgtcgaggatctgacctacgcggtgctcgaccgcgatcagaccgagctgagccacgactacgcgctgaacctctccggctcgcgctacttcgtcgagcggccgccgatcgccgattacgcggcgctcgaccgccggatgcgcgacggcgagctgtcgctcgcgatcgagattccgccgaacttcgcgcgcgacgtcgagcgcggcgcgcccgcgcagatcggcatgtggatcgacggcgcgatgccgcagcgcgccgagacgatccgcggctacgcgatcggcatgcacacgatgtggctcgccgacaaggcgcggcaccgcctcggcgtgacgctcgcgccgcgcgcggaagtggtcacgcgctaccgctacaacccggacgtgaagagcctgccggcgatgatccccgccgtgatgccgctgctgctgctgatgttgcccgcgatgctcaccgcgctcgccgtcgttcgcgaacgcgagctcggctcgatcctgaacctgtacgtgacgcccgtcacgcgcaccgagttcctgatcggcaagcaggtgccgtacgtcgtgctcgcgatgctgaacttcctgctgatgacgatgctcgcgcgcatcgcgttcgacgtgcccgtcaagggcagcttcatgacgctgttgctcgcggtgctgatcttcaacgtcgtcgccacgggcatcggcctgctcgcgtcgacgttcacgcgcagccaggtggccgcgatcgtgatgacgatcatcggcacgatgatcccgaccgtgcagttcgcggggctgctcacgccgctgtcgtcgctcgagggcaccgggcgcttgatcggcctcgtctatccggccacctacatgctgtcgatcagccgcggcgtgttcaacaaggcgctgtcgctccacgatctctactcgcagttctggccgctcgccgcctccgtaccggtgatcctcggcgcgaccatactgctcttgaaaaaacaggaacgctga

SEQ ID NO: 27397 - protein, 1074 aa, Burkholderia pseudomallei K96243
MSAPSVVRFSDVSLRYGKTVALERITLEIPAGLTIGLIGPDGVGKSSLLALAAGARALQTGAVDALGGDMRSRRHRERVCRRIAYMPQGLGKNLYPTLSVEENLQFFARLFGHDADERRRRIDALTRSTGLFAFLSRPAGKLSGGMKQKLGLCCALIHDPDLLILDEPTTGVDPLARAQFWDLIARIRSERPAMSVIVATAYMDEAQRFDWLIAMDAGRVLATGAPAELLARTGCDSLEAAFIALLPEDERRGHKPVTLEPLRADAQTGTAIEARGLTMRFGDFTAVDHVSFRIRRGEIFGFLGSNGCGKSTTMKMLTGLLPATEGTAQLFGKTVDPKDINTRRRVGYMSQAFSLYSELTVRQNLVLHARLFGVPAAEIDARVDEMARRFGLADIYDMLPDSLPLGMRQRLSLAVAMVHKPELLILDEPTSGVDPVARDSFWQLMIDLARRDRVTIFISTHFMNEAQRCDRISLMHAGRVLASDAPAALVRARGAATLEEAFIGYLVDASAQEAQGGAGGRPGAGERAAGESLAGRGAATDGDADGAHARPAAYANGAAQHRAPDADAAGTDVAAETGARDDARTAHAAGHSAGNDVRATVGSEVGSEVASEAGLAASAESGSERGVAHGAERAREPAADAGAAIDVEPGASAESATAAVAPARHAESAATSPRAGNAPAGTPFAAAPPSHAAPAEPPHRAFSAQRALSYMWREMLELRRDPVRATLALIGSLVLMCVIGIGISLDVEDLTYAVLDRDQTELSHDYALNLSGSRYFVERPPIADYAALDRRMRDGELSLAIEIPPNFARDVERGAPAQIGMWIDGAMPQRAETIRGYAIGMHTMWLADKARHRLGVTLAPRAEVVTRYRYNPDVKSLPAMIPAVMPLLLLMLPAMLTALAVVRERELGSILNLYVTPVTRTEFLIGKQVPYVVLAMLNFLLMTMLARIAFDVPVKGSFMTLLLAVLIFNVVATGIGLLASTFTRSQVAAIVMTIIGTMIPTVQFAGLLTPLSSLEGTGRLIGLVYPATYMLSISRGVFNKALSLHDLYSQFWPLAASVPVILGATILLLKKQER

SEQ ID NO: 27398 - DNA, 1641 bp, Methylococcus capsulatus str. Bath
  CDS (1)..(1641): transl_table=11
gtgccggtcggggccacaccctctcactcctttctctcggtaatcattttgatctctacagccaacgtcaccatgcagttcggcgtcaagccgctgttcgaaaacgtctccgtcaagttcggcgagggcaaccgttatggcctgatcggggccaacggctgcggcaagtcgaccttcatgaaaatcctcggcggcgatctggagccgaccgccggtaatgtttcgctcgacctcaacgtgcgtttgggcaagctgcgccaggatcagttcgccttcgaggaccagcgggtgctggacgtcgtgatgatggggcacaccgagatgtgggcggcgatgtccgagcgcgatgcgatctacgccaatccggacgcgagcgaggacgactacatgcgggcggcggagctggaggccgcctttgccgaatatgacggctataccgcggaagcccgtgccggcgaactgctgttgggtgtgggcattccgctggagcagcacgacgggccgatgagcgccgtggcgccgggctggaagctgcgcgtgttgctggcccaggcgctgttttccaacccggatatcctgctgctggacgaaccgaccaacaacctggacatcaacaccatccgctggctggaaaacgtgctgaacgcccgcaacagcaccatgatcatcatttcccacgaccggcacttcctcaacagcgtctgcacgcacatggcggacatggactatggcgagctgcggatctatccgggcaactacgacgattacatgatcgcctccacccaggcgcgcgaacgccagctggccgagaacgccaagaagaaggcccagatcgccgaactgcaggccttcgtcagccgcttctcggccaacgcctccaaggcccggcaggccacctcccgagcccgccagatcgagaagatcaagctggaggacatcaaaccctccagccgggtgaaccccttcatccgcttcaaccaggacaggaagctccatcgcctggccctggaagtggaagggctggccaagggctacggggaagagcccctgttccagggcctgaacctgatggtggaggcgggcgagcgggtggcggtgatcggccccaacggcatcggcaagaccaccctgctgcgctgcctggtgggcgacctggaggcggacgccggccaggtaaagtgggcggaaaacgccagcctgggctatttcgcccaggatcatgccgccgatttcgccgaggacatcagcctcttggactggatgggccggtggaagcgggaggcggacgacgagcagacggtgcgcggcaccctgggccgcctgctgttctcccaggacgagatcaagaaatcggtcaaggtgctctcgggcggagagcagggccgcatgctgttcggcaagctgatactgcgccagcccaacgtcatggtgctggacgagccgaccaaccacctcgacatggaatccatcgagtcgctcaacaccgcgctggaacactaccccggcaccctgatcttcgtcagccacgaccgcgagttcgtctcctccctggcgacccgtatcatcgagctgacgccgcagggcgtggtcaattaccgcggcacctatgacgagtacctgcagtcgcagggtctggaatag

SEQ ID NO: 27399 - protein, 546 aa, Methylococcus capsulatus str. Bath
MPVGATPSHSFLSVIILISTANVTMQFGVKPLFENVSVKFGEGNRYGLIGANGCGKSTFMKILGGDLEPTAGNVSLDLNVRLGKLRQDQFAFEDQRVLDVVMMGHTEMWAAMSERDAIYANPDASEDDYMRAAELEAAFAEYDGYTAEARAGELLLGVGIPLEQHDGPMSAVAPGWKLRVLLAQALFSNPDILLLDEPTNNLDINTIRWLENVLNARNSTMIIISHDRHFLNSVCTHMADMDYGELRIYPGNYDDYMIASTQARERQLAENAKKKAQIAELQAFVSRFSANASKARQATSRARQIEKIKLEDIKPSSRVNPFIRFNQDRKLHRLALEVEGLAKGYGEEPLFQGLNLMVEAGERVAVIGPNGIGKTTLLRCLVGDLEADAGQVKWAENASLGYFAQDHAADFAEDISLLDWMGRWKREADDEQTVRGTLGRLLFSQDEIKKSVKVLSGGEQGRMLFGKLILRQPNVMVLDEPTNHLDMESIESLNTALEHYPGTLIFVSHDREFVSSLATRIIELTPQGVVNYRGTYDEYLQSQGLE

SEQ ID NO: 27400 - DNA, 2724 bp, Methylococcus capsulatus str. Bath
  CDS (1)..(2724): transl_table=11
atgagcgccatcatccgggtcgaggagtgccgccaccgttatggcaaggtcgaagcgctcgcgggtatctcgctggaattgtccgccggcgggctgaccggcttcgtcggtccggacggggtggggaaatcgaccctgctgggtttgatcgccggcgtccgggcgctgcaggccgggcgtatcgaagtgttcggagcggacatcgccgatcccaaggcgcatcggcgcttgcgccaccgtatcgcctacatgccgcagggtctggggcacaacctgtatgcgacgctctcggtgtgggagaacgccgagtttttcggccggctgttcgggtttgacggaaaggagcggcgccggcggatcgagcgcctgctggcggcggttggactggcgccgttccgggatcgcccggcaggcaagctttccggcgggatgaggcagaagctcggcctctgctgcgccttgctgcatgagccggagctgttgatcctcgatgagccgaccaccggtgtcgatccgctgtcgcgtcggcagttctgggagctgatcgatacgctgaggcaggagcggcccggcatgaccgtcctggtcgccaccgcctacatggaggaggccgcgcgcttcgaccgtctggttgccatggacgccggccgcgttctggcgagcgggaccgcggcggaactgctggatcgcaccggcactgccgatatggagtcggcctacgtggccctgctgccgccggagaaaaggcgggggcatgaggcgctcgtgatcccgccgcgccggaacggccggggcgaggcggcgatcgaggccgtcgggctcacccgccgctttggcgatttcctggccgtggacggcgtgagcttccggatcgagcgcggcgaaatcttcggtttcctcggctccaacggctgcggcaagaccacgaccatgaagatgctcgccggactcctgccggccagcgccggctcggcctcgctgttcggccagccggtggcgtcggggaatgcggcgatgcgccgccgcatcggcttcatgtcgcagggattttcgctctacaccgagctgacggtcaggcagaacctggaactgcatgcccatatcttcggactggcgccttccgcgctcgaagcccggatcgcagagctggcggcccgcatgcatctggccgggcacctcgatgctctggccgaatcgctgccgctgggtatccgccagcgtctgtcactggcagtggcgctggtccacgatcccgagctgctgatcctggacgagccgacttcgggcgtcgatccggtcgcccgcgatcgtttctgggagctactggtggagctgtcgcgcgagaaaggcgtgacgatcttcatctcgacccatttcatgaacgaggcggcgcgctgcgaccgcatctcgctgatgcacgcgggacgggtgctcgcccagggcgcgcccgccgagctggtgcgggaggcgggggcgccctcgctggaggacgccttcatcgcttgcctggagcgggagagcgctcccacggccggtgtcgccgcggtggttccttccctcgctccggaagttgccggaccggcgcccgccgccagcccctggttcagtccccgccgcttcaacgcatacgtctggcgcgaaaccatggaactggcgcgcgatccgatccgcctcgccttcgcgctgctcgggccgatgctgctgatggtggtcatgggctacgggatttcgctggacgtcgagcatctgccctacgcggtcctcgactacgaccggacgccggaaagccgccgatatctggagcacttcgcccattcgcgctatttcgaggagcaggccccgctgcaagacgacgacgatatctcgagacggatggcgaggggccagctcaacttcgccgtggagattccgccgggtttcgggcgcgacctcaaggccgggcgtccggtcgaggtgggcgtccgcatcgacggcagcatcccgttccgcgccaacacggtgcaaggctatgtggaggccgtgcacgcccgtttccgcagcgacatgatggatgaaagcccggctcgcgcagcggccccgccgctgcgggtggaaacccgtttccgctacaatccggatctgaagagcgtctacgccctggtaccgggcgtgatcgcggtgatgctggcggtgattccgccgattctcacggcggtcagcgtggtgcgggaaaaagagatcggttcgatcacgaatctgtatgccacgccctcgacccgtctggagttcctgctgggcaagcagcttccctacgtcgtggtgggcctcgtcaacgccttgtccttgattgcgctggctctgtggttgttcggcgtaccggtgaagggggacctgtcggctctgttgctgggggccatgctggccgtcgccggaaccaccggctggggactgctgatttcggcgttcacgcgctcgcagatcgccgccctgttcgccgcgttcctgctgtccatcgtgcccgccatcaatttttcaggattcctggcgccggtggcctcccagaccggcgcggcggccgtgatgggctacgggtttccgacttcctggttcttgtccatcagcgtcggagtgttcaccaaggccttgggcttccccgaactctaccccaaccacgtcgtgctgctggccttcgtgctgggctatctggggctcagcctcgcgctgctccccagccggggacgttga

SEQ ID NO: 27401 - protein, 907 aa, Methylococcus capsulatus str. Bath
MSAIIRVEECRHRYGKVEALAGISLELSAGGLTGFVGPDGVGKSTLLGLIAGVRALQAGRIEVFGADIADPKAHRRLRHRIAYMPQGLGHNLYATLSVWENAEFFGRLFGFDGKERRRRIERLLAAVGLAPFRDRPAGKLSGGMRQKLGLCCALLHEPELLILDEPTTGVDPLSRRQFWELIDTLRQERPGMTVLVATAYMEEAARFDRLVAMDAGRVLASGTAAELLDRTGTADMESAYVALLPPEKRRGHEALVIPPRRNGRGEAAIEAVGLTRRFGDFLAVDGVSFRIERGEIFGFLGSNGCGKTTTMKMLAGLLPASAGSASLFGQPVASGNAAMRRRIGFMSQGFSLYTELTVRQNLELHAHIFGLAPSALEARIAELAARMHLAGHLDALAESLPLGIRQRLSLAVALVHDPELLILDEPTSGVDPVARDRFWELLVELSREKGVTIFISTHFMNEAARCDRISLMHAGRVLAQGAPAELVREAGAPSLEDAFIACLERESAPTAGVAAVVPSLAPEVAGPAPAASPWFSPRRFNAYVWRETMELARDPIRLAFALLGPMLLMVVMGYGISLDVEHLPYAVLDYDRTPESRRYLEHFAHSRYFEEQAPLQDDDDISRRMARGQLNFAVEIPPGFGRDLKAGRPVEVGVRIDGSIPFRANTVQGYVEAVHARFRSDMMDESPARAAAPPLRVETRFRYNPDLKSVYALVPGVIAVMLAVIPPILTAVSVVREKEIGSITNLYATPSTRLEFLLGKQLPYVVVGLVNALSLIALALWLFGVPVKGDLSALLLGAMLAVAGTTGWGLLISAFTRSQIAALFAAFLLSIVPAINFSGFLAPVASQTGAAAVMGYGFPTSWFLSISVGVFTKALGFPELYPNHVVLLAFVLGYLGLSLALLPSRGR

SEQ ID NO: 27402 - DNA, 1446 bp, Mycoplasma hyopneumoniae 232
  CDS (1)..(1446): transl_table=4
atgaatttagaactttataaaggcgcagcagtcgccctaattggcgaaaatggggctggaaaatcaagtctgatgaaagttttaagtggggtttatcaacctgattcagggaaaatgaacttttgtagtgataatatttgcaatcaaaaagttgaattttccggggtaattaattcccaaaaacaaggaattgccattattcaccaagagcaaaatttagttgaaagcctaagtgtttcccagaacattttcctgggacgggaatttcggaattcctttggacttttagattataaaaaacaagatgaagaagcaaaaaaacttttagatactttaggggctgaatttagtccaaaagcacttgtttcttcgctttcgatctcacaaaagcaatttatcgaaatcgccaaagctttatcccaaaaaccggaaattatcatttttgatgaaccgacttcggttctaaccgaaaaagatacccaaaaactttatctgcttgttgaaaaacttaaaaaacaaggaattgcaatcgtctgaattacccatagaatggaagaaattaagaaaacttgtgaatttatcactgtgattcgaaacggaatgtatattgaaagtaagccaataaatgaatttaaaaacgaagatgagattatttctttaatggtcggttttgatatcgagcagcgttatcccgaaaaaacgccggttagaagtaaaaaaccatcgtttttagttagaaatttatcaaatgataaagtttctaatatcagttttgaaatcaaaccaggtgaaattttagttttttatggccttgtaagttcaggtcgaactgaattagctagaactttaattggcgatatgccttatttgaatggtcatattgaactaaatggtcaagaatttcgcccaaaaaatattaaggacagtcttgatcatggaatttattatctttctgaaaataggaaacaaattggtctaaatgttaatttaccaattaattttaatatcacaatttcttctcttggctcaaatcagattttttctttccttccttttgtctcaaaagcaaaaataactaaaactacaaatcattatattaaacaattaaagatcaaaacaacttcacaagatactccattaacttctttatcaggtggaaatcaacaaaaagtctcacttgcaaaagggcttgcaactcaaccgcaagttttcatcctcgatgaaccaactcgcggagtcgatgttggagcaagaaaggaaatttataatttaattcaccaattaaaacaagaaaataaaacaattatgataatttcttcggatatgcaagaagttatcggaatcgctgatcgggtaattacaatgtatgaaggcagaattacaagtgaattagttggcccgcaaattaccgatcaaaatataatgaaatattcacttaatttatag

SEQ ID NO: 27403 - protein, 481 aa, Mycoplasma hyopneumoniae 232
MNLELYKGAAVALIGENGAGKSSLMKVLSGVYQPDSGKMNFCSDNICNQKVEFSGVINSQKQGIAIIHQEQNLVESLSVSQNIFLGREFRNSFGLLDYKKQDEEAKKLLDTLGAEFSPKALVSSLSISQKQFIEIAKALSQKPEIIIFDEPTSVLTEKDTQKLYLLVEKLKKQGIAIVWITHRMEEIKKTCEFITVIRNGMYIESKPINEFKNEDEIISLMVGFDIEQRYPEKTPVRSKKPSFLVRNLSNDKVSNISFEIKPGEILVFYGLVSSGRTELARTLIGDMPYLNGHIELNGQEFRPKNIKDSLDHGIYYLSENRKQIGLNVNLPINFNITISSLGSNQIFSFLPFVSKAKITKTTNHYIKQLKIKTTSQDTPLTSLSGGNQQKVSLAKGLATQPQVFILDEPTRGVDVGARKEIYNLIHQLKQENKTIMIISSDMQEVIGIADRVITMYEGRITSELVGPQITDQNIMKYSLNL

SEQ ID NO: 27404 - DNA, 1686 bp, Nocardia farcinica IFM 10152
  CDS (1)..(1686): transl_table=11
atgagtgggtcagcggccggaggcggcagcgcagcatcaccacacaggccgccccactcaggcggaatcgggcacagtatgagcgaactgctgcggatcgaccagctgcgggtgacctatcgcagcggcggcggcgcggtgaccgcgctggccggcgcctcgctgacggtcgctcccggcgaggtggtggcgttggtcggcgaatccggttcgggcaaatcgacgctcgcgcacgcggtgatcggcctgctgccgcgggccgcgcgaatcggcggtggccacatcgagttcgccgggctgcgcgtcgacaccgccgacgagcgcacgctgcggcggctgcggggggccaggatcggcttcgtcccccaggatcccgggctgtcgctgaacccggtgcggcgggtgggcgatcagatcgccgaagcgctgcgcgtgcacggcctggccgatccgcgcaccgcccgcgcccgtgtcctcgacctgctcgacgaggtgggcctggagcggtcgcagcgctgggagcggcgctatccgcacgagctgtccggcggccaacgccagcgggtgctcatcgccatcgcactggcctgcggaccggagctgatcatcgccgacgaacccaccagtgccctggacgcgacggtggcacgccgggtgctcgaccggctggccgagcggatcggcgcgcgcggcaccgccgtgctgctgatcacccacgatctggcgatggccgccgagcgcgccgaccggctcgtagtgctggtcgacggggagatcgtggagtccggccgtcccgccgacctgctcaccgcgccacggcatccctacaccgcgcgcttgctggccgcctcgccgagcctgcgctccgcgcccccgcgcccggcccgcccggcgaccggtgcgccgctgctggtgctgcgggaggtgcacaagcgctaccgcacgcccgcgggcacggtcaccgccgtggacggggtcggcttcgagctgcgccgcggggaaacgctggcgctggtcggcgaatccgggtcgggcaagtccaccacggcgcggatcgcgttgcggctgaccggcgccgaccgtggcagcgtgaccttcgacgggcacgacatcaccgcggtgcgcggcgcacggttgcgtgcgctgcgcaggcgcttccaggtggtgtaccagaacccctacggctcgctggatccacgccagtcgctggccacgatcatcgccgagccgttgcgcgccttcggcatcggcgaccgggccgcccgccgggcccgggtgcgggaactgctcggacaggtcgcgttgcccgagcactacgccgtccgccgtccggccgaactctccggcggccaacgtcaacgcgtcgcgatcgcccgcgcgctggcgctgcaccccgacctgctggtcctcgacgaaccggtctcggccttggacgcctcggtgcaggcccagatcctcgacctgctcgaacgcctgcaatccgagctggatgtgagctacctgttcatctcccacgacctcgcggtggtccggcgcatcagcgaccacgtggcggtgatgcggcacgggaaggtcgtcgaatccgggccgacggcggcgatattcgacgcgccgcgccacgagtacaccgccgagctgctcgcggcgatcccccacccccagctgtcccggaaaggaccgtcctga

SEQ ID NO: 27405 - protein, 561 aa, Nocardia farcinica IFM 10152
MSGSAAGGGSAASPHRPPHSGGIGHSMSELLRIDQLRVTYRSGGGAVTALAGASLTVAPGEVVALVGESGSGKSTLAHAVIGLLPRAARIGGGHIEFAGLRVDTADERTLRRLRGARIGFVPQDPGLSLNPVRRVGDQIAEALRVHGLADPRTARARVLDLLDEVGLERSQRWERRYPHELSGGQRQRVLIAIALACGPELIIADEPTSALDATVARRVLDRLAERIGARGTAVLLITHDLAMAAERADRLVVLVDGEIVESGRPADLLTAPRHPYTARLLAASPSLRSAPPRPARPATGAPLLVLREVHKRYRTPAGTVTAVDGVGFELRRGETLALVGESGSGKSTTARIALRLTGADRGSVTFDGHDITAVRGARLRALRRRFQVVYQNPYGSLDPRQSLATIIAEPLRAFGIGDRAARRARVRELLGQVALPEHYAVRRPAELSGGQRQRVAIARALALHPDLLVLDEPVSALDASVQAQILDLLERLQSELDVSYLFISHDLAVVRRISDHVAVMRHGKVVESGPTAAIFDAPRHEYTAELLAAIPHPQLSRKGPS

SEQ ID NO: 27406 - DNA, 783 bp, Streptococcus thermophilus LMG 18311
  CDS (1)..(783): transl_table=11
atgtcacttatacgcttagaaaatgtcagcttggctcgccaaggaaaaacactcttgtccaatcttaactggtcagttgaaaaaggccagacctgggctatccttggacttaatggtgcaggaaaatcaacacttctacgcttattgacagctgagttctttccttccgaaggtcatgctgaaatacttggctatacctttggtaatggagacatcacgggtcttcgcaaacatatcggtattgtcagttccttcatcactgagcgtctgcctaagcatatgactgcagaaaaaatcgtccttactggtaaatacaagagctcaatcctctacaaggcatatggggataaggagttgcaagaagctaaggacatgctgacctcacttggtgctggggatttgataggtcgtaaataccatggcctctctcaaggagaaaaacaaatttgtttgattgctcgcagtctcatggaagatcctgacatcattattcttgatgaagcgactgttggcttggacctatttgctcgtgaaaaactcttgcgtcagattgatcgtatcacctcgcttcctcatgctccactggttctttacgtcactcaccacgctgaggaaatcactgaaaacatggaccatattctcctactccgtcaaggaaaaatcgtagcacaaggacccaaaaatgatgtcatcacaccagaagtcttagctgacttctatcaaaatcctgttcaaattattccaattgacgaccatcgtttttacattaaccctcttttatag

SEQ ID NO: 27407 - protein, 260 aa, Streptococcus thermophilus LMG 18311
MSLIRLENVSLARQGKTLLSNLNWSVEKGQTWAILGLNGAGKSTLLRLLTAEFFPSEGHAEILGYTFGNGDITGLRKHIGIVSSFITERLPKHMTAEKIVLTGKYKSSILYKAYGDKELQEAKDMLTSLGAGDLIGRKYHGLSQGEKQICLIARSLMEDPDIIILDEATVGLDLFAREKLLRQIDRITSLPHAPLVLYVTHHAEEITENMDHILLLRQGKIVAQGPKNDVITPEVLADFYQNPVQIIPIDDHRFYINPLL

SEQ ID NO: 27408 - DNA, 1707 bp, Streptococcus thermophilus CNRZ1066
  CDS (1)..(1707): transl_table=11
ttgatatctcttctctttgttagtagaaacatggataaatacattagttttaatcagtttacatttcaatatgatgcgcaagcagaagcgacgcttaaagatatcagctttgatattgccaaaggcgagaaagtgctcattttaggcccttctggtagcggaaagtcgacccttgctcagtgtctcaatggtatcatacctaatatccataaaggtcaggcaaaaggccaggtaaggatagatggtcaggatattttcaagcaatctatctatgataagtcacagtcggtatctacggtattgcaggatccagatggtcagtttattggcctaacagtagccgaggatttggcttttgctttggagaatgattgtgctaatcaaagtgagatgaaggataaggtagcactctgggctgaacgtctagacttgacttctctttttaatcaccgccctcaagacttatcaggtggccaaaaacaacgagttagtttggctggagtcttgattgatgagagccctattcttttatttgatgagcctctagcaaatttagatcctaaatcaggacaggaaaccattgacctcattgataaaatccacaaggaggtgggagctacaacaattcttattgagcaccgtctagaagatgttctttatcgtcccgttgaccgtattttgctagtcaatgatgggcaacttctctttaacggtagcccagatgagcttttatcaagtactctcttactggaaaatgggattcgcgaacctctatatgtgacggttttacgtcagttgggatttgatacaactagagcacaaaatcttagccaactagatgctttggatttgtctggattaggtatcccagatagcgttttgaaagataaaagagacagttcaagtgattctattttgaaggttgaggggcttagcgtttcctatggggataatccagcgattatagaggatatgtcttttagcttgaaaaaaggtgagcgactagcgattgtcggtaaaaatggagctggaaagtcgacgcttgctaaagctctatgcggttttgtccctagtcaagggaaattaacttacgagggtcaggatatcagtcaggatagcatcgccgagcgttcagagcgtataggctttgttttgcaaaaccctaatcagatgattagccaaactatgatttttgatgaagtggctctaggtttacgcttgcgagggattgaagaaactgaggttgaagagcgtgttcatgaggtactgaagacttgtggcctttatagttttcgtaaatggcccatttctgcgctttcctttggtcagaaaaagcgtgtgaccattgcgtctatcttggtcttgagacctgaaatcattatcttggatgagccaacagctggtcaagattacaagacttacacggatatcatgaatttcttggacagtcttcagaagcaaggtcatacgattgtgatgattacccatgacatgcagctcatgttggaatatagcgatcgttgtctcgttgtggttgaggggaaaatcattgcagacgacaatcctgttacaattcttaatcagaaggatttacttgagtcagctaatctcaagcagacatctctgtatactttgggtcagaaattgtcaagtaatccagtagaagtaacccagtattatatcgaaaaaggaggtcctaatgtctaa

SEQ ID NO: 27409 - protein, 568 aa, Streptococcus thermophilus CNRZ1066
MISLLFVSRNMDKYISFNQFTFQYDAQAEATLKDISFDIAKGEKVLILGPSGSGKSTLAQCLNGIIPNIHKGQAKGQVRIDGQDIFKQSIYDKSQSVSTVLQDPDGQFIGLTVAEDLAFALENDCANQSEMKDKVALWAERLDLTSLFNHRPQDLSGGQKQRVSLAGVLIDESPILLFDEPLANLDPKSGQETIDLIDKIHKEVGATTILIEHRLEDVLYRPVDRILLVNDGQLLFNGSPDELLSSTLLLENGIREPLYVTVLRQLGFDTTRAQNLSQLDALDLSGLGIPDSVLKDKRDSSSDSILKVEGLSVSYGDNPAIIEDMSFSLKKGERLAIVGKNGAGKSTLAKALCGFVPSQGKLTYEGQDISQDSIAERSERIGFVLQNPNQMISQTMIFDEVALGLRLRGIEETEVEERVHEVLKTCGLYSFRKWPISALSFGQKKRVTIASILVLRPEIIILDEPTAGQDYKTYTDIMNFLDSLQKQGHTIVMITHDMQLMLEYSDRCLVVVEGKIIADDNPVTILNQKDLLESANLKQTSLYTLGQKLSSNPVEVTQYYIEKGGPNV

SEQ ID NO: 27410 - DNA, 1590 bp, Salmonella enterica subsp. enterica serovar Paratyphi A str. ATCC
  CDS (1)..(1590): transl_table=11
atgacatctccattgcttgcgattgaaaatttatcggtaggtttccgtcagcaacagcacgtgcgccctgtcgttaacgccatttcgttacaggtgaacgccggggaaacgctggcgctggtcggcgagtccgggtcaggaaaaagcgtgacggcgctttccattctgcgtcttttgcctacccctcccgccgtctacctctccggcgatattcgctttcacggcgaatcattgcttcatgccagcgagcagacgctacgcggcgtgcacggcaataaaatcgccatgatttttcaggaaccgatggtttcacttaacccgctgcatacgctggaaaaacagctctatgaagtgctgtcgctccatcggggaatgcgtcgggaggcggcaagagcggagatgatcggttgtctggatcgggtcggtatccgccaggcgagccagcgtctgcgcgattaccctcatcagctttccggcggcgaacgccagcgcgtcatgatagccatggcgctgttaacacggccggaattactgatcgccgatgagccgaccaccgccctcgacgtctccgtacaggcgcagattttatctctactgcgggaactccagcgcgagctcaatatgggattgctgtttatcacccataacctcagcattgtaaaaaaactggcggattcagtggcggtaatgcaacacggcaagtgcgtagagaaccaacgcgccgacacgctgctctccgcgccgccccatccgtacacgcaaaaactactcaacagcgaacccactggcgatccggttccgctccccgccgggcagacgccgttgctggaagtggacaggctgcgcgtcgccttcccgatccgcaaaggcattctgaagcgcgtcgtggatcataatgtggtggttaacaatatcagtttcaccctgcatccaggcgaaacgctgggtctggtcggcgagtcaggatcgggaaaaagcaccaccggtctggcgctgttacggcttatccgctccgaaggccgcatcgtatttgacggtcaatcgctggatacgttaaaccgccgccagcttttacctgttcgccaccgtatccaggtcgtattccaggacccgaactcatcgctaaacccgcgtttaaacgtgttgcaaattatcgaagaaggcctgcgcgtccaccagcctacgctttcaggcgcgcagcgcgaacagcaggtgaaagcggtcatgatggaagtcggcctggacccggaaacacggcatcgttaccccgctgagttttccggcggccagcgtcaacgtatcgccgtcgccagggcgctgattttaaaaccgtcgcttattattctggatgaaccgacctcatcgctggataaaaccgttcaggcgcagattcttgccctcctgaaatcgctccagcaaaagcaccgtctggcctatatcttcattagccacgatctgcatgtagtacgcacgctgtgccatcaggttatcgtgctgcggcagggggaggtggttgaacaggggcaatgcgagcgcgtgtttaccgcaccgcaacaggcctatacgcgtcagctactcgcgttaagctga

SEQ ID NO: 27411 - protein, 529 aa, Salmonella enterica subsp. enterica serovar Paratyphi A str. ATCC
MTSPLLAIENLSVGFRQQQHVRPVVNAISLQVNAGETLALVGESGSGKSVTALSILRLLPTPPAVYLSGDIRFHGESLLHASEQTLRGVHGNKIAMIFQEPMVSLNPLHTLEKQLYEVLSLHRGMRREAARAEMIGCLDRVGIRQASQRLRDYPHQLSGGERQRVMIAMALLTRPELLIADEPTTALDVSVQAQILSLLRELQRELNMGLLFITHNLSIVKKLADSVAVMQHGKCVENQRADTLLSAPPHPYTQKLLNSEPTGDPVPLPAGQTPLLEVDRLRVAFPIRKGILKRVVDHNVVVNNISFTLHPGETLGLVGESGSGKSTTGLALLRLIRSEGRIVFDGQSLDTLNRRQLLPVRHRIQVVFQDPNSSLNPRLNVLQIIEEGLRVHQPTLSGAQREQQVKAVMMEVGLDPETRHRYPAEFSGGQRQRIAVARALILKPSLIILDEPTSSLDKTVQAQILALLKSLQQKHRLAYIFISHDLHVVRTLCHQVIVLRQGEVVEQGQCERVFTAPQQAYTRQLLALS

SEQ ID NO: 27412 - DNA, 1572 bp, Salmonella enterica subsp. enterica serovar Paratyphi A str. ATCC
  CDS (1)..(1572): transl_table=11
atgcagttcggcagtaagccgctgttcgaaaacatttccgtcaaatttggcggcggcaaccgttacggcctgatcggcgccaacggtagcggaaagtccacttttatgaaaatcctcggcggcgacctggagccgacgctgggcaatgtttccctcgatccgaatgagcgcatcggtaagctgcgtcaggaccagttcgcttttgaaacattcaccgtacttgatactgtcattatggggcatggcgaactgtgggaagtcaagcaggagcgcgaccgtatctacgctttgccggaaatgagcgaagaagacggctataaagtcgccgatctggaagtaaaatacggcgagatggacggttattccgctgaggcgcgcgcgggcgaactgctgttgggggtgggcatcccgctggagcagcattacggtctgatgagtgaagtcgcgccaggctggaatttgcgtgtgctgctggcgcaggcgttattctctaatccggacatcctgttgctcgacgaaccgaccaacaacctggatattgatactatccgttggctggagcaggtgctgaacgagcgcgatagcacgatgatcatcatttcgcacgaccgtcacttcctgaacatggtttgtacgcatatggcggatctggattacggcgacttgcgcgtctatccgggtaactatgatgagtatatgacggcggcgacccaggcgcgtgaacgtctgttggccgataatgcgaagaaaaaagcgcaaattgccgagctgcaatcttttgttagccgttttagcgccaatgcctctaaatcgcgtcaggcaacgtcgcgcgcgcggcagattgataaaatcaagctggaagaggtgaaagcctccagtcgtcagaacccgttcatccgttttgagcaggataaaaaactgttccgtaacgctttggaagtggaagcgttgacgaaaggttttgataacggtccgctgtttaaaaatgtcaatttgctgctcgaagtcggcgagaagctggcagtactcggcaccaatggcgtgggtaaatctacgctgctgaagacgctggttggcgatctggacgccgatcatggcaccgttaaatggtcggaaaacgcgcgtattggttactacgcgcaggaccacgaatatgaattcgaaaatgacctgacggtgtttgaatggatgagtcagtggaagcaggaaggcgacgacgagcaggcagtgcgcagtattctgggccgcctgctatttagccaggatgatatcaaaaagcctgcgaaagtcctctccggtggcgagaagggccgtatgctgttcggcaaactgatgatgcaaaagccgaatatcctgatcatggacgaaccgactaaccacctggatatggagtcgatcgaatcgctgaatatggcgctggagctgtatcagggcacgctgatctttgtttcgcacgaccgtgagttcgtcagctcgctggcaacccgcgtcattgaaattacgccggagcgcgtggtggacttcagcggcaactacgacgattatttgcgtagtaaagggattgaaagctaa

SEQ ID NO: 27413 - protein, 523 aa, Salmonella enterica subsp. enterica serovar Paratyphi A str. ATCC
MQFGSKPLFENISVKFGGGNRYGLIGANGSGKSTFMKILGGDLEPTLGNVSLDPNERIGKLRQDQFAFETFTVLDTVIMGHGELWEVKQERDRIYALPEMSEEDGYKVADLEVKYGEMDGYSAEARAGELLLGVGIPLEQHYGLMSEVAPGWNLRVLLAQALFSNPDILLLDEPTNNLDIDTIRWLEQVLNERDSTMIIISHDRHFLNMVCTHMADLDYGDLRVYPGNYDEYMTAATQARERLLADNAKKKAQIAELQSFVSRFSANASKSRQATSRARQIDKIKLEEVKASSRQNPFIRFEQDKKLFRNALEVEALTKGFDNGPLFKNVNLLLEVGEKLAVLGTNGVGKSTLLKTLVGDLDADHGTVKWSENARIGYYAQDHEYEFENDLTVFEWMSQWKQEGDDEQAVRSILGRLLFSQDDIKKPAKVLSGGEKGRMLFGKLMMQKPNILIMDEPTNHLDMESIESLNMALELYQGTLIFVSHDREFVSSLATRVIEITPERVVDFSGNYDDYLRSKGIES

SEQ ID NO: 27414 - DNA, 1476 bp, Salmonella enterica subsp. enterica serovar Paratyphi A str. ATCC
  CDS (1)..(1476): transl_table=11
atgtcatcgttgcaaatttcgcaaggcacgtttcgtctgagcgatacaaaaacacttcatctggattcgctgacgctcaatgcgggcgatagctgggcattcgttggggctaacgggagcgggaagtcggcgctcgcccgcgcgctggcgggtgaactgccgttattaacaggcgagcgccagtgtcggtttacccgcattactcgtctgtcctttgaacaattgcaaaagctggtcagcgatgagtggcaacgtaataacaccgatatgctcagtcctggcgaagacgataccgggcgcactaccgcggaaattattcaggatgaagttcaccatcctgcccgctgtgcgatgctggcgcagcagttcggcatttccgctttactcgacaggcgttttaaatacctttctaccggcgagacgcgaaaagcgctgctgtgtcaggcgctgatgtctgagccggagttattgatccttgatgaaccgttcgacgggcttgacgtggccgcccgtcaccaactggcgcaacgcctgacggcgttgaaccaggcgggcattaccttggcgctggtactcaaccgttttgatgaaatcccggacttcgtgcagtttgccggcgtgcttgccaactgtacgctggcggagaccggaacgacggcagagttgctgcaacgggcgttggtcgctcaactcgcgcacagcgagcgtctggccgacgtacaattacccgaaccggacgaaccttccgcccgccatgcgttgcccgatggcgaaccacggatcgtacttaacgatggcgtagtctcgtataacgatcgccctatcctccaccacctaagctggcgagtaaatccaggcgaacactggcagatcgtcggtcctaacggggcgggtaagtctacgctgcttagccttattactggcgatcatccgcaaggctacagcaacgatctcacgctgttcgggcggcggcgaggaagcggcgaaacaatctgggatatcaaaaaacatatcggctacgtcagcagcagtttacatctggattaccgcgtcagtaccacggtgcgcaatgtcattctctccggctatttcgattctatcggcatttaccaggccgtttcagacaggcaacgaaaactggcgcaacagtggctggatattctgggaatcgataagcgtacggcggatgcccccttccacagtctctcctggggacagcagcggctagcgctgatcgtgcgcgcgctggttaagcatccgacagtgttgattctggatgagccgctgcaagggttggacccgctgaaccgccaactggtacgtcgttttgtggatgtattaattcgccagggagagactcaactgctgttcgtttcccatcatgcagaggatgcgcctacctgtattacccaccggctggaatttgtaccagagggcgaacgttataagtacgtttccggacgatgcaataattaa

SEQ ID NO: 27415 - protein, 491 aa, Salmonella enterica subsp. enterica serovar Paratyphi A str. ATCC
MSSLQISQGTFRLSDTKTLHLDSLTLNAGDSWAFVGANGSGKSALARALAGELPLLTGERQCRFTRITRLSFEQLQKLVSDEWQRNNTDMLSPGEDDTGRTTAEIIQDEVHHPARCAMLAQQFGISALLDRRFKYLSTGETRKALLCQALMSEPELLILDEPFDGLDVAARHQLAQRLTALNQAGITLALVLNRFDEIPDFVQFAGVLANCTLAETGTTAELLQRALVAQLAHSERLADVQLPEPDEPSARHALPDGEPRIVLNDGVVSYNDRPILHHLSWRVNPGEHWQIVGPNGAGKSTLLSLITGDHPQGYSNDLTLFGRRRGSGETIWDIKKHIGYVSSSLHLDYRVSTTVRNVILSGYFDSIGIYQAVSDRQRKLAQQWLDILGIDKRTADAPFHSLSWGQQRLALIVRALVKHPTVLILDEPLQGLDPLNRQLVRRFVDVLIRQGETQLLFVSHHAEDAPTCITHRLEFVPEGERYKYVSGRCNN

SEQ ID NO: 27416 - DNA, 1536 bp, Salmonella enterica subsp. enterica serovar Paratyphi A str. ATCC
  CDS (1)..(1536): transl_table=11
atgcaaatcagtcacaatactgcatcccctctgatttgtgtgcagaacatttataaaagttattccggcgtcgaagtactaaagggaattgactttactctgcatgcgggagaggtgcacgcattgcttggcggcaatggtgcgggtaaatcaacattaatgaagattattgccggtatagtcccgccagatggagggactatcgatattgctggtgtgcgttgcagtcatttaacgcctctgaaggcgcaccagtatggcatttacctggttccccaggagcctctgttatttccgagtttatctgtgcgggaaaatatcttgtttggcttacagggacgtcaggcctccacggaaaaaatgcagcagctattaaaggcgatgggatgccaactcgatccggcgagcgctgcgggtacgcttgatgttgcagaccgccagatcgttgaaattatgcgcggcttgatgcgcgactcgcgaatcttaattcttgatgagcctacggcgtcgttaacgccagccgaaactgaccggttatttacgcgtctgcaagagttgctgaaaaagggtgtcggaattgtatttatttctcataagctaccagaaattagacagttagctcactgcgttagcgtgatgcgtgacggtaaaatcgcattattcggaaaaacgcatgacctttctaccgacgagattattcaagctatcaccccggcaacgcagggcgtcagtctttccgcgaatcaaaagttgtggctggaattgcctggcagccgcccgcagaacgaacgcggcgcgacggtattagcgctggagtcactgacgggcgaaggttttatgaatatcaaccttgaggtgcgggcaggcgaaatccttggtctggccgggttagtcggcgcgggacgcacagaactggctgaaacgctgtacggtattagaccggtcaatgcggggaggatgctgttcaatggcgaagaaattaacgccctgacaacccaacagcggttgcagctcggcctggtctatttgccggaagatcggcagtcatccgggctgtatcttgacgcttccctggcatggaatgtctgttcgctgacccacaaccaaaaaggattttggataaagccccagcgggataacgccacccttgaacgttaccaccgcgcgttaaatatcaaactcaataatgccgaacaggcggcgcgtactttatccggcggtaaccagcaaaaagtattgattgccaaatgcctggaagcctctccgcaattactgattgtcgatgaaccgacccgcggtgtcgatgtctccgcccgcagcgacatttatcagctgttgcgcagtatcgcgcaacaaaatgtcgcagtgctgtttatttcctccgatctggaagagatagagcaaatggccgatcgcgtatatgtcatgcaccagggggaactgggggggcctgcattatgcggcgaggaaattaacgttgataccatcatgcacgttgcgtttggcgaacatggtgcgtcggaggcaacatgttga

SEQ ID NO: 27417 - protein, 511 aa, Salmonella enterica subsp. enterica serovar Paratyphi A str. ATCC
MQISHNTASPLICVQNIYKSYSGVEVLKGIDFTLHAGEVHALLGGNGAGKSTLMKIIAGIVPPDGGTIDIAGVRCSHLTPLKAHQYGIYLVPQEPLLFPSLSVRENILFGLQGRQASTEKMQQLLKAMGCQLDPASAAGTLDVADRQIVEIMRGLMRDSRILILDEPTASLTPAETDRLFTRLQELLKKGVGIVFISHKLPEIRQLAHCVSVMRDGKIALFGKTHDLSTDEIIQAITPATQGVSLSANQKLWLELPGSRPQNERGATVLALESLTGEGFMNINLEVRAGEILGLAGLVGAGRTELAETLYGIRPVNAGRMLFNGEEINALTTQQRLQLGLVYLPEDRQSSGLYLDASLAWNVCSLTHNQKGFWIKPQRDNATLERYHRALNIKLNNAEQAARTLSGGNQQKVLIAKCLEASPQLLIVDEPTRGVDVSARSDIYQLLRSIAQQNVAVLFISSDLEEIEQMADRVYVMHQGELGGPALCGEEINVDTIMHVAFGEHGASEATC

SEQ ID NO: 27418 - DNA, 1614 bp, Idiomarina loihiensis L2TR
  CDS (1)..(1614): transl_table=11
atgatcctggatgttgactacgtgatttctgctgcaaatatcaccatgcaatttggtgcaaagcctctttttgaaaatatttctgttaaattcggcaatggtaaccgttatggcctgataggcgctaatggctgcggtaagtcgacctttatgcgtatattaagtggtgagcaggagccttcggctggcaatgtgtcgctggaacccaatattcgcatcggtaagttgcgtcaggatcaatttgcttacgaagactacagtgtcgttgatgccgttattatgggccacgaagagctgtgggcggtaaaagaagaacgggaccgcatttacagcagcggcgaaatgagcgaagaagacggcatgcgtgtggccgatctggaaaccgaatttgctgaaatggacggttatactgcggagtcacgcgccggtgagttattgctggggctgggcataccggtagagcagcactttggactgatgtcggcgctggcgccgggtgtaaaaattcgggtgttactggcgcaggtactgttttccgagccggatattatgttgctggacgagccgaccaacaacctcgatattaacactattcgctggctggaaggcgtattagccgaaaagcaaagtaccatgattattatttcgcacgaccgtcactttctgaacacggtttgtacgcatatggccgatattgactatggcgagctgcgcgtctacccgggtaactatgacgaatacatgtttgccgccactcaggcgcgcgagcagttaatgagcgataacgccaagaaaaaagagaaaattgccgagctgcagagctttgttagccgcttctcagcgaacgcgtcaaaagctaaacaggcaacgtcgcgtcagaaacaaatggagaaaattcagctggacgaggttaaagcctccagtcgtgttaatccgtacattcgttttactcaggaaaagaaactctaccggttagcgcttgaaaccgagaacgtgcgtaagagcttcgaagacgaagcggtcttaaaaggcttgagtacctcgatagaagtgggtgaaaaagtcgctattattggtgccaacggtattggtaaaacgaccttgctgaaatgtttgatgggcgagtacacgccggactcaggcagcatcaaatggtctgaaaatgcggcgataggttactacgcgcaggatcacgcccactggtttaaacaggatatgaccgtttacgagtggatgtatcagtggaaaaaaccgggtgacgacgagcaggctattcggggtgtgttgggccgtatgctgttctcttctgatgacattcaaaagccggtatcgattttgtctggtggtgaaaaaggccggatgattttcggtaaactgattttgcagcgcccgaatattctggtgatggacgaaccgactaaccatttggatatggaatcgatagagtcgctgaacctggcactggagcagtttgaaggcactttgttgtttgtcagccatgaccgcgagttcgtctcgactctggctactcgtattatcgaaattaccgacaaaggcttacgtgactttgccggcagttacgatgaatatctggcgcagttggctgcggcttaa

SEQ ID NO: 27419 - protein, 537 aa, Idiomarina loihiensis L2TR
MILDVDYVISAANITMQFGAKPLFENISVKFGNGNRYGLIGANGCGKSTFMRILSGEQEPSAGNVSLEPNIRIGKLRQDQFAYEDYSVVDAVIMGHEELWAVKEERDRIYSSGEMSEEDGMRVADLETEFAEMDGYTAESRAGELLLGLGIPVEQHFGLMSALAPGVKIRVLLAQVLFSEPDIMLLDEPTNNLDINTIRWLEGVLAEKQSTMIIISHDRHFLNTVCTHMADIDYGELRVYPGNYDEYMFAATQAREQLMSDNAKKKEKIAELQSFVSRFSANASKAKQATSRQKQMEKIQLDEVKASSRVNPYIRFTQEKKLYRLALETENVRKSFEDEAVLKGLSTSIEVGEKVAIIGANGIGKTTLLKCLMGEYTPDSGSIKWSENAAIGYYAQDHAHWFKQDMTVYEWMYQWKKPGDDEQAIRGVLGRMLFSSDDIQKPVSILSGGEKGRMIFGKLILQRPNILVMDEPTNHLDMESIESLNLALEQFEGTLLFVSHDREFVSTLATRIIEITDKGLRDFAGSYDEYLAQLAAA

SEQ ID NO: 27420 - DNA, 2919 bp, Azoarcus sp. EbN1
  CDS (1)..(2919): transl_table=11
gtgagccaagcgctcggcgacgcagccccgagcgctgcgccgcgccccacctcgcggacgaccccgactgcgcccacgcaggcgaacgcgtcggcgccgccggtggtgcgcttgatcgacgtccgccaccggtacggcgacacgcttgcggccgacggcatcacgctccaccttccggccgggcgaatgatcggcttcatcgggccggacggcgtgggcaagtccaccttgctgagcctgatcgccggcgcgcgcaggatccagcacggcacggtggaagtgctcggcggcgacatcgccgatgcacgccaccgcacacgggtgtgccctcgcatcgcctacatgccgcaggggctgggcaagaacctctatcccacgctatcggtgttcgagaacatcgacttcttcggccgcctgttcggccagtcgcgcaccgagcgcgcacgccgcatcgccgaactgctcgccgccaccggcatgtcggccttcgccaaccgcccggccaacaagctctccggcggcatgaagcagaagctcggcctgtgctgcgcgctgatccacgaccccgatctgctgatcctcgacgagcccaccaccggcgttgatccgctgtcgcgccgccagttctgggaactcatcgcgcgcatccgcgcaggccgccccggcatgagcgtgctgatcgccactgcatatatggaagaggccgaaggctacgactggctggtggcggtggacgccggccgcgtgctcgccaccggcacgcccgacgaattgcgtaccgccggcggcgccgacaccctggaagaagccttcatcgcgctgctgcccaagacccgccgccaggaccaccgtcggctcgagatcccgccacacactgcaggcgagatcgtgatcgaggcgcgtgcactgcagatgcgcttcggcgacttcgtcgcggtcgatgatgtcaatctcgcggtgcggcgcggcgagatcttcggcttcctcggctccaacggctgcggcaagtcgaccacgatgaagatgctcaccggcctgctcgagcccagtgcgggtgaggccctgctgctcggcggtaaactggacgcgaagaacctggaaacccgccgtcgcgtgggttacatgtcgcaggccttctcgctgtatggcgaattgtccgtgcggcagaacctcgacctgcacgcccgcctgttcgacctcgccgacgacgaggccgagtcccgcatcggcgagctcgcccgccgcttcgacctcgacccggtgatgaacgtgccgccggacgcgctgccgctcggcatccgccagcgcctgcaactcgcggtggcggtgctgcaccgaccggatgtgctgatcctcgacgaacctacctcgggcgtcgacccggtggcgcgcgatcatttctgggaactgatcgtcgacctgtcgcgcaacgacggcgtgaccatcttcatcaccacccatttcatgaacgaggcgcagcgctgcgaccgcatctcgctgatgcacgccggtcgcatcctcgccagcgacaccccggcggcgctcgtcgaacgccgtggcaccgccagcctggaggacgcgtttgtcgcttggctgcaggacgcgatcgacggcgaaccgccgtctcgggcaacgcccgacccccacgccacgctgccgcaagcaacgctgccgcccgcgaccgtcccgcaagccggggctgccaccgtatccgtgcccgcacccgtaccggccgcaccgcatccgacgccagactcagcccaagcctcatcctcaaccagcaaacgccacgccggcttcagccttgcccgcctgctcagcctgtcggcgcgcgaagcgaccgagttgcgccgcgacccggtgcggctcacgctcgcactggtcggcacgctggtgctgatgctggtcatgggctacggcatcaacatggacgtggagaacctcagcttcgcggtgctcgaccacgaccgcagcgtggccagccagcgctacacgctgcgcatcgccggctcgcgctacttcaccgaacgccccgcactcgacagccatgtcgacctcgaccagcgcatgcgcagcggccggctgacgatggcgatcgaggtcccgcccggcttcggccgcgacctcgcgcgcggcaaggcgccacagatcgcagtgtggctcgacggctcgatgccgctgcgcgccgaactcgcacgcgcctacgtgagcggcgtgcatgggcagacgctcgccgacgcggtcgccgaatcgggcgcgagcgcctctgccgcgcccgccactatcgaagtgcgctaccgctacaaccccgaattgcgcagcctggtgtcgatggtgccgatggtgatcccgctgctgctggtgttcatcccggcgatgctgaccgcgctcggcgtagtgcgcgagaaggagctcggctccatcctcaacctctacaccaccccggtgacccgcttcgaattcctcgtcggcaagcagttgccctacatcgggctgtcgctgttcaacttcgtgctgctcttcatcttcgcggtcacgctattccaggtgccattcaagggcagcttcctcgccctggcctgcggcgccctgctctacgtcaccgccaccaccggactgggcctgctcgcttcgacgatgaccagcagccaggtggccgcgctcgccggcacctcgatcggcaccttgctgccggcgatccagttctccgggctgatggacccggtgtcctcgctcgagggcggcggcgcgctgatcggcgcgatctacccgaccacgcacttcctcaccatctcgagcggcaccttctccaaggcgctcggcttcgccgacctcggcggctcgttcctgccgctggcgacggcgatcccggtgctgaccctgctgtcggtcctgctgctgaaaaagcaggcccgatga

SEQ ID NO: 27421 - protein, 972 aa, Azoarcus sp. EbN1
MSQALGDAAPSAAPRPTSRTTPTAPTQANASAPPVVRLIDVRHRYGDTLAADGITLHLPAGRMIGFIGPDGVGKSTLLSLIAGARRIQHGTVEVLGGDIADARHRTRVCPRIAYMPQGLGKNLYPTLSVFENIDFFGRLFGQSRTERARRIAELLAATGMSAFANRPANKLSGGMKQKLGLCCALIHDPDLLILDEPTTGVDPLSRRQFWELIARIRAGRPGMSVLIATAYMEEAEGYDWLVAVDAGRVLATGTPDELRTAGGADTLEEAFIALLPKTRRQDHRRLEIPPHTAGEIVIEARALQMRFGDFVAVDDVNLAVRRGEIFGFLGSNGCGKSTTMKMLTGLLEPSAGEALLLGGKLDAKNLETRRRVGYMSQAFSLYGELSVRQNLDLHARLFDLADDEAESRIGELARRFDLDPVMNVPPDALPLGIRQRLQLAVAVLHRPDVLILDEPTSGVDPVARDHFWELIVDLSRNDGVTIFITTHFMNEAQRCDRISLMHAGRILASDTPAALVERRGTASLEDAFVAWLQDAIDGEPPSRATPDPHATLPQATLPPATVPQAGAATVSVPAPVPAAPHPTPDSAQASSSTSKRHAGFSLARLLSLSAREATELRRDPVRLTLALVGTLVLMLVMGYGINMDVENLSFAVLDHDRSVASQRYTLRIAGSRYFTERPALDSHVDLDQRMRSGRLTMAIEVPPGFGRDLARGKAPQIAVWLDGSMPLRAELARAYVSGVHGQTLADAVAESGASASAAPATIEVRYRYNPELRSLVSMVPMVIPLLLVFIPAMLTALGVVREKELGSILNLYTTPVTRFEFLVGKQLPYIGLSLFNFVLLFIFAVTLFQVPFKGSFLALACGALLYVTATTGLGLLASTMTSSQVAALAGTSIGTLLPAIQFSGLMDPVSSLEGGGALIGAIYPTTHFLTISSGTFSKALGFADLGGSFLPLATAIPVLTLLSVLLLKKQAR

SEQ ID NO: 27422 - DNA, 2829 bp, Zymomonas mobilis subsp. mobilis ZM4
  CDS (1)..(2829): transl_table=11
atgttcggacagagccttcggcacaatggccaagcctcaagtcggatcggggatgatacaatggcaaaaaattttgccgcttccgatttcgccgtttctatccagaatctgactcatcattatggcgataacgaagccttgcatcagattgatctggatctgccagccggtcaaactatcggcttggtcgggcccgatggcgtaggcaaatcgacactgcttggtattatttcgggggtaaaacgccttcaatccggcaaagtcaccacacttgatgcggatataggacaaaaaaaacaacgcgaagccgttctgcctcgggttgctttcatgccgcaaggtttggggcataacctctatccgactttgtcagtacaggaaaatatcgactttttcgcaagactgttcggtctcgatgccgaatatcggaaaacccgtattgcccagcttttggaagcgaccagcctcgcccctttttttgatcgtccggccggaaaattatccggtggtatgaagcaaaaggtcagcctctgctgcgctcttgtccataatcccgatttgcttattctcgacgaaccgaccaccggcgtggatcctctgtcgcggcaacaattctgggaattggtcgatgccttacaagccggtaatccctcgatgacggtaattgtctccactgcctatatggaggaggcggctcgtttttcatggctggttgctatggatgacgggaaagttttggcaaatggcaaaacgatagatattctaaaacaaaccggccaagatacggttgaaaaagcctatatttctcttctgccagaagaaaaacgtacccaagccagcggtttttcaattcctccctatcaaaataccgatccaaaacccgctatcgaggctaataacctcacttgtcgctttggctcttttacagcggtagataatgtcagctttcgtattggtcgaggcgagattttcggctttctcggctccaatggctgcggcaaatcgacaacgatgaaaatgctgacgggtctgctggacgcgaccagcggtacggccaaattattcggcaagccagtctctgcgggggatctcaatacacgtatgcggattggctatatgtcacaggccttttcgctttatgaagaattgacggtcaaacaaaatctggtgctgcaatcgcgcctttatcgggcaactgaaaaagaaaccgaacagcgtgttgatgatgcgctggataattttgaattacgcccctttgccgatatcagtccggctgatctccctttgggtatccggcaacgtttgcagcttgccgctgcttgtatcaatacccctgatattctcattcttgacgaaccgacctcgggcgttgatccggccgcgcgagatatgttctggcatcatctgatcgatctttcccgtaacaagcatgtaaccattttcgtctcaacccatttcatgaatgaagcggcctgttgtgaccgtatttccctgatgcatcgcggccatgtgctggcggttggcacaccagatgaattgatgaaaaagcggggagaaaaatcactcgaagccgcgtttatcgactatctccaagaccaaatgtcacaagacaaagataaccgtgacaaccagacctcttcctcgaatgtctctcttgagaatatttcggataataaaaaaaaggcgacgccctcgcctctctggcattggttgtcttatgtctgggcttttgcaaggcgcgaaagccttgaactattaagggataaattacgcctgacctttgcagttgcagggcccattatcctgcttttggtctcggcctatagtatttcctttgacatcaataaaatcagcttcaccgtctgcgaccaagatcaaagcaacgaaagccgcagcttggtcaaaaccttccaaggctcatcctatttcacagaaaaagcggcctcttccagcatcgctgaaatgaacaaacgccttagtgatgggacagcacagatgacgcttgatattcctgccggtttcggtcgggatatcgaggccggtcgccatccctctctcggtatcgggatcagcggtgcgatgccttttcttggggcaaatattcaatcctatgccacgaatgccctgttacaatatgcccaattatcggcacagggattaacgcataatgcgccttcttcgctgcctttttcgattgaaccccgctttgtctataatcaagaatttctcagcatttatacgatggtgccagataccatcatgctggccttaattctaatcccgaccatgctgacggcgcttggcgtcgttcgggaaaaagaaattggttcaattatcaatctctatgcctctccggcttcaactcgacaatatcttatcgggaaacagcttccctatgttgctattgcgatgctggcctatctctcgctggtggtgctgtcagtcacgattttaggcgttcctttgaaagggtcttttttagcactttccctaggcgcattgctctataatcttgctgcaaccggcctcggccttttgatctcgacttttgtcagctcccaagtcgcagcgattttcggaacggccattttgtgcctcattccggcagtcaatttttcggggctgctataccctgtttcaacattaacgggcatttcctatcatgttggacgctgttttccggcatcatggttccagctaatcagtcttggcagttttaccaagggtcttggttttacggcctttttgacgatgtatggggctttaacgggatttgcccttctctatctcgcccttgcctgcgtcctccttcggaaacaggagctataa

SEQ ID NO: 27423 - protein, 942 aa, Zymomonas mobilis subsp. mobilis ZM4
MFGQSLRHNGQASSRIGDDTMAKNFAASDFAVSIQNLTHHYGDNEALHQIDLDLPAGQTIGLVGPDGVGKSTLLGIISGVKRLQSGKVTTLDADIGQKKQREAVLPRVAFMPQGLGHNLYPTLSVQENIDFFARLFGLDAEYRKTRIAQLLEATSLAPFFDRPAGKLSGGMKQKVSLCCALVHNPDLLILDEPTTGVDPLSRQQFWELVDALQAGNPSMTVIVSTAYMEEAARFSWLVAMDDGKVLANGKTIDILKQTGQDTVEKAYISLLPEEKRTQASGFSIPPYQNTDPKPAIEANNLTCRFGSFTAVDNVSFRIGRGEIFGFLGSNGCGKSTTMKMLTGLLDATSGTAKLFGKPVSAGDLNTRMRIGYMSQAFSLYEELTVKQNLVLQSRLYRATEKETEQRVDDALDNFELRPFADISPADLPLGIRQRLQLAAACINTPDILILDEPTSGVDPAARDMFWHHLIDLSRNKHVTIFVSTHFMNEAACCDRISLMHRGHVLAVGTPDELMKKRGEKSLEAAFIDYLQDQMSQDKDNRDNQTSSSNVSLENISDNKKKATPSPLWHWLSYVWAFARRESLELLRDKLRLTFAVAGPIILLLVSAYSISFDINKISFTVCDQDQSNESRSLVKTFQGSSYFTEKAASSSIAEMNKRLSDGTAQMTLDIPAGFGRDIEAGRHPSLGIGISGAMPFLGANIQSYATNALLQYAQLSAQGLTHNAPSSLPFSIEPRFVYNQEFLSIYTMVPDTIMLALILIPTMLTALGVVREKEIGSIINLYASPASTRQYLIGKQLPYVAIAMLAYLSLVVLSVTILGVPLKGSFLALSLGALLYNLAATGLGLLISTFVSSQVAAIFGTAILCLIPAVNFSGLLYPVSTLTGISYHVGRCFPASWFQLISLGSFTKGLGFTAFLTMYGALTGFALLYLALACVLLRKQEL

SEQ ID NO: 27424 - DNA, 1593 bp, Zymomonas mobilis subsp. mobilis ZM4
  CDS (1)..(1593): transl_table=11
atgacatttttggcgatcgaaaatctgacggtcaaagcaaaagaccgctatttgctacaggatataggattccgtatcggacggggtgaaattgttgctgtccttggtgaatccggttcggggaaatccacccttgctcgcagtatcttgcggcttttgcctgaaaatctgattttatctggcgcgctccgcgttggaaaaaccgatctaatgcagcttcctgaaaaacagatgaatgactggcgtggccaaaaaatagcttttatcggtcaggattctttacgttttctagacccgatgatgactatcgcccaacatatccgcgaaggcctcaaggaaaaatcgacagaaaataaacagccctctgccatgaccaatgccttggaacaggtgggactttctcccgatatcgcaaaacgctatccgcatcagctttccggcggacaaagacaaagggcagccattgccatagccttggcggccaaaccggctttgttaatcgcggatgagcccagttctgcacttgatatgctgactgaagcgcaaatcatggcgatttttgaaaaagccacggaaaaccgtcaaacggctattttacttatcagccataatcctgccttggcggtcagaatggcagaacgcatcgtggttttaaaagacggtcgccttgtctcgaaaatggccagccgccgttggtggtcaaatccggcagaggcgtatagtcaagcgatcatccaatcttatcatcagattttatctagcacgccctatggaaaggatgcccccaaacaatcccaaaatcacccgcccataatggataatccgcgccccttattaagactgcaaaatctttcctatcaggaaaaagacgatcatcgcctaaaggatatctcactcgaaatctataaaggcgaaaggattgccatcatcggggaatctggtgccggaaaatcaaccctactcaaattgatatccggcctgctgccagcatcatccggtgaaattttttgggaaaatcagcctctttcttttcaaaagaaacaagatcgcctcgctttttatcaaaaagcacaaatggttttccaagacccgaacagtagccttgatccggcttggacagttgaaaaaaccgtcaccgagccccttgcgctttatcagaagaaaatatcctcggaatatcggcagcaagccttgcaatcagccctgaacaaggcggccttatccctcgatcttcggcatcgttatccggcaacgctttccggcggccaaggtcaaagggtggcgatagcgcgcgccttagtgaacaatcctgatttactgttgctggatgaagccttctcggctctggatagtgtcaatcgggttgaaatcggaaaagaactgatgacgctctctgaacaagaaaaaatgacttgtttactggtaacgcatgaccttgcttttgcccgtttttttgcaaccagagtggtgattctccaccatggtcatgttatagaagagaataatacatattctattttcaccaagcctaatcacccctatacacaaaggctgatcgaaatatggcggaaaaattataatctccaagcctga

SEQ ID NO: 27425 - protein, 530 aa, Zymomonas mobilis subsp. mobilis ZM4
MTFLAIENLTVKAKDRYLLQDIGFRIGRGEIVAVLGESGSGKSTLARSILRLLPENLILSGALRVGKTDLMQLPEKQMNDWRGQKIAFIGQDSLRFLDPMMTIAQHIREGLKEKSTENKQPSAMTNALEQVGLSPDIAKRYPHQLSGGQRQRAAIAIALAAKPALLIADEPSSALDMLTEAQIMAIFEKATENRQTAILLISHNPALAVRMAERIVVLKDGRLVSKMASRRWWSNPAEAYSQAIIQSYHQILSSTPYGKDAPKQSQNHPPIMDNPRPLLRLQNLSYQEKDDHRLKDISLEIYKGERIAIIGESGAGKSTLLKLISGLLPASSGEIFWENQPLSFQKKQDRLAFYQKAQMVFQDPNSSLDPAWTVEKTVTEPLALYQKKISSEYRQQALQSALNKAALSLDLRHRYPATLSGGQGQRVAIARALVNNPDLLLLDEAFSALDSVNRVEIGKELMTLSEQEKMTCLLVTHDLAFARFFATRVVILHHGHVIEENNTYSIFTKPNHPYTQRLIEIWRKNYNLQA

SEQ ID NO: 27426 - DNA, 1599 bp, Silicibacter pomeroyi DSS-3
  CDS (1)..(1599): transl_table=11
atgagcctgttgcagatcaccgacctgtcgctgtcgatccatgcctatgacatcctcaagcgcgtctcactgaccatcgacgcgggcgagatcgtggccgtcaccggcgagagcggctcgggcaagtcgatgacggcgctggccgtgatgcagctgttgcccggcggagcgcgagccagcggctcgatccggctggacggacaagagattctgaccctgcccgaggcagaaatgtgcgccctgcgcggcgcggcggtcgggatggtgtttcaggaaccgatgaccgcactgaacccggtcaagaccatcggcgatcaggtgatggaaacgatcctgatccacaaagcgatgacgcccatcagggcggaagagcgcgcgcgcgaagtgctgacccgtgtcggcctgccgcctgaccggttcccgctttcgcgctatccgcatgaactcagcggcggccagcgccagcgcgtggtcatcgccatggccatcgcactgcgcccgaaactgctgatcgcggacgagccgacaaccgcgctcgacgtcaccacgcaggcgcagatcctcgacctgctcaaggggctggtgcaggaatacggcatgggcatgctgatgatcacccatgacctggccgttgttgccgacatggccgaccatatcaccgtcatgcgccatggcgaggtggtcgaggccgccccgacccagcgcctgctgaccggtatgagtcatccctatacgaagatgctgttcgccgcctcggatcaccgcgtgaccctgcccgcgccaccgccaccggcaccgctgctggaggtgtcggaggtggtgcgcgactatgccctgccgcgcacccggctgtttgcgcacccggggcatcaccgcgccgtggatcatgtcagctttgccctgaaccggggcgagcggctggggctggtcggcgaatccggctgtggcaaatccaccctgacacgcgccatcctggggctggagccggtacagggcggcgaaatccgtctggcggggcaaccggtctatgacggcaaacgcgccaatcccgaaatccgccgccgcatgcaggtggtgtttcaggatccttacggcagcttcaacccgcgccaccgtgtcgaccggctggtgaccgaaccgtttcatctgctcgatgcgccgccaaccgggtcggaccgcagcgaccgcattgccgagatgctgaccgccgtcggcctgtcgcccgacgatgcgggaaagtatatccacgagttttccggcggtcagcgccagcgcatcgccattgcccgtgcgctgatcatccggcctcagctgatcctgttcgacgaggcggtctcggcgcttgatgtctcggtccgggcgcagatccttgacctgctggcgcagctctgctccgaatatgacctgacctatctgttcatcagccatgatctgagcgtggtgcgcacgatcaccgaccgggtgctggtgatgcaatcgggccgcattgtcgaacagggcgagaccgcacaggtcttctcggaccccgcgcatccctatacccgggccctgatcgccgccgcgccgcgtctgcccgaaaccggggcgcggcgggcatga

SEQ ID NO: 27427 - protein, 532 aa, Silicibacter pomeroyi DSS-3
MSLLQITDLSLSIHAYDILKRVSLTIDAGEIVAVTGESGSGKSMTALAVMQLLPGGARASGSIRLDGQEILTLPEAEMCALRGAAVGMVFQEPMTALNPVKTIGDQVMETILIHKAMTPIRAEERAREVLTRVGLPPDRFPLSRYPHELSGGQRQRVVIAMAIALRPKLLIADEPTTALDVTTQAQILDLLKGLVQEYGMGMLMITHDLAVVADMADHITVMRHGEVVEAAPTQRLLTGMSHPYTKMLFAASDHRVTLPAPPPPAPLLEVSEVVRDYALPRTRLFAHPGHHRAVDHVSFALNRGERLGLVGESGCGKSTLTRAILGLEPVQGGEIRLAGQPVYDGKRANPEIRRRMQVVFQDPYGSFNPRHRVDRLVTEPFHLLDAPPTGSDRSDRIAEMLTAVGLSPDDAGKYIHEFSGGQRQRIAIARALIIRPQLILFDEAVSALDVSVRAQILDLLAQLCSEYDLTYLFISHDLSVVRTITDRVLVMQSGRIVEQGETAQVFSDPAHPYTRALIAAAPRLPETGARRA

SEQ ID NO: 27428 - DNA, 2727 bp, Silicibacter pomeroyi DSS-3
  CDS (1)..(2727): transl_table=11
atgacgcccgcacctgtcgccagcctgtctgcggttacccaccgctatggctccacgttggccctgtccgacgtcacgctggatatcccggcgggctgcatggcagggctgatcggcccagacggggtcgggaaatccaccttgctggcgttgatcgccggcgtgcgcaaactgcaagccggcggcgcgatcgtgctgggcggcgatatcaccgaccgccaccacctcagggcgtgcaaccatcgcatcgcctacatgccgcagggtcttggccggaacctttacccgacgctctcggtctatgaaaacctggactttttcggcagactctttggccagtcggaagccgaacgccgcgcccgcatcaacaatcttctgaccgccaccgggcttgatccgttcccggaccggcccgcaggcaagctgtccggcgggatgaagcagaaactctcgctctgctcggcactgatccacgatccagacctggtgatccttgacgaaccgaccactggggtcgatccgctgtcacgccagcagttctgggatctgatcgaccatatccgcgaagaacgcccggcgatgagcgtaatcgtggccaccgcatacatggaagaggcggagcgctttgactggcttgccgcgatgaatgcgggacaggtgatctcgacgggatcgccgatcgagatccggaacgctgccgggcaaccgacactggaaaaggccttcattgccatgctgcccgaggcggaccggcaaggccaccgcatagacgaagtaccaccgcgcagacctgtcatcggcccacctgccatcgaggcgaaaggcctgacctgccgtttcggcgatttcatcgcggtcgatcatgtcgaattccagatcgagccgggcgagatcttcggattcctcggctcgaacggctgcggcaagaccaccaccatgaagatgctgaccgggctacagaaggccagcgaaggcaaggcgcttctgttcggagaggcgctgaatccggacgacatggcgacccgacggcaggtcggctacatgtcgcagtccttttccctctatggtgaattgaccgtccgccagaaccttgagcttcatgcgcggctctaccagttgccgatcgagacccgcgcagagcgggtcgcacagatgctgcatgatttcgatctggccgaggaggcggacaaacggccggacggcctgccgctgggcatccgtcaacgtctgcaacttgccgtcgcggtgatccactccccggaggttctgatcctggacgagccgacctcgggcgtcgatccagtcgcacgggacgggttctggcgacacctgatcaagctgtcgcgcgacgacggcgtgacgatcttcgtctcgacccatttcatgaacgaagcggcgcgatgcgaccgcatctcattgatgcacgcgggaaaggttttggcggtgggaacgcccgaagacctggcgcgaagcaaagatacggatgacctcgaagaagcatttgtcggatatctgcgcgaggcggcaggcaataccgatggcagggcgtccgagacacctgcggcaaaattgccggacaggctggaaaaacctgatcgcctcttcgatttggcccggctttgggcctttgcgcgccgcgagtcgatcgagatattgcgggacccgatgcgccttgcctttgcgtttctgggtccggtcatcttgatgctcactttcggttatggaatttcattcgatgtgcaggaactgccctatgcggttctcgatcgtgacaagagcgcagaaagccggaacctcatgcagagcttctccggctcgcgctacttcgttgaaaggccggctgcgggcagtgtgaccgagcttgatattcgcatgagaagctccgaacttgtcatcgctgtcgaggtgccgccggggtttggaaaatccctgctgcgcggtgatcaaccagaagtccgcgttgccgttgacggagctatgccattccgggcggaaacgacacgcggctatctgcaggggctcgcggcatcctacatgtccgatcagactgaacggctttatggccatgccttcgacccgtcggcagcctcggttgaaacccggtttcgctacaatcaggcgttcaagagcgtctttgcgctgatcccttcggttatcatgctgatgctggttctgatccccgcaatgatggcggcgatgggggtcgtgcgggaaaaggaaaccggttcgatcgccaatttccgctcgacgccggtgacgcgaaccgagttcattctgggcaagcagctgccgtatgtcgcgattgccatgctcagctttgcctcgctgatcatcgtttcctatggcgtcttcggtgtattgatcaaaggctctgtcctagcgctccttgtcggcacattgctttacgtgctggcgacaacgggctttggtgtgttggtctcgacatttacccgcacgcaggttgcggcaacctttgccgccgcggtaatttcgatcattccggctgtcaacttctcgggccttctggtgccggtgtcctcgctttcgggtggcggccgtctgatcggtctgtccttcccatcgtcctggtatcagcagatcagtatgggcaccttcaccaaaggcctcggattccccgaactctggctcaaccacgtcgctctggcgggctttgcggccttgttcattgcggtgtcggtccttgccttgaacaagcaggagacatga

SEQ ID NO: 27429 - protein, 908 aa, Silicibacter pomeroyi DSS-3
MTPAPVASLSAVTHRYGSTLALSDVTLDIPAGCMAGLIGPDGVGKSTLLALIAGVRKLQAGGAIVLGGDITDRHHLRACNHRIAYMPQGLGRNLYPTLSVYENLDFFGRLFGQSEAERRARINNLLTATGLDPFPDRPAGKLSGGMKQKLSLCSALIHDPDLVILDEPTTGVDPLSRQQFWDLIDHIREERPAMSVIVATAYMEEAERFDWLAAMNAGQVISTGSPIEIRNAAGQPTLEKAFIAMLPEADRQGHRIDEVPPRRPVIGPPAIEAKGLTCRFGDFIAVDHVEFQIEPGEIFGFLGSNGCGKTTTMKMLTGLQKASEGKALLFGEALNPDDMATRRQVGYMSQSFSLYGELTVRQNLELHARLYQLPIETRAERVAQMLHDFDLAEEADKRPDGLPLGIRQRLQLAVAVIHSPEVLILDEPTSGVDPVARDGFWRHLIKLSRDDGVTIFVSTHFMNEAARCDRISLMHAGKVLAVGTPEDLARSKDTDDLEEAFVGYLREAAGNTDGRASETPAAKLPDRLEKPDRLFDLARLWAFARRESIEILRDPMRLAFAFLGPVILMLTFGYGISFDVQELPYAVLDRDKSAESRNLMQSFSGSRYFVERPAAGSVTELDIRMRSSELVIAVEVPPGFGKSLLRGDQPEVRVAVDGAMPFRAETTRGYLQGLAASYMSDQTERLYGHAFDPSAASVETRFRYNQAFKSVFALIPSVIMLMLVLIPAMMAAMGVVREKETGSIANFRSTPVTRTEFILGKQLPYVAIAMLSFASLIIVSYGVFGVLIKGSVLALLVGTLLYVLATTGFGVLVSTFTRTQVAATFAAAVISIIPAVNFSGLLVPVSSLSGGGRLIGLSFPSSWYQQISMGTFTKGLGFPELWLNHVALAGFAALFIAVSVLALNKQET

SEQ ID NO: 27430 - DNA, 1665 bp, Synechococcus elongatus PCC 6301
  CDS (1)..(1665): transl_table=11
atggctgatccgctcctagaaattcggcaattgcaaatctgctttggagaggcgatcgctctgcaaggattggatctggtggttcagcctggggaatctgtcggaattgttggcgaatcggggtctggtaaatcggttgcttgcttggccattccgggcttgttgcccaagacggcccgctgcagtggtcagattgcctttcgatcggtagcgggacaatccagtcgagatctcttgacgctaccagaacgcgagttgcgacagttgcggggcgatcgcctcggcttcatttttcaggagccgcttagctctctcaatccagtttttagcgccggttttcagctgctagaggccatccaacagcatttgcctttgagtcaggcggaagcccaacagcgagtgatcgcgctccttcaggaagttcagctgattcgcgagccgtctcaggctgcccagattctgcgacgctatccgcaccaactatctggcgggcagcgtcaacgcttgatgattgcgatcgccctagcggccaatcccgacctcttgctggcagatgaaccgacgacagctctggatgccacggtgcaagcctcagtgctgcaactgttgcgccgcctgcagcagcaacggcagatggcgatgatttttgtcagtcatgaccttggggtgattgccgaagtcgccgatcgcgtcgtggtgctctatcgcggccaggtcgttgagcaaggtcgagtggccgacgtcctgaattcccctcagcatccttacactcaggggctggtggcttgccgaccgcagatcaatccccgcagttgctatctccccaccgttgctgattttctggaaggccaaaccgaaccgcgatcgctgccaccccgatcgccagccacccagccgctgttgcaggtcgagcagcttggcattacctatcgtggtcgtagtacggcttttcaggcggtgcaaaacctttcctttaccctgcccgccggtttgaccctaggactcgtgggcgagtcgggctgtggcaaaagtagcttggctcgctgtctcgtcgggttagttcctgcgagtgaggggcaaatttggctcgatcaacagccgcttgatctgcgatcgtcgcgcgatcgccagcgacttcgccagacggtacaaatggtctttcaagatccggcggcagcccttgatccacgctggaccgtgggatccgcgattctagaacccttgcggatcaaacaaccgcgccgcgatcgcaccgctgatcaacgcctgcttaaacaatggttgcaacgggtcgatctgccgacagatatcggcgatcgctacccccacgagttttccggtggccagcggcagcgcatctgtattgcccgcgccctgattggtcagccgcgcttgctaatttgtgatgaatcggtttcagcgctagatgtctcggtgcaggcgcaaattctcaacttgctcaagcaactgcaggcggagctggggttgacctacctgttcatctcccacgatctcgcggtggtgcgctacatgagcgatcgcattttggtgatgaatcagggtcagcttgaagaagatagcccaacggagcaactcttccagcggccgcaatcagactacacgcgccgcctgattgcggctatccccggagaagtcgcagcttaa

SEQ ID NO: 27431 - protein, 554 aa, Synechococcus elongatus PCC 6301
MADPLLEIRQLQICFGEAIALQGLDLVVQPGESVGIVGESGSGKSVACLAIPGLLPKTARCSGQIAFRSVAGQSSRDLLTLPERELRQLRGDRLGFIFQEPLSSLNPVFSAGFQLLEAIQQHLPLSQAEAQQRVIALLQEVQLIREPSQAAQILRRYPHQLSGGQRQRLMIAIALAANPDLLLADEPTTALDATVQASVLQLLRRLQQQRQMAMIFVSHDLGVIAEVADRVVVLYRGQVVEQGRVADVLNSPQHPYTQGLVACRPQINPRSCYLPTVADFLEGQTEPRSLPPRSPATQPLLQVEQLGITYRGRSTAFQAVQNLSFTLPAGLTLGLVGESGCGKSSLARCLVGLVPASEGQIWLDQQPLDLRSSRDRQRLRQTVQMVFQDPAAALDPRWTVGSAILEPLRIKQPRRDRTADQRLLKQWLQRVDLPTDIGDRYPHEFSGGQRQRICIARALIGQPRLLICDESVSALDVSVQAQILNLLKQLQAELGLTYLFISHDLAVVRYMSDRILVMNQGQLEEDSPTEQLFQRPQSDYTRRLIAAIPGEVAA

SEQ ID NO: 27432 - DNA, 1593 bp, Staphylococcus aureus subsp. aureus COL
  CDS (1)..(1593): transl_table=11
atgtcaaatttattagaagtcaacagtctgaatgtacaattcaattatgatgaaactacagttcaagcggtaaaaaacgtctctttcgaattacgaaaaaaacatatcctaggtattgttggtgaatcaggatcaggaaaaagtattaccgctaaatctattttagggctactaccagattatccagatcacacattaacaggagaaattatttttaatgggcaatcgttaaataatttatcaacttcagcgttacaacaaattcgaggtaaggatatttcaatgatttttcaagatccactctcttcgttgaatccaagattaacgattggcaaacaaattacagaagtaatatttcaacataaacgtgtatctaaatctgaagcaaagtcgatgacaatagacattttagaaaaagtaggtataaaacatgcaactcgacaatttgatgcttatccacatgaactttctggtggtatgcgtcaacgtgtcatgatagcaatggcattgattttaaagccacaaattttaatcgcagatgaaccaacaacggcattagatgccagtacacaaaatcaattactgcagttaatgaagtccctttatgagtacacagaaacatctattatttttatcactcacgatttaggcgctgtgtatcaattttgcgacgatgtgattgtaatgaaagatggaagtgtcgttgaaagtggcacggttgaaagtatttttaaatcgccacaacatacctatacaaaacgcttaatagatgcgattcctgatattcatcaaacgcgtccgccaagaccgttaaacaatgatattttattaaaattcgatcgcgtgagcgtggattacacatcaccgagtggcagcctataccgagcagttaatgatattaacttggctattagaaaaggcgaaacattaggcattgtcggtgaatcagggtcagggaaatcgacattagctaagacggtcgtcggtctaaaggaagtgtcagaaggctttatttggtataacgaattaccattaagtttatttaaagatgatgaattgaaatctttacgacaagagatacaaatgatttttcaagatccattcgcatctattaatccaagatttaaagtcattgatgtgattaaacgaccactaatcattcatgggaaagtcaaagataatgatgacattattaaaactgtcgtatcgttgttagaaaaggttggcctagatcaaactttcttatatcgctatccacacgaattatctggtgggcaacgtcagcgtgtaagtatcgcgagagcacttgctgttgaacctaaagtgattgtttgcgacgaggcagtgtccgctttagacgtttcaattcaaaaagatatcatcgagttattaaaacaattacagttagacttcggcatcacttatttattcatcacacatgacatgggtgttatcaatgaaatatgtgatcgcgttgcagttatgaaaaatggcgaaatcgttgaactgaataacacagaagatattatcaaacatccgcagtcagactatgcaaagcaacttatttcagaagtagcagttattgctaaataa

SEQ ID NO: 27433 - protein, 530 aa, Staphylococcus aureus subsp. aureus COL
MSNLLEVNSLNVQFNYDETTVQAVKNVSFELRKKHILGIVGESGSGKSITAKSILGLLPDYPDHTLTGEIIFNGQSLNNLSTSALQQIRGKDISMIFQDPLSSLNPRLTIGKQITEVIFQHKRVSKSEAKSMTIDILEKVGIKHATRQFDAYPHELSGGMRQRVMIAMALILKPQILIADEPTTALDASTQNQLLQLMKSLYEYTETSIIFITHDLGAVYQFCDDVIVMKDGSVVESGTVESIFKSPQHTYTKRLIDAIPDIHQTRPPRPLNNDILLKFDRVSVDYTSPSGSLYRAVNDINLAIRKGETLGIVGESGSGKSTLAKTVVGLKEVSEGFIWYNELPLSLFKDDELKSLRQEIQMIFQDPFASINPRFKVIDVIKRPLIIHGKVKDNDDIIKTVVSLLEKVGLDQTFLYRYPHELSGGQRQRVSIARALAVEPKVIVCDEAVSALDVSIQKDIIELLKQLQLDFGITYLFITHDMGVINEICDRVAVMKNGEIVELNNTEDIIKHPQSDYAKQLISEVAVIAK

SEQ ID NO: 27434 - DNA, 1701 bp, Lactobacillus acidophilus NCFM
  CDS (1)..(1701): transl_table=11
atgactgaagcaataattacatttaaagatttctcatttaagtatgatagccaagcagaacccacgttaaaaaacatcaacttagatattaataagggtgaaaaaatattaattgcagggccatcaggcagtggtaaatcaactattggacgctgtataaacggactcattcctaatattgactctggcgatattactggtaaatgtattattaatggcaaaaatatcacagaaaccagcttatttgatttatcatttactacttcaaccattttgcaagatgcagatagccaatttattggtttaactgttggcgaagatatcgcttttgcgttagaaaacgattgccaaccacaaaacaaaattcgtcaaactgtccatcgctgggcagatgaacttgaaattggtaaactcttaaagcagtcacctcaaaacttatcaggcggtcaaaaacaaatcgtagctttagcaggagtattagttgatgaatctcctgtccttttgtttgacgaaccactagccaatttagatccagcttcaggaatgaagacaatgagtttaatcgatcaaattcaaaaaagacttaacgccacagtaattattatcgaacaccgtctagaagaagttctgagtcaaccaattgatagaatcattttaattgatgatggacaaattgtagcaaataaaacacctaatgaattattgcatgaaaacaaattagaaaatattggaataagaagtcctctatatctaaaagcattagagaaagccaatatagatattgagcaaattccagatatatcatcagttgataaattacccgataacagcataatatctgagaaattaaaagaatgggaacaaaaaaatacattaaaaattaattctattgaaccaaaacctttattagaattaaaagatgtaggtcatcgttataataaaatgcaggtaaatcctttacatgatgttaatactacaatcaatcaaggtgattttatttcaatcgttggacaaaacggtgcaggtaaaaccacactttgtagaattatttgtggttttatttcaaacgaaggtcgtattcttttaaacggtgaagatattagtaatctttccataaaagaacgttctgaaaaaataggttatgtcatgcaagatcctaatcaaatgatttctcagaagatgatctttgatgaagtggcattaggattacgattaagaggctacagtaaaaaagatattaaagataaagcctatcaagcattaaaaatttgtggtctttatccctaccggaattggcctatttctgctcttagtttcggtcaaaagaagcgagttaccattgcttctattttagttcttgaacctgaattaattattttagatgaaccgacagcagggcaagattggaagacttatacagaaattatgtcatttctaaaaaagttaaatgaacaaggaaaaacaatcatgattattactcatgatatgtatttaatgatggaatatactaatcgttcattagcctttgccaatggtgaactaattgctgatactaacccaattaaattattaaccgtgaagaatttagttaaaaaagcagcactaaaacgtactagtttatactatttagctaagaagtataatttaaacaatccagacaattttgtccgtgcctacattgattcggaaagggataagtag

SEQ ID NO: 27435 - protein, 566 aa, Lactobacillus acidophilus NCFM
MTEAIITFKDFSFKYDSQAEPTLKNINLDINKGEKILIAGPSGSGKSTIGRCINGLIPNIDSGDITGKCIINGKNITETSLFDLSFTTSTILQDADSQFIGLTVGEDIAFALENDCQPQNKIRQTVHRWADELEIGKLLKQSPQNLSGGQKQIVALAGVLVDESPVLLFDEPLANLDPASGMKTMSLIDQIQKRLNATVIIIEHRLEEVLSQPIDRIILIDDGQIVANKTPNELLHENKLENIGIRSPLYLKALEKANIDIEQIPDISSVDKLPDNSIISEKLKEWEQKNTLKINSIEPKPLLELKDVGHRYNKMQVNPLHDVNTTINQGDFISIVGQNGAGKTTLCRIICGFISNEGRILLNGEDISNLSIKERSEKIGYVMQDPNQMISQKMIFDEVALGLRLRGYSKKDIKDKAYQALKICGLYPYRNWPISALSFGQKKRVTIASILVLEPELIILDEPTAGQDWKTYTEIMSFLKKLNEQGKTIMIITHDMYLMMEYTNRSLAFANGELIADTNPIKLLTVKNLVKKAALKRTSLYYLAKKYNLNNPDNFVRAYIDSERDK

SEQ ID NO: 27436 - DNA, 1560 bp, Salmonella enterica subsp. enterica serovar Choleraesuis str
  CDS (1)..(1560): transl_table=11
ttgcaacgttgtgctaagcacattgacatccgttgccgaaagacgtatccctgtcattcatcgctgcaaaaaatgggatgcaaaatgtcatcgttgcaaatttcgcaaggcacgtttcgtctgagcgatacaaaaacacttcatctggattcgctgacgctcaatgcgggcgatagctgggcattcgttggggctaacgggagcgggaagtcggcgctcgcccgcgcgctggcgggtgaactgccgttattaacaggcgagcgccagtgtcggtttacccgcattactcgtctgtcctttgaacaattgcaaaagctggtcagcgatgaatggcaacgtaataacaccgatatgctcagtcctggcgaagacgataccgggtgcactaccgcggaaattattcaggatgatgttcaccatcctgcccgctgtgcgatgctggcgcagcagttcggcatttccgctttactcaacaggcgttttaaatacctttctaccggcgagacgcgaaaagcgctgctgtgtcaggcgctgatgtctgagccggagttattgatccttgatgaaccgttcgacgggcttgacgtgaccgcccgtcaacaactggcgcaacgcctgacggcgttgaaccaggcgggtatgaccctggcgctggtactcaaccgttttgatgaaatcccggacttcgtgcagtttgccggcgtgcttgccgactgtacgctggcagagaccggaacgacgacagagttactgcaacgggcgttggttgctcaactcgcgcacagcgagcgtctgaccgacgtacaattacccgaaccggacgaaccttccgtccgccatgcgttacccgatggcgaaccacggatcgtacttaacgatggcgtagtctcgtataacgatcgccctatcctccaccacctaagctggcgagtaaatccaggcgaacactggcagatcgtcggtcctaacggagcgggtaagtctacgctgcttagccttattactggcgatcatccgcaaggctacagcaacgatcttacgctgttcgggcggcggcgaggaagcggcgaaacaatctgggatatcaaaaaacatatcggctacgtcagcagcagtttacatctggattaccgcgtcagtaccacggtacgcaatgtcattctctccggctatttcgattctatcggcatttaccaggccgtttcagacaggcaacgaaaactggcgcaacagtggctggatattctgggaatcgataagcgtacggcggatgcccccttccacagtctctcctggggacagcagcggctggcgctgatcgtgcgcgcgctggttaaacatccgacagtgttgattctggatgagccgctgcaagggttggacccgctgaaccgccaactggtacgccgttttgtagatgtattaattcgccagggagagacccaactgctgttcgtttcccatcatgcagaggatgcgcctgcctgtattacccaccggctggaatttgtaccagatggcgaacgttataagtacgtttccggacgatgcaataattaa

SEQ ID NO: 27437 - protein, 519 aa, Salmonella enterica subsp. enterica serovar Choleraesuis str
MQRCAKHIDIRCRKTYPCHSSLQKMGCKMSSLQISQGTFRLSDTKTLHLDSLTLNAGDSWAFVGANGSGKSALARALAGELPLLTGERQCRFTRITRLSFEQLQKLVSDEWQRNNTDMLSPGEDDTGCTTAEIIQDDVHHPARCAMLAQQFGISALLNRRFKYLSTGETRKALLCQALMSEPELLILDEPFDGLDVTARQQLAQRLTALNQAGMTLALVLNRFDEIPDFVQFAGVLADCTLAETGTTTELLQRALVAQLAHSERLTDVQLPEPDEPSVRHALPDGEPRIVLNDGVVSYNDRPILHHLSWRVNPGEHWQIVGPNGAGKSTLLSLITGDHPQGYSNDLTLFGRRRGSGETIWDIKKHIGYVSSSLHLDYRVSTTVRNVILSGYFDSIGIYQAVSDRQRKLAQQWLDILGIDKRTADAPFHSLSWGQQRLALIVRALVKHPTVLILDEPLQGLDPLNRQLVRRFVDVLIRQGETQLLFVSHHAEDAPACITHRLEFVPDGERYKYVSGRCNN

SEQ ID NO: 27438 - DNA, 1596 bp, Salmonella enterica subsp. enterica serovar Choleraesuis str
  CDS (1)..(1596): transl_table=11
gtgttagtttccagcaacgttaccatgcagttcggcagtaagccgctgttcgaaaacatttccgtcaaatttggcggcggcaaccgttacggcctgatcggcgccaacggtagcggaaagtccacttttatgaaaatcctcggcggcgacctggagccgacgctgggcaatgtttccctcgatccgaatgagcgcatcggtaagctgcgtcaggaccagttcgcttttgaaacattcaccgtacttgatactgtcattatggggcatggcgaactgtgggaggtcaagcaggagcgcgaccgtatctacgccttgccggaaatgagcgaagaagacggctataaagtcgccgatctggaagtaaaatacggcgagatggacggttattccgctgaggcgcgtgcgggcgaactgctgttgggggtgggcatcccgctggagcagcattacggtctgatgagtgaagtcgcgccaggctggaaattgcgtgtgctgctggcgcaagcgttattctctaacccggacatcctgttgctcgacgaaccgaccaacaacctggatattgatactatccgttggctggagcaggtgctgaacgagcgcgatagcacgatgatcatcatttcgcacgaccgtcacttcctgaacatggtttgtacgcatatggcggatctggattacggcgacttgcgcgtctatccgggtaactatgatgagtatatgacggcggcgacccaggcgcgtgaacgtctgttggccgataatgcgaagaaaaaagcgcaaattgccgagctgcaatcttttgttagccgttttagcgccaatgcctctaaatcgcgtcaggcaacgtcgcgcgcgcggcagattgataaaatcaagctggaagaggtgaaagcctccagccgtcagaacccgttcatccgttttgagcaggataaaaaactgttccgtaacgctctggaagtggaggcgctgacgaaaggttttgataacggtccgctgtttaaaaatgtcaatttgctgctcgacgtcggcgagaagctggcggtactcggcaccaatggcgtgggtaaatctacgctgctgaagacgctggttggcgatctggacgccgatcacggcaccgttaaatggtcggaaaacgcgcgtattggttactacgcgcaggaccacgaatatgaattcgaaaatgacctgacggtgtttgaatggatgagtcagtggaagcaggaaggcgacgacgagcaggcagtgcgcagtattctgggccgcctgttatttagccaggatgatatcaaaaagcctgcgaaagtcctctccggtggcgagaagggccgtatgctgttcggcaaactgatgatgcaaaagccgaatatcctgatcatggacgaaccgactaaccacctggatatggagtcgatcgaatcgctgaatatggcgctggagctgtatcagggcacgctgatctttgtttcgcacgaccgtgagttcgtcagctcgctggcaacccgcgtcattgaaattacgccggagcgcgtggtggacttcagcggtaactacgacgattatttgcgtagtaaagggattgaaagctaa

SEQ ID NO: 27439 - protein, 531 aa, Salmonella enterica subsp. enterica serovar Choleraesuis str
MLVSSNVTMQFGSKPLFENISVKFGGGNRYGLIGANGSGKSTFMKILGGDLEPTLGNVSLDPNERIGKLRQDQFAFETFTVLDTVIMGHGELWEVKQERDRIYALPEMSEEDGYKVADLEVKYGEMDGYSAEARAGELLLGVGIPLEQHYGLMSEVAPGWKLRVLLAQALFSNPDILLLDEPTNNLDIDTIRWLEQVLNERDSTMIIISHDRHFLNMVCTHMADLDYGDLRVYPGNYDEYMTAATQARERLLADNAKKKAQIAELQSFVSRFSANASKSRQATSRARQIDKIKLEEVKASSRQNPFIRFEQDKKLFRNALEVEALTKGFDNGPLFKNVNLLLDVGEKLAVLGTNGVGKSTLLKTLVGDLDADHGTVKWSENARIGYYAQDHEYEFENDLTVFEWMSQWKQEGDDEQAVRSILGRLLFSQDDIKKPAKVLSGGEKGRMLFGKLMMQKPNILIMDEPTNHLDMESIESLNMALELYQGTLIFVSHDREFVSSLATRVIEITPERVVDFSGNYDDYLRSKGIES

SEQ ID NO: 27440 - DNA, 1590 bp, Salmonella enterica subsp. enterica serovar Choleraesuis str
  CDS (1)..(1590): transl_table=11
atgacatctccattgcttgcgattgaaaatttatcggtaggtttccgtcagcaacagcacgtgcgtcctgtcgttaacgccatttcgttacaggtgaacgccggggaaacgctggcgctggtcggcgagtccgggtcaggaaaaagcgtgacggcgctttccattctgcgtcttttgcctacccctcccgccgtctacctctccggcgatattcgctttcacggcgaatcattgcttcatgccagcgagcagacgctacgcggcgtacgcggcaataaaatcgccatgatttttcaggaaccgatggtttcacttaacccgctgcatacgctggaaaaacagctctatgaagtgctgtcgctccaccggggaatgcgtcgggaggcggcaagagcggagatgatcggttgtctggatcgggtcggtatccgccaggcgagccagcgtctgcgcgattatccgcatcagctttccggcggcgaacgccagcgcgtcatgatagccatggcgctgttaacacggccggaattactgatcgccgatgagccgaccaccgccctcgacgtctccgtacaggcgcagattttatctctactgcgggaactccagcgcgagctcaatatgggattgctgtttatcacccataacctcagcattgtaaaaaaactggcggattcggtggcggtaatgcaacacggcaagtgcgtagagaaccaacgcgccgacacgctgctctccgcgccgacccatccgtacacgcaaaaactactcaacagcgaacccacaggcgatccggttccgctccccgccgggcagacgccgttgctggaggtggacaggctgcgcgtcgccttcccgatccgcaaaggcattctgaagcgcgtcgtggatcataatgtggtggttaacaatatcagtttcaccctgcatccaggcgaaacgctgggtctggtcggcgagtcaggatcgggaaaaagtaccaccggtctggcgctgttacggcttatccgctccgaaggccgcatcgtgtttgacggtcaatcgctggatacgttaaaccgccgccagcttttacctgttcgccaccgtatccaggtcgtattccaggacccaaactcatcgctaaacccgcgtttaaacgtgttgcaaattatcgaagaaggcctgcgcgtccaccagcctacgctttcaggcgcgcagcgcgaacagcaggtgaaagcggtcatgatggaagtcggcctggacccggaaacgcggcatcgttatcccgctgagttttccggcggccagcgtcaacgtatcgccgtcgccagggtgctgattttaaaaccgtcgcttattattctggatgaaccaacctcatcgctggataaaaccgttcaggcgcagattcttgccctcctgaaatcgctacagcaaaagcaccgtctggcctatatcttcattagccacgatctgcatgtagtacgcgcgctgtgccatcaggttatcgtgctgcggcagggggaggtggttgaacaggggcaatgcgagcgcgtgtttaccgcaccgcaacaagcgtatacgcgtcagctactcgcgttaagctga

SEQ ID NO: 27441 - protein, 529 aa, Salmonella enterica subsp. enterica serovar Choleraesuis str
MTSPLLAIENLSVGFRQQQHVRPVVNAISLQVNAGETLALVGESGSGKSVTALSILRLLPTPPAVYLSGDIRFHGESLLHASEQTLRGVRGNKIAMIFQEPMVSLNPLHTLEKQLYEVLSLHRGMRREAARAEMIGCLDRVGIRQASQRLRDYPHQLSGGERQRVMIAMALLTRPELLIADEPTTALDVSVQAQILSLLRELQRELNMGLLFITHNLSIVKKLADSVAVMQHGKCVENQRADTLLSAPTHPYTQKLLNSEPTGDPVPLPAGQTPLLEVDRLRVAFPIRKGILKRVVDHNVVVNNISFTLHPGETLGLVGESGSGKSTTGLALLRLIRSEGRIVFDGQSLDTLNRRQLLPVRHRIQVVFQDPNSSLNPRLNVLQIIEEGLRVHQPTLSGAQREQQVKAVMMEVGLDPETRHRYPAEFSGGQRQRIAVARVLILKPSLIILDEPTSSLDKTVQAQILALLKSLQQKHRLAYIFISHDLHVVRALCHQVIVLRQGEVVEQGQCERVFTAPQQAYTRQLLALS

SEQ ID NO: 27442 - DNA, 2742 bp, Salmonella enterica subsp. enterica serovar Choleraesuis str
  CDS (1)..(2742): transl_table=11
atgacgtcgctgacgctggtgcctgttcctcccgtagcgcagcttgagggggtgagccagcattacggaaaaacggtcgcgctgaacaatatcacgctggacattcccgcccgtagtatggtcgggctgattggtccggacggggtgggtaagtcgagcctgctgtcgctgatttctggcgcgcgggtgattgagcaagggaacgttatcgtcctgggcggcgatatgcgcgatgcgaaacatcgccgcgacgtctgtccgcgcatcgcctggatgccgcaggggctggggaaaaacctttatcacacgttatcggtttatgagaacgtcgattttttcgctcgtctctttggtcatgacaaagctgaacgcgaagcgcgtattaccgagctgctgaacagcaccggcctggcgccgtttcgtgaccgtcctgccgggaagctgtccggtgggatgaaacaaaagctggggttgtgctgtgctctgattcatgacccggaattgctgattcttgatgagcctaccaccggcgtggacccgctctcccgcgctcagttctgggacttaatcgacagtatccgccagcgccagaccaatatgagcgtgttggtcgcaacggcctatatggaagaggcggagcgttttgactggctggtggcgatgaatgcgggcgagatactggcaaccggcagcgcgcagcaactgcgggcaaaaacccatagcgcgacgctggaacaggcgtttatcgccctgttgccagaagcgcagcgccaggcgcataagccggtggtgatcccgccgtatcacgctgagcaggaagagattgccattgaggcgaaagatctgaccatgcgcttcggtaagttcgtcgcggttgaccatgttaatttccgtattccgcgcggcgagatttttggcttcctcggttcaaacggttgcggcaaatcgaccaccatgaaaatgctgaccggtctgcttcccgccagcgaaggccaggcctggctatttggccagccggtagacccgaacgacatcgacacccgtcgccgggtcgggtatatgtcgcaggctttttcgctctataacgaactcaccgtgcggcagaatctggaacttcatgcccgcctgtttcatattccgcctgcggagatcccggcgcgcgtcgcgcagatgatcgaacgctttatgctaacggaggtggaagatacgctccccgcttcgttgccgctcggtatccgccagcgtttatcgctggcggtagcggtgatccatcgcccggaaatgctgattcttgatgagccaacgtccggcgttgatccggtcgccagagatatgttctggcagcttatggtcgatctttcgcgtcaggataaggtgacgatttttatctcgacccattttatgaacgaagcggaacgttgcgaccgaatgtcattgatgcacgccggtaaagtgcttgccagcggtacgccgcaggaattggtgcaacagcggggcgcggccaatctggaagcggcgtttatttcctggctacaggaagctgcgggagcggcgcctgaaaccccaataccgccatcccagacgcctgccgcgtcaggtaaaccgtcgcggcagggattgagcttccggcgtttgttcagctacagtcgccgcgaagcgctggagctacgccgcgatccggtacgctcgacgctggcgctgctgggaacggtaattctgatgttgattatgggctatggcatcagtatggacgtggagaacctgcgttttgccgtactcgatcgtgaccagaccgtcagtagccaggcatggtcgctcaatctggcgggatcgcgctattttatcgaacagccgccgctcgccagctatgacgagcttgaccggcggatgcgttcgggagagctggcggttgccattgagatcccgcctaattttggccgcgatattgctcgcggtacgccagcgcagattggcgtctgggtggatggcgccatgcccagccgcgccgagacggtgaaggggtacgttcaggcgatgcaccaaagctggctgcaggaggcggcaagtcgtcagccgaacccggttaaacaggtcgggctgctcaatattgaaacgcgctatcgctataacccggatgtgaaaagtctgcccgctatcgttccggcggtcattccgctgctgctcatgatgatcccgtcaatgcttagcgccctgagcgtggtgcgggagaaagagctggggtcgatgattaatctgtacgtaacgccgacgacgcgcagcgaatttttgctgggtaaacaactgccgtatatcgagctgggtatgctgaacttcttgctactgtgcgcgctgtcggtctttgtgttcggcgtgccgctgaaaggcagctttctcacgcttaccctcgcggcgctgctttatgtcatcatcgccaccggtctggggctgctgatctccacgtttatgaagagccaaatcgccgctatttttgggacgtcgattattaccctcattccggcaacacaattttccggcatgatcgatccggtggcttcgctggaaggaccgggaagatggatcggcgagatctacccgaccagtcattttctgacgatcgcgcgcgggacgttttccaaagcgttggatctgtccgatctctggccgttatttatgccgttactgattgccgtcccggtggtgatgggtctgagcattctgctgctgaaaaaacaggaggggtaa

SEQ ID NO: 27443 - protein, 913 aa, Salmonella enterica subsp. enterica serovar Choleraesuis str
MTSLTLVPVPPVAQLEGVSQHYGKTVALNNITLDIPARSMVGLIGPDGVGKSSLLSLISGARVIEQGNVIVLGGDMRDAKHRRDVCPRIAWMPQGLGKNLYHTLSVYENVDFFARLFGHDKAEREARITELLNSTGLAPFRDRPAGKLSGGMKQKLGLCCALIHDPELLILDEPTTGVDPLSRAQFWDLIDSIRQRQTNMSVLVATAYMEEAERFDWLVAMNAGEILATGSAQQLRAKTHSATLEQAFIALLPEAQRQAHKPVVIPPYHAEQEEIAIEAKDLTMRFGKFVAVDHVNFRIPRGEIFGFLGSNGCGKSTTMKMLTGLLPASEGQAWLFGQPVDPNDIDTRRRVGYMSQAFSLYNELTVRQNLELHARLFHIPPAEIPARVAQMIERFMLTEVEDTLPASLPLGIRQRLSLAVAVIHRPEMLILDEPTSGVDPVARDMFWQLMVDLSRQDKVTIFISTHFMNEAERCDRMSLMHAGKVLASGTPQELVQQRGAANLEAAFISWLQEAAGAAPETPIPPSQTPAASGKPSRQGLSFRRLFSYSRREALELRRDPVRSTLALLGTVILMLIMGYGISMDVENLRFAVLDRDQTVSSQAWSLNLAGSRYFIEQPPLASYDELDRRMRSGELAVAIEIPPNFGRDIARGTPAQIGVWVDGAMPSRAETVKGYVQAMHQSWLQEAASRQPNPVKQVGLLNIETRYRYNPDVKSLPAIVPAVIPLLLMMIPSMLSALSVVREKELGSMINLYVTPTTRSEFLLGKQLPYIELGMLNFLLLCALSVFVFGVPLKGSFLTLTLAALLYVIIATGLGLLISTFMKSQIAAIFGTSIITLIPATQFSGMIDPVASLEGPGRWIGEIYPTSHFLTIARGTFSKALDLSDLWPLFMPLLIAVPVVMGLSILLLKKQEG

SEQ ID NO: 27444 - DNA, 1584 bp, Pseudomonas syringae pv. syringae B728a
  CDS (1)..(1584)
atgcacgacaacctgattgaaattcgcgacctgcgggtcgccttcaacggccacgaagtggtgcatggcgtcagcctcgacatccgccgtggcgagtgcctggcactggtgggcgaatccggctcgggcaagtcggtcacggcgcattcgattctgcgtctgttgccggcgaaaaccgtcagtacccagggctcgattcattacgacgggctggatttggtgactgccagcgacaagcagttgcgcagcctgcgcggcaaccgggtggcgatgatttttcaggagcccatgagttcgctgaacccgctgcacacggtcgaaaaacagatcgtcgaaatcctcgtgacccacaagggcctgaagggcaaggccgcgctgagccgcaccctggagctgctggaactggtcggtattcgtgatccgctgtcacgtctcaaggcgtatccgcatcaactgtcgggcgggcaacggcagcgcatcatgattgccatggcgttggccaacgagccggatctgctgatcgccgacgagccgaccaccgcgctggatgtgaccgtgcaggtgaagattctggagttgctcaagtccctgcagcagcggctgaacatgtcgctgctgctgatcagccacgacctcaatctggtgcggcgcatcgcccagcgggtctgcgtgatgcgtgagggcgagatcgtcgagcaggccgattgccagaccctgttcgacagcccgcaacacccgtacagccgtctgctgatcaatgccgagccggatggtgaaccggtgccgtccacgcacagcaacacgctgctgtcggtgcaggacctgaaggtctggttcccgctgggcaaggcctggttcaagcgtgagccgcagtacgtgaaagcggtggacggggtgagtttcgagctgctcaagggcaagaccctgggcattgtcggcgagtcgggttcgggtaaatcgaccctgggccaggcgattttgcgcctggtcgattcagagggcagcatccgcttcggcaccaaggaactgagcctgcacagccagcacctgatgcgcccgttgcgccgccagttgcaggtggtgtttcaggacccgttcggcagcctcagcccgcgcatgaccgtggagcagatcattgccgagggcctggtgacgcacaacatcggtacgccgaaagagcgtgaacagacggtgatccgcgtgttgcaggaagtcggcctggacccggccacccggcatcgttacccgcacgagttttccggcggtcagcgccagcgtgtttccatcgcacgggcgctggtgcttgagccggacctgatcctgctcgacgagccgacctcggcgctcgaccggaccgtgcaaaagcagatcgtcgccctgctgcgcgacctgcaaatccggcatggcctgacgtacctgttcatcagccatgacctggcggtggttcacgccctggcccatgacctgatcgtcatcaaggacggcaaggtggtcgagcagggtccgtcccgcgagatcttcgccgcaccgcagcaggcctacactcaggaactgctgcgttcgtcggggctggtgttcgcctga

SEQ ID NO: 27445 - protein, 527 aa, Pseudomonas syringae pv. syringae B728a
MHDNLIEIRDLRVAFNGHEVVHGVSLDIRRGECLALVGESGSGKSVTAHSILRLLPAKTVSTQGSIHYDGLDLVTASDKQLRSLRGNRVAMIFQEPMSSLNPLHTVEKQIVEILVTHKGLKGKAALSRTLELLELVGIRDPLSRLKAYPHQLSGGQRQRIMIAMALANEPDLLIADEPTTALDVTVQVKILELLKSLQQRLNMSLLLISHDLNLVRRIAQRVCVMREGEIVEQADCQTLFDSPQHPYSRLLINAEPDGEPVPSTHSNTLLSVQDLKVWFPLGKAWFKREPQYVKAVDGVSFELLKGKTLGIVGESGSGKSTLGQAILRLVDSEGSIRFGTKELSLHSQHLMRPLRRQLQVVFQDPFGSLSPRMTVEQIIAEGLVTHNIGTPKEREQTVIRVLQEVGLDPATRHRYPHEFSGGQRQRVSIARALVLEPDLILLDEPTSALDRTVQKQIVALLRDLQIRHGLTYLFISHDLAVVHALAHDLIVIKDGKVVEQGPSREIFAAPQQAYTQELLRSSGLVFA

SEQ ID NO: 27446 - DNA, 1578 bp, Sulfolobus acidocaldarius DSM 639
  CDS (1)..(1578): transl_table=11
atgtacgcagtagagataaagggattacaatttttttacttgggatatccgacaccagctatcacagttgacgaactgtttatcgagaagggagagtcggtactcattacaggtagatcaggatcaggtaagtccacactagttagttgcattaacggaattattccccatatgacgagtggagatctaaaaggggaagtttacgtactagggaagagtataaaagatacgcctttgtctaagctgtccacagttgtaggcacggtcttacaagaccctgaaagccaagttgtgaattacactgtggaggaagaagttgcgtttggaccggagaacctgaattttcctccagaacagattgtggagagagtaaaggagtccatggagatagctgggatatcgcatttatggggaagggagaccacaacgctatctggaggagagctacagaggacagtattagcctctgtcctcaccatgagaccagaggtgctaatattagatgagccaacttcaaatatagacccagaaggaactaatcaaattttctctacactgaaagacctcagggggcaaaagacactcatcatagtggaacataaggtggagagggtactaccatttgtagacagagttattctcgtggataagggtaaggtttcacttgaccttgaaaaggacgaaatattagagggagctgagaccctacattcagcaggagtcgaagtacctgagtatttcatttatgcaaaaaagttcggagtcaagtcaccggatctagatacagtgaagaaattgatagtacaaaataatgttaaattggaacaccctaagaggaggactcctgagaacaagatactaacagctaatctgaggattaatgttaaggaaaaacagattgtagatttctctctggatttgtgggagggggaactagttgccataatggggaaaaatggtgcaggaaagacaactgcactgaaagcactagctggaattctagatacgtctgaatatagtataacggggtcaataaaatatcaaggggaggaactaatcaataaacctgtctggtataggggtaaatacatgatttatatgccacagtcctttgaccttatgttagtcacaaaccaagtgagaaaagaaatcgagtatagtttgaagaagagaaaagtaaagaactacagggagataagtgagaagtacatgagggagtttgggttattcgagtatagggatagggatcccacgttactaagtatgggtgagaggaggagggtagctatggcatcagttttagcttcaggcgtgaaaattatgttaatggatgaaccgacctcaggtcaggactactcaaataagatgagcctaggtaaagagttacgccaacttaccgacaaaggctacactgttgtggtggttacacatgattcaaaatttgtctatgatttcgctgacaggttaatagtaataagtgatgggaagaaagttcttgaaggaagaccagaggaagtttttataagttcctctagatatggaataaacccaccatcagacttcctcctcaggtggtag

SEQ ID NO: 27447 - protein, 525 aa, Sulfolobus acidocaldarius DSM 639
MYAVEIKGLQFFYLGYPTPAITVDELFIEKGESVLITGRSGSGKSTLVSCINGIIPHMTSGDLKGEVYVLGKSIKDTPLSKLSTVVGTVLQDPESQVVNYTVEEEVAFGPENLNFPPEQIVERVKESMEIAGISHLWGRETTTLSGGELQRTVLASVLTMRPEVLILDEPTSNIDPEGTNQIFSTLKDLRGQKTLIIVEHKVERVLPFVDRVILVDKGKVSLDLEKDEILEGAETLHSAGVEVPEYFIYAKKFGVKSPDLDTVKKLIVQNNVKLEHPKRRTPENKILTANLRINVKEKQIVDFSLDLWEGELVAIMGKNGAGKTTALKALAGILDTSEYSITGSIKYQGEELINKPVWYRGKYMIYMPQSFDLMLVTNQVRKEIEYSLKKRKVKNYREISEKYMREFGLFEYRDRDPTLLSMGERRRVAMASVLASGVKIMLMDEPTSGQDYSNKMSLGKELRQLTDKGYTVVVVTHDSKFVYDFADRLIVISDGKKVLEGRPEEVFISSSRYGINPPSDFLLRW

SEQ ID NO: 27448 - DNA, 1374 bp, Leuconostoc mesenteroides subsp. mesenteroides ATCC 8293
  CDS (1)..(1374)
atggttactcatttaaaacatatcagtttgtcatatggcaatacaaaaatacttgatgataccaccatgtcaatatctcacaatagttttaacctgctaattggtccctctggctctggaaaatcaacccttctccgaatatttgcaggattatatccgcaactaaaaggtgaagtacttgttaatgatcaagcagttaccacattaccggctaacgagaaagccaaagtcgtcggttttttatttcaagatccagacacccaatttgttatgaaaacgccactggatgaattgattttcactttagaaaacttgcaagttcatccttctgatatcaagcaacgtgcaacgcacgctctagaatttgttggtatttcagacttaactcatcaagacattgacaccttatcaggtggtgaaaaacaaaaagttgcattggctatcattgttgcaatgcaaagtgatttcttattattagacgaaccttttgcaaatattgatagccaatctcgccaagacctattagctaaattgaaagatttgcaaatacagggacaaaccactatattaatcactgatcatgatttacatgggtacgaaccacttgttgatcatgtgtgggaaatacaccacaaaaaagtagcaactgttagtaactttcagaatcgtattttaccggaacaaaatgtccacctgcaattacctaaagaaggtgttttgcaattaaaaaattttgaacttttagtggggcaacgtcaattaattagtatttctgatttacctttggctcccggtggaattacgctctttactggagcaaatggcacaggcaagtcatcccttttcaatgcgctaactcgactaaaatcctaccaaggtgacattttgtatatagatcaaaatatcaaaaaatttaatgctgctaaatatgcaaaacaagtagcattgatctttcaaaatgcagaacggcagtttttacgaatgacgattcgtgaggaaatcgcgttgagcatgcaacatgcgcaacaaccagaaaaatggtccgaaaacgtaattactcgttacttagagcgcttaaatttggatgggctacaagatcatgtcgtttatcagctctctggcgggcaaaagaaaaaagttcaactcttggtgatgttaattgttggcacaccaatattattgttagacgaacctattgctggtctggacacagattccgttcgggttgtaggcgaaattttacgagaaatcgcagataatggacggcaacgttttattattattagccaccaactagatcagctacgcccaatcattgattatcatttgcatctatctaatcgaactttacaatatatggagcattttttatga

SEQ ID NO: 27449 - protein, 457 aa, Leuconostoc mesenteroides subsp. mesenteroides ATCC 8293
MVTHLKHISLSYGNTKILDDTTMSISHNSFNLLIGPSGSGKSTLLRIFAGLYPQLKGEVLVNDQAVTTLPANEKAKVVGFLFQDPDTQFVMKTPLDELIFTLENLQVHPSDIKQRATHALEFVGISDLTHQDIDTLSGGEKQKVALAIIVAMQSDFLLLDEPFANIDSQSRQDLLAKLKDLQIQGQTTILITDHDLHGYEPLVDHVWEIHHKKVATVSNFQNRILPEQNVHLQLPKEGVLQLKNFELLVGQRQLISISDLPLAPGGITLFTGANGTGKSSLFNALTRLKSYQGDILYIDQNIKKFNAAKYAKQVALIFQNAERQFLRMTIREEIALSMQHAQQPEKWSENVITRYLERLNLDGLQDHVVYQLSGGQKKKVQLLVMLIVGTPILLLDEPIAGLDTDSVRVVGEILREIADNGRQRFIIISHQLDQLRPIIDYHLHLSNRTLQYMEHFL

SEQ ID NO: 27450 - DNA, 1677 bp, Leuconostoc mesenteroides subsp. mesenteroides ATCC 8293
  CDS (1)..(1677)
atggtagaaccatttattgattttcaacatgtgacatttaaatatcacgcgcaatctgaaccgacgttacatgatgtgagttttcaaatttatcctggtgaaaaagttttaatagccggtgcatctggttcgggtaaaacaacattactgcgtttactgaatggtttaattccgcaagcctatcaaggggatattactggtgaactgacaattaatggtaaaaagatcctaaatcagtcgttgtttgacctatctttgcaagctggtactgttcttcaggattctgatgcgcaatttgtgggcatgacggtcgccgaagatatagctttttctcttgaaaatgataatcagccgataaaaattgtcagagaaaaagtcgctaaatgggccaatcgatttgggttaggaaaacgtttgacgttggcaccgcaatcattgtctggtggccaaaaacaacgtactgctatggcaggtgttttggttgatgaaggggatctattgttatttgacgaaccattggctagtcttgatccagctgctggtgcggctgcaatggcactgattgatgaacttcaacaagaacgtaatatgacagtggttgtgattgaacatcggatagaagatgtgttacgtgctcatgttgatcgtgtaattgtcatggcacatggtagaattgtcgctaatgacacgcctactgccattatccaagcaggcgtgttgtctgcaaatggcttagacgaaccactatacatacaactattacgccgagcaggcgttccagtgaataaaatacctcacgtagcagatgttgaaaaagtggacgtttcaaactttagggaccaaattgaaactttggcagaaccagtgcagacagtcactcatgatgacaagcagttgttggtccaaaatttgacctttgcgtacgaccagcaagaaccattgtttgaaaatttgtcgacatcaattcatgaaggtgaaattcttggtattgtgggcaaaaatggatcaggtaaaacaactttgtcccacctattaactggctttttgacacccagtgggggagatattcaattagatggacgttcgctgctaagcgattctattaaagaacgggccgaccacataggctatgttttgcagaatcctaatcatatgattacgaaagcaacagtatttgatgaagttgccagtgggctgcgattgcgtaacattgatgaagaacaagtaacggaacgtgtgcgtgaaatgttacaacttgtcgatcttgatggtatgcgtaattggcccatttctgcattaagctttgggcaaaagaaacggcttacaattgcggctgttttggttttgaaaccagaaattctaatattagatgaaccaacagctggacaagatgcaacgcacacgtctcagttactcagtttcttacagaatattaacattacgaaccatacgactattataatcattactcatgatatgcatttattagcaaactttgttcaacgggctctggttgttgttgatgggcaaatattggcggatacaacaccagcggagttacttgcaaatgaagcattagttgacgctgctagtttgcgaactaccagtatttatcgtttagcccagcgtcttagcattgtgcatccagaagaattaaatgcagctataaggaaataa

SEQ ID NO: 27451 - protein, 558 aa, Leuconostoc mesenteroides subsp. mesenteroides ATCC 8293
MVEPFIDFQHVTFKYHAQSEPTLHDVSFQIYPGEKVLIAGASGSGKTTLLRLLNGLIPQAYQGDITGELTINGKKILNQSLFDLSLQAGTVLQDSDAQFVGMTVAEDIAFSLENDNQPIKIVREKVAKWANRFGLGKRLTLAPQSLSGGQKQRTAMAGVLVDEGDLLLFDEPLASLDPAAGAAAMALIDELQQERNMTVVVIEHRIEDVLRAHVDRVIVMAHGRIVANDTPTAIIQAGVLSANGLDEPLYIQLLRRAGVPVNKIPHVADVEKVDVSNFRDQIETLAEPVQTVTHDDKQLLVQNLTFAYDQQEPLFENLSTSIHEGEILGIVGKNGSGKTTLSHLLTGFLTPSGGDIQLDGRSLLSDSIKERADHIGYVLQNPNHMITKATVFDEVASGLRLRNIDEEQVTERVREMLQLVDLDGMRNWPISALSFGQKKRLTIAAVLVLKPEILILDEPTAGQDATHTSQLLSFLQNINITNHTTIIIITHDMHLLANFVQRALVVVDGQILADTTPAELLANEALVDAASLRTTSIYRLAQRLSIVHPEELNAAIRK

SEQ ID NO: 27452 - DNA, 1674 bp, Bifidobacterium longum DJO10A
  CDS (1)..(1674)
atgaccgttgcaccccattccttcgacgccgacgagttccacgattctgccgaacctcacgcttccgccgagcctgcctcccccgccgccgtgctcaaggacattcgtttcagctatgaccgcggcacctcatgggctttggatggcgtttcactcacggtccatgccggcgagcgcctatgcttggtcggtccgaacgggtcgggcaaatccacgttggcccgtctgattgcgggattgaccgcgccggacggtggtgaagtgacgttactggggcaacgcgtgtacgcagccggcccgaatgccgatgcctatcgtgctgcccgccacggcatcggtatggtgttccagaatcccgaggatcagctggtcactaccgtgttggaggatgacgtggcctttggcccggagaatctcgggctggagcgcgagctcatcggcgagcgtatcgttgattcattgcaggccgtggggttggcgaacttacgccagtccgacccgacccgtatgagcggcgggcagcagcaacgcgcctccatcgccggcatgctggccatgaacccggcaatgctggtattggatgagccgaccgccatgctggacgaatccgcacgcgccgaagttatgcgcattttggatgatttgcaggcgcgcggcaccactattgtgcatgtcacgcatcatccagatgaaaccgttcatgccgatcgcatcgtgcacatggaggccgggcgaatcattggtatcactgcagccgtcgataatcgatccccgctagcggaggctgtctcgcaaagcgagactgagggtagtatcggcacagaagccgcccccagtcgccctacgaacgacagcccccgccagcgggagcgcgaagacggctccgaactgccgctgctctccgatggcatcggtgatatgacgaaccccattattcgcgtctcgcatctgacctatcgctatccttcggccaaacgggcggttatcgatgacctgtcgttcaccatcgcgcgcggtgaaaccgtggcactgatgggcgtgaatggttcgggcaagtcgacgctggtgcgcatgttgtgcgcactgactgcgccgaccgccggcagcatcgaagtggccggtgttccggtggcctcgaccggcaagcgcggtcgcaacgtgcgcccgaagtcggcgaatcgcaagcaattagcgcaattgcgccggcatgtgggttacgtgatgcagcatccagagcatcagctgttcgctgacacggtagccgaggacgtggcgtacggcccacgcaaccaagggcttggcgagaccgaggtagccgaccgcgtgcgcgaatcactggaactgctgcatatcgggcatcttgccgaccgctcccccttcgacctgtccggcgggcaacaacgattggcagccattgccggcgtgctggcttgcaatcctgacgtgctcatcatggacgagccgaccgcgagtctggacgcccaagccaagaagcgtatccatgagctgttgcgcacgctcaaatcgcgtggcgtgaccgtgctcatcatcacccatgaccgggaggaggccgagcaaatcgccgaccgcgtggtccgtatgccgattgccgcccccgcatccggcggccccgtcacggccaccgtcaccgagccggccgtatcctccaactag

SEQ ID NO: 27453 - protein, 557 aa, Bifidobacterium longum DJO10A
MTVAPHSFDADEFHDSAEPHASAEPASPAAVLKDIRFSYDRGTSWALDGVSLTVHAGERLCLVGPNGSGKSTLARLIAGLTAPDGGEVTLLGQRVYAAGPNADAYRAARHGIGMVFQNPEDQLVTTVLEDDVAFGPENLGLERELIGERIVDSLQAVGLANLRQSDPTRMSGGQQQRASIAGMLAMNPAMLVLDEPTAMLDESARAEVMRILDDLQARGTTIVHVTHHPDETVHADRIVHMEAGRIIGITAAVDNRSPLAEAVSQSETEGSIGTEAAPSRPTNDSPRQREREDGSELPLLSDGIGDMTNPIIRVSHLTYRYPSAKRAVIDDLSFTIARGETVALMGVNGSGKSTLVRMLCALTAPTAGSIEVAGVPVASTGKRGRNVRPKSANRKQLAQLRRHVGYVMQHPEHQLFADTVAEDVAYGPRNQGLGETEVADRVRESLELLHIGHLADRSPFDLSGGQQRLAAIAGVLACNPDVLIMDEPTASLDAQAKKRIHELLRTLKSRGVTVLIITHDREEAEQIADRVVRMPIAAPASGGPVTATVTEPAVSSN

SEQ ID NO: 27454 - DNA, 1518 bp, Haemophilus somnus 129PT
  CDS (1)..(1518)
atgaatgatttgagtcgttctccatatattttagagatgcggaatgtatctaaaacattccccggcgttaaagcattggacggcattaacttaaaagtcaagcgtggaaccattcatgccttaatgggggaaaacggtgcaggtaaatcaacgttaatgaaaattctctacggcatctatacgccggatgccggtggagaattaattttagatgataagccttttaaaccgagtgcaccgattgatgctattcgcaccggtttgacaatggtaccacaagaaatttctccggcagggaatttaactattgcagataacttctatcttggacgagaaattactcgcagtaaattctttttaaatcaaaaagaaatggattgtaaaacagcggaaatcttaaatgaattgggtattccgatggatgtaaccgctaaaatgtcagatgtttccgtagcgaaggcacaattggttgcgattgctaccgcagtttctaatgatgcgaaagtaattattatggacgaaccgacaacggcattaacagaagtagaggttgaacagctttataaaattattgaaacggtaagacaaagagggatttcaattatctttatttcacataagttagatgaagtttttcgtgtttctgatgaaatcacagtaattcgtgatggtcaatatgtaggtacgaaactaacctcagaagtaaccaaagatgaattgatttctatgatggttggtcgtgatatgtcagaaatgttccaacgtgaacgtattgtcatttctgatgaagttgtactcgaaattaaaaatttctctcgtgcaggcaaatatcatgatattaatttccaagtgcgtagaggagaaatctttggtattgccggtctagttggtgcaggtcgttctgagattgtagagggattgtttggttataaactggctgatagtggtgaaatctatgttcatggcgaaaaagccgatattaaaaccccgttagatgctatgaaatacaaaattggctttgtaacggaagatcgtaagttaacaggactgtttttaaatttaagtattactgacaatatgattatgcctagaatgtccccttacttggaaaattttttagtgtcggtgacaaaagcacagaagtcagcaaatgctcaaaaagataaattaaaaattaaagcaccaaatgttgaggtcattaccaataatttatctgggggtaatcagcaaaaagttttattggctcgttggttattacttgagccggatattttaattttagatgaaccaacaaaaggtattgatgttggggcaaaagctgagctttataaactcatggtggaattagcaaaacaaggtaagagtattatcatgattacatcagatatgcttgaattgctttcgatgagtgacagagtgatggtaatgcacgaaggtcgtgtagccggaattattccacaagaagaattgacccaagaacgggtacttgaattagcatccggtttaggtcaagtataa

SEQ ID NO: 27455 - protein, 505 aa, Haemophilus somnus 129PT
MNDLSRSPYILEMRNVSKTFPGVKALDGINLKVKRGTIHALMGENGAGKSTLMKILYGIYTPDAGGELILDDKPFKPSAPIDAIRTGLTMVPQEISPAGNLTIADNFYLGREITRSKFFLNQKEMDCKTAEILNELGIPMDVTAKMSDVSVAKAQLVAIATAVSNDAKVIIMDEPTTALTEVEVEQLYKIIETVRQRGISIIFISHKLDEVFRVSDEITVIRDGQYVGTKLTSEVTKDELISMMVGRDMSEMFQRERIVISDEVVLEIKNFSRAGKYHDINFQVRRGEIFGIAGLVGAGRSEIVEGLFGYKLADSGEIYVHGEKADIKTPLDAMKYKIGFVTEDRKLTGLFLNLSITDNMIMPRMSPYLENFLVSVTKAQKSANAQKDKLKIKAPNVEVITNNLSGGNQQKVLLARWLLLEPDILILDEPTKGIDVGAKAELYKLMVELAKQGKSIIMITSDMLELLSMSDRVMVMHEGRVAGIIPQEELTQERVLELASGLGQV

SEQ ID NO: 27456 - DNA, 1566 bp, Pseudomonas syringae pv. syringae B728a
  CDS (1)..(1566)
atgcagttcggccccaaacctttgttcgagaatgtctcggtcaagtttggcgctggtaaccgttacggcctgattggcgcgaacggctgcggcaagtccacgttcatgaaaatcctcggtggcgacctcgagccttcgggtgggcaggtgatgctggagccgaacgtgcgtctgggtaaactgcgccaggatcagttcgcctatgaagagttcacggtgctcgacaccgtgatcatgggtcacgaagagctgtggaaggtcaaggccgagcgcgaccgcatctattcgctgccggaaatgagtgaagacgacggcatggccgttgccgagctggaaaccgagtttgccgaaatggacggctacactgccgaatcccgcgccggtgaattgctgttgggtctgggtatcggcatcgaacagcacaacggcccgatgagcgaagtctcgccgggctggaagctgcgcgttctgctggcgcaggcactgttctctgatccggaagtgctgctgctcgacgaaccgaccaaccacctggacatcaacaccattcgctggctggaaaacatcctgacccagcgtaacagcctgatgatcatcatctcccacgaccgtcacttcctgaacagcgtgtgcacgcacatggccgacctggattacggcgagttgtgcctgttcccgggcaactatgacgagtacatgaccgtggcgacccagtcccgcgagcagctgctgtccgacaacgccaagaagaaagcccagatttccgaactgcaatcgttcgtcagccgcttctcggccaacgcctcgaaagccaagcaggccacctcccgagccaaggcgatcgacaagatccagctggccgaggtcaagccatccagccgtgtcagcccgttcattcgtttcgagcagaccaaaaagctgcaccgtcaggcggtcatcgtcgatcgcatggccaaaggcttcgacggcaagaccctgttcaaggacttcagcttccaggtcgaagccggcgagcgtgtggccatcatcggcccgaacggcatcggcaagaccaccctgctgcgcaccctggtcaacgagttgcaggcggatgccggcacggtcaagtggaccgacgcagcggaaatcggctattacgctcaggaccatgctcacgatttcgaggatgactccaccctgttcgactggatgggtcagtggacccagggcggcgagcaactggtacgtggcactctgggccgcatgctgttctccaacgacgagatcctcaaatcggtgaaggtaatttccggtggtgaacagggccgcatgctgttcggcaagctgatcctgcaaaagcccaacgtgctggtgatggacgaaccgaccaaccacctggacatggaatccatcgagtcgctgaacctggcgctggaaaactatccaggcacactgattttcgtcagtcacgaccgcgagttcgtgtcctcgctggcaacccgcatcatcgaactcagcccaagtggcgtggtcgatttcagcggcacctatgacgactacctgcgtagccagggcgttacgttctaa

SEQ ID NO: 27457 - protein, 521 aa, Pseudomonas syringae pv. syringae B728a
MQFGPKPLFENVSVKFGAGNRYGLIGANGCGKSTFMKILGGDLEPSGGQVMLEPNVRLGKLRQDQFAYEEFTVLDTVIMGHEELWKVKAERDRIYSLPEMSEDDGMAVAELETEFAEMDGYTAESRAGELLLGLGIGIEQHNGPMSEVSPGWKLRVLLAQALFSDPEVLLLDEPTNHLDINTIRWLENILTQRNSLMIIISHDRHFLNSVCTHMADLDYGELCLFPGNYDEYMTVATQSREQLLSDNAKKKAQISELQSFVSRFSANASKAKQATSRAKAIDKIQLAEVKPSSRVSPFIRFEQTKKLHRQAVIVDRMAKGFDGKTLFKDFSFQVEAGERVAIIGPNGIGKTTLLRTLVNELQADAGTVKWTDAAEIGYYAQDHAHDFEDDSTLFDWMGQWTQGGEQLVRGTLGRMLFSNDEILKSVKVISGGEQGRMLFGKLILQKPNVLVMDEPTNHLDMESIESLNLALENYPGTLIFVSHDREFVSSLATRIIELSPSGVVDFSGTYDDYLRSQGVTF

SEQ ID NO: 27458 - DNA, 1545 bp, Desulfovibrio desulfuricans G20
  CDS (1)..(1545)
atgacccagaacacaccgcttttttcaatggaatccgtcagtgtccggcacaacagcgttccggcactggatgcagtcagctggacgctgcaccgcggtgcgcactgcgccgtgctgggcggcaacggcgccggcaaatcgactctgttacggcttgccgccggagcaatacgccccgaccagcacgacggcggcaccgtattatggtttccccgcggctcggcagaagattcgcccattgccgtacgcacacactgcggtcttgtttcggcagagcagcaggagcactacctgcgccgctcatggcgcataacaggcgaagaaatcgtgctttccggctatttcggcacggacatgctgtaccgtccagccggtacggcacagcgccatgcggccgcccgactggcaaaagcgctggacgcggagcatctgatgccggttatgctcgaagccatgtcgcagggacagttgcgcaaaatccttctggcgcgcgccatggtccattcgccgcagctgcttctgctggatgaagtatgcgaaggtctggatgcagctgcccgccgcgaaatgctggcagccatcgaccgtgcggctgctctgggtaccaccgtgcttatgagcgggcacagagccgggcagtttccggactgtatccggcaggccgtgctgctccgtcagggcaggctggtatttaccggcggactgcatcaggcgctgcacctgatgcgcaccacgcaccagcccttgccggccggtgcatcagacaccgcggccggacagtgcagctgctgcacgccgccccccgcatgtgcgggggcagcgccggtggtggaaatagaacacgccgatgtgtatctgggacgcacgccggtgctgcatgacataacatggagcatattaccggggcagaactgggtggtccgcggcccgaacggagcaggaaaatcaaccctgctccggctgctgtacggcgatcagagacaggcctggggcggtatagtgcgctggttcggcatggccggaccggtgccgcttgaagaagtgcgccgcaacgtggcgctggtctccgacagagtgcaggcgctttacggtcatgacggctaccactccacccggcttgagctgaacggcgaggaactggtgcacaccggtttttacgattccacgggactgtggggaaagacacccgacgcgcaacagcacgccgcagccctgcgctggatggaccggctgggcattgcggcgctggccggcactgacatccgccgcatgtcctacggcacgttacggcgttttatgctggcccgcgctctcgtacgcgatccgcagctgctcatccttgacgaaccgctttccggccttgatgaatccgcccgccgcatcatgcttaccacgctgtccgcacttatgcggtcgggcaggcagctggtgctggtgacccaccatcaggaagacatccagccggaaacaacccatgaactgcacctgaatgccggacgcataacatactgcggaccggtttgccccgcaggagacaccctgtga

SEQ ID NO: 27459 - protein, 514 aa, Desulfovibrio desulfuricans G20
MTQNTPLFSMESVSVRHNSVPALDAVSWTLHRGAHCAVLGGNGAGKSTLLRLAAGAIRPDQHDGGTVLWFPRGSAEDSPIAVRTHCGLVSAEQQEHYLRRSWRITGEEIVLSGYFGTDMLYRPAGTAQRHAAARLAKALDAEHLMPVMLEAMSQGQLRKILLARAMVHSPQLLLLDEVCEGLDAAARREMLAAIDRAAALGTTVLMSGHRAGQFPDCIRQAVLLRQGRLVFTGGLHQALHLMRTTHQPLPAGASDTAAGQCSCCTPPPACAGAAPVVEIEHADVYLGRTPVLHDITWSILPGQNWVVRGPNGAGKSTLLRLLYGDQRQAWGGIVRWFGMAGPVPLEEVRRNVALVSDRVQALYGHDGYHSTRLELNGEELVHTGFYDSTGLWGKTPDAQQHAAALRWMDRLGIAALAGTDIRRMSYGTLRRFMLARALVRDPQLLILDEPLSGLDESARRIMLTTLSALMRSGRQLVLVTHHQEDIQPETTHELHLNAGRITYCGPVCPAGDTL

SEQ ID NO: 27460 - DNA, 1473 bp, Actinobacillus pleuropneumoniae serovar 1 str. 4074
  CDS (1)..(1473)
atgccaaatatcaacatccagaacgccttattttcccttgctcaacacaataaactgtcgattgaatcgctggaaatcaatactcacgatttctgggtgattgtcggcggtaacggctcgggtaaaactgctttcgcccaagcgctacataattcactttcactatattcgggcgaatatcaaaacagcttccaacatatcgctttactttccttcgagcagcaacaaaaaatcatcgagcaaatctttaaacaccgtaacaacgatatgatttcaccggatgatttcggtttaacagcacgtcaaattatcttaaacggtagcgaaaaaacgcaattatgcgaggaatatgaggctaaattacgcattcaaccgttattagatcgcccgtttattcagctctccaccggcgaaagtcgcaaagtgttattttgccaaatgttggttagtgaaccggatttattgattctagatgagcctttcgaagggttagaccaagcctcggtcgcttattggcaagacgttatggcgcaactcggcaagcaaatggcggtggttctgatttctaaccgctttaacgatattcccaactgtgctacgcatatcgctttattggataatctacaactgattttacaaggcgaacgccaagcgattgagcaacaagcggtctattctcagctaaaatttgcagaacagaatgtgaatgcgccgttaccggacagtgccgcaccgctgattcagctcccaccgaataccaatccgttcgaactgaaaaacgtgatgattcgttacggcgaaaaaaccattattgatgatctaacttggacggttgccccaaaacaacattggtggattaaaggcccgaacggagccggcaaatcgaccttactttcgattattaccggcgatcatccgcagtcttatgccaattctgtgcatttattcggtcgtcagcgtggctccggcgaaacgatttgggatattaagaaaaatatcggctatgtaagtagtcaattacatatggattatcgggtgaattgttcggcgttagatgtgattttatccggcttttttgattcaatcggtgtttaccaacaagtgccaagtgccttacagctcaaagcaatggaatggctggaacgcttacatttagccaatctggcgaaaaaaccgttccgttcactttcgtgggggcaacaacgtttattattgattactcgagccatggtaaagcatccgccgattctaattttagacgaacctctgcaaggcttggatggtgtaaaccgcaaattggttaaacagtttatcgagcagttggtcactaacagccaaacccagttgctatttgtttctcatcaagatgcggacgccccaaattgcatcacccatttatttgaatttgtcccgcaagagaatggtggttatcgatacgtacagacggctttgaatcaaatagaaaacgcctga

SEQ ID NO: 27461 - protein, 490 aa, Actinobacillus pleuropneumoniae serovar 1 str. 4074
MPNINIQNALFSLAQHNKLSIESLEINTHDFWVIVGGNGSGKTAFAQALHNSLSLYSGEYQNSFQHIALLSFEQQQKIIEQIFKHRNNDMISPDDFGLTARQIILNGSEKTQLCEEYEAKLRIQPLLDRPFIQLSTGESRKVLFCQMLVSEPDLLILDEPFEGLDQASVAYWQDVMAQLGKQMAVVLISNRFNDIPNCATHIALLDNLQLILQGERQAIEQQAVYSQLKFAEQNVNAPLPDSAAPLIQLPPNTNPFELKNVMIRYGEKTIIDDLTWTVAPKQHWWIKGPNGAGKSTLLSIITGDHPQSYANSVHLFGRQRGSGETIWDIKKNIGYVSSQLHMDYRVNCSALDVILSGFFDSIGVYQQVPSALQLKAMEWLERLHLANLAKKPFRSLSWGQQRLLLITRAMVKHPPILILDEPLQGLDGVNRKLVKQFIEQLVTNSQTQLLFVSHQDADAPNCITHLFEFVPQENGGYRYVQTALNQIENA

SEQ ID NO: 27462 - DNA, 2613 bp, Actinobacillus pleuropneumoniae serovar 1 str. 4074
  CDS (1)..(2613)
atgggtaaatcaactctcttatcactcattgcaggtgtgaaaatcctacagcatgggtctattaccgtctttgatcaaaatattgcgaaccaagccgaacgtgaagctcttactcacaaaatcgccttcatgccgcaaggtttaggcaaaaatctctatctcacgttgtcgatttacgacaacgtcgattttcatgcgcgcctcttcggtctttctccgttacaacgacgagctaaaatccaacgtttacttagagcgaccggcttattaccctttgccgatcgtcccgcaggaaaattatctggcggtatgaaacaaaaacttagtttatgctgtgctttagtacacaatccggatttactgattttagatgaaccgactaccggcgtagatccgctttctcgccgccaattttggcaattagtaaaagaattacgtgccgagtcgccggaaatgacggtaattgttgcaaccgcttatattgatgaagccgaaaattttgcgcacgttttagcgatggataacggcaaaattattgcgcataaacccactcaacaactcattgcagaaatgcaagtacaaaatcttgaacaggcatatatcaaattattacctccggaaaaacgaggagcggaaaacggtattgaaattcagccattccaatattcaccgaatgaaccgcccgttattattgctaaaaatttaaccaaaaaattcggtaattttatttctgtagataatgtcagttttgaaattgccaaaggtgagatctttggcttcctcggttcaaacggttgcggtaaatccaccacaatgaaaatgctaaccggtctactagatcctaccgaaggcgaggcgacattgttaggtcagcctatcaatgccggcgatattgatactcgtaagcgggtaggctatatgtcgcaagccttttcgttgtatgaagagttgagtgtcaaagaaaaccttgcattacacgctaaactttatcaactgccgaaagatgaatggtcaagcagaatccaagcggcattaatgcaatttgatttattagagacggcagaatatacaccggccgatttaccgctggggattcgccaacgattacaactcgctgccgcctgcttacacaaacctgaagttttgattctagacgaacctacatcaggtgtggatcctgccgctcgagatatgttttggtcctatttgattaaactttcacgtgaagatcatatcaccattttcgtaaccacccattttatgaatgaagcggcacgttgcgatcggatttctcttatgcaccgaggcaaagttttagcggttggttcgcctgaagcgttacgccttgaaaaacaatccgccacattagaacaagccttcattaaatatttagaagaacaggcggacgacatcacaatgccaaccgaatccaacgaagtacaggaaattcaagaagaaccggtacaagcggtcaaattttggcaaaaatttacccattacttttctgttatcaccacctttgctttacgagaaagtaaagaattactccgagatagaatccgcttattattcgcattactcgggccgctgattatgttgttggctatggggtccagtatttccttcgatattaatccgttaaaaatggcagtattagatcacgataacagttcggaaagtcgtaaattaattgaaaatttacgaggctcacgttacttcatcttacaagagaatttatattcgatcgatgaaattagctccgtcctacaagtgggtaaagtacgtgttgttttagaaattccggcacacttcggacggaatctactccgccgccaacaaccggaactgggcttgtttattgacggagcttttccttccactgcagaaaatttaaagggttcggccacaggtgttatcttacaatatataaaagatatgcaaaaacaagcaggctttactatcacgcaaaataatctgattgagccaagaatggtttataaccaagatttcaaaagtatttttgcaatgacgccgggaattattatgttagccatggtgatgatcccaacgatgatgaccgcactaagtgtggtgcgtgaaaaagagattggttctattatgaatctatacggctcgccggcttcgtcctttcagtttttatttggcaagcaactgccttatatcgttttagcctttgtaagctatttagtgttggtgctaaccgcaataatagtatttgatgttccgattaaaggctcaattccggcaatgttcttgggtgtcttgttaggcatctgcgcatccaccggttttggtttgctcgtttcaagttttgtgaaatcacaagtcgctgcaatttttgtagcggcaattgtatcaatgatcccgtcggttaatttttctggtgtgatgtatcctgtttcacggctggacgatagtgttcaattggtttctaaaatcttcccgggagcatggtttcaacaaatcagcttaggcggttttactaaaggattaagttttactcaatttgagcagagttatttagctctagccctcatttattttgtttacctcacacttgccactttggcattaaaaaaacaggaaaagtaa

SEQ ID NO: 27463 - protein, 870 aa, Actinobacillus pleuropneumoniae serovar 1 str. 4074
MGKSTLLSLIAGVKILQHGSITVFDQNIANQAEREALTHKIAFMPQGLGKNLYLTLSIYDNVDFHARLFGLSPLQRRAKIQRLLRATGLLPFADRPAGKLSGGMKQKLSLCCALVHNPDLLILDEPTTGVDPLSRRQFWQLVKELRAESPEMTVIVATAYIDEAENFAHVLAMDNGKIIAHKPTQQLIAEMQVQNLEQAYIKLLPPEKRGAENGIEIQPFQYSPNEPPVIIAKNLTKKFGNFISVDNVSFEIAKGEIFGFLGSNGCGKSTTMKMLTGLLDPTEGEATLLGQPINAGDIDTRKRVGYMSQAFSLYEELSVKENLALHAKLYQLPKDEWSSRIQAALMQFDLLETAEYTPADLPLGIRQRLQLAAACLHKPEVLILDEPTSGVDPAARDMFWSYLIKLSREDHITIFVTTHFMNEAARCDRISLMHRGKVLAVGSPEALRLEKQSATLEQAFIKYLEEQADDITMPTESNEVQEIQEEPVQAVKFWQKFTHYFSVITTFALRESKELLRDRIRLLFALLGPLIMLLAMGSSISFDINPLKMAVLDHDNSSESRKLIENLRGSRYFILQENLYSIDEISSVLQVGKVRVVLEIPAHFGRNLLRRQQPELGLFIDGAFPSTAENLKGSATGVILQYIKDMQKQAGFTITQNNLIEPRMVYNQDFKSIFAMTPGIIMLAMVMIPTMMTALSVVREKEIGSIMNLYGSPASSFQFLFGKQLPYIVLAFVSYLVLVLTAIIVFDVPIKGSIPAMFLGVLLGICASTGFGLLVSSFVKSQVAAIFVAAIVSMIPSVNFSGVMYPVSRLDDSVQLVSKIFPGAWFQQISLGGFTKGLSFTQFEQSYLALALIYFVYLTLATLALKKQEK

SEQ ID NO: 27464 - DNA, 2763 bp, Dechloromonas aromatica RCB
  CDS (1)..(2763)
atggaccgcgtgccggtcgcgaagttatccgcagtcagccatcgctacggcgctgtggtggcgctggagggggttgatattgagctgccggccggttgtatggtcgggttgatcgggccggatggcgtcggcaagtcatcgctgctggcgttggtctccggggcacgacagattcagacgggcaaggttgaggtgctgggtggcgatatcggcgaccgccattttcgtgccatggcccagccgcgcattgcctacatgccgcagggactgggcaagaatctgtacccgacgctgtcggttttcgagaatgtcgatttcttcggccggctgttcgggcagggcaaacgagagcgcgagcagcgcatcaatgaactgctgaccagcactggccttgcccctttccgcgatcggcctgcggccaagctgtcaggcggcatgaagcagaagcttggcctgtgctgcgccctgatccacgatcccgacctgctgattcttgacgagccgacaaccggcgtcgatccgctgtcccgtcgccagttctgggaactgatcgacagcatccgcgcccggcggcccggcatgagcgtgctggtggcaacggcctacatggaagaggctgagcgtttcgactggctggtggcgatggacgacggcaaggtgatcggcaccggtacgccggccgaacttcggaaacagaccgggcaggagactctggatggcgccttcattcagttgctgcctgaggaacgtcggcaggctcaccatgcgctggtgattccgccgcgtgtcggcgatggcggcacctttgccatagaggcagatgggctgtcgcagcggtttggcgactttacggccgtcgaccgcgtcagtttcaagatcgaacctggcgaaattttcggctttctcggctccaatggctgcggcaagacgacgacgatgaagatgctgaccggtctgttgccgccaactgagggtgtcgccaagctgttcggcaagatgctcgacgcccgcgatctggagacgcgcaaacaggtcggctacatgtcgcaatccttctcgctgtacggcgagctgacggtgcgtgccaacctcgatctgcacgcccgacttttcaacctgtcggatgatcggcgagggccacgtatcgccgaactgatggcccgttttggcctggagccttatgccgacaaggcggcggccgaattgccgctcggtatccgccagcgcctgtcactggctgtggccgtggtccacgagccgaagctgctgatcctcgacgagccgacttcaggtgtggacccggtagcgcgcgacgaattctgggcgttgctggttgagttgtcgcgccagcaaggcgtgaccatcttcatttcgacccacttcatgaacgaggctgagcgctgcgatcggatttcgctgatgcatgccggcaaggtgctggccagcgatacgccggccagcttgtgcaagacacgcggcgagccgacgctggaggcggcgttcatcagctatctggaagaggcaacgggcattgccggccaggctgccgtgagcagcccggaaaaggtgtccaaaaccgaagcggccgaggttgaaacgcctgatcgcaccaatggagccagtaatcagcggccgagcgccttcagcccgcgccgcctgctcggctacgcctaccgcgaatcgctggaattgcgccgtgatccgatccgcctggctttcgcgctgctcggttcggtgctcttgatgttcgtgctcggctttggtatttcgctcgatgtcgaagggctccgctttggcgtgctcgaccgcgaccagtcaccagagagccgggcctacatccagaatatcgctggttcccgctatttcatcgagcagccgcccatactcgacgatgccgatctcgagcgccgcatgcgtaacggcgagttatcgctggccatcgatattccggccagtttcggccgtgacctgcggcgcagccactggccggaagtcggcgtctggatcgacggtgccatgccctatcgcggtgaaacggtgcgcggctatatccagggcctgcatctcgattacgtgcagcagatcgtccaggaggcgacgggccagactagcagctatccggtcaatatcgtctcgcgattccgctataaccaggacgtcaagagcatctacgccatggtgccggcggtcattcccatcctgctcatcttcattccggccatcctgatggcgctcggcgtcgtgcgcgagaaggaactcggctcgatcaccaatctctacgtcactccggtgacccgcctcgaattcctgcttggcaaacagttgccctacatcgtcgtcgccctgatcagtttcgcgctgctcgtcatccagtcgcagatcatgttccatgtgccgatcaagggcagcctgctcgccctgagcttcggggcctttctctacgtcatcgccaccaccggctttggcctgctgatctccaccttcaccagtacgcagatcgctgcgctgtttggcacggcgatcctgaccatattgccgaccgtcagcttttccgggttgacgacgccggttggtgcgctggaaggcgtcagctactggatcggccagttcttcccggccagctatttcctgatcatcagccgcggcaccttcaccaaggcgctcggttttgccgacctgctgccgcaattcatggcgctggccatcttcatcccggtgctgacgctgatctcggtcgccttgcttaaaaagcaggagaaatag

SEQ ID NO: 27465 - protein, 920 aa, Dechloromonas aromatica RCB
MDRVPVAKLSAVSHRYGAVVALEGVDIELPAGCMVGLIGPDGVGKSSLLALVSGARQIQTGKVEVLGGDIGDRHFRAMAQPRIAYMPQGLGKNLYPTLSVFENVDFFGRLFGQGKREREQRINELLTSTGLAPFRDRPAAKLSGGMKQKLGLCCALIHDPDLLILDEPTTGVDPLSRRQFWELIDSIRARRPGMSVLVATAYMEEAERFDWLVAMDDGKVIGTGTPAELRKQTGQETLDGAFIQLLPEERRQAHHALVIPPRVGDGGTFAIEADGLSQRFGDFTAVDRVSFKIEPGEIFGFLGSNGCGKTTTMKMLTGLLPPTEGVAKLFGKMLDARDLETRKQVGYMSQSFSLYGELTVRANLDLHARLFNLSDDRRGPRIAELMARFGLEPYADKAAAELPLGIRQRLSLAVAVVHEPKLLILDEPTSGVDPVARDEFWALLVELSRQQGVTIFISTHFMNEAERCDRISLMHAGKVLASDTPASLCKTRGEPTLEAAFISYLEEATGIAGQAAVSSPEKVSKTEAAEVETPDRTNGASNQRPSAFSPRRLLGYAYRESLELRRDPIRLAFALLGSVLLMFVLGFGISLDVEGLRFGVLDRDQSPESRAYIQNIAGSRYFIEQPPILDDADLERRMRNGELSLAIDIPASFGRDLRRSHWPEVGVWIDGAMPYRGETVRGYIQGLHLDYVQQIVQEATGQTSSYPVNIVSRFRYNQDVKSIYAMVPAVIPILLIFIPAILMALGVVREKELGSITNLYVTPVTRLEFLLGKQLPYIVVALISFALLVIQSQIMFHVPIKGSLLALSFGAFLYVIATTGFGLLISTFTSTQIAALFGTAILTILPTVSFSGLTTPVGALEGVSYWIGQFFPASYFLIISRGTFTKALGFADLLPQFMALAIFIPVLTLISVALLKKQEK

SEQ ID NO: 27466 - DNA, 1632 bp, Rhodobacter sphaeroides 2.4.1
  CDS (1)..(1632)
atgaccggccgcgacgccagcgacgcgggggcgccggtcctcgacgtgtcgaacctcaccgtccgcttccggcaggacgggcggaccgtcgaggcggtgaagggcgtctccttcaccgtcgggcgcggcgagaccgtggcgctggtgggcgagagcggatcgggcaagtcggtgacggcgctctcgacggtggcactcctgcccgacagcgccgaggtcggcggatcggtccgctacgagggccgcgagatggtgggcgcccccgcggccgagctgcgccgggtgcgcggcaatgacatcagcttcatctttcaggagccgatgacctcgctcaacccgctgcacacgatcgagcggcagatcggcgagagcctcgctttgcatcagggcctcgccggagaggcggcgcgggtgcggatcctcgagctgctgagcaaggtcggcatccgcgatcccgagacgcggctcggcgcctatccgcatcagctgtcgggcgggcagcggcagcgggtgatgatcgccatggcgctggccaacgggccggatctgctgatcgccgacgagcccacgaccgcgctcgacgtgacgatccaggcgcagatcctcgaccttctggccgagctgaagcgcaccgaggggctgagccttctgttcatcacccacgatctcggcgtggtgcgccgcatcgccgaccgggtctgcgtcatgcagggcggcgccatcgtcgagcagggcccggcgcggcgcatcttcgaggcgccggaacatccctatacccggaagctcctcgcggcggagcccacgggcaggcccgatccggtgcccgagggggcgaaggagatcgtgcggaccgacgggctgcggatctggtttccgatccagcgcgggatcctccggcggacggtcggccatgtgaaggcggtgaacggcgtcagcctctcgatccgcgagggcgagacgctgggcgtggtgggcgagagcggctcgggcaagacgacgctcgggctcggcatcctgcggctgatcgagtccgaggggccgatcctctttctcgggcaggagatccacagccgccggtcgcgggcgctgcgcgagatccggcgcgacatgcagatcgtgtttcaggacccgtatggcagcctctcgccgcggatgacggtcgagcagatcgtggccgaggggctgggcgtgcatggcgtcgagccgggacgcgaccgccgctcgatggtggccgagatcctgaccgaggtcgggctcgatccggcggcgatggggcgctatccgcacgaattctcgggcggccagcgccagcgcgtggccatcgcccgcgccatgatcctgcggccgaagttcgtcgtgctggacgagccaacgagtgcgctcgatatgacggttcaggtgcagatcgtggaccttttgcgcgacctgcagcggaaatggggtctggcctaccttttcatcagccacgacctgcgggtggtgcgcgccctctcgcacaaggtgatcgtgatgaaggagggcaatgtcgtcgaggcgggggagggggcggagctcttcgccgcgccgcagaccgactatacccgcacgcttctggcggcggccttcggagacgcggtgcccgaagccgtgtga

SEQ ID NO: 27467 - protein, 543 aa, Rhodobacter sphaeroides 2.4.1
MTGRDASDAGAPVLDVSNLTVRFRQDGRTVEAVKGVSFTVGRGETVALVGESGSGKSVTALSTVALLPDSAEVGGSVRYEGREMVGAPAAELRRVRGNDISFIFQEPMTSLNPLHTIERQIGESLALHQGLAGEAARVRILELLSKVGIRDPETRLGAYPHQLSGGQRQRVMIAMALANGPDLLIADEPTTALDVTIQAQILDLLAELKRTEGLSLLFITHDLGVVRRIADRVCVMQGGAIVEQGPARRIFEAPEHPYTRKLLAAEPTGRPDPVPEGAKEIVRTDGLRIWFPIQRGILRRTVGHVKAVNGVSLSIREGETLGVVGESGSGKTTLGLGILRLIESEGPILFLGQEIHSRRSRALREIRRDMQIVFQDPYGSLSPRMTVEQIVAEGLGVHGVEPGRDRRSMVAEILTEVGLDPAAMGRYPHEFSGGQRQRVAIARAMILRPKFVVLDEPTSALDMTVQVQIVDLLRDLQRKWGLAYLFISHDLRVVRALSHKVIVMKEGNVVEAGEGAELFAAPQTDYTRTLLAAAFGDAVPEAV

SEQ ID NO: 27468 - DNA, 1557 bp, Burkholderia cepacia R18194
  CDS (1)..(1557)
atggacgcacagcttcccgccgcaaccgatgccgccgatggcggcgaagcgaagcccgtcgtgctcgagacgcgcggcgtcggcaagaccttcggtgtcgtgcgcgcgctcaacggcgtctcgctgtcgctgcgtgcgggcgaggtgcacgggctgatgggcgagaacggcgccggcaagtcgacgctgatcaagatcctcaccggcttccaccagcctgatgcgggcgagatcctcgtcgatggcgtaccggtgtcgttcgacagtccgcgtgccgcgcagcgtgcaggcatctgcgcggtctaccaggaaatcaacctgatccccgagcgcagcgtggccgagaacatctttctcggtcacgagccgcgccgcttcggcccgtggatcgaccggcgcgagatgctggcgcgcacgcgcgaaatcgtcgagcgctacgggctcgcggtcgacccggcagacaaggtcgggtcgctcgggctcggccagcagcagatggtgtcgatcgcgcgcggcgtgtcgctcggcgcacgcgtgctgattctcgacgaaccgacgtcggcgttgagcggggcggaagtggaggtgctgttcggtgtcgtcgatcaactgcgtgcgacgggcattgcgatcgtgctggtgagccatcgattatccgagtgctaccggatgtgcgaccggctcaccgtgctgcgcgatggcgcggtcgtgcgcagcgatacgcccgaccggctgccgcgcatggcgctgatctcggcgatgctcggccgcgaggttggcgcgcacggcccacgcgaacaggcggaagcggccgctgccgatacgacgcagacaccggcgctcgccgtcgaccgcttgcgctggggcacgcgcctgcgcgacgtgacgttccgtgtcgcgccgaaggaaatcgtcgggctcgcgggcttgctcggcgcgggccgcaccgaaaccttcaaggccgtgttcggcgcgcagcagccggacggcggcacggtgcgcgtcggcggccgtgtgctcgacggcgcggacccggcgcgggcgattcgcgcggggctcgcgttcctgtccgaggatcgccgctcggaaggcattttctcgaagctgtcggtgcgcgagaacatcgtcgtgtgcgtgctgccgcgtatcgcgcggttcggcttcatttccgtgcgcaagcaggaggcgctcgtcgaacgctatatccgcgagctcggcatcaagacgtcgcatgcgggcgcgccgatctcgacgctgtccggcggcaaccagcagaaggcgctgatcgcgcgctgcctgtcgaccgagccgacggtgctgctgctcgacgatccgacgcgcggcatcgacgtcggcgcgaaggcggaagtacacgacctcgtcaaacggctcgccgatgcggggctggcggtggtcgcgacgtcgtcggagatggaagaactgctcgagctggccgaccggctcgtgatcctgcatgaaggcgcgacgagcggcgagctgtcgacgcgtggcgcgagccccgacgacgtgaccgcgctgctcgcgaaccaggcgtaa

SEQ ID NO: 27469 - protein, 518 aa, Burkholderia cepacia R18194
MDAQLPAATDAADGGEAKPVVLETRGVGKTFGVVRALNGVSLSLRAGEVHGLMGENGAGKSTLIKILTGFHQPDAGEILVDGVPVSFDSPRAAQRAGICAVYQEINLIPERSVAENIFLGHEPRRFGPWIDRREMLARTREIVERYGLAVDPADKVGSLGLGQQQMVSIARGVSLGARVLILDEPTSALSGAEVEVLFGVVDQLRATGIAIVLVSHRLSECYRMCDRLTVLRDGAVVRSDTPDRLPRMALISAMLGREVGAHGPREQAEAAAADTTQTPALAVDRLRWGTRLRDVTFRVAPKEIVGLAGLLGAGRTETFKAVFGAQQPDGGTVRVGGRVLDGADPARAIRAGLAFLSEDRRSEGIFSKLSVRENIVVCVLPRIARFGFISVRKQEALVERYIRELGIKTSHAGAPISTLSGGNQQKALIARCLSTEPTVLLLDDPTRGIDVGAKAEVHDLVKRLADAGLAVVATSSEMEELLELADRLVILHEGATSGELSTRGASPDDVTALLANQA

SEQ ID NO: 27470 - DNA, 1614 bp, Pseudomonas fluorescens PfO-1
  CDS (1)..(1614)
atgaccgacaacctgattgaaatccgcgacctgcgcgtcgccttcgccgggcacgaagtggtgcacggcgtgaacctcgacatccgccgtggcgaatgcctggcactggtcggtgaatccggctcgggcaagtcggtgacggcgcactcgatcctgcgtttgctgccaggcaagaccgtcagtagcacgggcagcatccgctacaacggcgtggacttgctgcacgccagcgaacaacaactgcgcggcttgcgcggcaatcgcatcgcgatgattttccaggagccgatgacctcgctgaacccgttgcacacggtggaaaaacagatcagcgaagtgctggagatccacaagggactcaagggccgcgccgcgcgccagcgcacgctggagctgctggaactggtcggcattcgccagccgttgcagcgtttgaaggcctatccgcaccagctctccggcggccagcggcaacgggtgatgatcgccatggcgctggccaacgaaccggaattgctgatcgccgatgagccgaccacggcgctggacgtgaccgtacagcagaagattctcgagctgctgatcgagttgcagcaacgcctgggcatgtcgctgctgctgatcactcacgacctcaatctggtgcgacgcatcgcccaacgggtgtgcgtgatgcgccacggggagatcgtcgaacaggccgactgcgaaacactgttccgcgccccgcagcatccttacagtcgcctgctgatcgaggcggaaccgtccggcgcgccggtgcagagtcgctacgatcacaacctgctggaggtggacgatctgaaagtctggttcccgctgcccaaggcgttgttcagccgcacccagcaatacatcaaggccgtggacggcgtgagtttccggctgcaacggggcaagaccctggggattgtcggcgagtccggctcgggcaagtcgacgctgggccaggcgattctgcggctggtggaatccgagggcgatattcgcttcggcaacaagcatttgagcctgctcaatcagcgcttgatgcgcccgttgcgccggcagattcaggtggtgttccaggacccgttcggcagcctcagcccacggatgtcggtgcagcagatcatcgccgaaggcctgctgacccacggcatcggcacgcccgaagaacgtgaggctgcggtgatccgcgtcttgaaggaagtcggcctcgatccgcagagccggcatcgctatccccatgagttctccggtggccagcgccagcgcatttccatcgcccgcgcattggtgctggaaccggcgttgattctgctcgacgaaccgacctcggcgctggatcgcacggtgcagaaacaggtggtggagttgttgcggcagttgcagatccgccatggcttgacgtacctgttcatcagccatgacctggcggtggtgcatgcgctggcgcacgacttgatggtgatcaaggacggcaaggtggtggaacaggggtcgtcccgggagatttttgcggcgccgcggcatgcctacacccaggaactcctgaaggcctccggcctggcattggcaaaaaccgggaaagagctggttacaacaatctga

SEQ ID NO: 27471 - protein, 537 aa, Pseudomonas fluorescens PfO-1
MTDNLIEIRDLRVAFAGHEVVHGVNLDIRRGECLALVGESGSGKSVTAHSILRLLPGKTVSSTGSIRYNGVDLLHASEQQLRGLRGNRIAMIFQEPMTSLNPLHTVEKQISEVLEIHKGLKGRAARQRTLELLELVGIRQPLQRLKAYPHQLSGGQRQRVMIAMALANEPELLIADEPTTALDVTVQQKILELLIELQQRLGMSLLLITHDLNLVRRIAQRVCVMRHGEIVEQADCETLFRAPQHPYSRLLIEAEPSGAPVQSRYDHNLLEVDDLKVWFPLPKALFSRTQQYIKAVDGVSFRLQRGKTLGIVGESGSGKSTLGQAILRLVESEGDIRFGNKHLSLLNQRLMRPLRRQIQVVFQDPFGSLSPRMSVQQIIAEGLLTHGIGTPEEREAAVIRVLKEVGLDPQSRHRYPHEFSGGQRQRISIARALVLEPALILLDEPTSALDRTVQKQVVELLRQLQIRHGLTYLFISHDLAVVHALAHDLMVIKDGKVVEQGSSREIFAAPRHAYTQELLKASGLALAKTGKELVTTI

SEQ ID NO: 27472 - DNA, 2721 bp, Pseudomonas fluorescens PfO-1
  CDS (1)..(2721)
atgaacagcgtcgcggttcacgcgaacgccatcactcaccgctatggcgagcggcaagcgctggatggcatcgcgttcggcctgccggccggtacccgctgcggcttgattggccctgacggagcgggcaaatccagtctgttggggctgattgcgggcgtgaaagccctccagcaagggcaactggaagtgcttggcggtccgatccaggatcgcagccaccgcaacacgctgtacgcgcgtatcgctttcatgccgcagggattgggcggcaacctgtacccggaactgtcgatccgcgagaacgtgcattttttcgccaccttgttcggcctctccgccgacgaaagcgcgcagcgcctgcacaacctgttgctcgccactgatctgctgaggttcgccgatcgaccggccggcaaactctccggtggcatgaaacagaaactcggactgtgttgcgcactgattcacgaaccggatctgttgatcctcgacgagccgaccaccggcgtcgatccgctctcgcgccgcaagttctgggaattgatcgacgatgttcggcgccaacgaccgcagctgaccctgctggtcgccacggcctacatggaggaagctgaacaattcgagcattgcctgatgctcgacggcggccggatgatcgccaccggtctgagccgcgaactggctgctgtcacgcccagcggcaagcttgatgacgccttcactcattttcagggtgaaagccgtcacgccactcaaccgctgcacatcccgccttacaccggcaacaccgatattgccatcgaggctcacgacctgacgttgcgtttcggcaactttacggctgtggatcgcgtcagcttcgccatcgggcgaggcgagattttcggtttccttggctccaatggctgcggcaagaccaccacaatgaaagtcctgaccggactgatgcccgccagcgaaggtaacgcaacgctgctgggcaatccggtggatgcgaaggatctggccacgcgcaaacgggtcggattcatgtctcagagcttttcgctgtatggcgaactcagcgtgcggcaaaaccttgaactgcacgcacgcctgttcgatttgccgaaaaccgagagcgcccagcgcatcgacgcgctgattcaacgcttcgatctgcacggtgtcgccaatcaatcgtccggggccttgcctctgggaatacgccagcgcctgtcactggcggtcgcggtcttgcacagcccggaagtgctgattctggatgagccgacctctggagttgatcccgcggcgcgagacgatttctggcgcctgttgatcgaactgtcccgtgatcaaggcgtgaccattttcctttccacccatttcatgaacgaagctcagcgttgcgaccgcatttccctgatgcacgcgggcaaagtgctggcctgtgacacgccgacggcactgcaacaacagtttggcggcaagtccctggaggcggcgttcgtgacctgccttgaacaggctcagggtagtgccgaaaccgccccgcctcccgcgccgtcaccggccccgaaggcgccggccagctccgtcagggagcgggttttcagtttcggtcgtctgacggcagtggctcgccgcgaaggcaaagaactgatccgcgacaaagtgcgcatggcgtttgcactgctgggtgccattttcatgatggtgatttttggcttcgggatttccctggatgtagagaacctggccttcgccgtgtatgaccaggatcaaacgccacaaagccgcgcctatctggaggccttccgcggctcccgctatttcgccgaacagccgcccatcgaagatgcacaggctctgcaccgccggctgcaacgttcggaaatcaaactggcgctggagatcccgcccggattcggccgcgacctgtacgccggacatcggccggaagtcgcggcgtggctggatggcggcatgccctttcgcgccgagaccagtcgcaactacgtcgaggccgtccatctggccaatcttgagcaacttgccgaacaaagcagcccggcattgaccctgtcagccccagccacgctgcagacccgctttcgctataaccaggatgtggtcagcgtcaatgccatcggccccggcgtgatggcgctgattctggccttcattccggcgatgctgactgcgctcggcatcgtgcgcgagaaagagctgggctcgatcaccaatttctacgccacgcccctgacccgcctcgaatttctgctgggcaaacaactaccctatctgctggtcagcctggtcaacctcgccgtgctcgtggcgatgaatcgctggctgttcggcgtgcccttcaagggcagcctgccgacccttgcgttcggcgggctgctgtatgtactggccactaccagcatgggcctgctgatttcagcgttcacccgaacgcagatcgcggcgatcctcggcaccatgatcatcaccagcctgccgaccatccagttctcgggtctgatcgtgccgcgttcttcgctggaaggagccgccgccgtgatgggcttgctgtttccggccggtcacttcctcgacatcgccgtaggaacgttcaccaaagctctggacctgcgtcaactctggccacaatgtctggcgctgggcggcttttttatcgggttcaccggcttgagcctgatcatgctgaagaagcaggaggcctga

SEQ ID NO: 27473 - protein, 906 aa, Pseudomonas fluorescens PfO-1
MNSVAVHANAITHRYGERQALDGIAFGLPAGTRCGLIGPDGAGKSSLLGLIAGVKALQQGQLEVLGGPIQDRSHRNTLYARIAFMPQGLGGNLYPELSIRENVHFFATLFGLSADESAQRLHNLLLATDLLRFADRPAGKLSGGMKQKLGLCCALIHEPDLLILDEPTTGVDPLSRRKFWELIDDVRRQRPQLTLLVATAYMEEAEQFEHCLMLDGGRMIATGLSRELAAVTPSGKLDDAFTHFQGESRHATQPLHIPPYTGNTDIAIEAHDLTLRFGNFTAVDRVSFAIGRGEIFGFLGSNGCGKTTTMKVLTGLMPASEGNATLLGNPVDAKDLATRKRVGFMSQSFSLYGELSVRQNLELHARLFDLPKTESAQRIDALIQRFDLHGVANQSSGALPLGIRQRLSLAVAVLHSPEVLILDEPTSGVDPAARDDFWRLLIELSRDQGVTIFLSTHFMNEAQRCDRISLMHAGKVLACDTPTALQQQFGGKSLEAAFVTCLEQAQGSAETAPPPAPSPAPKAPASSVRERVFSFGRLTAVARREGKELIRDKVRMAFALLGAIFMMVIFGFGISLDVENLAFAVYDQDQTPQSRAYLEAFRGSRYFAEQPPIEDAQALHRRLQRSEIKLALEIPPGFGRDLYAGHRPEVAAWLDGGMPFRAETSRNYVEAVHLANLEQLAEQSSPALTLSAPATLQTRFRYNQDVVSVNAIGPGVMALILAFIPAMLTALGIVREKELGSITNFYATPLTRLEFLLGKQLPYLLVSLVNLAVLVAMNRWLFGVPFKGSLPTLAFGGLLYVLATTSMGLLISAFTRTQIAAILGTMIITSLPTIQFSGLIVPRSSLEGAAAVMGLLFPAGHFLDIAVGTFTKALDLRQLWPQCLALGGFFIGFTGLSLIMLKKQEA

SEQ ID NO: 27474 - DNA, 1911 bp, Pseudomonas fluorescens PfO-1
  CDS (1)..(1911)
atgatccgacttcagaacctgactttacagcgtggcccgcaacgtctgctagaagacgccgagctgaccctgcacgccggccacaaagccggcctcatcggtgccaacggcgccggcaaatccagcctgttcgccttgctccgcggtgagttgcacccggactcgggcgactgcctgctgccggccgactggcgtatcgcccacatgcgccaggaggtcgacacactcgagcgtctggcggtcgactatgtgctcgacggcgacctgcgcctgcgcgaagtgcagcgtgagctcgcggcagccgaagaggcccacgacggcaccgcgctggcccgtctgcacgccgaactcgacagcgccgacggctacaccgccgatgcgcgtgcacgcaagttgctcgccggcctcggattcaccaacgagcagatggatcgtcaggtaggagatttctccggtggctggcggatgcgtctgaaccttgcgcaggctttgatgtgcccatcagacctgttgctgctcgacgaaccgaccaaccacctggatctcgacgccatcatctggctcgaagagtggctgaaaagttaccccggcaccttgctgctgatttctcacgaccgggacttcctcgatgaagtggtcgatcacgtggcccacgtcgatcagcgcaagctgacgctctaccgtggcggctacaccgcgttcgaacgcgcccgtgccgagcgtctggcccagcagcaacaggcctacgagaagcaacaggcgcagcgtgcgcacatggaaagctacatcgcccggttcaaggcccaggcgaccaaggcccgtcaggcccagagccggatcaaggcgctggagcgcatggaagagctgtcggctgcccacgtcgactcgccgttcgatttcgtgttccgcgagtcgaccaagatctccagcccgctgatcgatctgtccgatgcacgtctgggttatggcgagaaaaccgtgctggagaaggtcaagctgcaactgacccccggcgcgcggatcggcttgctcggccccaacggcgcgggtaaatcgaccctgatcaagaaccttgccggcgagctgtcaccgctggccgggcgcctgactcgcggtgagaacaccgtggtcggttacttcgctcagcatcaactcgactcgctggattccaaggccagcccgttgctgcacttgcagcgtctggcgccgaccgagcgcgagcagaccctgcgcgatttccttggtggtttcgacttccgtggcgcacggatcgacgaaccggtgctgaatttctccggtggcgaaaaggcccgtctggccctggcgctgatcgcctgggaacggccgaacctgctgctgctcgacgaaccgaccaaccacctcgacctggaaatgcgcctggcgctgaccatggcgttgcaggaattcagcggcgcggtgttggtggtttcccacgatcggcatctgctcaagagcaccaccgacaacttcttcctggtcgcggacagcaaggtcgaggagttcgatggcgaccttgaggactacgcccgttggctggtcgagtaccgtcagcgcaacgccccggtcagcaacacaccggtcaacccggacaagaccgacaagaaggcccagcgtcaagccgccgctgcgttgcgtcagcaactggcgccgcacaagcgcgaagccgacaagctcgaagccgagctcggcaagctgcacgagaagttggcgaaggtcgatgccagccttggcgacagcgacctctacgagccggcgcgcaagaacgaattgcgtgacttgctggccgaacaggccaagctgaaagtccgcgaaggcgaacttgaagaagcgtggatgcaagccctggaaaccctggaaagcatgcaggcggagctggaggcgttgtcctga

SEQ ID NO: 27475 - protein, 636 aa, Pseudomonas fluorescens PfO-1
MIRLQNLTLQRGPQRLLEDAELTLHAGHKAGLIGANGAGKSSLFALLRGELHPDSGDCLLPADWRIAHMRQEVDTLERLAVDYVLDGDLRLREVQRELAAAEEAHDGTALARLHAELDSADGYTADARARKLLAGLGFTNEQMDRQVGDFSGGWRMRLNLAQALMCPSDLLLLDEPTNHLDLDAIIWLEEWLKSYPGTLLLISHDRDFLDEVVDHVAHVDQRKLTLYRGGYTAFERARAERLAQQQQAYEKQQAQRAHMESYIARFKAQATKARQAQSRIKALERMEELSAAHVDSPFDFVFRESTKISSPLIDLSDARLGYGEKTVLEKVKLQLTPGARIGLLGPNGAGKSTLIKNLAGELSPLAGRLTRGENTVVGYFAQHQLDSLDSKASPLLHLQRLAPTEREQTLRDFLGGFDFRGARIDEPVLNFSGGEKARLALALIAWERPNLLLLDEPTNHLDLEMRLALTMALQEFSGAVLVVSHDRHLLKSTTDNFFLVADSKVEEFDGDLEDYARWLVEYRQRNAPVSNTPVNPDKTDKKAQRQAAAALRQQLAPHKREADKLEAELGKLHEKLAKVDASLGDSDLYEPARKNELRDLLAEQAKLKVREGELEEAWMQALETLESMQAELEALS

SEQ ID NO: 27476 - DNA, 1563 bp, Pseudomonas fluorescens PfO-1
  CDS (1)..(1563)
atgcagttcggcgccaagccgctgtttgaaaacgtttcggtcaaattcaacggcggcaaccgctatggcctgatcggcgccaacggttgcggcaagtcgaccttcatgaaaatcctcggcggcgacctcgagccgtccggtggccaggtcatgctggagccgaacgtacgcctgggtaaactgcgccaggatcagttcgcctacgaagaattcaccgtgatcgacaccgtgatcatgggtcacgaagagctgtggaaggtcaaggccgagcgcgaccgcatctactcgctgccggaaatgagcgaagaagacggcatggccgtggccgagctggaaaccgagttcgccgagatggacggctacaccgccgaatcccgcgccggtgaactgctgctgggtctgggcattccgctggaacagcatttcggtccgatgaccgaagtcgcgccaggctggaaactgcgtgttctgttggctcaggcactgttctccgatccggaagtgctgctgctcgacgaaccgaccaaccacctggacatcaacaccatccgctggctggaaacgattttgacggcgcgtaacagcaccatgatcatcatttcccacgaccgtcacttcctcaacagcgtctgcacccacatggccgacctggactacggcgagctgcgtctgttcccgggcaactacgacgagtacatgaccgcggcgacccagtcccgcgagcaactgctgtcggacaacgccaagaagaaagcccagattgccgaactgcaaacgttcgtcagccgcttctcggccaacgcctcgaaagccaagcaggccacttcccgcgccaagcagatcgacaagatccagctggccgaggtcaagccatcgagccgcgtgagcccgttcatccgtttcgaacagaccaagaagctgcaccgccaggccgtgaccatcgagcagatgtccaagggcttcgacggcaagactctgttcaagaacttcagctttaccgttgaagccggcgagcgcgtggcgatcatcggcccgaacggtatcggcaagaccaccctgctgcgcaccctgatgggcgaactgaccccggacacaggctcggtgaagtggaccgaaagcgcggagctgggctactacgctcaggaccatgcccacgacttcgaagaggacgtcagcctgttcgactggatgggtcagtggactcaaggcgaacaagtgatccgtggcaccctcggtcgcatgctgttctccaacgacgagatcctcaagtcggtgaaggtgatttccggtggtgagcaaggtcgcatgctgttcggcaagctgatcctgcaaaagccgaacgtgctggtgatggacgaaccgaccaaccacctggacatggaatcgatcgaggcgctgaacctggcgctggaaaactacccgggcacgctgatcttcgtcagccacgaccgtgagttcgtatcgtccctggccacgcgcatcatcgagctgagcccgaatggcgtgaccgacttcagcggcacctacgacgattacctgcgcagccaaggcgtagtgttctga

SEQ ID NO: 27477 - protein, 520 aa, Pseudomonas fluorescens PfO-1
MQFGAKPLFENVSVKFNGGNRYGLIGANGCGKSTFMKILGGDLEPSGGQVMLEPNVRLGKLRQDQFAYEEFTVIDTVIMGHEELWKVKAERDRIYSLPEMSEEDGMAVAELETEFAEMDGYTAESRAGELLLGLGIPLEQHFGPMTEVAPGWKLRVLLAQALFSDPEVLLLDEPTNHLDINTIRWLETILTARNSTMIIISHDRHFLNSVCTHMADLDYGELRLFPGNYDEYMTAATQSREQLLSDNAKKKAQIAELQTFVSRFSANASKAKQATSRAKQIDKIQLAEVKPSSRVSPFIRFEQTKKLHRQAVTIEQMSKGFDGKTLFKNFSFTVEAGERVAIIGPNGIGKTTLLRTLMGELTPDTGSVKWTESAELGYYAQDHAHDFEEDVSLFDWMGQWTQGEQVIRGTLGRMLFSNDEILKSVKVISGGEQGRMLFGKLILQKPNVLVMDEPTNHLDMESIEALNLALENYPGTLIFVSHDREFVSSLATRIIELSPNGVTDFSGTYDDYLRSQGVVF

SEQ ID NO: 27478 - DNA, 1662 bp, Rhodospirillum rubrum
  CDS (1)..(1662)
atgaccaccgtgactccgcccctcccggtcgcccctctgctgccccccctgctgtcggttgaaaaccttcaggtgcgctttggcgccggccccgaggccgttgacgccgtgcgcggcgtgtcgttcaccatcgccaagggcgaaaccctggccctggtcggcgaaagcggctcgggcaaatcggtcaccgccctgtcgatcacccgcctgttgccctatccgccggccagccaccccggcggcgccatcttcttcgatagcgaagacctgctccatgccccgggtgcccgcctgcgcgacgtgcgcggcaacaggatttcaatgatcttccaggagccgatgacctcgctcaacccgctccattccatcgagcgtcaggtgggcgaggtgctgaccctgcacaagggcctgcacggcaaggcccgccgcgcccgggtgatcgacttgctgcgcttggtcggcctgccccaggtcgaggggcgcctgggcgccctgccccatgagctgtcgggcggccagcgccagcgggtgatgatcgccatggcgctggccaacgaacccgatctgctgatcgccgacgaaccgaccaccgcccttgatgtcaccatccaggcccagatcctggccctgctcgccgatctgcaaaagcgcttcggcatggcgatcttgttcatcacccatgatctgtcgatcgtccgccgggtcgccgaccgggtggcggtgatgaaggacgggctgatcgtggaaaccggcacgacggcggcgctgtttgccgcccccagccatccctacaccaaagccctgttggccagcgagccgcgcggcacgccgcgccttgttcccaacgcccccgagatcctgtcctgtgacgacctcaaggtctggtttcccatccgcaaaggggtgatccgccgcaccgttggtcacatcaaggcggtcgacggcatctcgttttcgctgaaggccggggaaaccttgggggttgtcggcgaaagcggcagcggcaagaccacccttggcctgggcctgttgcgcctagtgtcctcgcaaggcgccatcgtcttttccggcacccggctggacggactgtcgaacacggcgatgcggcctttgcgccgccgcttgcagatcgtcttccaagacccctatggctcgctctccccccggctttcggtcggcgagatcattggcgaggggctggccgtccatggcttggccggcgatcgcgccggccgccgcgccctggtcacccaggctttgagcgaagtcggcctcgatccggcgacccaggaccgctatccccacgagttttccggcggtcagcgccagcgcatcgccatcgcccgcgccctggtgctcaagcccgaggtgatcgtgctcgacgagccgaccagcgcccttgacgtcacggtgcaggcgcagatcgtcgatctgctgcgcgacatccaaacccgccacgccatcgcctatgtcttcatcagccatgatctgcgcgtcgtccgcgccctggccgcccaggtgctggtgatgaaggacggcaaggtggtcgaggccggaagcggcgagcagatcttccaggcgccgcgccatgactatacgcgcgccctgctcgccgccgccctgtcccttgaagccgacagcagcggcatcgtgaaaaattaa

SEQ ID NO: 27479 - protein, 553 aa, Rhodospirillum rubrum
MTTVTPPLPVAPLLPPLLSVENLQVRFGAGPEAVDAVRGVSFTIAKGETLALVGESGSGKSVTALSITRLLPYPPASHPGGAIFFDSEDLLHAPGARLRDVRGNRISMIFQEPMTSLNPLHSIERQVGEVLTLHKGLHGKARRARVIDLLRLVGLPQVEGRLGALPHELSGGQRQRVMIAMALANEPDLLIADEPTTALDVTIQAQILALLADLQKRFGMAILFITHDLSIVRRVADRVAVMKDGLIVETGTTAALFAAPSHPYTKALLASEPRGTPRLVPNAPEILSCDDLKVWFPIRKGVIRRTVGHIKAVDGISFSLKAGETLGVVGESGSGKTTLGLGLLRLVSSQGAIVFSGTRLDGLSNTAMRPLRRRLQIVFQDPYGSLSPRLSVGEIIGEGLAVHGLAGDRAGRRALVTQALSEVGLDPATQDRYPHEFSGGQRQRIAIARALVLKPEVIVLDEPTSALDVTVQAQIVDLLRDIQTRHAIAYVFISHDLRVVRALAAQVLVMKDGKVVEAGSGEQIFQAPRHDYTRALLAAALSLEADSSGIVKN

SEQ ID NO: 27480 - DNA, 1569 bp, Burkholderia fungorum LB400
  CDS (1)..(1569)
atgaatcaggacgcaatttcaccggctttgccgaattcaccgcagtccgaagcgtctctgccgttcctgcaggttgtcggcgtgcacaagcgcttcaccggcgtgcatgcgctgcgcggcgtgagtctgtcattcgaacgcggccagatctatcacctgctcggcgaaaacggttgcggcaagagcacgctcatcaagatcatctccggcgcgcagccgcccgacgaaggcgaactcgtgatcgaaggcgtgcggcatgcgcggctctccgcgctcgaatcgctcgccgcgggcattgaaaccgtttatcaggatctctcgctgctgcccaacatgaacgtggccgaaaacgtcgcgctcacgtccgagctggccacgcacgcgggcaagctggtccgcaccttcgaccggcgcgagctggcgcgcacggccgcgcgcgcgctcgaagcggtcggcctgcccggcactgcggagtttcaggcgacgctgatcgagcaattgccgctcgccacgcggcaactcgtggcgattgcccgcgcgattgccagcgaggcgaagttcgtcatcatggatgagcccaccacgtcgctcacgcagaaggaagtcgacaatctgattgccgtgctcgccaatctgcgcgctcagggtgtcaccgtgctgttcgtgagccacaagctcgacgagtgctacgcgatcggcggcgaggtgatcgtgctgcgcgacggacagaaaatggcgcaaggaccgatcgcgcaattcaccaaagcgcagatcagcgaactgatgacgggcaggcatctgtcgaacgagcgctatcgcgagggcgcatgcgagcagaacgtcgtgctcgatgtgcggggttatacgcgcgccggccagttcagcgatgtgtcgttcgcgctgcacggcggggagattctgggcattacagggctgctcgattcggggcgcaacgaactcgcgcgtgcgcttgccggtgtcgcgcccgcgcaatccgggcaggtgctgctcgacggcaaggccgtttctctgcgcacaccttcggacgcgaaggagcaccgcatcggctatgtcccggaagaccgcctgaacgaagggctttttctcgacaagtcgattcgcgacaacgtgatcaccgcgatgatctccagtttgcgcgaccgcttcggccaggtggatcgcagccgtgcacaggcgctcgcggagcagacggtgaaggatctgcagatcgccacgccgggtgtggacaaacccgtgcaatcgctttcgggcggcaaccagcagcgcgtgctgattggacgctggctcgcgatcgacccgcgcgtgctgattctgcatggaccgacggtgggcgtggacgtgggctcgaaggacatcatttaccgcatcatgcagcgcctgtcgcaacgcggcatcggcatcattctgatcagcgacgacttgcccgaactgctgcagaactgcgaccgcatcctgatgatgaagaaagggcgcgtggccggagaataccaggccgccacgttgagcgaagccgatctgtatcacgcgctgctttcggaagccgcataa

SEQ ID NO: 27481 - protein, 522 aa, Burkholderia fungorum LB400
MNQDAISPALPNSPQSEASLPFLQVVGVHKRFTGVHALRGVSLSFERGQIYHLLGENGCGKSTLIKIISGAQPPDEGELVIEGVRHARLSALESLAAGIETVYQDLSLLPNMNVAENVALTSELATHAGKLVRTFDRRELARTAARALEAVGLPGTAEFQATLIEQLPLATRQLVAIARAIASEAKFVIMDEPTTSLTQKEVDNLIAVLANLRAQGVTVLFVSHKLDECYAIGGEVIVLRDGQKMAQGPIAQFTKAQISELMTGRHLSNERYREGACEQNVVLDVRGYTRAGQFSDVSFALHGGEILGITGLLDSGRNELARALAGVAPAQSGQVLLDGKAVSLRTPSDAKEHRIGYVPEDRLNEGLFLDKSIRDNVITAMISSLRDRFGQVDRSRAQALAEQTVKDLQIATPGVDKPVQSLSGGNQQRVLIGRWLAIDPRVLILHGPTVGVDVGSKDIIYRIMQRLSQRGIGIILISDDLPELLQNCDRILMMKKGRVAGEYQAATLSEADLYHALLSEAA

SEQ ID NO: 27482 - DNA, 786 bp, Thermobifida fusca
  CDS (1)..(786)
atgaacgggcacgtgctgcacatgagcggggtcggggtacgccgcggccagacggtgttgctggacgcagtggactggactgtggcggaaggggagcgctgggtggtcgtgggaccgaacggtgcaggcaagaccaccctgctgcggatcgccgccactcaactgcaccccacccggggcacggtggaggtgctcggtgagcggctcggccgcggagacgtgttcgagctccggccgatgattggcttcgcctcgtctgcggtggccgcccagcttgaggacgacatgcgcgtccgggacgtggtggtcagcgccgcctacggctatctgggcacagggaaagaggagtacagcgcccctgactatgcgcgggcccgggcactgctgggccggtggggagtgctgcggttcgaggaccgtgcgttcggcaccctttcggaaggggaacgcaaacgggtgctgatcgcccgagcgttgatgtccaacccggagctgctgctcttggacgagcctgcggccgggctcgacttgggcgcgcgggaggatctggtgcgccgcctcggcacgctcgcgaaagacgagtctgcccccgctctcgtgctcgttacccaccatgttgaggagattccccccgggtttacgcacggcctgctgctgcgcggaggcaaggtggtggccgcggggccgctggagcaggtgatgaccgccgaccacctcagcaccacgttcggtatcgggctgaaggtggagttcgacggggagcgctggtcggcccgagcgtcgtaa

SEQ ID NO: 27483 - protein, 261 aa, Thermobifida fusca
MNGHVLHMSGVGVRRGQTVLLDAVDWTVAEGERWVVVGPNGAGKTTLLRIAATQLHPTRGTVEVLGERLGRGDVFELRPMIGFASSAVAAQLEDDMRVRDVVVSAAYGYLGTGKEEYSAPDYARARALLGRWGVLRFEDRAFGTLSEGERKRVLIARALMSNPELLLLDEPAAGLDLGAREDLVRRLGTLAKDESAPALVLVTHHVEEIPPGFTHGLLLRGGKVVAAGPLEQVMTADHLSTTFGIGLKVEFDGERWSARAS

SEQ ID NO: 27484 - DNA, 1506 bp, Cytophaga hutchinsonii
  CDS (1)..(1506)
atgccctctcccatcatacacgcacaaaacctttctctttccatcgaatcagaaaatatcttaaacaacatttccttttctatcaatacgggggaatgtattgttctgacaggtgcttccggaagcggcaaaacaagtcttgcaaaaatacttgccgggcattggaaagcgtcttccggtgagatacatttttcttcacctgacttaaaaaaaaccattgtacagcagcagcatgatttcaggtatgcattcgaaacaaagtcgtattttggtcagcgttacgaccgtaattacagcggcaacttccctacggtaaacgatattctgttaaaagaaaaatctgcggcaactgatctgcaaagagttgttactcaattaaacttatctgaaaaactgcagcagcctgttattgagctgtcaaacggagaaggcaagcgtctgcagcttgcgctggcactgcttacaaaaccggatgtattaattcttgaccagccatttataggcctggatactgcaacacgcggtgagctgcatcagttgctggaaaagattaaagaacaaaaaattaccgttatcctcattactacaccggatgaaattccggcatgtgccgatcagatttttttaatgagagccggaacgctttgtgcgcaaacaaaagatgcgcctggcattatagaagaaatgcaacagcaacaaaacggatctgttaactgggaagatttaaaagaaatttctgtctctgcatttccgccgtttgaagttgcggtacacatgaatcacgtgaacgtttcttttggtaataaaaaaatactcgatgacatttcgtggacagtaaaacgcggtgagcattgggccttacttgggcataatggttcgggtaaatcaaccttgctgagtctgatcaatgcagataacccgcaggtatacctgaatgatgtatttctttttgatcaaaaacgcggaaatggtgaaagcatctgggagatcaaaaaaaagatcggttatgtttctccggaaatgcataaccacgtgttgcgtggcagcagctacattcaatcgcaggcattagctaaaaacgattattcgctgggcgggttttcacaggataaaaccacttgttttgaaattgttagttcaggtgtaaacgaccaggttggttcttccacgcgcctaacggctatgcagcaaaagacggttacgtactggatggaagcgctggatgtgattcacctgaaacaaagagctttttataaaacatcgttaggacagcagcgtttgctgttgcttgcacgtgctctggtaaaaaacccaccggtgctgattttagatgaaccttgtcagggcctggataaagaacagacccagcgttttacttcattggttgatacagtctgcaatcacattgaaaaaacattgatctatgtttcacactatgccagcgatatgccgtcgtgtattgatcatgtcttaatgcttgaaaacggacgggtgaaagaaaactaa

SEQ ID NO: 27485 - protein, 501 aa, Cytophaga hutchinsonii
MPSPIIHAQNLSLSIESENILNNISFSINTGECIVLTGASGSGKTSLAKILAGHWKASSGEIHFSSPDLKKTIVQQQHDFRYAFETKSYFGQRYDRNYSGNFPTVNDILLKEKSAATDLQRVVTQLNLSEKLQQPVIELSNGEGKRLQLALALLTKPDVLILDQPFIGLDTATRGELHQLLEKIKEQKITVILITTPDEIPACADQIFLMRAGTLCAQTKDAPGIIEEMQQQQNGSVNWEDLKEISVSAFPPFEVAVHMNHVNVSFGNKKILDDISWTVKRGEHWALLGHNGSGKSTLLSLINADNPQVYLNDVFLFDQKRGNGESIWEIKKKIGYVSPEMHNHVLRGSSYIQSQALAKNDYSLGGFSQDKTTCFEIVSSGVNDQVGSSTRLTAMQQKTVTYWMEALDVIHLKQRAFYKTSLGQQRLLLLARALVKNPPVLILDEPCQGLDKEQTQRFTSLVDTVCNHIEKTLIYVSHYASDMPSCIDHVLMLENGRVKEN

SEQ ID NO: 27486 - DNA, 1377 bp, Oenococcus oeni PSU-1
  CDS (1)..(1377)
atgactacgagtttgtttcatgtcagcctttcttacggcgacaaaaaaattatcaatgatctcaatatcgagtttcaagatgctagttttaatttattgattggtccctcgggtattggaaaatcaacttttttacgaattttagccgggttttatccgcaaatagaaggaaaagtcattgttgctgataaaacgattgatagtttgccggccaatcagcgggctcgatatgttggttttctgtttcaagatccaaatactcaatttgccatgacgacggcttttgaggaacttgtttttaccttggaaaatttgcagattccccgagacgaaattcgagaaagggttcaaaaagcaatcgatttcgttgggattaatcaattttccaattcaaaaataaattctctctcgggtggtgaaaagcaaaaggtcgctctatctgtgattgtggcaatggaaagtaagttactccttcttgatgaaccctttgcaaatattgatcaaccatcgagagaatatttactgaaaaaacttaagcagcttcaagcacgcggtataacaattatagtcgtcgaccatgatttatctgcttatgaaaagccggccgaccaagtttggctaatggaagatagaaaaattaaaccgatcagcgagaaggaatttaaaaaacgtttgccgatacgtcaaagttttgattttgcggttcccaaaaagggtagactcgtttgtaatgatttaaccgtcaaggttggagataggaaactttttttcgttaaccatctacctttggcggaatctggaatcactctgttaaccggagataatggcactggaaaatcgactttctttagtgctttgactcgtctgaaggattatgaaggcaaaatcgcttacctcggtaaggatatttctaaattaaaggttcctcgatacatgaaggaagtggcacttgtttttcaaaattcggaaaaacaatatctgcgtatgacagtcagtgaggaactgaccttgagtctggaacagactcgtcatccagcagactggccaccagaagtggttgatgaatatttgcagcgcctcaacctgttcgggctcggtgatcagattatttatcaactttccggtggacaaaagaaaaaattgcagttaattgtgatgctgattatggaaacaccgatcttattactcgatgaacctttggctggtctggattttcagtctgttgagcaggtatctaagattttacgcgaaatcgccgatcgcaaacgtcaacgttttgtaatcatcagtcatcaacttgaccgtttattgccgaaagtcgatttttatctacgtttggaaaatcagactttaaagtatcaggagcatttattatga

SEQ ID NO: 27487 - protein, 458 aa, Oenococcus oeni PSU-1
MTTSLFHVSLSYGDKKIINDLNIEFQDASFNLLIGPSGIGKSTFLRILAGFYPQIEGKVIVADKTIDSLPANQRARYVGFLFQDPNTQFAMTTAFEELVFTLENLQIPRDEIRERVQKAIDFVGINQFSNSKINSLSGGEKQKVALSVIVAMESKLLLLDEPFANIDQPSREYLLKKLKQLQARGITIIVVDHDLSAYEKPADQVWLMEDRKIKPISEKEFKKRLPIRQSFDFAVPKKGRLVCNDLTVKVGDRKLFFVNHLPLAESGITLLTGDNGTGKSTFFSALTRLKDYEGKIAYLGKDISKLKVPRYMKEVALVFQNSEKQYLRMTVSEELTLSLEQTRHPADWPPEVVDEYLQRLNLFGLGDQIIYQLSGGQKKKLQLIVMLIMETPILLLDEPLAGLDFQSVEQVSKILREIADRKRQRFVIISHQLDRLLPKVDFYLRLENQTLKYQEHLL

SEQ ID NO: 27488 - DNA, 1689 bp, Oenococcus oeni PSU-1
  CDS (1)..(1689)
atgccagctgttacatttaaaaacgttaatttcaaatatcgcgttcaaagccaagccacattgcatgatgtcagctttgcttttgattatggggagaaaattattattgccgggccatccggctccggtaagaccacgattggccatttaattaacggtttgattccacaatgttttcccgggaatctcgatggtcagatcttggttaatgatcaggatgtttctaaattggatattttcaatttatcttttgccgtcgcgactgtcctgcaagataccgattctcaatttgtcggcatgacagttgctgaagatgtttcttttctgcttgaaaatgaaaatatcgatcatcaaacactattaaaaaaaacaaatcattggttaacggaactgaatcttcaatcggttaagaatcatcatccccaagaactttccggtggacaaaagcagcgagtcagtatggccggtgttttaagttcggacagcaagattcttttgtttgacgaaccattggccaatctcgatccggctgctgggagagcggcaattcaattaatctcccaactacagaaaaagttgaatttaacggttattatcattgaacaccgtttggaagaagcacttaaaattcaggccgataaactggtgattatcagtcgaggaaaaatcattgccaacgatacgcctgatcgggtcctgcaaagcggggttgtttctcaagtcggacttcgtgaaccgctttatctgaccgctttaaagaaagccggtttcgatctgagtttggagaaacatttgacagatctttcttctttgaatcaagaattggttagcaaaaaaatctcgaattggcttaatactcaaatttctgttaaaaaaccaaatcctggtcaactgattttatcaattaaaaacttgtttttttcctatccgaaacaaagcgtttttaaagatttcaatttggatttttatgctggtcagattacggcgattgttggtaagaacggttccggaaaatcaactttttcaaatttagtaaccggttttttaaaacaggattccggccagatttttttcgatggtcaaagcttggactctctgtctgtcaaagagcgggctgataaaattggttacgttttgcaaaatccaaatcaaatgatcagccaaaatattgtctttgacgaagtcgcctacggactgaaattacgcgaatttaatcctgaagagatcaaaacaagagttcgacgagtattgaaaatctctggtcttgattcgatgcgtcattggccggtctcggctttaagcttcggccaaaagaagagagtgacgattgcttctgttttggttttggaaccgcaaattcttttattggatgaacctaccgctggacaagattatctgaattatcgttcgatcatgaattttgttgcttctcttaatcgtgagcatcatacttcgattattgtcatcactcacgatatgcatttaatgctggaatacgctgatcgagccttggctttggttgacggcaagattcttgctgatgatcgtccagccgtgcttttgagcaacttggagcttttaaaagaagcctctttggctccgaccagcctttataatctggcccgattcagtcaagtcgatccgattaaattatcggaaagacttgttgaaagcgaggccgatttatga

SEQ ID NO: 27489 - protein, 562 aa, Oenococcus oeni PSU-1
MPAVTFKNVNFKYRVQSQATLHDVSFAFDYGEKIIIAGPSGSGKTTIGHLINGLIPQCFPGNLDGQILVNDQDVSKLDIFNLSFAVATVLQDTDSQFVGMTVAEDVSFLLENENIDHQTLLKKTNHWLTELNLQSVKNHHPQELSGGQKQRVSMAGVLSSDSKILLFDEPLANLDPAAGRAAIQLISQLQKKLNLTVIIIEHRLEEALKIQADKLVIISRGKIIANDTPDRVLQSGVVSQVGLREPLYLTALKKAGFDLSLEKHLTDLSSLNQELVSKKISNWLNTQISVKKPNPGQLILSIKNLFFSYPKQSVFKDFNLDFYAGQITAIVGKNGSGKSTFSNLVTGFLKQDSGQIFFDGQSLDSLSVKERADKIGYVLQNPNQMISQNIVFDEVAYGLKLREFNPEEIKTRVRRVLKISGLDSMRHWPVSALSFGQKKRVTIASVLVLEPQILLLDEPTAGQDYLNYRSIMNFVASLNREHHTSIIVITHDMHLMLEYADRALALVDGKILADDRPAVLLSNLELLKEASLAPTSLYNLARFSQVDPIKLSERLVESEADL

SEQ ID NO: 27490 - DNA, 1587 bp, Oenococcus oeni PSU-1
  CDS (1)..(1587)
atgatggagcaaataaaagaaaaaattccggcaattaaaatggaacatatagtcaaaaaatttggcaattttgctgccaataatgatattaatctcgaggtaaaagccggtgagattcatgcattgcttggtgagaacggcgccggaaaatcaactttaatgaatatcttgtcgggcttgttgcaaccaacatccggcgagatatttttgcgaggaaaaaaagtcaagatcaaaaatccggcggcagcttccaagcttggaattggaatggtccatcaacattttatgctgatagatgcctttacagtgacggaaaatattatgcttggtgccgaaaaaaccaagggggcatcgttggatatcgagactgcaaaaaaggaaatccaagcccttgtcgataaatataaattaaaagttaatccagatgctttgataaccgatatttcagtcggtcaacaacaacgtgttgaaattttaaaaactctctatcgaaaagccgatattttaattttcgacgaaccgacagctgttttaactccccaagaaattcaagaattgatcgcggcaatgaagaatttggccgccgaaggaaaagcgatcattttaataactcataaactcgaagagattcgtcaggcagcagatcgagttaccgttatccgatcaggaaaatcgcttgaaacttttaatgcaaagaatgtttctgcaataactttggcagaaaaaatggttggcagaaaagtttcttttacaactgagaaaaaagcagccaaaacaggcaaagatattttaaaaatcaacgatcttgtcgttaaagacgcagaaaatgttactaaagtcgatcacctctctctcgatattcgtgctggcgagattatcggtatcgccggaatcgacggcaatggtcagacagaattggttcaaacagttaccggcttaacacactcacaatccggagaaattattttagacggcaagaatattaccaataagacaccaagaaaaataatcaaagccggtacttcccatattccagaagaccgcctgcgtcatgggttagaaatcaatatgccgcttgctgacaatatggtgattgaaaatttctacgaaaaaccatatgccagaatgggaattcttcagggaaaagcaattgccgatcatgccaaaaaattaattaaacaattcgatgtcaaaatgacttcgatcgatgaaccagctggatccttgtcaggcggtaatcaacaaaaagccgtcgtcgcaagagaactttcgcgtgattccaaactgattgttgctgctcaaccgacgcgtggtcttgacgtcggagccatcgaatacattcacaaacaattaattaaacagagagatcttggaaaagcagttatgctcataagcttcgagcttgatgaaattctggatctggctgatagaattgcggttatatcgtccggaaaaattatcggcgttgtcaacaccaaagacacaaccaaagaagaacttggtttgatgatgaccggggtcggcttgaagagtgctagaaaagaactggaagcaagcaaaaacaaaaataaggcaggagttaaataa

SEQ ID NO: 27491 - protein, 528 aa, Oenococcus oeni PSU-1
MMEQIKEKIPAIKMEHIVKKFGNFAANNDINLEVKAGEIHALLGENGAGKSTLMNILSGLLQPTSGEIFLRGKKVKIKNPAAASKLGIGMVHQHFMLIDAFTVTENIMLGAEKTKGASLDIETAKKEIQALVDKYKLKVNPDALITDISVGQQQRVEILKTLYRKADILIFDEPTAVLTPQEIQELIAAMKNLAAEGKAIILITHKLEEIRQAADRVTVIRSGKSLETFNAKNVSAITLAEKMVGRKVSFTTEKKAAKTGKDILKINDLVVKDAENVTKVDHLSLDIRAGEIIGIAGIDGNGQTELVQTVTGLTHSQSGEIILDGKNITNKTPRKIIKAGTSHIPEDRLRHGLEINMPLADNMVIENFYEKPYARMGILQGKAIADHAKKLIKQFDVKMTSIDEPAGSLSGGNQQKAVVARELSRDSKLIVAAQPTRGLDVGAIEYIHKQLIKQRDLGKAVMLISFELDEILDLADRIAVISSGKIIGVVNTKDTTKEELGLMMTGVGLKSARKELEASKNKNKAGVK

SEQ ID NO: 27492 - DNA, 1653 bp, Streptococcus suis 89/1591
  CDS (1)..(1653)
atgaaaaaaatcattgaatttaaagattttacatttaaataccaagcgcaacaggaacccactttaaaagatattcagttaacgatttatcagggagagaaagttctgattattggcccatctggttcaggaaagtcgacgattggacaatgtcttaatggtattattcccaatatttacaagggggaacatagcggaagtttactattggatggtcaggaagcttttaatctttcagtttatgataagtccttgctcgtatcaacggttcttcaagatacagatggtcaattcattggcttatcagttgccgaggacctagcttttgctttggaaaacgacatggaaagccaggtggtgatgaagcaaaaagtaggagattgggcagaaagactgtctttgaccgatttgctggcacatcgaccacaagatttatctggaggtcaaaagcaacgtgtcagtctgggcggagttcttattgatgagagtcctattttgttgtttgatgagccacttgctaatttagaccccaaatcaggccaagatacgattgatttgattgaccgtctgcacaagcaagaagggaccacaaccattattatcgaacaccgtttagaggacgtactgtatcgtcaggtggaccgagttgtattgattaatgatggtcggattttgttcaatggaggactggatgatttattacgtacctcattgttacaggaaaacggcatccgtgaacccttatatctatcgactcttcgcgccttaggatatccgattgcgcaggcagaacacctctcctcagtttgggaaattgatattgaggctttgaatatagcatctctaccgactctacactttgaaaatggagagaaagagtctttgttagaagtcaagcatcttcatttttcctatcctaacaaacaagttcttacagatattcaactgacgattcataagggagagcgtctagctattgttggaaaaaatggtgctgggaaatctactttagccaaggtgctttgtggttttattcagggtgagggtgagattctctggaaggggcagtcaatcaaagaagattctgtcaaagagcgagcagaacggattggttatgttcttcagaatcccaaccaaatgattagccaaacgatgatctttgatgaggttgctcttggtttgcgcgtgcgaggggtgacagaagaagaaatcgaacaccgagttcaccatatcttgaaagtatgtggcctgtatccgtttcgtaattggccgatttcggcactttcctatgggcagaaaaaacgggtaacgatagcatctatcttggttctcaatccagaaattattttgctagatgagccaacagcaggacaagatcaacggcattatcgggaaatgatggagtttttggaccaattaaatgctcaagggcacaccattgtcatgattacccatgacatgcaactcatgctagattattcagatagagctgttgttgtggtggatgggcagattattgaagatgccagtccagcagaaattttatctgatgatatggtgattgagcgagccaatttaaaagaaacatcaatttttcacttggcggagaggttgggagttaatcccttggaattaacgacgttttatatgtag

SEQ ID NO: 27493 - protein, 550 aa, Streptococcus suis 89/1591
MKKIIEFKDFTFKYQAQQEPTLKDIQLTIYQGEKVLIIGPSGSGKSTIGQCLNGIIPNIYKGEHSGSLLLDGQEAFNLSVYDKSLLVSTVLQDTDGQFIGLSVAEDLAFALENDMESQVVMKQKVGDWAERLSLTDLLAHRPQDLSGGQKQRVSLGGVLIDESPILLFDEPLANLDPKSGQDTIDLIDRLHKQEGTTTIIIEHRLEDVLYRQVDRVVLINDGRILFNGGLDDLLRTSLLQENGIREPLYLSTLRALGYPIAQAEHLSSVWEIDIEALNIASLPTLHFENGEKESLLEVKHLHFSYPNKQVLTDIQLTIHKGERLAIVGKNGAGKSTLAKVLCGFIQGEGEILWKGQSIKEDSVKERAERIGYVLQNPNQMISQTMIFDEVALGLRVRGVTEEEIEHRVHHILKVCGLYPFRNWPISALSYGQKKRVTIASILVLNPEIILLDEPTAGQDQRHYREMMEFLDQLNAQGHTIVMITHDMQLMLDYSDRAVVVVDGQIIEDASPAEILSDDMVIERANLKETSIFHLAERLGVNPLELTTFYM

SEQ ID NO: 27494 - DNA, 2751 bp, Pseudomonas aeruginosa UCBPP-PA14
  CDS (1)..(2751)
atgaccgctggcgggagcggcgtggcgagcctccggggcgtttcgctgtgctacggcgagacgcgcgcggtggacgacgtcagcctggagatcccggccaaccgcatggtcggcctgatcggtccggacggggtcggcaagtccagcctgctggcgctgctggccggcgcacggaagatgcaggatggcgagatccgcgtgctcgatggcgacatgcgcgaccgccgccaccgccgggcggtctgcccgcgcatcgcctacatgccccaggggctgggcaagaacctctacccgacgctctcggtgttcgagaacgtcgacttcttcggtcggctgttcggccacgacaaggccgagcgcgagcggcgcatcgccgatctgctgcaaagcaccggattggcgccgttcgccgagcgtcctgcgggcaagctgtccggcggcatgaagcagaagctcgggctgtgctgcgcgctgatccacgatcccgacctgctgatcctcgacgagccgaccaccggcgtcgacccgctgtcgcgcaaccagttctgggagctgatcggccgtatccgcgcgggccgcgaaggcatgagcgtgctggtcgccaccgcctacatggaggaagccgagcgcttcgactggctggtggcgatggacgatggaaaggtcctggccaccggtacgccgcaggagttgcgcgagcgtaccgggacgcagagcctcgagtcggcgttcatcgccctgctgccggaaagcaagcgcgccggccaccatcgattggtgatcccgccgcgaccgcagagcgaaggcgcgccgcggatcgccatcgaggccgagggcctgacctgtcgtttcggcgacttcgtcgcggtcgatcacgtcagcttccgtatcgagcgtggggaaatcttcggcttcctcggctccaacggctgcggcaagtccaccaccatgaagatgctcaccggcctgctgccggccagcgaaggcacgtgcgcgctgttcggccaggcggtggacgccagcgacatggcgacccgtcgccgggtcggttacatgtcccaggccttctccctgtatgccgagctgagcgtgcggcagaacctggtgctgcacgcccggctgttccacctgccggcggatggcatcccggcacgggtcggcgaaatgctccggcgcttcgacctggagaaggtggccgacgaactgcccgacgacctgccgctgggcattcgccagcgcctgtcgctggcggtggcggtgatccacaagccggagatcctgatcctcgacgagcccacctcgggggtcgatccggtggctcgcgacggcttctgggaactgatggtcgagctgtcgcgccgcgacggggtgaccatcttcatttccacccacttcatgaacgaggcccagcgctgcgatcgcatctcgctgatgcatgccggcaaggtactggccagcgatactcccgatgagctggtgcgccagcgcggcctgccgaccctggaggcgaccttcatcgcgtacctggaagaagccgccggcgccgccgcgccagcgcaaccggccgaggcgccggccgtcgcggagcagcccggcgatggccaggggcgccaggcgcaacgcgaacgcttcagccccctgcggctgttcagttatgcgcgccgcgaagccatggaactgcgccgcgacccgatccgcctgaccctggccctgctcggcaccgcgctgctgatgttcatcatcggctacggcatcaacatggacgtcgaggacctctcctgggcggtcctcgaccgtgaccagaccaccaccagccaggcctatgcgctgaacatcgccggctcgcgctatttcgtcgaacatgcgccgatcaccgacccggacgacctcgaccggcgcctgcgcagcggcgagctgagcctggcggtggagatcccgccgaacttcgggcgcgatctcaagcgtggctccgatccggccatcggcgtgtggatcgacggagcgatgccgacccgtgccaacaccgtgctcggctacgtgcagggcctgcacaccagctacctggcggacctctcgcggcaggtgggtggggccgaggccagcgcggcggccagcaccgaggtgcgctatcgctacaaccccgacgtggaaagcctgaaggcgatggtgccggcggtgatcccgctgctgctgatcatgatcccggccatgctcaccgccctcggcgtggtgcgcgaaaaggaactgggctcgatcaccaacctctatgtcaccccggtgacgcgcctggagttcctggtcggcaagcagttgccttacgtcgccatgggcatgatcaacttcctgctgatgctggtcctggccatcgtggtatttcgcgtgccgctcaagggcagcttcctggcgttgaccatcggcgctttcctctatgtggtcaccagcaccggcctcgggctgttcctctcgacgttcatgcgcagccagatcgccgctgtattcggcgtggcgatcgccaccatgatcccggcgatccagttctccgggctgatccacccggtgtcctcgctggaaggtgcggcggcctggatcggcaagctctatccgacctcgcatttcctggtggtcagccgcggcgccttttccaaatcgctgggcctgcccgatctctgggcctactacctgccgcttgccgcttccatcgtggtgctgaccctgctcagcgtggcctgcctgaagaagcaggaggactga

SEQ ID NO: 27495 - protein, 916 aa, Pseudomonas aeruginosa UCBPP-PA14
MTAGGSGVASLRGVSLCYGETRAVDDVSLEIPANRMVGLIGPDGVGKSSLLALLAGARKMQDGEIRVLDGDMRDRRHRRAVCPRIAYMPQGLGKNLYPTLSVFENVDFFGRLFGHDKAERERRIADLLQSTGLAPFAERPAGKLSGGMKQKLGLCCALIHDPDLLILDEPTTGVDPLSRNQFWELIGRIRAGREGMSVLVATAYMEEAERFDWLVAMDDGKVLATGTPQELRERTGTQSLESAFIALLPESKRAGHHRLVIPPRPQSEGAPRIAIEAEGLTCRFGDFVAVDHVSFRIERGEIFGFLGSNGCGKSTTMKMLTGLLPASEGTCALFGQAVDASDMATRRRVGYMSQAFSLYAELSVRQNLVLHARLFHLPADGIPARVGEMLRRFDLEKVADELPDDLPLGIRQRLSLAVAVIHKPEILILDEPTSGVDPVARDGFWELMVELSRRDGVTIFISTHFMNEAQRCDRISLMHAGKVLASDTPDELVRQRGLPTLEATFIAYLEEAAGAAAPAQPAEAPAVAEQPGDGQGRQAQRERFSPLRLFSYARREAMELRRDPIRLTLALLGTALLMFIIGYGINMDVEDLSWAVLDRDQTTTSQAYALNIAGSRYFVEHAPITDPDDLDRRLRSGELSLAVEIPPNFGRDLKRGSDPAIGVWIDGAMPTRANTVLGYVQGLHTSYLADLSRQVGGAEASAAASTEVRYRYNPDVESLKAMVPAVIPLLLIMIPAMLTALGVVREKELGSITNLYVTPVTRLEFLVGKQLPYVAMGMINFLLMLVLAIVVFRVPLKGSFLALTIGAFLYVVTSTGLGLFLSTFMRSQIAAVFGVAIATMIPAIQFSGLIHPVSSLEGAAAWIGKLYPTSHFLVVSRGAFSKSLGLPDLWAYYLPLAASIVVLTLLSVACLKKQED

SEQ ID NO: 27496 - DNA, 1671 bp, Ralstonia eutropha JMP134
  CDS (1)..(1671)
atgaacgtggtaccgaagctgcgggaagcggaggccatgccgctcgagccgacgccgtccccggcgccgggcagtacgctgatctgcgtggacaagctgtcggtgacgtttggtcacggcgacgacgctacccgcgccgtgcgcgaggtcagcttcgacctgcgtgccggcgagcgctatgcgctggtgggtgagtcaggctccggcaagacggtcaccgcgcttgccatgttgcggctcgtcgaggacgctgcctaccagggtgcgatccggttcgagggccgcaacctgctcgacgtatcggaccgtgacatgcgcgccatccgcggtgcggagatcgccatgatcttccaggagccgatgaccgcgctgaacccgctgtatacgatcggcaaccagattgtcgagacgctggcgctccacgaagggctcgaccggcgcgctgcgcgcgaacgcgcgattgcactgctggaacgcaccggcatcagcgatgcggcacaccgcttcgacagtttcccgcaccagctttccggcgggcagcgccagcgcgcgatgatcgccatggcgctcgcctgccgcccgaagctgctgctcgcggacgagccgaccacggcgctcgacgtcaccattcgcgcgcagatcgtggacctgttgcgtgacctccaggccgagttcggcatggcggtgatgctgatcacccatgacctgaacctcgtgcgttcgttcgcgcagcgtgtcggtgtcatggagaagggcgtgctggtcgagaccggcgagaccgcgcaggtgttcgcctcgccgcagcatccctacacgcgcaagctgatcgacagtcgcccgcggcgcgaggtgctgccgctcgtgccactggcgccgacgctgctggaggcgcgcggcctgtgcgtcaactacgcgcgcaagcgcaagggcatcgccggctggttcggcaaggaccagttcgctgcggtgaaggacgtcgattttcagctgcgcgaaggcgaaaccatcggcatcgtcggggaatctggctccggcaagaccacgctggcccataccgtgctggcgctgcagcgcaagagcgcgggcacgatccatttcctgggccgcagcttcgacgacgccacgagcaaggaccgctgcaagttgcgcgcgcgcatgcaggtggtgttccaggatccgttcgggtcgctgtcgccgcgcatgacgatcgagcagatcgtcggggaagggctggcgttgcaccagccgggcctgaagcgcgagaccacgcgcgagcgggttatcgaagcgctgcgcgaggtcggactggaccggactgcactcggccgctatccgcacgaattctcgggcggacaacgccagcgcatcgcgatcgcgcgggtgctcatcctcaagccgcagatcctggtgctcgacgagcccacatcggcgctcgatgtctcgatccagcagcaggtgctgggtctcctttcccagttgcagcacaaatacaacctcagctatctgttcatcagccacgatcttgcggtcatccgggcgatggcccaccgggtcatcgtcatgaaggccggcgaggtggtggaggcaggggagaccgaggccgttctcggtgcgccgcaacatccctatacgcgcaagctgatggctgctgcccagattggtgcagcctga

SEQ ID NO: 27497 - protein, 556 aa, Ralstonia eutropha JMP134
MNVVPKLREAEAMPLEPTPSPAPGSTLICVDKLSVTFGHGDDATRAVREVSFDLRAGERYALVGESGSGKTVTALAMLRLVEDAAYQGAIRFEGRNLLDVSDRDMRAIRGAEIAMIFQEPMTALNPLYTIGNQIVETLALHEGLDRRAARERAIALLERTGISDAAHRFDSFPHQLSGGQRQRAMIAMALACRPKLLLADEPTTALDVTIRAQIVDLLRDLQAEFGMAVMLITHDLNLVRSFAQRVGVMEKGVLVETGETAQVFASPQHPYTRKLIDSRPRREVLPLVPLAPTLLEARGLCVNYARKRKGIAGWFGKDQFAAVKDVDFQLREGETIGIVGESGSGKTTLAHTVLALQRKSAGTIHFLGRSFDDATSKDRCKLRARMQVVFQDPFGSLSPRMTIEQIVGEGLALHQPGLKRETTRERVIEALREVGLDRTALGRYPHEFSGGQRQRIAIARVLILKPQILVLDEPTSALDVSIQQQVLGLLSQLQHKYNLSYLFISHDLAVIRAMAHRVIVMKAGEVVEAGETEAVLGAPQHPYTRKLMAAAQIGAA

SEQ ID NO: 27498 - DNA, 1524 bp, Chloroflexus aurantiacus
  CDS (1)..(1524)
atgcaaaccccgatcctggagatgcgtcagattaccaaagagttccccggtgtgcgcgcacttgataacgtcactttcagcgtgaaacggggtgaaatccattgtctggtaggcgaaaatggggccggcaaatcgatattgatgaaggtcttgagcggtgtctatccgtatggctcgtacagtggcgaaattctgattgatggtcagccacagcgctttttcagcattgctgacagtgagcgggttgggatcggtatcatttaccaggaactggccctggtaccagaaatgaccgtctacgaaaatatctttctcggccacgaagttagtcgtaatgggattatcgactggaacgagacgatccgccgggccgatgagatgttgcgcaaggtgcggctcaccgtgaatccggctgccaaaatccgggatttgggtgtcggtaagcagcaactggtcgaaattgcgaaggcgctaagccgtgaagtaagaattttgatccttgatgagccgacggctgcgctgaatgaagatgatagtgagaacctgttaaacctgttacgcgaattgcgcgatcagggtgtgacctgcattctgatttcacacaagctgaaagaggtgttatcagttgccgatacggtgaccgttctccgtgatgggaagacggtctgtaccctcgatgctcacaagggcgaagtgaacgaacaggcgctgatccgcaatatggttgggcgtgaaattacgaatatctacccgccacgcaatcatcagcccggtgacgaggtggtacttgagctacgcaactggacagtctattccgcagaagcgggccgctatctgttgcgcgatgttaatttgcaggtacggcgcggcgaaattgtcggcctggccggtttgatgggtgccggtcgcaccgagctggcgctcagtctgttcggcaatgcaccgggttatcgcgtgagtggcgaattgtggctcaaaggtcgtaaacgtgagttcagacatccgcgtgaggcgattgccgccggtatggcttacgtctcggaagaccgcaaagcaaaaggcttgatcctcatccaggacgtgcgccagaacatcacgctggcgaacctgcgtgcgctggcgaacaagggcgttattgatcgaaacgctgagattcaggttgctgaagaataccgtaaatcgttgaatatcaaaactcctaccatcgagcaacaggttgtcaatctgagtggtggtaatcagcaaaaggtgtgtctcggtaaatggctcttcgttcgtcctgatgtcttgattctcgatgaaccgactcgtggtatcgatgtgggggccaagtatgaaatctatcaacttatgaatcggttggtcgaagatggcatgagcatcatcatgatttcatcggaattgcccgaagtcctcggtatgagtgaccgggtctatgtcgtttccggtggtcggattaagggcgatctaccaattgccgtggcaacccaggaaaagattatggccctggcagtcgattattaa

SEQ ID NO: 27499 - protein, 507 aa, Chloroflexus aurantiacus
MQTPILEMRQITKEFPGVRALDNVTFSVKRGEIHCLVGENGAGKSILMKVLSGVYPYGSYSGEILIDGQPQRFFSIADSERVGIGIIYQELALVPEMTVYENIFLGHEVSRNGIIDWNETIRRADEMLRKVRLTVNPAAKIRDLGVGKQQLVEIAKALSREVRILILDEPTAALNEDDSENLLNLLRELRDQGVTCILISHKLKEVLSVADTVTVLRDGKTVCTLDAHKGEVNEQALIRNMVGREITNIYPPRNHQPGDEVVLELRNWTVYSAEAGRYLLRDVNLQVRRGEIVGLAGLMGAGRTELALSLFGNAPGYRVSGELWLKGRKREFRHPREAIAAGMAYVSEDRKAKGLILIQDVRQNITLANLRALANKGVIDRNAEIQVAEEYRKSLNIKTPTIEQQVVNLSGGNQQKVCLGKWLFVRPDVLILDEPTRGIDVGAKYEIYQLMNRLVEDGMSIIMISSELPEVLGMSDRVYVVSGGRIKGDLPIAVATQEKIMALAVDY

SEQ ID NO: 27500 - DNA, 1845 bp, Chloroflexus aurantiacus
  CDS (1)..(1845)
atgagtggtctgtgggtggcaccggtgttcatgcaaacctcaatggcccttcacctgttgattgcctcgttcctcagcagcacggcacttggttcggcgattgccctggtggtgttgaaggctcttgagcgtgccggtgttgtgagattacccggcaaagaggggttacataccttgaggcagatcgtcgttcgtgatctcagctatcgctatccacaggcgacgcagtggacattgcgtcgcctgaacctgtcgattgacgccggtgaatacgtgctgctctgcggtgccagcggcagcggcaaatcaaccctgtgccggatacttaccgggttgattccgcacgtgtacgaaggaagcattgaggggacagttctggttgacggggttgacacccgtgaacagtcacccgccgatgtatgcacccggatcggtctggtctttcaacatccgcagtggcaactcttcaacagtacagttacccgtgagattgcctttggcctggaaagtctggggtatgcaccggcagaaatccggcaacgtatcgacgaagtcgccggttggctcggcatcgagcatttgcttgcgcgacatccgcaacagctctccaccggtgagcagcttttggtagcgctggcgagtattctggccatggggtcgcggatcgttgtcctcgatgaaccgtttgccaatctcgatggcaggcatgtgacgcaggtgcaggctatcctgcgcaggcttcatcagcaaggagtgacgatcatcgttgccgagcatcggcttgggctggtggccgccgatgcgacccgtatgatcgtgttgcacaatggtcaggttgtgctggatgggccgccggttcaggttctggccgccgatattcagcaatttcatctcgaaccaccattgccggtacagattggccgtgctctcaacctgaagccattgccgttgacggtagaggctgtgctggcgcaggtcgatcatcagcagcttgcgaccatgtatccacttccacccgccttgccgcgctctgcaaacggatcgccactgctcagcgtgcgcgatctctcgttctccgccggccaacggcgggtgctgaacagtgttcatctcgatctgtacgcaggtgagggggtggcaattgtcggggctaatggcgccggcaaaacctcgttgatcaaacacttcaacggtcttcaccgtccccaacagggacaggtacgggttatcgggaaagacacccgtacaacaccggtatcggtgctggcccgtcacgtggggatggtatttcagaaccctgatgaccagttgtttacgacccgtgtccgcgatgaggtggcggttggtgctcgcgtcatgggtgtctatgatccggatcaggtagcggctgtattacgcacatttcagcttgaacaccttgttgagcgctcgccctttaccttgagtgccggcgaaaaacgacggctgacactggcggcagcgctggtgaccaatccggcaatcctggtgctcgacgagccaacaaccggtctcgactggccggcacggcaggcgctggcccggcatctccgcgaacaggtgcagcatggtcgcaccgtagtcgtggtgacgcacgatctggagtttgccggcgcactcacctcacactggttcgtcctggccgatggatgcctgctggccgaaggggtacctcacgcgatatgtatgcaacccgccgtggtacaggcggctgacctcctgcttcctgatcgctaccggctggcgctggcgttacaacacgtggctgccgacgcgggcggtcccgtcagaaaacgagggagaggtgtaatggcgttccacccttga

SEQ ID NO: 27501 - protein, 614 aa, Chloroflexus aurantiacus
MSGLWVAPVFMQTSMALHLLIASFLSSTALGSAIALVVLKALERAGVVRLPGKEGLHTLRQIVVRDLSYRYPQATQWTLRRLNLSIDAGEYVLLCGASGSGKSTLCRILTGLIPHVYEGSIEGTVLVDGVDTREQSPADVCTRIGLVFQHPQWQLFNSTVTREIAFGLESLGYAPAEIRQRIDEVAGWLGIEHLLARHPQQLSTGEQLLVALASILAMGSRIVVLDEPFANLDGRHVTQVQAILRRLHQQGVTIIVAEHRLGLVAADATRMIVLHNGQVVLDGPPVQVLAADIQQFHLEPPLPVQIGRALNLKPLPLTVEAVLAQVDHQQLATMYPLPPALPRSANGSPLLSVRDLSFSAGQRRVLNSVHLDLYAGEGVAIVGANGAGKTSLIKHFNGLHRPQQGQVRVIGKDTRTTPVSVLARHVGMVFQNPDDQLFTTRVRDEVAVGARVMGVYDPDQVAAVLRTFQLEHLVERSPFTLSAGEKRRLTLAAALVTNPAILVLDEPTTGLDWPARQALARHLREQVQHGRTVVVVTHDLEFAGALTSHWFVLADGCLLAEGVPHAICMQPAVVQAADLLLPDRYRLALALQHVAADAGGPVRKRGRGVMAFHP

SEQ ID NO: 27502 - DNA, 1356 bp, Lactobacillus delbrueckii subsp. bulgaricus ATCC BAA-365
  CDS (1)..(1356)
ttgcaagcagaactgacaattgaccacttaactttttcctacggggaccgggaggtcatccgcgacctgtccttaaccctgccggcggggactttttccctcttgatcgggccgaccggctgcggcaagtcgaccctgttgaagatcatggccggcctctacccgaaatacgggggccagctgaccagcgggcaggtctctttgggcgggcggagccaggccatgatgttccaggaagccggcgagcagtttaccatggccacgcctagagaagagattatttttgccatggaaaacctgggcaaaagcaagacagaatttgcggaccggctgaagctggccagcgaattcgcggaaatcgactctcttttagaccagaagatcgtaaccatgtccggcggggaaaagcagcgggtagccttggccgtcctggtcgccatggacgtggatcttttcttattagatgagccttttgccagcgtggatccggcggcccgccgcttcttgattggccgcttggccaagctgaaagagcagggcaagaccatcatcatcactgaccacctttttgacgactaccagggcaaggtggacggggtctaccgcttcaaagacgagcaagtggacttattgactaaggatgaacaagcgcttctcctggctactgagccaatcggcctgcacttccccctgccagagaacgagccagcggcttttgtcatgaaaaatttcgccatcaagcaaggccggcctttgcttgagcaaaaggaattatccatccccaaggggaaggtgaccttgatcacggggccaaacggtagcgggaagagctccctgtttaaggccatgaccaagttgctggactaccaagggtctttgacctgggagggcaaggaagtagccaagctcaaggagcggacctacttccagcatgtagcccagatttttcaaaatgcaagtgaccagttcatggccatcaccgtcaaagaggagctggctttgagccaaaagcacgcttccccctacttcactccggaagtcttagaccaggccttggctgacctggatttggccgaccacatggaccaggtggtctactccttgtcgggcgggcaaaaaaagaagctggagatcctcttgatgcttttgtcgggccaggaagtgctcttaatcgatgagcctttgagtggcctagaccagaagtcaattgagcaggtcgtgcagcttttgcaaaagtgccaggaaaagagcgggcagacgatcctgctgatcagccaccatttctacggaatcagcacttggtgcgactaccacctgcgtctggccggcagagagctggcttttgtccaggattag

SEQ ID NO: 27503 - protein, 451 aa, Lactobacillus delbrueckii subsp. bulgaricus ATCC BAA-365
MQAELTIDHLTFSYGDREVIRDLSLTLPAGTFSLLIGPTGCGKSTLLKIMAGLYPKYGGQLTSGQVSLGGRSQAMMFQEAGEQFTMATPREEIIFAMENLGKSKTEFADRLKLASEFAEIDSLLDQKIVTMSGGEKQRVALAVLVAMDVDLFLLDEPFASVDPAARRFLIGRLAKLKEQGKTIIITDHLFDDYQGKVDGVYRFKDEQVDLLTKDEQALLLATEPIGLHFPLPENEPAAFVMKNFAIKQGRPLLEQKELSIPKGKVTLITGPNGSGKSSLFKAMTKLLDYQGSLTWEGKEVAKLKERTYFQHVAQIFQNASDQFMAITVKEELALSQKHASPYFTPEVLDQALADLDLADHMDQVVYSLSGGQKKKLEILLMLLSGQEVLLIDEPLSGLDQKSIEQVVQLLQKCQEKSGQTILLISHHFYGISTWCDYHLRLAGRELAFVQD

SEQ ID NO: 27504 - DNA, 1677 bp, Streptococcus thermophilus LMD-9
  CDS (1)..(1677)
atggataagtacattagttttaatcagtttacatttcaatatgatgcgcaagcagaagcgacgcttaaagatatcagctttgatattgccaaaggcgagaaagtgctcattttaggcccttctggtagcggaaagtcgacccttgctcagtgtctcaatggtatcatacctaatatccataaaggtcaggcaaaaggccaggtaaggatagatggtcaggatattttcaagcaatctatctatgataagtcacagtcggtatctacggtattgcaggatccagatggtcagtttattggcctaacagtagccgaggatttggcttttgctttggagaatgattgtgctgatcaaagtgagatgaaggataaggtagcactatgggctgaacgtctagacttgacttctctttttaatcaccgccctcaagacttatcaggtggccaaaaacaacgagttagtttggctggagtcttgattgatgagagccctattcttttatttgatgagcctctagcaaatttagatcctaaatcaggacaggaaaccattgacctcattgataaaatccacaaggaggtgggagctacaacaattcttattgagcaccgtctagaagatgttctttatcgtcccgttgaccgtattttgctagtcaatgatgggcaacttctctttaacggtagcccagatgagcttttatcaagtactctcttactggaaaatgggattcgcgaacctctatatgtgacggttttacgtcagttgggatttgatacaactagagcacaaaatcttagccaactagatgctttggatttgtctggattaggtatcccagatagcgttttgaaagataaaagagacagttcaagtgattctattttgaaggttgaggggcttagcgtttcctatggggataatccagcgattatagaggatatgtcttttagcttgaaaaaaggtgagcgactagcgattgtcggtaaaaatggagctggaaagtcgacgcttgctaaagctctatgcggttttgtccctagtcaagggaaattaacttacaagggtcaggatatcagtcaggatagcatcgccgagcgttcagagcgtataggctttgttttgcaaaacccaaatcagatgattagccaaactatgatttttgatgaggtggctcttggtttgcgcttgcgaggaattgaagagactgaggttgaagagcgtgttcatgaggtcctgaagacttgtggcctatatagttttcgtaaatggcccatttctgcgctttcctttggtcagaaaaagcgcgtgaccattgcatctatcttggttttgaaacctgaaatcattatcttggatgagccaacggctggtcaagattacaagacttacacagatatcatgaatttcttggacagtcttcagaagcaaggtcataccattgtgatgattacccatgatatgcagctcatgttggaatatagcgatcgttgtctcgttgtggttgaggggaaaatcattgcagacgacaatcctgttacaattcttaatcagaaggatttacttgagtcagctaatctcaagcagacatctctgtatactttgggtcagaaattgtcaagtaatccagtagaagtaacccagtattatatcgaaaaaggaggccctaatgtctaa

SEQ ID NO: 27505 - protein, 558 aa, Streptococcus thermophilus LMD-9
MDKYISFNQFTFQYDAQAEATLKDISFDIAKGEKVLILGPSGSGKSTLAQCLNGIIPNIHKGQAKGQVRIDGQDIFKQSIYDKSQSVSTVLQDPDGQFIGLTVAEDLAFALENDCADQSEMKDKVALWAERLDLTSLFNHRPQDLSGGQKQRVSLAGVLIDESPILLFDEPLANLDPKSGQETIDLIDKIHKEVGATTILIEHRLEDVLYRPVDRILLVNDGQLLFNGSPDELLSSTLLLENGIREPLYVTVLRQLGFDTTRAQNLSQLDALDLSGLGIPDSVLKDKRDSSSDSILKVEGLSVSYGDNPAIIEDMSFSLKKGERLAIVGKNGAGKSTLAKALCGFVPSQGKLTYKGQDISQDSIAERSERIGFVLQNPNQMISQTMIFDEVALGLRLRGIEETEVEERVHEVLKTCGLYSFRKWPISALSFGQKKRVTIASILVLKPEIIILDEPTAGQDYKTYTDIMNFLDSLQKQGHTIVMITHDMQLMLEYSDRCLVVVEGKIIADDNPVTILNQKDLLESANLKQTSLYTLGQKLSSNPVEVTQYYIEKGGPNV

SEQ ID NO: 27506 - DNA, 1452 bp, Deinococcus geothermalis DSM 11300 [sequence omitted]

SEQ ID NO: 27507 - protein, 483 aa, Deinococcus geothermalis DSM 11300
MTGKAGEKTRVGRGKAPLVELRDVTVRAGGQTLLEHVDLRLERGEALRLAGPNGGGKTTLLRLLAGEIAPTSGERVYGLGGTVQRSAVRARRSLSVVGPDAETFYLTRDWTQTVRDVLLAGFEGDMLRLWEPTAEALARLREVAALTEVANLLERDFRTLSHGQRRRVVLARALMPDPELLLLDEFTDGLSAGARERLGHVLRDVHASGVALVLATHRPEEAPLLPWRTLWVEGGQVRTGPATAPAPTVSLSLPPPPGSGVLVHLRDVEVYRNGHRALGPLSWTWQAGQHWLVTGENGSGKSTLARLIAGELHPALGGQLERPFLRRDLLSERRRTVGLVGAEVGIRQRRAWTGREVIGSGWSGSEGFTADLTPEQAAQVEELATQLDVTELLDRRAETLSQGQLRRLLLARAVIHAPRLLLLDEGLDFLDADARTRFLALLPELARRGTHVMVIAHREQDALPGLTHHLHLERGQVAAQGRL

SEQ ID NO: 27508 - DNA, 1437 bp, Anaeromyxobacter dehalogenans 2CP-C
  CDS (1)..(1437): transl_table=11
atgcgccggccgctcgtcacgctcgaccgggtggacgtccgcctgggcggcgtccccgtcctcgccggcgtcaccctggcgctccacgccggcgaggggctggcggtgctgggcgggaacggcgcgggaaagtccacgctcctgcggctgctccgcggcgagctctggccggatccgcgcggcgggcggcgcctcttccacgggccggacggggccttcgagagccccatcggcgcgcgcgagcggttcgcgcgggtggcgcccgaggcgcaagacgcctacctgcgcaacgaatgggacctgccggtcgaggcggtgatccgctccggcttcttcgacgcgctgtggccgtccgaggcggcgacggcggagcagtcgcggcgcgtccgcgaggtggcccgcgcgctgggcgtggcggggctgctggggcgatcggtgctggagctgtcgcgcggcgaggggcgccgcgtgctgctggcgcgcgcgctcgcgccgcggccggaggcgctgttcctggacgaggcctgcgacgggctcgacgcgccggcgcgggccggcctgctcgagaccgtctccgcgatcgcgcgcggcggcgtggccgtggtgatggccacgcaccggcccgaggagctcgtgcccgagctgggccgcgtcatccggctggagggcgggcggatcgcgtgggagggcgaccgcgccgccgcgcgggcgggcgcgcgcgaggcccccgcgccgccccgcgcgccggggcgcgaggccggcccgcgcgcggcgctgttcgagctccgcggcgctaccgtgctcgtggacgggcgcgcggtgctcgacggcgtggactggacggtccgcgccggcgagcgctgggcgatcaccggcccgaacggcgcggggaagtccacgctgctccggctgctcgcgggcgaggagcagccggcgcgcggcgcggtggaccggctcggcctcgggccgcgcgcgtccgccgaggacctgcgcggccgcgtgggcctggtctcgccggagctgcaggcgcgccaccgcttcgacgcgcgcgccgcggacgtcgtgctctccgggttcgccgggacgatcgggctcgcggtggagcccaccgcgcgcgagcgggcgctggccgccgccgcggcggagcggctcggggtgacgccgctgctcgggcggcacgtgctgtcgctctcctacggcgagctccgcaaggtgctcatcgcccgcgcgctcgcgccggcgccgcgggcgctgctgctcgacgagcccctcgccggcctcgaccccgccgcgcgcgcctgggtgctccgggtgctcgacgagctgggcgcggccggcaccgcgatcgtggccgtgtcccaccacgccgacgagctgcccggcgcggtggacgagcgggcgcggctcgacgcgggacggctcgccgtggacgcctga

SEQ ID NO: 27509 - protein, 478 aa, Anaeromyxobacter dehalogenans 2CP-C
MRRPLVTLDRVDVRLGGVPVLAGVTLALHAGEGLAVLGGNGAGKSTLLRLLRGELWPDPRGGRRLFHGPDGAFESPIGARERFARVAPEAQDAYLRNEWDLPVEAVIRSGFFDALWPSEAATAEQSRRVREVARALGVAGLLGRSVLELSRGEGRRVLLARALAPRPEALFLDEACDGLDAPARAGLLETVSAIARGGVAVVMATHRPEELVPELGRVIRLEGGRIAWEGDRAAARAGAREAPAPPRAPGREAGPRAALFELRGATVLVDGRAVLDGVDWTVRAGERWAITGPNGAGKSTLLRLLAGEEQPARGAVDRLGLGPRASAEDLRGRVGLVSPELQARHRFDARAADVVLSGFAGTIGLAVEPTARERALAAAAAERLGVTPLLGRHVLSLSYGELRKVLIARALAPAPRALLLDEPLAGLDPAARAWVLRVLDELGAAGTAIVAVSHHADELPGAVDERARLDAGRLAVDA

SEQ ID NO: 27510 - DNA, 2736 bp, Azotobacter vinelandii AvOP
  CDS (1)..(2736): transl_table=11
atgagcggcgtcgcccagcttgccggggtcaccctgcgctatggccggacttgcgccctggaccggctcgacctggaaatccccgccaaccgcatggtgggcctgatcggtccggacggcgtcggcaagtccagcctgctggcgctgatctccggcgcgcggcgtatccagcagggcagcatcagtgtgctggacggcgacatggccgacgccgcccaccgccgccgggtctgcccgcgcatcgcctacatgccccaggggctgggcaagaacctctacccgacgctgaccgtgcgcgagaacctggagttcttcggccgcctgttcggccaggaccgggcggagcgcgacgcacgcatcgccgacctgacccgcagcaccggcctggcgcctttcaccgagcggccggcgggcaagctctccggcggcatgaagcagaagctcggcctctgctgttcgctgatccacgaccccgacctgctgatcctcgacgaacccaccaccggcgtcgacccgctggcgcgcagccagttctgggaactgatcgaacgcatccgcgacaaccgcgccggcatgagtgtgctggtggccaccgcctacatggacgaggcgcaacgtttcgactggctggtggtcatggacgacggcaaggtcctggacaccggcagccccggcgagatcctcgcccgcaccggcagcgccgacctggagaccgccttcatcgccctgctgcccgaggagaagcgccgcggccaccacgccctggagatcccgccgctggccgccgacagccgcgaggccgccatcgaggcccatggcctgacctgccgcttcggcgacttcgtcgcggtggaccacgtggacttccgcatcgaacgcggggaaatcttcggcttcctcggctccaacggctgcggcaaatccaccaccatgaagatgctcaccggcctgctgccggccagcgagggccaggccctgctgttcggccagccggtggacccgaaggacatcgacacgcgccggcgggtgggctacatgtcccaggcgttctccctctacggcgaactgacggtcctgcagaacctggagctgcacgcccgcctgttccacctccccgaggcgcagcgcacgccgcgcatcggcgaaatgctcgaccgcttcgacctgcgccaggtcggcgacagcctgcccgaacaactgccgctgggcatgcgccagcgcctctcgctggccgtggcggtgctgcacaacccggaaatcctgatcctcgacgaacccacctccggcgtcgacccggtcgcgcgggacaacttctgggaactgctgatccagttgtcgcgccaggacggggtgaccatcttcatctccacccacttcatgaacgaggcgctgcgctgcgaccgcatctccatgatgcacgccggccgcgtgctggacagcgactcgccccgcgccctgatggaaaagcgcggcctgccgaccctggaggaaaccttcatcgcctacctgcgggatgccgccagcgccggcggcgacgagccgctcgccgaatcccccgccgccgacacggcggcgcctgcggcggcggacgccacggctccgtccgagggcttcagcccgcggcgcctgtacagctatttcctgcgcgaggcgacggagctgcgccgcgacccgatccgcggctccctggccctgctgggcaccctgctgctgatggcgatcatgagctacggcatcaccatggacgtggaagacctgaaatacgccgtgctcgaccgcgaccagagcggcgccagccaggactacgcgctggccctgtccggttcgccgcgctacttcaccgagcagccgccgttgaccgactatgccgacctggaccggcgcctgcgcggcggcgagatcagcgtggcggtggagatcccgccgaacttcggccgcgacctcaagcgcggcgccgtcccgcaggtggccttctggatcgacggcgccatgcccatgcgcgccgacaccgtcaagggctacgtccagggcatccaccagcgctacctcgaagaactggccgcccgcgatccagccggccagggcgccagcctcgccgaagtggccctgcgctaccgctacaaccccaacgtgctgagtctgccggccatggtcccggcggtcatcccgctgctgctgatgatgatcccggccatgctcaccgccctgggcgtggtgcgcgaaaaggagctgggatcgatcaccaacctctacaccaccccggtgacccggctggaatttctgctcggcaagcaactgatctacatactgatcggcctgatcaacttcctcatgctgctggtcttcgccgtggccgtgctcgacgtgccggtcagcggcagcctgtcggcgctgatcctgggcgcgctgctctacgtcgcctgctccaccggcctgggcctgttgatgtccacggtgaccaacagccagatcgccgccatcttcggcaccaccatcgtcaccctgctgccggcgatccagttctccgggctgctgcacccggtttccgccctggagggcatcggcgccctcaccggccagctctacccgaccagccatttcctgaccatcagccggggcgccttctccaaggccctgggcctgggggatctgctgccctatttcatcgccctgctggtgaccgccccgctgctgaccctcatcagcgtcgtcggcctgaagaaacaggaacgctga

SEQ ID NO: 27511 - protein, 911 aa, Azotobacter vinelandii AvOP
MSGVAQLAGVTLRYGRTCALDRLDLEIPANRMVGLIGPDGVGKSSLLALISGARRIQQGSISVLDGDMADAAHRRRVCPRIAYMPQGLGKNLYPTLTVRENLEFFGRLFGQDRAERDARIADLTRSTGLAPFTERPAGKLSGGMKQKLGLCCSLIHDPDLLILDEPTTGVDPLARSQFWELIERIRDNRAGMSVLVATAYMDEAQRFDWLVVMDDGKVLDTGSPGEILARTGSADLETAFIALLPEEKRRGHHALEIPPLAADSREAAIEAHGLTCRFGDFVAVDHVDFRIERGEIFGFLGSNGCGKSTTMKMLTGLLPASEGQALLFGQPVDPKDIDTRRRVGYMSQAFSLYGELTVLQNLELHARLFHLPEAQRTPRIGEMLDRFDLRQVGDSLPEQLPLGMRQRLSLAVAVLHNPEILILDEPTSGVDPVARDNFWELLIQLSRQDGVTIFISTHFMNEALRCDRISMMHAGRVLDSDSPRALMEKRGLPTLEETFIAYLRDAASAGGDEPLAESPAADTAAPAAADATAPSEGFSPRRLYSYFLREATELRRDPIRGSLALLGTLLLMAIMSYGITMDVEDLKYAVLDRDQSGASQDYALALSGSPRYFTEQPPLTDYADLDRRLRGGEISVAVEIPPNFGRDLKRGAVPQVAFWIDGAMPMRADTVKGYVQGIHQRYLEELAARDPAGQGASLAEVALRYRYNPNVLSLPAMVPAVIPLLLMMIPAMLTALGVVREKELGSITNLYTTPVTRLEFLLGKQLIYILIGLINFLMLLVFAVAVLDVPVSGSLSALILGALLYVACSTGLGLLMSTVTNSQIAAIFGTTIVTLLPAIQFSGLLHPVSALEGIGALTGQLYPTSHFLTISRGAFSKALGLGDLLPYFIALLVTAPLLTLISVVGLKKQER

SEQ ID NO: 27512 - DNA, 1590 bp, Azotobacter vinelandii AvOP
  CDS (1)..(1590): transl_table=11
ttgatctccacagcaaacatcaccatgcaattcggcgccaagccgctgttcgagaacgtctccgtcaagttcaacaacggtaaccgctacggtctgatcggcgccaacggctgcggaaagtccactttcatgaaaatcctcggcggcgatctggagccctccgccggccaggtgatgcttgagcccaacgtgcgcctcggcaagctgcgccaggatcagttcgcctacgaggatttttccgtgatcgataccgtgatcatgggccacgaggaactgtggaacgtgaaggccgaacgcgaccgtatctacgcgctgccggagatgagcgaagaggacggcatgaaggtcgccgatctcgaggtgcagttcgccgagctggacggctataccgccgaatcccgcgccggcgagctgctgctcggggtgggcattccgctggaccagcacttcggctcgatgagcgccgtggcgcccggctggaaactgcgcgtgctgctggcccaggcgctgttctccgacccggacgtgctgctgctcgacgagccgaccaaccacctggacatcaacaccatccgctggctggaaagcgtgctcaccgcgcgcaactccaccatgatcatcatctcccacgaccgtcacttcctgaacagcgtctgcacccacatggccgacctggactacggcgagttgcgcctgtttcccggcaactacgacgagtacatgaccgtggcgacccaggcccgcgagcgcctgctcgccgacaacgccaagaagaaggcgcagatcgccgagctgcagaccttcgtcagccgcttctcggccaacgcctccaaggccaagcaagccaccagccgcgcccggcagatcgacaagatccagttggaagaggtcaagccgtcgagccgggtcagccccttcatccgcttcgaacagaacaagaagctgcaccgccaggcgctgaccctggagaaggtcggccagggcttcgacggcatgacgctgttcaaagacctgtcgctgcaggtcgaagccggcgagcgggtcgccatcatcggccccaacggtatcggcaagaccaccctgctgcgcacgatggtcggcgagatgccgccgcagtccggcgaggtgaagtgggccgagagcgccgaaatcggctacttcgcccaggaccacgccgacgacttcgagcaggatctgaccctgttcgactggatggcccagtggacccagggcggcgagcagctggtgcgcggtaccctcgggcgcatgctgttctccaacgacgagatcaagaagtcggtgaaagtgatttccggcggcgaacaggggcgcatgctgttcggcaagctgatcctcgccaaacccaacgtgctggtgatggacgagccgaccaaccacctcgacatggagtccatcgaagcgctcaacctggccttggagaactaccccggcacgctgatcttcgtcagccacgaccgcgagttcgtcagctcgctggccacccgcatcatcgaactctccgccagcggcgtgaccgacttcagcggcagctacgacgactacctgcgcagccagggcgtggcgatctga

SEQ ID NO: 27513 - protein, 529 aa, Azotobacter vinelandii AvOP
MISTANITMQFGAKPLFENVSVKFNNGNRYGLIGANGCGKSTFMKILGGDLEPSAGQVMLEPNVRLGKLRQDQFAYEDFSVIDTVIMGHEELWNVKAERDRIYALPEMSEEDGMKVADLEVQFAELDGYTAESRAGELLLGVGIPLDQHFGSMSAVAPGWKLRVLLAQALFSDPDVLLLDEPTNHLDINTIRWLESVLTARNSTMIIISHDRHFLNSVCTHMADLDYGELRLFPGNYDEYMTVATQARERLLADNAKKKAQIAELQTFVSRFSANASKAKQATSRARQIDKIQLEEVKPSSRVSPFIRFEQNKKLHRQALTLEKVGQGFDGMTLFKDLSLQVEAGERVAIIGPNGIGKTTLLRTMVGEMPPQSGEVKWAESAEIGYFAQDHADDFEQDLTLFDWMAQWTQGGEQLVRGTLGRMLFSNDEIKKSVKVISGGEQGRMLFGKLILAKPNVLVMDEPTNHLDMESIEALNLALENYPGTLIFVSHDREFVSSLATRIIELSASGVTDFSGSYDDYLRSQGVAI

SEQ ID NO: 27514 - DNA, 1638 bp, Azotobacter vinelandii AvOP
  CDS (1)..(1638): transl_table=11
atgccttcgacccgaggaagtgaaatgaacgattcgcagaacctcatcgagatccgcgacctcgcggtcgagttcgtcggcggcgatcgcctggagcgcgtggtggaaggcgtcagcttcgacatccggcggggcgagaccctggccctagtcggcgaaagcggttcgggcaagtcggtcactgctcactcgatcctgcgtctgctgccctatccgctcgcccgccatccgtccggcagcatccgctatgccggccaggacctgctccagctcgacgagcgcaggctgcgcggcatccgcggcaaccgcatcgccatggtcttccaggagccgatgacctcgctgaacccgctgcacagcatcgagaagcagatcaacgaggttctcgccctacacaagggcctgcgcggcgcggcagccaccgcgcgcaccctggagctgctcgaactggtcggcattcccgagccgcacaagcgcctcaaggcttatccccacgagctttccggcggccagcggcaacgggtgatgatcgccatggcgctggccaacgaacccgaactgctgatcgccgacgagccgaccacggcgctggacgtcaccgtgcagttgaagatcctcgagctgctcaaggacctgcaggcccgcctgggcatggccttgctgctgatcacccacgacctcaacctggtgcggcgcaccgcccatcggatctgtgtcatgcgcggcgggcgcatcgtcgaacaggccggctgcgaggaaatcttccacgcgccgaagcatccctatactcaggaattgctcggtgccgaacccagcggggcgccggcggacaacccggtcggcgagccgctgctggaggtcgaggacctgcgcgtctggttcccgatcaagaagggcctgctgcgccgtaccgtcgatcacgtcaaggcggtggacggcatcggcttcagcctgcgccgcgggcagaccctgggcatcgtcggggaaagcggttccggcaagtccaccctcggcctggcgatcctgcgcctgctcgccagccagggctcgatccgcttccgcggccagacgctggacggtctgtcgcaaggcgagatccgccccctgcgacgggagatgcaggtggtcttccaggatcccttcggcagcctcagcccgcgcatgtcggtgggccagatcgtcggcgagggcctgcgcatccaccgcctcggcacgctggccgaacaggagcaggcgatcgtcgaggcgctgcgcgaggtcggcctggacccggaaacccgccaccgctacccgcacgagttttccggcggacagcggcagcggatcgccatcgcccgggcgctggtgctgaagccggcgctgatcctgctggacgagcccacttccgcgctcgaccgcacggtacagcgccaggtcgtcgagctgctgcgctcgctgcagcgcaagtacgacctgacctacctgttcatcagccacgacctggcggtggtcaaggcgctcagccaccagttgatggtggtcaggcagggacaggtggtcgaacagggggcggcgcgggatatcttcgccgctccgcgacatacttatacacggcagttgctggaagccgccttcctggctcccggcagcgccgattaa

SEQ ID NO: 27515 - protein, 545 aa, Azotobacter vinelandii AvOP
MPSTRGSEMNDSQNLIEIRDLAVEFVGGDRLERVVEGVSFDIRRGETLALVGESGSGKSVTAHSILRLLPYPLARHPSGSIRYAGQDLLQLDERRLRGIRGNRIAMVFQEPMTSLNPLHSIEKQINEVLALHKGLRGAAATARTLELLELVGIPEPHKRLKAYPHELSGGQRQRVMIAMALANEPELLIADEPTTALDVTVQLKILELLKDLQARLGMALLLITHDLNLVRRTAHRICVMRGGRIVEQAGCEEIFHAPKHPYTQELLGAEPSGAPADNPVGEPLLEVEDLRVWFPIKKGLLRRTVDHVKAVDGIGFSLRRGQTLGIVGESGSGKSTLGLAILRLLASQGSIRFRGQTLDGLSQGEIRPLRREMQVVFQDPFGSLSPRMSVGQIVGEGLRIHRLGTLAEQEQAIVEALREVGLDPETRHRYPHEFSGGQRQRIAIARALVLKPALILLDEPTSALDRTVQRQVVELLRSLQRKYDLTYLFISHDLAVVKALSHQLMVVRQGQVVEQGAARDIFAAPRHTYTRQLLEAAFLAPGSAD

SEQ ID NO: 27516 - DNA, 1623 bp, Burkholderia vietnamiensis G4
  CDS (1)..(1623): transl_table=11
atgagcgccatcgacgcctcgcagccgggcgaaccgctgctgtcgctcgagcatctgcacgtgcgcttcggcgacacggtggccgtcgaagacgtgacgctcgcgatcggtcgcggcgaacgcgtcgcgctggtcggcgagtcgggctcgggcaagagcgtgaccgcgctgtcgatcctgcggctgctgcgtgatgcggacgtgagcggcaccatccgcttcgccgggcaggatctcgccggcaagagcgagcgcgagatgcgcgggctgcgcggctcggacatcgcgatgatcttccaggagccgatgacggcgctcaatccgctgtacacggtcggcgcgcagatcgccgagacgatcgtgctgcacgacggcgtgacggccggcgaagcgcgcaagcgcacgatcgcgctgctcgcccgcaccggcatcgcggagcccgagaagcgcgtcgacagctacccgcacgagctgtcgggcggccagcggcagcgcgcgatgatcgcgatggcgctcgcctgccggccgcggctgctgctcgccgacgagccgaccaccgcgctcgacgtgacgatccgcgcgcagatcgtcgacctgctgctcgaactgcagcgcgacgaggcggaaaagcgcgggatggcgatcctgctgatcacgcacgatctgaacctcgtgcggcgcttcgccgagcgggtcgccgtaatggagcacggcaggctggtcgagagcgggccggtggagcggatcttcgcgcagcccgagcatccgtatacgcagcggctgctgaacagccggccgcagcgcacggtcgcgccggtgctgccgatcgcgccggtcgtgctcgacgcgcgccacgtcagcgtgcagttcgcgcgcaagcggccggggctggccggctggttcgggacgctgccggtgacggcggtggatgacgtgtccgtgtcggtgcggcagggcgagacgctcgggatcgtcggcgaatcaggctccggaaagtcgacgctcgcgatggcgctgctcgggctgcaacggacggtggccggcgagatcgagttccaggggcgcgcgctgtcgacctatcgcggccgcgaacagaccgcgctgcgctcgaacatgcaggtcgtctttcaggatccattcagttcgctgtcgccgcgtcagacgatcgagcggatcgtcggggaggggctcgagttgcatcgcccggaactgagcgcggacgcgcgccgcgcgaagtcgctgacggtgctgcgcgaagtcggcctcgaccgcacggtgctgcatcgctatccgcacgagttctccggcggccagcggcagcggatcgcgatcgcacgcgcgctcgtgctcgagccgcgcatcctgatcctcgacgagccgacttccgcgctcgacgtgtcgatccagcagcaggtgctgaagctgctcgcgaatttgcaacagaaatacaacctgggctatgtattcatcagccacgatctggaggtgatcggcgcgatggcgcaccgcgtcgcggtgatgcagggcggggcggtcgtcgagtccggcgacgtggcggatatcttcacgagaccgtcacatccttacacacaaaagctgttgaaagccgtctggaaagcgtga

SEQ ID NO: 27517 - protein, 540 aa, Burkholderia vietnamiensis G4
MSAIDASQPGEPLLSLEHLHVRFGDTVAVEDVTLAIGRGERVALVGESGSGKSVTALSILRLLRDADVSGTIRFAGQDLAGKSEREMRGLRGSDIAMIFQEPMTALNPLYTVGAQIAETIVLHDGVTAGEARKRTIALLARTGIAEPEKRVDSYPHELSGGQRQRAMIAMALACRPRLLLADEPTTALDVTIRAQIVDLLLELQRDEAEKRGMAILLITHDLNLVRRFAERVAVMEHGRLVESGPVERIFAQPEHPYTQRLLNSRPQRTVAPVLPIAPVVLDARHVSVQFARKRPGLAGWFGTLPVTAVDDVSVSVRQGETLGIVGESGSGKSTLAMALLGLQRTVAGEIEFQGRALSTYRGREQTALRSNMQVVFQDPFSSLSPRQTIERIVGEGLELHRPELSADARRAKSLTVLREVGLDRTVLHRYPHEFSGGQRQRIAIARALVLEPRILILDEPTSALDVSIQQQVLKLLANLQQKYNLGYVFISHDLEVIGAMAHRVAVMQGGAVVESGDVADIFTRPSHPYTQKLLKAVWKA

SEQ ID NO: 27518 - DNA, 2832 bp, Burkholderia vietnamiensis G4
  CDS (1)..(2832): transl_table=11
gtgaacacgacgacgcgcgcagataccgacagccgcgcgaccgacggcgcgccgggcgcggccggcccggcgccggtcgcccggctgtcgggcgtgtcgctgcgctacggcggcaaggcggcgctcgacgacgtgacgctcgagatcccggccggccgcatgatcgggctgatcggcccggacggcgtcggcaagtcgagcctgctcgcactcgtgtcgggcgcgcgcgcgatccagcaggggcacgtgcacgcgctcgacgccgatctgtcgtcgcgccgcgatcgcgcgcgcgtatgccggcgcatcgcgtacatgccgcagggcctcggccgcaacctgtacgcgacgctgtcggtcgaggagaacctgcagttcttcgcgcgcctgttcggccacgacgcggccgagcggcgccgccggatcgacgcgctgacgcgcagcaccggcctgcatccgttcctcgaccgcccggccggcaagctgtccggcgggatgaagcagaagctcggcctgtgctgcgcgctgatccacgatcccgacctgctgatcctcgacgagccgacgaccggcgtcgatccgctgtcgcgcgcgcagttctgggatctgatcgcgcgcattcgcgtcgcgcggcccgccatgagcgtgctggtcgcgaccgcctacatggacgaggcgcgccgcttcgactggctgatcgcgatggacgccggccgcgtgctggccaccggcagccccgccgacctgctcgcgcgcaccggctgcgacacgctggaggccgcgttcatcgcgctgctgccggacgagcgccgcaaggggcaccagccggtgcagatcgaaccgttccggcccgacgcgaccgccggctacgcgatcgaggccgacgggctgacgatgcggttcggcgagttcgtcgcggtggaccacgtgagcctgcagatccgtcgcggcgaaatcttcgggtttctcggctccaacggctgcggcaagtcgacgacgatgaagatgctcaccggcttgctgccggcgtccgaaggcacggcgacgctgttcggccagccggtcgccgccaacgacatcgacacgcgccgccgcgtcggctacatgtcgcagggcttttcgctgtacggcgagctgaccgtgcggcagaacctcgtgctgcacgcgcgcctgttcggcgtgccggaagccgacgtgcccgcgcgggtcgacgagatggtcgcgcgcttcgggctcgccggcgtgctcgacgtgctgccggagcgcctgccgctcgggatgcggcagcggctgtcgctcgcggtcgcgatggtgcacaagccggagctgctgatcctcgacgagccgacctcgggcgtcgacccggtcgcgcgcgacgacttctggcggctgatgatcgagctggcgcgccgcgatcgcgtcacgatcttcatctcgacgcacttcatgaacgaggccgcgcgctgcgaccgcatctcgctgatgcatgcgggccgcgtgctcgcgagcgccgcgccggcggagctggtgcgcatgcgcggcgcggcatcgctcgaggacgcgttcatcggctatctcaccgatgcgcagcgtgaggacagcccgagcgatgcagccgcagcggccgatgcgtcgtccgacgccggctggctcgccactgccccgtcggccacgcccgcggccgcccgcggcgcggcgcggaccgcatggttcagcgccgcgcgcgccggcagctacctgtggcgcgaggtgctggagctgcgccgcgacccgctgcgggcgacgctcgcgctgttcggctcgctcgtgctgatgtgcgtgatcagcatcggcatcagcctcgacgtcgacaacctgacgttcgcggtgctcgaccgcgaccagtcgatcctgagccaggactacgcgcagaacctcgccggctcgcgctacttcgtgccgcgcgcgccgctcgcggacgatcgcgacatcgaacgccgcatgcgcaacggcgagctgtcgctcgcgatcgagattccgcccgacttcgcgcgcgacgtcgcgcgcgggcggcacgtcgagatcggcgcgtgggtcgacggcgcgatgccgatgcgcgccgagacgatccgcggctacgtggccggcatgcacgagaactggctgcgcgaccaggcgaagcgccgcctcggcgtggcgctcgcgccggccgtcgacatcgcggtccgctatcgctacaaccccgacgtgaagagcttgcccgccatgattccggcgatcatgccgatgctgctgttgatgttgcccgcgatgctcaccgcgctcgccgtggtgcgagaacgcgagctcgggtcgatcgtgaacctgtacgtgacgcccgtcacgcgcgccgaattcctgatcggcaagcaggtgccgtacgtgatgctggcgatgcttaacttcctgctgatggtggtgctcgccgacctcgtgttcggcgtgcggatcaaaggcagtttcgcgacgctggcggccgcggtgctgatcttcaacgtggtggcgaccggcatcggcctgttcgcgtcgaccttcacgcgcagccagatcgccgcgatcttcatgacgatcgtcggtacgctgataccggtcgtgcagttctcggggctgctcacgccgctgtcgtcgctggaaggcagcggcaagtggatcggcacgatctatccggccacctacatgctcgcgatcagccgcggcgtgtacaacaaggcgctcgggctgtccgacctgtcgtcgcagttctggccgatgctcgtggccgtgcccgtcatcctcgtgatgaccggcatgctgctgcgcaaacaggagcgctga

SEQ ID NO: 27519 - protein, 943 aa, Burkholderia vietnamiensis G4
MNTTTRADTDSRATDGAPGAAGPAPVARLSGVSLRYGGKAALDDVTLEIPAGRMIGLIGPDGVGKSSLLALVSGARAIQQGHVHALDADLSSRRDRARVCRRIAYMPQGLGRNLYATLSVEENLQFFARLFGHDAAERRRRIDALTRSTGLHPFLDRPAGKLSGGMKQKLGLCCALIHDPDLLILDEPTTGVDPLSRAQFWDLIARIRVARPAMSVLVATAYMDEARRFDWLIAMDAGRVLATGSPADLLARTGCDTLEAAFIALLPDERRKGHQPVQIEPFRPDATAGYAIEADGLTMRFGEFVAVDHVSLQIRRGEIFGFLGSNGCGKSTTMKMLTGLLPASEGTATLFGQPVAANDIDTRRRVGYMSQGFSLYGELTVRQNLVLHARLFGVPEADVPARVDEMVARFGLAGVLDVLPERLPLGMRQRLSLAVAMVHKPELLILDEPTSGVDPVARDDFWRLMIELARRDRVTIFISTHFMNEAARCDRISLMHAGRVLASAAPAELVRMRGAASLEDAFIGYLTDAQREDSPSDAAAAADASSDAGWLATAPSATPAAARGAARTAWFSAARAGSYLWREVLELRRDPLRATLALFGSLVLMCVISIGISLDVDNLTFAVLDRDQSILSQDYAQNLAGSRYFVPRAPLADDRDIERRMRNGELSLAIEIPPDFARDVARGRHVEIGAWVDGAMPMRAETIRGYVAGMHENWLRDQAKRRLGVALAPAVDIAVRYRYNPDVKSLPAMIPAIMPMLLLMLPAMLTALAVVRERELGSIVNLYVTPVTRAEFLIGKQVPYVMLAMLNFLLMVVLADLVFGVRIKGSFATLAAAVLIFNVVATGIGLFASTFTRSQIAAIFMTIVGTLIPVVQFSGLLTPLSSLEGSGKWIGTIYPATYMLAISRGVYNKALGLSDLSSQFWPMLVAVPVILVMTGMLLRKQER

SEQ ID NO: 27520 - DNA, 2829 bp, Burkholderia vietnamiensis G4
  CDS (1)..(2829): transl_table=11
atggctgccacgctcggcacgtcgggggctggccatgcggcgggcgcgatccatgtcgcgaacctgtcgcatcgctatggctcggcgctcgcgctcgacgacgtatcgctgtcgctgccggcgcacacgacgatcggcctgatcggcccggacggcgtcggcaagtcgacgctgctcggcgtcatcgccggcgtgaagcgcatccagcagggcgacgtgtcggtgctcggcgcggacctgcgcgtgcgcgaccggcgcgaggcgatcctgccgcgcgtcgcgttcatgccgcaagggctcgggcgcaatctgtacccgacgctctcggtgtacgagaacatcgatttcttcgcgcgcctgttcgggctcgatgcgcatgcgcgcgcggcgcgcatccagcgcctgctcgatgccaccggccttgcgccgtttccggaccggccggcaggcaagctgtcgggcgggatgaagcagaagctcggcctgtgctgcgcgctcgtgcacaatcccgacctgctgatcctcgacgaaccgaccaccggcgtcgatccgctgtcgcgccgccagttctggacgctggtcgacgatctgcgcgccgagcatcgcggcatgagcgtgatcgtcgcaaccgcctacatggaagaggcgcagcgcttcgagcatctggtcgcgatggacggcgggcgcgtgctcgtcaacgacagcacgcaggcggtgctcgagcgcgcgggcacggacgacctggagcgggcgtacgtgtcgctcctgccgggggccggcggcgccggcgcggccgcccttgtgattccgccgcgcccgcaggacggcgcgcccgcgatcgtcgccgacgggctcacgcggcgcttcggcagcttcgtcgcggtcgatcacgtgagcttccggatcgagcgcaacgagatcttcggctttctcggctcgaacggttgcggcaagacgacgacgatgaagatgctgacgggcctgctcgacgcgacgagcgggaccgcgacgctgctcggcaagccgatcgacgcgaccgacatgaacacgcggatgaaggtcggctacatgtcgcagtcgttctcgctgtacgaggagctgacggtgcggcagaacctcgacctgcacgcgaagctctaccggatggagggcgagcgcgcgagtgaggccgtcgagcggtcgctggcgagcttcgagctgcagccgtgcgccgacgagcggcccgccgcgctgtcgctcggcatccgccagcggttgcagctcgcggccgcatgcctgcacaagccggaagtgctgatcctggacgaaccgacttcgggcgtcgatcccggcgcgcgcgacatgttctggcggcacctgatccagttgtcgcgcgaggaacgcgtgaccattttcatctcgacgcacttcatgaacgaggcggcgcgctgcgaccgcatttcgctgatgcaccgcggccgcgtgctcgccgtgggcagcccggaggaattgcgcgagcagcgtcacgcgtcgacgctcgaagaggcgttcgtggcctgtctcgaagaagccgaggcggccggcgcgacggcgccggcctcgcgccagccggatgcggcgcgacctgacgctcaggcggacgcgacggccgaagcgacagccgaagcaaccggcaaagcgacagccgaaggggcccccgaagcaacgcccaccacagcccccaccgccggctcgctcgcgcgcatctgggccttcgcgcgccgcgagtcgctggaactcgcgcgcgacaggctgcggctcgcgttcgcgctgctcggcccggtggtgctgctgctcgccgccgcatggagcgtgtcgttcgacgtggagaacgtgcggttcgcggtgctcgatcgcgaccatagcctcgaaagccgtaccctggtcgagcagttttccggctcgcgctacttcgtgccgaccggccacgtgtacaccgacggcgaagcgcaccgtctgctgcaggccgacgacgcgcagctggtcgtcgagattccgccggacttcggccgcgacctgctcgccgggcgccggcccgagctgtcgttccatgtcgatggctccagcccgttccccggcgcgacgatcggcacctacgtgaacgcggtgctgctcgactacgtcggcaaggaaatccgtcatgcgagcgtcgcgatgcccgcactgccggtgtcggtcgagtcgcgcttcatctacaacgaggaattccgcagcatctatgcgattacgcccggcgtcatcatgctcgcgctgatcctgatcccgacgatgctgaccgcgctcggcgtcgtgcgcgagaaggagatgggctcgatcacgaatctctatgcatcgccggcgggcgtcggcgagtacctgctcggcaagcaggcgccttacgtggggctcgcgatggtgagctacctcgtgctcgtcgcgctgaccgtcacggtgctcggcgtgccgctgaagggatcgttcgtcgcgctctcgatcggcgcgctgctgttcgtgttcgcggcgaccggcctcggcctgctcgtgtcgacgttcgtgcgctcccaggtcgcggcgattttcggcaccgcgattctgtgcctgattccgtcggtcaatttctccgggctgctctatccggtgtcgacgctcaccgggagcagctactgggcgggcctcggctttccgtcgtcgtggttccagctcgtgagcctgggcagcttcacgaagggcctgggcgccgcgcacttcggcacgatgtacgccgcgctgtcgggcttcgcgctgctctacctgatcggcgcgtattgcctgttgccgaagcaggaggcctag

SEQ ID NO: 27521 - protein, 942 aa, Burkholderia vietnamiensis G4
MAATLGTSGAGHAAGAIHVANLSHRYGSALALDDVSLSLPAHTTIGLIGPDGVGKSTLLGVIAGVKRIQQGDVSVLGADLRVRDRREAILPRVAFMPQGLGRNLYPTLSVYENIDFFARLFGLDAHARAARIQRLLDATGLAPFPDRPAGKLSGGMKQKLGLCCALVHNPDLLILDEPTTGVDPLSRRQFWTLVDDLRAEHRGMSVIVATAYMEEAQRFEHLVAMDGGRVLVNDSTQAVLERAGTDDLERAYVSLLPGAGGAGAAALVIPPRPQDGAPAIVADGLTRRFGSFVAVDHVSFRIERNEIFGFLGSNGCGKTTTMKMLTGLLDATSGTATLLGKPIDATDMNTRMKVGYMSQSFSLYEELTVRQNLDLHAKLYRMEGERASEAVERSLASFELQPCADERPAALSLGIRQRLQLAAACLHKPEVLILDEPTSGVDPGARDMFWRHLIQLSREERVTIFISTHFMNEAARCDRISLMHRGRVLAVGSPEELREQRHASTLEEAFVACLEEAEAAGATAPASRQPDAARPDAQADATAEATAEATGKATAEGAPEATPTTAPTAGSLARIWAFARRESLELARDRLRLAFALLGPVVLLLAAAWSVSFDVENVRFAVLDRDHSLESRTLVEQFSGSRYFVPTGHVYTDGEAHRLLQADDAQLVVEIPPDFGRDLLAGRRPELSFHVDGSSPFPGATIGTYVNAVLLDYVGKEIRHASVAMPALPVSVESRFIYNEEFRSIYAITPGVIMLALILIPTMLTALGVVREKEMGSITNLYASPAGVGEYLLGKQAPYVGLAMVSYLVLVALTVTVLGVPLKGSFVALSIGALLFVFAATGLGLLVSTFVRSQVAAIFGTAILCLIPSVNFSGLLYPVSTLTGSSYWAGLGFPSSWFQLVSLGSFTKGLGAAHFGTMYAALSGFALLYLIGAYCLLPKQEA

SEQ ID NO: 27522 - DNA, 3240 bp, Burkholderia mallei NCTC 10247
  CDS (1)..(3240)
atgagcgcgccgagcgtcgttcgtttttccgacgtcagcctgcgctacggcaagaccgtcgcgctcgagcggatcacgctcgagatcccggccggtctcacgatcgggctgatcgggccggacggcgtcggcaaatcgagcctgctcgcgctcgcggccggcgcgcgcgcgctgcagacgggcgcggtcgacgcgctcggcggcgacatgcgctcgcgccgccatcgcgagcgcgtgtgccggcgcatcgcgtacatgccgcaggggctcggcaagaacctgtatccgacgctctccgtcgaggaaaacctgcagttcttcgcgcgcctgttcggccacgacgccgacgagcgccgccgccggatcgacgcgctcacgcggagcaccggcctctttgcgttcctgtcgcggcccgcgggcaagctctcgggcgggatgaagcagaagctcggcctatgctgcgcgctgatccacgatcccgacctgctgatcctcgacgagccgacgaccggcgttgatccgctcgcgcgcgcgcagttctgggatctgatcgcgcgcattcgctcggagcggccggcgatgagcgtgatcgtcgcgaccgcgtacatggacgaggcgcaacgcttcgactggctgatcgcgatggacgcgggccgcgtgctcgcgacgggcgcgcccgccgagctgctcgcgcgcaccggctgcgattcgctcgaggcggccttcatcgcactgttgcccgaagacgaacggcgcggccacaagccggtgacgctcgagccgctgcgcgccgacgcgcaaaccggcaccgcgatcgaggcgcgcgggctgacgatgcgcttcggcgatttcaccgcggtcgatcacgtgagcttccggatccggcgcggcgagatcttcggctttctcggctcgaacggctgcggcaagtcgacgacgatgaagatgctcaccggcctgctgcccgcgaccgagggcaccgcgcagctgttcggcaagacagtcgatccgaaggacatcaatacgcgccggcgcgtcggctacatgtcgcaggccttctcgctgtatagcgaactgacggtgcggcagaacctcgtgctgcacgcgcggctgttcggcgtgccggccgccgagatcgacgcgcgcgtcgacgagatggcgcgccgcttcggcctcgccgacatctacgacatgctgccggacagcctgccgctcgggatgcggcagcggctgtcgctcgcggtggcgatggtgcacaagccggagctgctgatcctcgacgagccgacctcgggcgtcgatcccgtcgcgcgcgacagcttctggcagttgatgatcgacctcgcgcgccgcgatcgggtgacgatcttcatctcgacgcacttcatgaacgaggcgcagcgctgcgaccggatctcgctgatgcacgcgggccgcgtgctcgcgagcgatgcgccggcggcgctcgtgcgcgcgcgcggcgcggcgacgctcgaggaggccttcatcggctatctcgtcgacgcttcggcgcaggaggcgcaggaggcgcagggcggcgcgggcgagcgccccggcgcgggcgagcgcgcggcgggcgaaagcgtggccggtcgcggcgcggcgaccgatggcgatgccgacggcgcgcatgcgcggcccgccgcgtacgcgaacggcgcggcgcaacatcgcgcgcccgatgcggacgcggccggcaccgacgtcgccgccgagacgggcgcacgcgacgacgcgcgcaccgcacacgcggccggacattccgccggaaacgacgtacgcgccacggtgggctccgaagtcggctccgaagtcggctccgatgtcggctccgaagtcgcctccgaagccggcctcgcagccagcgccgaaagcggctccgaacgcggcgtcgcccacggcgccgaacgtgcacgcgaacccgcggcggatgccggcgccgcaatcgacgtcgaaccgggcgcgagcgcggaatcggccacggccgccgtcgccccggctcgccacgccgaatccgccgccacgtcaccccgcgcagggaacgcgccggccggcacgccgttcgccgccgcgccggccgagccgccccatcgcgcattcagcgcgcagcgcgcgctcagctacatgtggcgcgagatgctggagctgcgccgcgatcccgttcgcgcgacgctcgcgctgatcggctcgctcgtgctgatgtgcgtgatcggcatcggcatcagcctcgacgtcgaggatctgacctacgcggtgctcgaccgcgatcaaaccgagctgagccacgactacgcgctgaacctgtccggctcgcgctacttcgtcgagcggccgccgatcgccgattacgcggcgctcgaccgccggatgcgcgacggcgagctgtcgctcgcgatcgagattccgccgaacttcgcgcgcgacgtcgagcgcggcgcgcccgcgcagatcggcatgtggatcgacggcgcgatgccgcagcgcgccgagacgatccgcggctacgcgatcggcatgcacacgatgtggctcgccgacaaggcgcggcaccgcctcggcgtgacgctcgcgccgcgcgcggaagtggtcacgcgctaccgctacaacccggacgtgaagagcctgccggcgatgatccccgccgtgatgccgctgctgctgctgatgttgcccgcgatgctcaccgcgctcgccgtcgttcgcgaacgcgagctcggctcgatcctgaatctgtacgtgacgcccgtcacgcgcaccgagttcctgatcggcaagcaggtgccgtacgtcgtgctggcgatgctgaacttcctgctgatgacgatgctcgcgcgcatcgcgttcgacgtgcccgtcaagggcagcttcatgacgctgctgctcgcggtgctgatcttcaacgtcgtcgccacgggcatcggcctgctcgcgtcgacgttcacgcgcagccaggtggccgcgatcgtgatgacgatcatcggcacgatgatcccgaccgtgcagttcgcggggctgctcacgccgctgtcgtcgctcgagggcaccgggcgcttgatcggcctcgtctatccggccacctacatgctgtcgatcagccgcggcgtgttcaacaaggcgctgtcgctccacgagctctactcgcagttctggccgctcgccgcctgcgtaccggtgatcctcggcgcgaccatactgctcttgaaaaaacaggaacgctga

SEQ ID NO: 27523 - protein, 1079 aa, Burkholderia mallei NCTC 10247
MSAPSVVRFSDVSLRYGKTVALERITLEIPAGLTIGLIGPDGVGKSSLLALAAGARALQTGAVDALGGDMRSRRHRERVCRRIAYMPQGLGKNLYPTLSVEENLQFFARLFGHDADERRRRIDALTRSTGLFAFLSRPAGKLSGGMKQKLGLCCALIHDPDLLILDEPTTGVDPLARAQFWDLIARIRSERPAMSVIVATAYMDEAQRFDWLIAMDAGRVLATGAPAELLARTGCDSLEAAFIALLPEDERRGHKPVTLEPLRADAQTGTAIEARGLTMRFGDFTAVDHVSFRIRRGEIFGFLGSNGCGKSTTMKMLTGLLPATEGTAQLFGKTVDPKDINTRRRVGYMSQAFSLYSELTVRQNLVLHARLFGVPAAEIDARVDEMARRFGLADIYDMLPDSLPLGMRQRLSLAVAMVHKPELLILDEPTSGVDPVARDSFWQLMIDLARRDRVTIFISTHFMNEAQRCDRISLMHAGRVLASDAPAALVRARGAATLEEAFIGYLVDASAQEAQEAQGGAGERPGAGERAAGESVAGRGAATDGDADGAHARPAAYANGAAQHRAPDADAAGTDVAAETGARDDARTAHAAGHSAGNDVRATVGSEVGSEVGSDVGSEVASEAGLAASAESGSERGVAHGAERAREPAADAGAAIDVEPGASAESATAAVAPARHAESAATSPRAGNAPAGTPFAAAPAEPPHRAFSAQRALSYMWREMLELRRDPVRATLALIGSLVLMCVIGIGISLDVEDLTYAVLDRDQTELSHDYALNLSGSRYFVERPPIADYAALDRRMRDGELSLAIEIPPNFARDVERGAPAQIGMWIDGAMPQRAETIRGYAIGMHTMWLADKARHRLGVTLAPRAEVVTRYRYNPDVKSLPAMIPAVMPLLLLMLPAMLTALAVVRERELGSILNLYVTPVTRTEFLIGKQVPYVVLAMLNFLLMTMLARIAFDVPVKGSFMTLLLAVLIFNVVATGIGLLASTFTRSQVAAIVMTIIGTMIPTVQFAGLLTPLSSLEGTGRLIGLVYPATYMLSISRGVFNKALSLHELYSQFWPLAACVPVILGATILLLKKQER

SEQ ID NO: 27524 - DNA, 1635 bp, Burkholderia cenocepacia AU 1054
  CDS (1)..(1635): transl_table=11
atggcgaatgcgttgcttcagatcgacgggttttcggcgcgcttcggcaccaaggcggccgtgcaggaccttagcctgtcggtcggccgcggcgagcgcgtggcgctcgtcggcgaatcggggtcgggcaagagcgtgacggcgctgtcgatcctgcgcctcgcgcagcaggcgacgctgtcgggacggatgctgttcgacggcgaggacctgctcgcgaagaccgaacggcagatgcgcgggattcgcggcgccgacatcgcgatggtgttccaggaaccgatgacggcgctgaatccgctgtatacgatcggcaagcagatcgccgagagcctgcggctgcacgaggggctgcggccgggcgatgcgcgcgagcgggggatcgcgctgctgcggcgcaccgggattccggagccggaacggcgcatcgacagctttccgcatcagttgtcgggcgggcagcggcagcgcgcgatgatcgcgatggcgctggcatgccggccgcggctgttgctggccgacgagccgacgacggcgctcgacgtgacggtgcgccagcagatcgtcgacctgctgatcgaactgcaggagcaagaggcggccgcgcgcgggatggccgtgctgctgatcacgcacgacctgaatctcgtgcggcgttttgcgcagcgcgtggccgtgatggagcagggcgtgctcgtggagacgaacacgaccgacgcgctgttcgccgcgccgcagcacgcctatacgcgccggctgctcgacagcgccccgcagcgggacgtcgagccggtcgcggccggcgcgcagacgattctcgacgtgcaggacctcgccgtcgattaccgcgtcgcggcgaagggctggcgcgcggtgctcggcaagacgacgttccgcgccgtgcacgatgtgaagttgaacctgaggcgcggcgaaacgctgggaatcgtcggcgaatcgggctcggggaaatcgacgctggcggcgacggtgctcggcctgcagcggccggccgagggctcgatcgaaatcgacggcatgccgctggacgcgctgcggacgacgggcggcaggcgcgcgctgtacggcaggatgcaggtcgtgttccaggatccgttcggctcgctgtcgccgcgcatgacggtcgagcagatcgtcggcgaggggctcgccgtgcaccggccgcaggtagccggcgccgcgcggcgctcgcgggtcgccgcgctgctgcaggaggtcggcctgccggccgaagcgatgcttcgctatccgcacgaattttccggtggccagcgccagcgcatcgcgatcgcgcgcgcgctggcggtggagccggagctgctggtgctggacgagccgacgagcgcgctcgacgtgtcgatccagaagcaggtgctgaatctgctgacgaatctgcaaaagaagtacaagctgagctacctgttcatcacgcacgatctcgcggtgatgcgtgcaatggcccaccgggtcgtggtgatgaaggcggggcgggtggtcgaggagggcgatacgctcgacgtgctgcatgcgccgtcccatccgtatacacgcgcgctgctcgcgtcgtcgatgctggctccggtgcgcggcacacaagagagaaccgatgattga

SEQ ID NO: 27525 - protein, 544 aa, Burkholderia cenocepacia AU 1054
MANALLQIDGFSARFGTKAAVQDLSLSVGRGERVALVGESGSGKSVTALSILRLAQQATLSGRMLFDGEDLLAKTERQMRGIRGADIAMVFQEPMTALNPLYTIGKQIAESLRLHEGLRPGDARERGIALLRRTGIPEPERRIDSFPHQLSGGQRQRAMIAMALACRPRLLLADEPTTALDVTVRQQIVDLLIELQEQEAAARGMAVLLITHDLNLVRRFAQRVAVMEQGVLVETNTTDALFAAPQHAYTRRLLDSAPQRDVEPVAAGAQTILDVQDLAVDYRVAAKGWRAVLGKTTFRAVHDVKLNLRRGETLGIVGESGSGKSTLAATVLGLQRPAEGSIEIDGMPLDALRTTGGRRALYGRMQVVFQDPFGSLSPRMTVEQIVGEGLAVHRPQVAGAARRSRVAALLQEVGLPAEAMLRYPHEFSGGQRQRIAIARALAVEPELLVLDEPTSALDVSIQKQVLNLLTNLQKKYKLSYLFITHDLAVMRAMAHRVVVMKAGRVVEEGDTLDVLHAPSHPYTRALLASSMLAPVRGTQERTDD

SEQ ID NO: 27526 - DNA, 1632 bp, Burkholderia pseudomallei 1655
  CDS (1)..(1632)
atgagcgccgcgcagatcgcgcgcggcgccggcgcgccgccgcatgagccgttgctgtcgatcgagcggctgcgcgtgcgcttcggcggcacgctcgccgtcgacgacgtatcgcttgcgatcggccgcggcgagcgcgtcgcgctcgtcggcgaatcgggctccggcaagagcgtcaccgcgctggcgatcctgcgcctgctgcgcgacgccgacgtgagcggcgcgatccgcttcgcgggcgagacgctcgccgacaagagcgagcgcgagatgcgcgcgctgcgcggcgcggacatcgcgatgatcttccaggagccgatgaccgcgctcaatccgctcttcacgatcggcgagcagatcggcgagacgatcgagctgcacgatggcgtatcgaagcgcgacgcgcgcgcgcgggcgatcgcgctgctcgcgcgcaccgggatcgaccggccggacgagcgcgtcgacagctacccgcaccagttgtcgggcggccagcggcagcgcgcgatgatcgcgatggcgctcgcatgccggccgcgcctgttgctcgccgacgagccgaccaccgcgctcgacgtgacgatccgcgcgcagatcgtcgagctgctgctcgaactgcagcgtgacgcggcggccgagcgcgggatggcggtgctgctcatcacgcacgatctgaatctcgtgcggcgcttcgccgagcgggtcgcggtgatggagaagggccggctcgtcgagtgcgggccggtcgagcggatcttcgatgcgcccgagcacccgtacacgcagcgcctgttgcacagccggccgcagcgcacggtgtcgcccgtgttgccgatcgcgcccgtcgtgctcgacgcgcgcggggtcaccgtgcagttcaggcagaagctgccgggcttcgcgggctggctccgctcggggcgcttcaccgcggtgtcggacgcgagcgtgtcggtgcggcagggcgagacgctcggcatcgtcggcgaatcgggctccggcaagtcgacgctcgcgatggcgctcctcgggctgcagcgggtcgcgcacggcgacatcgaattcgagggccgttcgctcgcgagctttcgcgggcgcgagcgcgtcgcgctgcgcgcgaacatgcaggtggtatttcaggatcccttcagctcgctttcgccgcggcagacgatcgggcggatcgtgtccgaagggctcgaactgcatcgccctcggctcacggccgacgcgcgccgcgacaaggtgatcgcggtgctgcgcgaagtcggcctcgatcggacggtgctgcatcgctatccgcacgagttctcgggcggccagcgccagcggatcgcgatcgcgcgcgcgctcgtgctggagccgcgcgtgctcgtgctcgacgagccgacgagcgcgctcgacgtgtcgatccaacaacaagtgttgaagctgctgtcgaatctgcaacgaaagtacaacctgggctacgtgttcatcagccacgatctggaggtgatcggcgcgatggcgcaccgggtggcggtgatgcagggcggggcgatcgtcgagacgggcgacgtcgagcgcatcttcaccgaaccggtgcatccttacacgcaaaaattgctgaaagccgttcgttaa

SEQ ID NO: 27527 - protein, 543 aa, Burkholderia pseudomallei 1655
MSAAQIARGAGAPPHEPLLSIERLRVRFGGTLAVDDVSLAIGRGERVALVGESGSGKSVTALAILRLLRDADVSGAIRFAGETLADKSEREMRALRGADIAMIFQEPMTALNPLFTIGEQIGETIELHDGVSKRDARARAIALLARTGIDRPDERVDSYPHQLSGGQRQRAMIAMALACRPRLLLADEPTTALDVTIRAQIVELLLELQRDAAAERGMAVLLITHDLNLVRRFAERVAVMEKGRLVECGPVERIFDAPEHPYTQRLLHSRPQRTVSPVLPIAPVVLDARGVTVQFRQKLPGFAGWLRSGRFTAVSDASVSVRQGETLGIVGESGSGKSTLAMALLGLQRVAHGDIEFEGRSLASFRGRERVALRANMQVVFQDPFSSLSPRQTIGRIVSEGLELHRPRLTADARRDKVIAVLREVGLDRTVLHRYPHEFSGGQRQRIAIARALVLEPRVLVLDEPTSALDVSIQQQVLKLLSNLQRKYNLGYVFISHDLEVIGAMAHRVAVMQGGAIVETGDVERIFTEPVHPYTQKLLKAVR

SEQ ID NO: 27528 - DNA, 2727 bp, Chromohalobacter salexigens DSM 3043
  CDS (1)..(2727): transl_table=11
atgagtgaagacctcatcgcccggctgcgcggcgtcagcctgcggtatgccgcgaccacggccctggccgacgtggacctggacgttccggcccggcgcatggtcggcctgatcggtcccgacggcgttggcaagtcgagcctgctggcgctggtggccggtgctcgacgccgccagcgaggcaacgtcgaggtgctcggcggcgacatggcgaacgccaggcatcgtcgcctgacgggaccgcgtatcgcctacatgccacagggcctcggcaagaacctgtatgcgaccctgacggtgcgcgagaatctcgagttcttcgcacgtctcttcggccagaaccaggccgagcgagaaggccgcattctcgacctgacccgcagcacgggactgtccgagttcctcgagcgccccgccggcaagctctccggcggcatgaaacagaagctgggcctgtgctgcgcgctgattcacgatcccgacctgctgatcctcgatgagcccacgaccggggtcgatccactctcgcggagccagttctgggagctcatcgcccgtctccgccagcaacgtcttcacatgagcgtgctcgtcgccaccgcctacatggacgaggcccagcgcttcgactggctggtggtcatgaacgagggccgactactggataccggcacgccccgggccctgctcgaacgcacccgctgcacgacgctggaagcggccttcatccagttgctgcccgaggaccagcgccgcacgcatcagcagctggacattcccccgcgacgcaccaacgacgagaccgccatcgaggcccatggactgaccaagcgattcggcgatttcaccgccgtggatcacgtcgactttcgcatcgcccgcggcgagatcttcggctttgtgggttccaacggctgcggcaagtcgaccaccatgaagatgctcaccggactgctgcctttcgaggcaggccaggcccggctgttcggccagccggtggcccccgacgacatcgcgacccggcggcgcatcggttacatgtcgcaggccttctcgctgtacagcgaactcagcgtgggccagaacctcgacctgcatgctcggctctttcagctgtcggaagacgactaccgccagcgccgccctgcgctgctgacccgtttcgacctcgagcacgtcgtcgaccggttgcccggacgcctgccactgggcgtccgccagcgtttgtcgctggcggtggcggtgctccatcgtccggaaatcctgattctcgacgaacccacctccggcgtcgatccgatcaaccgcgacgacttctggcatcagttggtacagatgtcgcgggaggacggcgtcaccattttcatttccacccatttcatgaacgaggccatgcgctgcgatcgcgtcgcgttgatgcatgctggccgggtgctcgccaccgacaccccgcaggcgctgatcgcaaaccgaggcagcgatacactggaacaggccttcatcggctatctgcgcgacgccgcctcgcctggcgcatcgaccggcgccgctcccatggcgctttccgcctccgacacggccatgaacgatacgccgccaccgcgtttcagtggccggcgactgctcagttacgcccggcgcgagagcatcgagctacgccgcgacccggtacgggccaccatggcgatgatcggtaccctcgtgttgatgttcatcatggggtacggcatcaacatggacgtcgatcgtctcgccttcgccgtgctcgaccgtgaccagaccacgaccagccagcactatgcgctcaacctgtccggctcgcgctacttccaggaaaaggcaccgctgcagagctatgcggatctggaaacacgcctgcgcagcggtgacatcagcctcgcggtggaaataccgcccgatttcgggaggcggctcaaacgcggcgactcgccccaggtggcgtactggatcgacggcgccatgccgagtcgcgccaataccatccgggggtacgtggtaggcatccacgatgcctatctgcaggagctggcgcacggcatgggcacgcgcgccgatagcgggcaggtcgacattgcgctgcgctatcgctacaaccccgacgtgcagagcttgccggccatggtgccgacgatcatgtcgctgttgctgatgatgattccggccatgctgaccgcgctgggggtggtgcgcgagaaggagctcggctccatcaccaacttctacgtcacgccggtgacacgcctggaattcctgatcggcaagcaactgccctacgtgacgctgggcctggtcaatttcctgctgctggtgctgctgtcgatcctcgtgttcgatgtgcccctcaagggcaacctgctgaccctgaccctgggcgcattgttgtacgtgatgtgcgccacggggctgggattcttgttctcgacgctgttcaacagccagatcgccgccatcttcggcaccacgatcggcacgctggtgccggcgctgcagttctcgggcatgttcaaccctgtggcctctctggaaggcacctctgccgtgatcggacaactctaccccaccacccattttctgctgatctgccggggcgtgttctccaaggccctgggattggctgacttgtatccctactttctggccttgctggcaacgctccccgtgctcggcgggctcagcctcgttgccctcggcaaacaggagaagtga

SEQ ID NO: 27529 - protein, 908 aa, Chromohalobacter salexigens DSM 3043
MSEDLIARLRGVSLRYAATTALADVDLDVPARRMVGLIGPDGVGKSSLLALVAGARRRQRGNVEVLGGDMANARHRRLTGPRIAYMPQGLGKNLYATLTVRENLEFFARLFGQNQAEREGRILDLTRSTGLSEFLERPAGKLSGGMKQKLGLCCALIHDPDLLILDEPTTGVDPLSRSQFWELIARLRQQRLHMSVLVATAYMDEAQRFDWLVVMNEGRLLDTGTPRALLERTRCTTLEAAFIQLLPEDQRRTHQQLDIPPRRTNDETAIEAHGLTKRFGDFTAVDHVDFRIARGEIFGFVGSNGCGKSTTMKMLTGLLPFEAGQARLFGQPVAPDDIATRRRIGYMSQAFSLYSELSVGQNLDLHARLFQLSEDDYRQRRPALLTRFDLEHVVDRLPGRLPLGVRQRLSLAVAVLHRPEILILDEPTSGVDPINRDDFWHQLVQMSREDGVTIFISTHFMNEAMRCDRVALMHAGRVLATDTPQALIANRGSDTLEQAFIGYLRDAASPGASTGAAPMALSASDTAMNDTPPPRFSGRRLLSYARRESIELRRDPVRATMAMIGTLVLMFIMGYGINMDVDRLAFAVLDRDQTTTSQHYALNLSGSRYFQEKAPLQSYADLETRLRSGDISLAVEIPPDFGRRLKRGDSPQVAYWIDGAMPSRANTIRGYVVGIHDAYLQELAHGMGTRADSGQVDIALRYRYNPDVQSLPAMVPTIMSLLLMMIPAMLTALGVVREKELGSITNFYVTPVTRLEFLIGKQLPYVTLGLVNFLLLVLLSILVFDVPLKGNLLTLTLGALLYVMCATGLGFLFSTLFNSQIAAIFGTTIGTLVPALQFSGMFNPVASLEGTSAVIGQLYPTTHFLLICRGVFSKALGLADLYPYFLALLATLPVLGGLSLVALGKQEK

SEQ ID NO: 27530 - DNA, 1680 bp, Chromohalobacter salexigens DSM 3043
  CDS (1)..(1680): transl_table=11
atgctttcgaccctcgccacgtgctcagcccccagacctcgcccacagcgagtgcctcgagcggccttccagggagaagcgcgcatggacaatgatacggtcgtcttcgaactcgatggcctgcgcatcgccttcggcgacaccacggtggtggaggacctgtcgctgacgctgcgccgcggtgaaaccgccgcgctggtcggcgaatcgggctccggcaagtcggtatccgccctcggcgcgctcgacctgttgccgcccagcgccaaggtcgacggcacgcgccggctcctgggagaatcgctcgacggtctccccaaggcgcgctggaatgcgctgcgcggcgggcaggtcggtttcgtctttcaggaacccaccacctcgctcaacccgctgcacagcgtgggcaagcagctcgccgaaaccttgcggctgcatcaaggggtgcgtggccgtgccgcgcgggaacgcgcacgcgaattgctcgttgcggtgcaattgccccgccccgatgtcctgctcgacgctcaccctcaccagttgtccggcgggcagcgtcaacgcgtcatgatcgccatggccatcgccaacgacccggcgctgctcatcgccgacgaacccacgaccgcactcgatgtcacggtgcaacgggagatcctcgcgctgctggctcggctgcgggatacccacggcatggccatgctgttcatcacccatgacctcaacctggtccgtcgtcacgcggacagcgtgcatgtcatgaagcagggccggctcatcgagagcggaaccgtggcgcaggtcttcgacaccccgcgcgaggcctacacccgacacttgctcgccgccgagcccgaaggccgcgccgtggcactgcccgctgccgcccccacgctgctcgaggcgcacgcactcagcgtggcgttcgaacagggcaagtcctggctggggcggcgccccgcccccttcgtcgccgtgcatccgctcgacatccagctggcacgcggcgaaacgctgggcctggtcggggaatcgggctccggcaagaccacgctggccatggcgttgctgcgcctcaccgccgccgacggcgagatcgtcttcggcggggagcgcctcgacaccttgcgtggcaatgccctgcgccgccggcgccgacgctttcaggtcgtctttcaggacccctacgggtcgttgtcaccccgcatgccggtcatggatatcgtcagcgaaggcctgcgcttccaccaccccgaactcagcgacgccgaggtcgaacgccgtgtcgccgcgacgctggacgaagtcggcctgcccgcggattgcgcggcgcgttatccgcacgaattctcgggcggccagcgccagcgcatcgccgtggcgcgcgccatcatcctcgagcccgacctggtggtcctcgacgagcccacgtctgcgctggaccgcagcgtgcagaaacagctcattgccctgttgcgggatcttcagtcgcgacgcggactgagctacctgttcatcagccacgatctcgccgtggtccgcgccatggcacaccgggtgatggtgctcaaggatggccgtgtcgtcgagcaaggcgactgcgacacgctgctcagccgcccccaggccgactacacgcagcgcctgctcgaggcatccggcctgggtgacagaacctga

SEQ ID NO: 27531 - protein, 559 aa, Chromohalobacter salexigens DSM 3043
MLSTLATCSAPRPRPQRVPRAAFQGEARMDNDTVVFELDGLRIAFGDTTVVEDLSLTLRRGETAALVGESGSGKSVSALGALDLLPPSAKVDGTRRLLGESLDGLPKARWNALRGGQVGFVFQEPTTSLNPLHSVGKQLAETLRLHQGVRGRAARERARELLVAVQLPRPDVLLDAHPHQLSGGQRQRVMIAMAIANDPALLIADEPTTALDVTVQREILALLARLRDTHGMAMLFITHDLNLVRRHADSVHVMKQGRLIESGTVAQVFDTPREAYTRHLLAAEPEGRAVALPAAAPTLLEAHALSVAFEQGKSWLGRRPAPFVAVHPLDIQLARGETLGLVGESGSGKTTLAMALLRLTAADGEIVFGGERLDTLRGNALRRRRRRFQVVFQDPYGSLSPRMPVMDIVSEGLRFHHPELSDAEVERRVAATLDEVGLPADCAARYPHEFSGGQRQRIAVARAIILEPDLVVLDEPTSALDRSVQKQLIALLRDLQSRRGLSYLFISHDLAVVRAMAHRVMVLKDGRVVEQGDCDTLLSRPQADYTQRLLEASGLGDRT

SEQ ID NO: 27532 - DNA, 1650 bp, Burkholderia pseudomallei 1710a
  CDS (1)..(1650)
atgagcgccgcgcagatcgcgcgcggcgccggcgcgccgccgtcgccgtcgacgccgccgcatgagccgttgctgtcgatcgagcggctgcgcgtgcgcttcggcggcacgctcgccgtcgacgacgtatcgcttgcgatcggccgcggcgagcgcgtcgcgctcgtcggcgaatcgggctccggcaagagcgtcaccgcgctggcgatcctgcgcctgctgcgcgacgccgacgtgagcggcgcgatccgcttcgcgggcgagacgctcgccgacaagagcgagcgcgagatgcgcgcgctgcgcggcgcggacatcgcgatgatcttccaggagccgatgaccgcgctcaatccgctcttcacgatcggcgagcagatcggcgagacgatcgagctgcacgatggcgtatcgaagcgcgacgcgcgcgcgcgggcgatcgcgctgctcgcgcgcaccgggatcgaccggccggacgagcgcgtcgacagctatccgcaccagttgtcgggcggccagcggcagcgcgcgatgatcgcgatggcgctcgcatgccggccgcgcctgttgctcgccgacgagccgaccaccgcgctcgacgtgacgatccgcgcgcagatcgtcgagctgctgctcgaactgcagcgtgacgcggcggccgagcgcgggatggcggtgctgctcatcacgcacgatctgaatctcgtgcggcgcttcgccgagcgggtcgcggtgatggagaagggccggctcgtcgagtgcgggccggtcgagcggatcttcgatgcgcccgagcacccgtacacgcagcgcctgttgcacagccggccgcagcgcacggtgtcgcccgtgttgccgatcgcgcccgtcgtgctcggcgcgcgcggggtcaccgtgcagttcaggcagaagctgccgggcttcgcgggctggctccgctcggggcgcttcaccgcggtgtcggacgcgagcgtgtcggtgcggcagggcgagacgctcggcatcgtcggcgaatcgggctccggcaagtcgacgctcgcgatggcgctcctcgggctgcagcgggtcgcgcacggcgacatcgaattcgagggccgttcgctcgcaagctttcgcgggcgcgagcgcgtcgcgctgcgcgcgaacatgcaggtggtatttcaggatcccttcagctcgctttcgccgcggcagacgatcgggcggatcgtgtccgaagggctcgaactgcatcgccctcggctcacggccgacgcgcgccgcgacaaggtgatcgcggtgctgcgcgaagtcggcctcgatcggacggtgctgcatcgctatccgcacgagttctcgggcggccagcgccagcggatcgcgatcgcgcgcgcgctcgtgctggagccgcgcgtgctcgtgctcgacgagccgacgagcgcgctcgacgtgtcgatccaacaacaagtgttgaagctgctgtcgaatctgcaacgaaaatacaacctgggctacgtgttcatcagccacgatctggaggtgatcggcgcgatggcgcaccgggtggcggtgatgcagggcggggcgatcgtcgagacgggcgacgtcgagcgcatcttcaccgaaccggtgcatccttacacgcaaaaattgctgaaagccgttcgttaa

SEQ ID NO: 27533 - protein, 549 aa, Burkholderia pseudomallei 1710a
MSAAQIARGAGAPPSPSTPPHEPLLSIERLRVRFGGTLAVDDVSLAIGRGERVALVGESGSGKSVTALAILRLLRDADVSGAIRFAGETLADKSEREMRALRGADIAMIFQEPMTALNPLFTIGEQIGETIELHDGVSKRDARARAIALLARTGIDRPDERVDSYPHQLSGGQRQRAMIAMALACRPRLLLADEPTTALDVTIRAQIVELLLELQRDAAAERGMAVLLITHDLNLVRRFAERVAVMEKGRLVECGPVERIFDAPEHPYTQRLLHSRPQRTVSPVLPIAPVVLGARGVTVQFRQKLPGFAGWLRSGRFTAVSDASVSVRQGETLGIVGESGSGKSTLAMALLGLQRVAHGDIEFEGRSLASFRGRERVALRANMQVVFQDPFSSLSPRQTIGRIVSEGLELHRPRLTADARRDKVIAVLREVGLDRTVLHRYPHEFSGGQRQRIAIARALVLEPRVLVLDEPTSALDVSIQQQVLKLLSNLQRKYNLGYVFISHDLEVIGAMAHRVAVMQGGAIVETGDVERIFTEPVHPYTQKLLKAVR

SEQ ID NO: 27534 - DNA, 1650 bp, Burkholderia pseudomallei 668
  CDS (1)..(1650)
atgagcgccgcgcagatcgcgcgcggcgccggcgcgccgccgtcgccgtcgacgccgccgcatgagccgttgctgtcgatcgagcggctgcgcgtgcgcttcggcggcacgctcgccgtcgacgacgtatcgcttgcgatcggccgcggcgagcgcgtcgcgctcgtcggcgaatcgggctccggcaagagcgtcaccgcgctggcgatcctgcgcctgctgcgcgacgccgacgtgagcggcgcgatccgcttcgcgggcgagacgctcgccgacaagagcgagcgcgagatgcgcgcgctgcgcggcgcggacatcgcgatgatcttccaggagccgatgaccgcgctcaatccgctcttcacgatcggcgagcagatcggcgagacgatcgagctgcacgatggcgtatcgaagcgcgacgcgcgcgcgcgggcgatcgcgctgctcgcgcgcaccgggatcgaccggccggacgagcgcgtcgacagctacccgcaccagttgtcgggcggccagcggcagcgcgcgatgatcgcgatggcgctcgcatgccggccgcgcctgttgctcgccgacgagccgaccaccgcgctcgacgtgacgatccgcgcgcagatcgtcgagctgctgctcgaactgcagcgtgacgcggcggccgagcgcgggatggcggtgctgctcatcacgcacgatctgaatctcgtgcggcgcttcgccgagcgggtcgcggtgatggagaagggccggctcgtcgagtgcgggccggtcgagcggatcttcgatgcgcccgagcacccgtacacgcagcgcctgttgcacagccggccgcagcgcacggtgtcgcccgtgttgccgatcgcgcccgtcgtgctcgacgcgcgcggggtcaccgtgcagttcaggcagaagctgtcgggcttcgcgggctggctccgctcggggcgcttcaccgcggtgtcggacgcgagcgtgtcggtgcggcagggcgagacgctcggcatcgtcggcgaatcgggctccggcaagtcgacactcgcgatggcgctcctcgggctgcagcgggtcgcgcacggcgacatcgaattcgagggccgttcgctcgcgagctttcgcgggcgcgagcgcgtcgcgctgcgcgcgaacatgcaggtggtatttcaggatcccttcagctcgctttcgccgcggcagacgatcgagcggatcgtgtccgaagggctcgaactgcatcgccctcggctcacggccgacgcgcgccgcgacaaggtgatcgcggtgctgcgcgaagtcggcctcgatcggacggtgctgcatcgctatccgcacgagttctcgggcggccagcgccagcggatcgcgatcgcgcgcgcgctcgtgctggagccgcgcgtgctcgtgctcgacgagccgacgagcgcgctcgacgtgtcgatccaacaacaagtgttgaagctgctgtcgaatctgcaacgaaagtacaacctgggctacgtgttcatcagccacgatctggaggtgatcggcgcgatggcgcaccgggtggcggtgatgcagggcggggcgatcgtcgagacgggcgacgtcgagcgcatcttcaccgaaccggtgcatccttacacgcaaaaattgctgaaagccgttcgttaa

SEQ ID NO: 27535 - protein, 549 aa, Burkholderia pseudomallei 668
MSAAQIARGAGAPPSPSTPPHEPLLSIERLRVRFGGTLAVDDVSLAIGRGERVALVGESGSGKSVTALAILRLLRDADVSGAIRFAGETLADKSEREMRALRGADIAMIFQEPMTALNPLFTIGEQIGETIELHDGVSKRDARARAIALLARTGIDRPDERVDSYPHQLSGGQRQRAMIAMALACRPRLLLADEPTTALDVTIRAQIVELLLELQRDAAAERGMAVLLITHDLNLVRRFAERVAVMEKGRLVECGPVERIFDAPEHPYTQRLLHSRPQRTVSPVLPIAPVVLDARGVTVQFRQKLSGFAGWLRSGRFTAVSDASVSVRQGETLGIVGESGSGKSTLAMALLGLQRVAHGDIEFEGRSLASFRGRERVALRANMQVVFQDPFSSLSPRQTIERIVSEGLELHRPRLTADARRDKVIAVLREVGLDRTVLHRYPHEFSGGQRQRIAIARALVLEPRVLVLDEPTSALDVSIQQQVLKLLSNLQRKYNLGYVFISHDLEVIGAMAHRVAVMQGGAIVETGDVERIFTEPVHPYTQKLLKAVR

SEQ ID NO: 27536 - DNA, 3261 bp, Burkholderia pseudomallei Pasteur
  CDS (1)..(3261): n means a or g or c or t/u, s means g or c
atgagcgcgccgagcgtcgttcgtttttccgacgtcagcctgcgctacggcaagaccgtcgcgctcgagcggatcacgctcgagatcccggccggtctcacgatcgggctgatcgggccggacggcgtcggcaaatcgagcctgctcgcgctcgcggccggcgcgcgcgcgctgcagacgggcgcggtcgacgcgctcggcggcgacatgcgctcgcgccgccatcgcgagcgcgtgtgccgacgcatcgcgtacatgccgcaggggctcggcaagaacctgtatccgacgctctccgtcgaggaaaacctgcagttcttcgcgcgcctgttcggccacgacgccgacgagcgccgccgccggatcgacgcgctcacgcggagcaccggcctctttgcgttcctgtcgcggcccgcgggcaagctctcgggcgggatgaagcagaagctcggcctgtgctgcgcgctgatccatgatcccgacctgctgatcctcgacgagccgacgaccggcgtcgatccgctcgcgcgcgcgcagttctgggatctgatcgcgcgcattcgctcggagcggccggcgatgagcgtgatcgtcgcgaccgcgtacatggacgaggcgcaacgcttcgactggctgatcgcgatggacgcgggccgcgtgctcgcgacgggcgcgcccgccgagctgctcgcgcgcaccggctgcgattcgctcgaggcggccttcatcgcactgttgcccgaagacgaacggcgcggccacaagccggtgacgctcgagccgctgcgcgccgacgcgcaaaccggcaccgcgatcgaggcgcgcgggctgacgatgcgcttcggcgatttcaccgcggtcgatcacgtgagcttccggatccggcgcggcgagatcttcggctttctcggctcgaacggctgcggcaagtcgacgacgatgaagatgctcaccggcctgctgcccgcgaccgagggcaccgcgcagctgttcggcaagacagtcgatccgaaggacatcaatacgcgccggcgcgtcggctacatgtcgcaggccttctcgctgtatagcgaactgacggtgcggcagaacctcgtgctgcacgcgcggctgttcggcgtgccggccgccgagatcgacgcgcgcgtcgacgagatggcgcgccgcttcggcctcgccgacatctacgacatgctgccggacagcctgccgctcgggatgcggcagcggctgtcgctcgcggtggcgatggtgcacaagccggagctgctgatcctcgacgagccgacctcgggcgtcgatcccgtcgcgcgcgacagcttctggcagttgatgatcgacctcgcgcgccgcgatcgggtgacgatcttcatctygacgcacttcatgaacgaggcgcagcgctgcgaccggatctcgctgatgcacgcgggccgcgtgctcgcgagcgatgcgccggcggcgytygtgcgcgcgcgcggcgcggcgacgctcgaggaggccttcatcggctatttcgtcgacgctttggcgcaggaggcgcagggcggcgcgggcgagcgccccggcgcgggcgagcgccccggcgcgggcgagcgccccggcgcgggcgagcgcgcggcgggcgaaagcgtggccggtcgcggtgcggcgtccgatggcgatgccgacggcgcgcatgcgcggcccgccgcgtacgcgaacggcgcggcgcaacatcgcgcgcccgatgcggacgcggccggcaccgacgtcgccgccgagacgggcgcacgcgacgacgcgcgcaccgcacacgcggccggacattccgccggaaacgacgtacgcgccacggtgggctccgaagtcggctccgaagtcgcctccgaagccggcctcgcagccagcgccgaaagcggctccgaacgcggcgtcgcccacggcgccgaacgtgcacgcgaacccgcggcggatgccggcgccgcaatcgacgtcgaaccgggcgcgagcgcggaatcggccacggccgccgtcgccccggctcgccacgccgaatccgccgccacgtcaccccgcgcagggaacgcgccggccggcacgccgttcgccgccgcgccgccgtcgcacgccgcgccggccgagccgccccatcgcgcattcagcgcgcagcgcgcgctcagctacatgtggcgcgagatgctggagctgcgccgcgatcccgttcgcgcgacgctcgcgctgatcggctcgctcgtgctgatgtgcgtgatcggcatcggcatcagcctcgacgtcgaggatctgacctacgcggtgctcgaccgcgatcaaaccgagctgagccacgactacgcgctgaacctgtccggctcgcgctacttcgtcgagcggccgccgatcgccgattacgcggcgctcgaccgccggatgcgcgacggcgagctgtcgctcgcgatcgagattccgccgaacttcgcgcgcgacgtcgagcgcggcgcgcccgcgcagatcggcatgtggatcgacggcgcgatgccgcagcgcgccgagacgatccgcggctacgcgatcggcatgcacacgatgtggctcgccgacaaggcgcggcaccgcctcggcgtgacgctcgcgccgcgcgcggaagtggtcacgcgctaccgctacaacccggacgtgaagagcctgccggcgatgatccccgccgtgatgccgctgctgctgctgatgttgcccgcgatgctcaccgcgctcgccgtcgttcgcgaacgcgagctcggctcgatcctgaacctgtacgtgacgcccgtcacgcgcaccgagttcctgatcggcaagcaggtgccgtacgtcgtgctcgcgatgctgaacttcctgctgatgacgatgctcgcgcgcatcgcgttcgacgtgcccgtcaagggcagcttcatgacgctgttgctcgcggtgctgatcttcaacgtcgtcgccacgggcatcggcctgctcgcgtcgacgttcacgcgcagccaggtggccgcgatcgtgatgacgatcatcggcacgatgatcccgaccgtgcagttcgcggggctgctcacgccgctgtcgtcgcttgagggcaccgggcgcttgatcggcctcgtctatccggccacctacatgctgtcgatcagccgcggcgtgttcaacaaggcgctgtcgctccacgatctctactcgcagttctggccgctcgccgcctgcgtaccggtgatcctcggcgcgaccatactgctcttgaaaaagcaggaacgctga

SEQ ID NO: 27537 - protein, 1086 aa, Burkholderia pseudomallei Pasteur
  Xaa in position 459 and 489 is unknown
MSAPSVVRFSDVSLRYGKTVALERITLEIPAGLTIGLIGPDGVGKSSLLALAAGARALQTGAVDALGGDMRSRRHRERVCRRIAYMPQGLGKNLYPTLSVEENLQFFARLFGHDADERRRRIDALTRSTGLFAFLSRPAGKLSGGMKQKLGLCCALIHDPDLLILDEPTTGVDPLARAQFWDLIARIRSERPAMSVIVATAYMDEAQRFDWLIAMDAGRVLATGAPAELLARTGCDSLEAAFIALLPEDERRGHKPVTLEPLRADAQTGTAIEARGLTMRFGDFTAVDHVSFRIRRGEIFGFLGSNGCGKSTTMKMLTGLLPATEGTAQLFGKTVDPKDINTRRRVGYMSQAFSLYSELTVRQNLVLHARLFGVPAAEIDARVDEMARRFGLADIYDMLPDSLPLGMRQRLSLAVAMVHKPELLILDEPTSGVDPVARDSFWQLMIDLARRDRVTIFIXTHFMNEAQRCDRISLMHAGRVLASDAPAAXVRARGAATLEEAFIGYFVDALAQEAQGGAGERPGAGERPGAGERPGAGERAAGESVAGRGAASDGDADGAHARPAAYANGAAQHRAPDADAAGTDVAAETGARDDARTAHAAGHSAGNDVRATVGSEVGSEVASEAGLAASAESGSERGVAHGAERAREPAADAGAAIDVEPGASAESATAAVAPARHAESAATSPRAGNAPAGTPFAAAPPSHAAPAEPPHRAFSAQRALSYMWREMLELRRDPVRATLALIGSLVLMCVIGIGISLDVEDLTYAVLDRDQTELSHDYALNLSGSRYFVERPPIADYAALDRRMRDGELSLAIEIPPNFARDVERGAPAQIGMWIDGAMPQRAETIRGYAIGMHTMWLADKARHRLGVTLAPRAEVVTRYRYNPDVKSLPAMIPAVMPLLLLMLPAMLTALAVVRERELGSILNLYVTPVTRTEFLIGKQVPYVVLAMLNFLLMTMLARIAFDVPVKGSFMTLLLAVLIFNVVATGIGLLASTFTRSQVAAIVMTIIGTMIPTVQFAGLLTPLSSLEGTGRLIGLVYPATYMLSISRGVFNKALSLHDLYSQFWPLAACVPVILGATILLLKKQER

SEQ ID NO: 27538 - DNA, 1692 bp, Polaromonas sp. JS666
  CDS (1)..(1692): transl_table=11
atgacccccacgcctgtcactgtgcatccagcgctgccgcccgatgggggcttcgcgacgggtggcggatcttccgcgcctgcccatccgctgctgaaagtcgacggcctcagcgtttcctttgccggcaaaagagtcgtgcatggaattgatttttccatcgcacccggagaaaaactggccctggtaggcgagtccggttcgggcaagacggtgacggccctgagcctgctgcggctggtgcaaaacgccagcatcagcgggcaggcccggtttgccgcaacagagggcctgcaagggccggtgaatctgctttcccttcctgaagccgagttgcgcggcattcgcggccgggatattgcgatgatcttccaggagccgatgacggccctgaatcccctgttcaacgttggggaccagattgccgaggttgtccagctaaaacgcggcctgacccctgcagagtctgtgacgatggcaattaaattgctggcagacaccggcattccggagcctgacaggcgggcgcgctcatttccccatcagctctctggtgggcaacgccagcgggccatgattgcgatggcgctggcctgccagcccaagctgctgctggctgacgagccgacaaccgcactggacgtcaccttgcgcggccagattctggacctgctcagcgagttgcagcagcgaaacggcatggcggtgctcctgatcacgcacgacctcaacctcgtccgccgctttgcggaccgggtggcggtgatggaaaacggatatctggtggagcagggcaccgtcgcggaggtgtttgccgatccgcagcacgcctacacccgtaaattgatcgacagcaagccggtgcgcaatgtgagcgagggcgtggacttcgggccgggcgggcctttgatgatgcaggccagtcgtgtctccgtgacctatccggtcgccattccgggtttcaggggctggttcaaaagcggtgggtttgtggctgtaaaggatgccaccttcgatattccacccggtcagacgctgggggtcatcggggaatcgggttccggcaagtcaactctggccctcgccagcctcggcctgctgccgttttccggtaccttgcaggcggcagggcagtcctggagccgtaatggcgccagcaacaaggcgattcgccgtgcggttcaggtggtttttcaggacccgttttcctccctttcaccgcgcatgacggtgggcgagatcgtggaggaaggcttgcgtgtccatgagccctcgctggacgagctcgaaatgcgggagcgggcgtcgcaagctctggcggacgtgggcatgagcgaggcgcagtttccgggcttgctgcaacggtatccgcatgagttctcgggcgggcagcggcagcgggtggccattgcacgggcgctgatcatccatcccggcttgctggtgctggacgagccgaccagcgcgctcgatgtgacgatccagaagcaggttttgtcgctgcttcagcggctgcagcgcgaacggggcttgagctatcttttgatcacgcatgacgtggacgtgatccgtgcgatggcccatcaggtgatggtgatgaaagacggtgaggtgctggaatccggcgcggtgctggacgttctggacaggccccatcatccctacacgcaggtattggtgtcgcaggcctga

SEQ ID NO: 27539 - protein, 563 aa, Polaromonas sp. JS666
MTPTPVTVHPALPPDGGFATGGGSSAPAHPLLKVDGLSVSFAGKRVVHGIDFSIAPGEKLALVGESGSGKTVTALSLLRLVQNASISGQARFAATEGLQGPVNLLSLPEAELRGIRGRDIAMIFQEPMTALNPLFNVGDQIAEVVQLKRGLTPAESVTMAIKLLADTGIPEPDRRARSFPHQLSGGQRQRAMIAMALACQPKLLLADEPTTALDVTLRGQILDLLSELQQRNGMAVLLITHDLNLVRRFADRVAVMENGYLVEQGTVAEVFADPQHAYTRKLIDSKPVRNVSEGVDFGPGGPLMMQASRVSVTYPVAIPGFRGWFKSGGFVAVKDATFDIPPGQTLGVIGESGSGKSTLALASLGLLPFSGTLQAAGQSWSRNGASNKAIRRAVQVVFQDPFSSLSPRMTVGEIVEEGLRVHEPSLDELEMRERASQALADVGMSEAQFPGLLQRYPHEFSGGQRQRVAIARALIIHPGLLVLDEPTSALDVTIQKQVLSLLQRLQRERGLSYLLITHDVDVIRAMAHQVMVMKDGEVLESGAVLDVLDRPHHPYTQVLVSQA

SEQ ID NO: 27540 - DNA, 1668 bp, Polaromonas sp. JS666
  CDS (1)..(1668): transl_table=11
atgacgcatctggtggatgtctccggcctgagcctatcaatcggcaagggcggccgcgaaatcgtgcgcaatgtctcgttcacggtcgcgcccggcgaaatcgtcggcatcgtcggcgaatccggcagcggcaagacccaggccgcacgggccatcatgggcctcacgccgccgccgctggtgcgcagcgcgggccacatcctgttcgagggcgaagacatggcggcggccggcgacgcgcgtttgcgcgcgctgcgcggcgcgcgcatcggcatggtgttccaggagcccatgacctcgctcaacccctccatgaccataggccggcagctcgacgaaggcctggccctgcaccgaccccagctcacaccggccgcgcgccgcgagatggcgctggcgatgctggcgcgcgtcggcatcaccgacccgcaggccgcgctggccgcctggccgcatgaattctcgggcggcatgcgtcagcgcatgatgctggcctcagtcatgctgctcgagcccgcgctgctgatcgccgacgagccgaccacggcgctggacgcgctggtgcagcgcgacgtgctcgaactcatggtcgggctcacgcgcgagcacaacacggccgtgctgctgatcagccacgacctgcccatggtcgcgcgctacacgcagcgcatgatcgtcatgcagcaaggcgaagtcgtcgaggccggcgacacggcggccttgctggccggcccgtcgcaggcctacacccgcaagctgctggaggccatcccgcgccggcaggcggcgcgcacaattgccgacgaccagcccgtcatcgaagtgcgcaatctcgtattcgactacccaggcaagcgccggctgttcgccaagtccacggccaagcgcgtgctgcacggcattgacctggtggtgcgcccgcgcgagatcgtcgcggtggtgggcggctccggttcgggcaagaccaccctgggccgcgcgattgccggcctgatcaagccgaccgagggcgatatccgttttcgcgggcgttcgattgcgcgcagcgacgcgggctggctggactaccggctcaattgccagatggtgttccaggacccgtattcgtcactaaacccgcgcatgagcataggccagctggtcggtgaagggctgcggctggtgcctggactctcctcgaccgagcggcaatcgcgtgttgccaagatgctcgacgaagtcgggctggagccgcggcatgcggcgcgctatgcgcatgaactctccggcggccagcgccagcgcgtggcgattgcccgggcgctgatacgcgagccggcctttgtgatcgccgacgagccggtgtccgcgctggacgtcaccgtgcgcgcccaggtgttggcgctgctggccgagctgcaggagcggcacggctttgcctgcctcttcatcagccacgacctcggcgtggtcgagcaggtggccgaccgcgtgatcgtgatgcaggccggccgcatcatcgagcaaggcaaccgcgacgaggttttcgaccgtccgcagcatgcctacacgcgcaagctgctctcggcgattcccgcgctgacgcccaccggccagggcggcatgcagctcaagtggcgttttgacgaagccgatgcgccagcgggcgccctgcaacctgccatgtaa

SEQ ID NO: 27541 - protein, 555 aa, Polaromonas sp. JS666
MTHLVDVSGLSLSIGKGGREIVRNVSFTVAPGEIVGIVGESGSGKTQAARAIMGLTPPPLVRSAGHILFEGEDMAAAGDARLRALRGARIGMVFQEPMTSLNPSMTIGRQLDEGLALHRPQLTPAARREMALAMLARVGITDPQAALAAWPHEFSGGMRQRMMLASVMLLEPALLIADEPTTALDALVQRDVLELMVGLTREHNTAVLLISHDLPMVARYTQRMIVMQQGEVVEAGDTAALLAGPSQAYTRKLLEAIPRRQAARTIADDQPVIEVRNLVFDYPGKRRLFAKSTAKRVLHGIDLVVRPREIVAVVGGSGSGKTTLGRAIAGLIKPTEGDIRFRGRSIARSDAGWLDYRLNCQMVFQDPYSSLNPRMSIGQLVGEGLRLVPGLSSTERQSRVAKMLDEVGLEPRHAARYAHELSGGQRQRVAIARALIREPAFVIADEPVSALDVTVRAQVLALLAELQERHGFACLFISHDLGVVEQVADRVIVMQAGRIIEQGNRDEVFDRPQHAYTRKLLSAIPALTPTGQGGMQLKWRFDEADAPAGALQPAM

SEQ ID NO: 27542 - DNA, 1560 bp, Exiguobacterium sp. 255-15
  CDS (1)..(1560): transl_table=11
atgtggtgccggaatctgaccgtccgctatccggatcaagaccgagatgttttaaacgacttgaccgtgtcgctccggcaaggagagacgaccttattgattggtccgagcggcagcggcaaaacgaccttcttgcatacgcttgccggtctgatgccggaaacgattgaggcggaagtcaccggtgaatggcgcgcagacggaaccgtcggcatgctgtttcaacagccggacgatcagttttgcatgcagacggtcggggcggaaatcgccttcagtctggaaaaccggagtattccccgcgatgaaatggaagaacgaatcagaacggtgttgaaacgggttggactcgacctcgccttgacgacgcaaattgccggactgtccggcgggatgaaacaacggcttgctttggcctgtgtgttggcactcgaaccggacatcctgttactcgatgaaccgacggcgcaactcgatccgcacggccgccgattgatgatggagctgattgaagaattgcatcacaatccgaacgtgacactggtgttgatcgaacatcaactggaagaatgtgtgacgtttgctgaccgtgtgttggtctttcgggaaggacagctgaggcttgacggttccccgcttgatgtcttcgaggagaaacgggaggacctgacccgacacggtatcatgtgcccactgctctatccctatacactcgagacgattccactgacgatcgcaacagcacggttcctggatggcccgccggtcgcaagacgtccggttgcaaacgaaacgacgcttgatttgaccgatgtgacgatcgcgcatggcaaacggatgattctagaccagatttcgctgaccgcgtccgccggagaatggatcatgctcgtcgggcgcaacggtgccggtaaaagcaccctgcttgagacgctggcaaaactgttgccggcgcaaagcgggacgatcaagctgtttcagacacctttgaaaaaatggcgggaccggacgttttaccggcaggtcggtttcgtctttcagcaaccggagtttcaatttctgaaacagacggtcgccgatgaactggccatcagctctccgtcaccggcacgaagtcaagtagctgacgctctgcaacactaccgtttggaggatgtcgccgctcagtccccgctggcactcagtctcgggcaaaaaagacgcttaagtgtcgcgacgatgctgctggaacgaaaagctgtcctgttactcgatgaaccgaccttcggacaagatgctgagacgacggctcagattctcgatgtgttacaccaagcccgggaagcgggaactacgctgatcatggtgacgcacgacatggagctggtctaccgttacgccgaccgcgttgtcgtcatcggcgagaagcacgttcagtttgacggggcaccggatgaattgttccggaacgaatcattgcttgagcataaccagttgatccgcccggtatcggtacgctatcagcaactcgaggaggtgaaacaccgtgcaggaaaacaattcgttgctcgcacgccttaa

SEQ ID NO: 27543 - protein, 519 aa, Exiguobacterium sp. 255-15
MWCRNLTVRYPDQDRDVLNDLTVSLRQGETTLLIGPSGSGKTTFLHTLAGLMPETIEAEVTGEWRADGTVGMLFQQPDDQFCMQTVGAEIAFSLENRSIPRDEMEERIRTVLKRVGLDLALTTQIAGLSGGMKQRLALACVLALEPDILLLDEPTAQLDPHGRRLMMELIEELHHNPNVTLVLIEHQLEECVTFADRVLVFREGQLRLDGSPLDVFEEKREDLTRHGIMCPLLYPYTLETIPLTIATARFLDGPPVARRPVANETTLDLTDVTIAHGKRMILDQISLTASAGEWIMLVGRNGAGKSTLLETLAKLLPAQSGTIKLFQTPLKKWRDRTFYRQVGFVFQQPEFQFLKQTVADELAISSPSPARSQVADALQHYRLEDVAAQSPLALSLGQKRRLSVATMLLERKAVLLLDEPTFGQDAETTAQILDVLHQAREAGTTLIMVTHDMELVYRYADRVVVIGEKHVQFDGAPDELFRNESLLEHNQLIRPVSVRYQQLEEVKHRAGKQFVARTP

SEQ ID NO: 27544 - DNA, 1506 bp, Methanosarcina barkeri str. fusaro
  CDS (1)..(1506): transl_table=11
atgatagaactaaaagatttttcatatacctacggaacagctgaaagccctgttctgaataaaattaaccttgaagtccgacagggagaactgcttctagttaccggacacagtgcagccggaaagacaacgcttgctcttgcaatggcaggtatcctgcaccatgaaatagggggcaagaccgaaggagaaatcattttcaaaaaccggaacgtaaaaagttttaacggcatgaaggaactgagccggcatatcgggatggtttttgatgatgcggaatcacagctgatcttcacaagtgtcgaagaggaaatccgttcgggacttgaaaatcgtggctatcccataaaagaactgagacacaggctggaagaagtaatggaattctgcgaaatcagccaccttagaaaccgggctccccatgctctttctggcggtcagaagcaaaaagttgcacttgcagcaacctttgccctcgataccgaagtccttatccttgacgaagctacagccgaactggatacaaaggctgtaagaagaatcttttcaatcctgaaaaggctgaaagaagccggaaagactatcataatcatagaccacaacatagatgatttcctcgaaatcggggatagggtcgtgctgcttgaaaaaggcagaataaaagatataaaaagtccagctgatttttcagcatcttctctttcagcatcttctctcgctttagaaccggaaattcctgaaactgacagacagactctttatatgcctcataataagtggaaggaaagaaagcccattatttctgtaaagaatctcacacagcgttacggagaagtcctggcactcgacagcatagacctggagatttatcctggggagctcgttgctgtgctgggcgagaatggttcaggcaagacaacccttgtcaagcactttaatggccttttacgcccttattctgggagtgtaactataaaaggctttgaaacttcaaaaagttctgtaaacgagcttgtcaaatataccggtctggtctttcagaacccggacaacatgctttttgaggatactgtcgaagcagaaattgctttcggattaaataacattaatataaaagggcttgaggctgagaaagcaatatccgattcccttgaacttgtaaatttgggcgaaaaactgagagtttttccccgcaacctgagcagaggagaaaggcagagactggcggttgcttgcataattgccatgaagcccgaactgatcgtgctcgatgaacctacaacaggtctggatgccgaagaatcggacagtatgatgcagctcatacgaaaactccagcaggaagggcacacaatagtcatggtgacccataacatgcagatagtaaaagaccacgccgagagggttattcgcatggcggccggaaaaatcgtcgaagataccagcaggataactgcagatagtgagcaggtgagcagagaacacattggaggcatttgtacatga

SEQ ID NO: 27545 - protein, 501 aa, Methanosarcina barkeri str. fusaro
MIELKDFSYTYGTAESPVLNKINLEVRQGELLLVTGHSAAGKTTLALAMAGILHHEIGGKTEGEIIFKNRNVKSFNGMKELSRHIGMVFDDAESQLIFTSVEEEIRSGLENRGYPIKELRHRLEEVMEFCEISHLRNRAPHALSGGQKQKVALAATFALDTEVLILDEATAELDTKAVRRIFSILKRLKEAGKTIIIIDHNIDDFLEIGDRVVLLEKGRIKDIKSPADFSASSLSASSLALEPEIPETDRQTLYMPHNKWKERKPIISVKNLTQRYGEVLALDSIDLEIYPGELVAVLGENGSGKTTLVKHFNGLLRPYSGSVTIKGFETSKSSVNELVKYTGLVFQNPDNMLFEDTVEAEIAFGLNNINIKGLEAEKAISDSLELVNLGEKLRVFPRNLSRGERQRLAVACIIAMKPELIVLDEPTTGLDAEESDSMMQLIRKLQQEGHTIVMVTHNMQIVKDHAERVIRMAAGKIVEDTSRITADSEQVSREHIGGICT

SEQ ID NO: 27546 - DNA, 1449 bp, Desulfuromonas acetoxidans DSM 684
  CDS (1)..(1449): transl_table=11
atgaaaattgaactggacaatattagcgttgtggttcgtaaacaagcgtggttacacgatgtctctctggcgatttcacccgacgagaactgggcgtttgtcggcagcaacggttcgggtaaaagtgtgctcgggcgtattttgtgtggagaactgcccgtgacttccggtcgctgccgtttgaacttgcccgctgctctggtcagctttgaacggctgggtgaggtgttgcagtttgaacgggaacatgatgattctgattttctcgaccgggtggatcacgggactccagtgcgagactttttcgctgccgatgcaccgggtgacgtagaaacattggccgaggctctgggatgccaagggttgctggaacgtgggctgcgttttctttccaccggtgaaatgcgcaaagtgatgatccttcaggccatggtgcagaagccccgcctgttggtgctggacgagccgtttgacggtttggattcgcagtcgcgtcatgcattacgcattctgattggtcgttggatcgagcaggggggacagctggttcttatggtcaatcgtttcagcaacctgttgccgcaggtgacgcatctggggtatctgcatgatggaacactgctggtgcagggaggccgggaggatgattacgttcagaacgccatccaacgtctgaaccattttgatgcgcatcaaacgctgcaactgcctgattgtgatgcgccattgccgacgttgcccgacctgcacggccagccgttgattgccatgaacaacgtcactgttcgctatgctgaggcgttggtccttaaccggctgtgctggcaggtgcagccgggcgaacactggaaaatttccggtccgaatggttccggaaaatcaaccctgctcagcttgatcagcggcgataatccccaggcttacgccaatgagattatgctgttcgggcgcgctaaaggcagtggcgaaagtgtctgggagatcaagcgtcatctcggacaggtctccgccttgtttcaccaggaataccgggtacggggcacggttttgaccacggtcttatctggtttttatgactccgtgggcctttatcagacgccgacccgtcgtcagcaacagattacccgccaatggcttgagttgttgggattggagggcaaggccaacctgccgtttcatcgcttgtcctacggggaacaacgtctggtcttactcgcgcgagccatggtcaaacagcctcgggtgttgatccttgatgagccgtgccaggggcttgacgaagtgcatcgccatctggtgctgggattgattgattatctggggcgtcaggggcgcactcagttgttgtatgtcactcaccatgatgaagatcgtattccctgtattcagcgtcatttgcggctggtgcctgcctgcggtggtggttttatggctgaggtggtgtcgtga

SEQ ID NO: 27547 - protein, 482 aa, Desulfuromonas acetoxidans DSM 684
MKIELDNISVVVRKQAWLHDVSLAISPDENWAFVGSNGSGKSVLGRILCGELPVTSGRCRLNLPAALVSFERLGEVLQFEREHDDSDFLDRVDHGTPVRDFFAADAPGDVETLAEALGCQGLLERGLRFLSTGEMRKVMILQAMVQKPRLLVLDEPFDGLDSQSRHALRILIGRWIEQGGQLVLMVNRFSNLLPQVTHLGYLHDGTLLVQGGREDDYVQNAIQRLNHFDAHQTLQLPDCDAPLPTLPDLHGQPLIAMNNVTVRYAEALVLNRLCWQVQPGEHWKISGPNGSGKSTLLSLISGDNPQAYANEIMLFGRAKGSGESVWEIKRHLGQVSALFHQEYRVRGTVLTTVLSGFYDSVGLYQTPTRRQQQITRQWLELLGLEGKANLPFHRLSYGEQRLVLLARAMVKQPRVLILDEPCQGLDEVHRHLVLGLIDYLGRQGRTQLLYVTHHDEDRIPCIQRHLRLVPACGGGFMAEVVS

SEQ ID NO: 27548 - DNA, 1584 bp, Jannaschia sp. CCS1
  CDS (1)..(1584): transl_table=11
atgatcgcggttgaggggctgtgtctgaacatcggaccggtgcagattttgcacgacgtcagctttgacatggcgggcggagagatcttcggcctggtgggggagagcggctccggcaaatcgatgacggcgctggcgatgatgggcctcgcgccgcgcagcgcatccgtcacgggggcggcgcggctgggcgatgtcgaccttctggcgctggaagagcccgccttgcaggacctgcgcggcaatgacatcgcgatgatttttcaggagccgatgacggccctgaacccggtgcagaccatcggtgaccaagtggctgaaacgctgctgatccacgggcgcgcggggcggcgcgaggcgctggacatcgcgcgaaaccgcttggaccgcgtggggctggagcatatcgcgctggaccgatttccccatgagttgtcgggtgggcagcggcagcgcgtgtgcattgccgccgccatcgcgttgcacccgaagctgttgatcgccgacgagccgacaacggcgctggacgtcacgacgcaggcgcaaattcttgatttgctgcgcgaattggtcggtgaggaaggcatgtcgctgctgctgatcacccatgatctggcggtcgtctccgacatggcggaccggatcgcggtgatgcaaaagggccggattgtggagcaaggcgcgacggcggatgtcctgcgcacccaagcccacccctacacccgcgcgctgtttgcggcgtcgtcgcaccagccggatcgcgcggcagaggccgccgacgatgcgatcctgaccgtggaagacgtccaccgccactaccccggcccccgcaaaggcttccggcgcgggccgccggtgcgggcggtcaacggcgtgagtttcgccctgcaacggggcgaaagccttgggctggtcggagaatccggctgcggcaaatccaccctgacccgcgcgatcctgggcctcgatccggtgacatcgggggcgatcacattgaacggccatcccgtatccccccagatgcccaagcccctgcgcgcagacgtgcaggtggtgtttcaggacccctacggcagcttcaacccgcgctggcgggtggaccggatcgtggcggaaccgttccatttgctggcgacgccaccgccgcgcgacaaggcggtggcggaggcgctggaggccgtgcgcctgtccccggaagatgcccagaagtacccacacgaattctccggcgggcaacggcagcgcatcgccatcgcgcgcgccctgatcacccggcccaaactgctggtgctggatgaggcggtcagcgcgctggacgtgtcggtgcgggcgcaaatccttgatttgctggcggagttgcagacggactttgggcttagctacctgttcatctcccacgatctgaccgtcgtgcgcgccatcaccgaccgcgtgctggtcatgcaacacggcgaaatcgtggagcagggagagaccgaagccgtcttcaccaacgcccgacacccctatacgcaaacccttctggccgccgccccgcaactgcccccatccttgcccggagatgcccatgtccatctggtttga

SEQ ID NO: 27549 - protein, 527 aa, Jannaschia sp. CCS1
MIAVEGLCLNIGPVQILHDVSFDMAGGEIFGLVGESGSGKSMTALAMMGLAPRSASVTGAARLGDVDLLALEEPALQDLRGNDIAMIFQEPMTALNPVQTIGDQVAETLLIHGRAGRREALDIARNRLDRVGLEHIALDRFPHELSGGQRQRVCIAAAIALHPKLLIADEPTTALDVTTQAQILDLLRELVGEEGMSLLLITHDLAVVSDMADRIAVMQKGRIVEQGATADVLRTQAHPYTRALFAASSHQPDRAAEAADDAILTVEDVHRHYPGPRKGFRRGPPVRAVNGVSFALQRGESLGLVGESGCGKSTLTRAILGLDPVTSGAITLNGHPVSPQMPKPLRADVQVVFQDPYGSFNPRWRVDRIVAEPFHLLATPPPRDKAVAEALEAVRLSPEDAQKYPHEFSGGQRQRIAIARALITRPKLLVLDEAVSALDVSVRAQILDLLAELQTDFGLSYLFISHDLTVVRAITDRVLVMQHGEIVEQGETEAVFTNARHPYTQTLLAAAPQLPPSLPGDAHVHLV

SEQ ID NO: 27550 - DNA, 1503 bp, Desulfitobacterium hafniense DCB-2
  CDS (1)..(1503): transl_table=11
atgattgagcttaaacaagtatcttttgcttatggaaacggtgagagagacagcgggcttgaggatattgagctgaaagttgaagagggcgaatttctcctgctgtgcggcggctccggctgcgggaaaaccactttaacacgtctgctcaacggtttaattcccaacttttatggaggggtccttaagggacaggtatgggtcgggggcctggatgttgctaaggcccctctctatgagacggcggggaaagtaggttcggtgtttcagaatccccgcagccagttttttaatatggacaccaccggtgaattggcctttggttgtgaaaatatgggtctgcccctaaaggagatttgcgcccgggtggagaggattgcccttgaattaggattagagcctttgctggatcgcaatatctttgccttatcaggaggagaaaagcagaaaattgcctgtggcgctgtggcggcgctggggcctcaggtttatgtcttagatgagccctcttccaatctggatgctttggctatcgaagaattacgagctcttttgaccaagctgaaggctcagggcaaaaccgtgatcattgctgaacatcggttgtactatctccgtgaattggtggatcgggtgatctatatgaagaaaggacggattcagcaggaatattcaggtcaggaattccgcgctttgccaaggggggaactggatgccatggggctgcgttctttatccttggagggtttactggagggcgccccggtacatttaccaaggactgagggggccattgccttgtccggcttttccttcgcctatccccggggaggccggagcctggacatcagggaaacatcgttcccccaaggggcggtggttgcagttaccggccacaacggagcgggaaaatccactctggcacggtgtctatgcggtctggaaaagaagtgccgcggcaggatggggatgcagggggagagtctgggaaggaaggaacgattaaagcgttcttatatggtcatgcaggatgtaaaccatcaattatttacagagagcgtgctggatgaggtgctgatttccatggggcatccggatgtgaagcagggggaggaaatccttaaaggcctcgatctgttgcagttcaaagagcgccatcccatgtccctatccggaggccaaaaacagagagttgccattgcttcggcgatagcctcccggcgggaattgatactttttgatgaacccaccagtggactggatctgctgcatatgcagggagtagcccggagtctgtctcaattagccgggatagggaaaagcgtcttggttgttactcatgatccggaatttatcctgtcctgctgcacccatatcctgcatatgcaagaagggaaaatcattgataacagacctttggatgcttgtggcaggggaaggatgctctcctattttcttgaggcggtaaaggagcctggagaaagaagggaaagggtggtgtga

SEQ ID NO: 27551 - protein, 500 aa, Desulfitobacterium hafniense DCB-2
MIELKQVSFAYGNGERDSGLEDIELKVEEGEFLLLCGGSGCGKTTLTRLLNGLIPNFYGGVLKGQVWVGGLDVAKAPLYETAGKVGSVFQNPRSQFFNMDTTGELAFGCENMGLPLKEICARVERIALELGLEPLLDRNIFALSGGEKQKIACGAVAALGPQVYVLDEPSSNLDALAIEELRALLTKLKAQGKTVIIAEHRLYYLRELVDRVIYMKKGRIQQEYSGQEFRALPRGELDAMGLRSLSLEGLLEGAPVHLPRTEGAIALSGFSFAYPRGGRSLDIRETSFPQGAVVAVTGHNGAGKSTLARCLCGLEKKCRGRMGMQGESLGRKERLKRSYMVMQDVNHQLFTESVLDEVLISMGHPDVKQGEEILKGLDLLQFKERHPMSLSGGQKQRVAIASAIASRRELILFDEPTSGLDLLHMQGVARSLSQLAGIGKSVLVVTHDPEFILSCCTHILHMQEGKIIDNRPLDACGRGRMLSYFLEAVKEPGERRERVV

SEQ ID NO: 27552 - DNA, 2766 bp, Methylobacillus flagellatus KT
  CDS (1)..(2766): transl_table=11
gtgagcgacacccggcagcaggtggcgtccgcagtccgcttgcaggacgtcagcctgcattacggcaagaccattgcactggacggtatcagcctcgatatccctgccagctgcatggtgggcatgataggcccggacggtgtcggcaagtccagccttctgtcgctggtggcaggtgcaagggcggtgcagacgggcaaggtggaggcgctgggcggcgatatgtccagcaagcagcaccgcgacgatgtctgcccgcgcatcgcctatatgccgcaaggcctgggcaagaacctctacccgacattgtcggtagaggaaaacctgcagttcttcggccgcctgttcggccatgatgcgcaggaacgcagacgacgcatcgacgatctcacgcgcagcaccggcctgcaaaaattcctagaccggccggcaggcaagctgtccggcggcatgaaacagaaactgggcctgtgctgcgcgctgatccacgaccccgacctgctgatcctcgacgagcccaccaccggcgtcgacccgctcgcgcgtgcccagttctgggatctgatcaagcgcatccgccaggaaagaaacagcatgagcgtcattgtcgccacggcctatatggatgaggcgcagcgcttcgactggctcgtggcaatggatgaaggccaggtactggcgacgggaacgccacaggaactgcttgaacgcacgggctccagctccctcgaaaccgcgttcatcgcgctgcttccggaagaaaaaaaacagggccacgaggaagtcacgattccgcccttgccagaaggcgacggcagcaacgcggatatcgccatcgaggccaaagaccttaccatgcgtttcggcgatttcgttgccgtcgaccacgtcagcttccgcattcgccgcggcgagattttcggctttctcggctccaatggctgcggcaaatccaccaccatgaaaatgctcaccggcctgctgcccgccagcgaagggcaagcctggctgttcgggcacgaaatcgaccccagggacatcgacacccgccgccgcgtcggctacatgtcgcaggcgttttcgctctacaccgagctgaccgtccggcagaatctggtgctgcatgcccgcctgttccacgtgccggaagcagacattcccgcccgtgtaaatgaaatggtgcagcgcttcgacctggaggaagcgctcgacagcctgccagatggcctgccgctcggcatccgccagcgcctgtcgctggccgtcgccatggtgcacaaacccgagctgctgattctcgacgaaccaacctccggcgtcgacccggtcgcccgcgacaatttctggcgcctgttgatcgagctgtcgcgccgtgaccgggtcaccatcttcatctccacccatttcatgaacgaggccgagcgctgcgaccgtatgtcgctgatgcatgcgggcaaggtgctggttagtgacacgcctgcgaacatcgtcgcgcagcgcaatgccgatacgctggagcaggctttcatcgactacctggtggaagccggcggcggcactgacaccggcaccaatgacacccaacaaaccactccctcaacgccggatattgcacaaggcagccatcaggccaagcttaggtttttcagcttcaatcgcatgttcagctacctttggcgcgaaatgctggagctacagcgcgacccggtacgcggcggcctcgccctggcaggctcgatgctgctcatgttcgtcatgggcttcggcatcagcatggatgtcgaggacctgacctatgccgtgctggaccgcgaccagaccacgctgagccagaattacgcgctcaatctctccggctcgcgctacttcatcgagcagccaccgatccgggattatcaggagctggaccagcgcatgcgcagcggcgaactgtcactcgccattgaaataccgccggggttcgcccgcgacgtgcaacgcggcagccgggccgaaatcggcgcctgggtgaacggcgccatgccgcagcgcgccgagacagtgcagggctatgtgcaaggtatccaccagcaatggctgcaacaacaggcgcaggagcggctgggcgtcacggtcgcaagcgcggccaccatagagacgcgctaccgctacaatccagatgtgcgcagcctgccggcaatggtgccggccgtgatccctctgctgctgctcatgctgcctgccatgctgtccgccctgtccgtggtgcgcgagaaggagctgggttccatcatcaacctgtacgtgacgccagtgacccgcaccgaattcctgctcggcaagcaattgccctatgtcgcacttgccatgctgaatttcctgctgatggtattgctcgccgtgacggtattcgacgtgccggtcaagggcagcttcgccacactggcgctggcagccttcctctatagcatcgtcgccactgggattggcctgctcgcctccaccttcacccgcagccagattgctgcgctgtttttcaccatgatcgcttccatcgtcccggcggtgcagttcgccggcatgctcaacccggtctcgtcgctggaaggcgcaggccgcatcgtcggcgagatctacccgacgacttatatgctgatcatcacccgcggtgtgttcagcaaggcgctggatttctccgacctgcaagcctcattctggccgttgttggccgccattcccgtggtcctggtgacaacagtgctcctactgaagaaacaggacaaatga

SEQ ID NO: 27553 - protein, 921 aa, Methylobacillus flagellatus KT
MSDTRQQVASAVRLQDVSLHYGKTIALDGISLDIPASCMVGMIGPDGVGKSSLLSLVAGARAVQTGKVEALGGDMSSKQHRDDVCPRIAYMPQGLGKNLYPTLSVEENLQFFGRLFGHDAQERRRRIDDLTRSTGLQKFLDRPAGKLSGGMKQKLGLCCALIHDPDLLILDEPTTGVDPLARAQFWDLIKRIRQERNSMSVIVATAYMDEAQRFDWLVAMDEGQVLATGTPQELLERTGSSSLETAFIALLPEEKKQGHEEVTIPPLPEGDGSNADIAIEAKDLTMRFGDFVAVDHVSFRIRRGEIFGFLGSNGCGKSTTMKMLTGLLPASEGQAWLFGHEIDPRDIDTRRRVGYMSQAFSLYTELTVRQNLVLHARLFHVPEADIPARVNEMVQRFDLEEALDSLPDGLPLGIRQRLSLAVAMVHKPELLILDEPTSGVDPVARDNFWRLLIELSRRDRVTIFISTHFMNEAERCDRMSLMHAGKVLVSDTPANIVAQRNADTLEQAFIDYLVEAGGGTDTGTNDTQQTTPSTPDIAQGSHQAKLRFFSFNRMFSYLWREMLELQRDPVRGGLALAGSMLLMFVMGFGISMDVEDLTYAVLDRDQTTLSQNYALNLSGSRYFIEQPPIRDYQELDQRMRSGELSLAIEIPPGFARDVQRGSRAEIGAWVNGAMPQRAETVQGYVQGIHQQWLQQQAQERLGVTVASAATIETRYRYNPDVRSLPAMVPAVIPLLLLMLPAMLSALSVVREKELGSIINLYVTPVTRTEFLLGKQLPYVALAMLNFLLMVLLAVTVFDVPVKGSFATLALAAFLYSIVATGIGLLASTFTRSQIAALFFTMIASIVPAVQFAGMLNPVSSLEGAGRIVGEIYPTTYMLIITRGVFSKALDFSDLQASFWPLLAAIPVVLVTTVLLLKKQDK

SEQ ID NO: 27554 - DNA, 1602 bp, Methylobacillus flagellatus KT
  CDS (1)..(1602): transl_table=11
atggccgcgcctttgcttgcgttggagaacgtctccatcgccttcggcaacaagctggccgtggacagcctcaacctggaggtacgtcccggcgagcgtcttgctctggtcggcgaatccgggtcgggcaagacggtcacggcgctgtccatcctgcgcttgctgagccagcccagaatatcgggcagcatccatttccaggggcaagacttgttgcagaagagcgaacacgagctgcgccagatcaggggccgtgacatcgccatgatcttccaggagccgatgactgcactcaacccgctgttcaccatcggcaaccagattgtcgagacgctgcagctgcatgagggcctgagcaagaagcaggcgcgagacaaggcgctgcaactgatcatcaggaccggcatacgccagccggagcgcagcatagacagctttccgcaccagctttccggcggtcagcgtcagcgtgcgatgattgcgatggcgctggcgtgccgtcccaagctgttgattgccgacgaaccgacgaccgccctcgatatgacgatacgcgcgcgcatcgtcaagacattgctggatttgcagcaggaggaaatccagcgcaatggcgacgccggcatggccatcctgctgattacccacgatctcaacctggtgcgcaaattcgcccagcgcgtggccgtgatggaacgtggcaaactggtcgaaaccggggatacggaatccattttcgccaacccgcagcatccttacacgatcaagctcatcaacagcatcccggtacgcaatatcgtgcctgtgcaggaagcggctcccatgttgctggaaacgcgggggctgcgtgtggaataccgcaaggccgccaacagttggcgtggcattttcagcaccagccgccatgttgcgctcaagggggctgatatccagttgcgtgaaggcgagaccattggagtggtgggggagtcgggctcgggcaagtctaccctggcccaggccatcctgaacctgattccggctgaatccggcgatatcgagtttgagggcgcgccggtggcgagattgagcaaataccggcagcgggccctgcgcgctcggctccaggtcgtgttccaggacccgttcggctcgctttcgccgcgccagaccataaggcagatcgtcggcgagggactggcgttgcatttccccgcgctcgatcctgaggagcagcacgaaaaaatcgtcaatgtgctgcgtgaggttggcctgcctgagaccgtactcaatgcctatccacatgagttctcaggggggcagcgccagcgcatcgcgatcgcgcgggcactgatcctcgcgcccagggtactggtgctcgacgagccgacctcggccctggatgtctctatccagaaccaggtgctcgagctgttggtaagcctgcaggagaaataccgcctgagttacctgctcatcacgcacgacctgactgtggtgaatgcgttggcgcatcgggtatatgtgctcaaggatggcgagatcgtggaatcgggcgatacggagcaggtgatcgagcgtccccgccatccttatacgcaaagcctggtccaggcttcgctgtaa

SEQ ID NO: 27555 - protein, 533 aa, Methylobacillus flagellatus KT
MAAPLLALENVSIAFGNKLAVDSLNLEVRPGERLALVGESGSGKTVTALSILRLLSQPRISGSIHFQGQDLLQKSEHELRQIRGRDIAMIFQEPMTALNPLFTIGNQIVETLQLHEGLSKKQARDKALQLIIRTGIRQPERSIDSFPHQLSGGQRQRAMIAMALACRPKLLIADEPTTALDMTIRARIVKTLLDLQQEEIQRNGDAGMAILLITHDLNLVRKFAQRVAVMERGKLVETGDTESIFANPQHPYTIKLINSIPVRNIVPVQEAAPMLLETRGLRVEYRKAANSWRGIFSTSRHVALKGADIQLREGETIGVVGESGSGKSTLAQAILNLIPAESGDIEFEGAPVARLSKYRQRALRARLQVVFQDPFGSLSPRQTIRQIVGEGLALHFPALDPEEQHEKIVNVLREVGLPETVLNAYPHEFSGGQRQRIAIARALILAPRVLVLDEPTSALDVSIQNQVLELLVSLQEKYRLSYLLITHDLTVVNALAHRVYVLKDGEIVESGDTEQVIERPRHPYTQSLVQASL

SEQ ID NO: 27556 - DNA, 1518 bp, Frankia sp. EAN1pec
  CDS (1)..(1518): transl_table=11
atgaggacgagcacgccgggggcgacccgcacgtctggcacgacccgcgcaacgcgaagatcatggtcacgaacgtcgagaaggggctcgcggcggccgatccggagagctccgccacgtaccgcgccaacctcgccggctacacgaccaagttggacgagctcgaccgggagaaccagcagaagatcgacaccatcccggcggaccggcgcaagctggtcaccaaccacgactcgttcggctactacgtggaccggtacggcctggagttcgtcgggtcgatcatcccgagcttcgacacgtccgccgagctctccggccgggcgatcgacgacatcgtcagccggatcagggcgtcccgcgtcgtggcggtgttctccgagtcatccctgccgccgcggacggcgcagaccatcggccgcgaggcgggcgtccgcgtcgtcgccggcgagggtgccctctacgccgacacgctgggcccggcggggtctgatggtgccacctacctcgaagccgaacggcacaacacggataccatcgtcaacgccctccggtgagacaggacccacagccaggatctacaggatggaccggtggtcgatcatgaccggtaacgctcaggcaccgtgcctgaccgcgccggacgggccggacggagccccgtcaccgtcgccggtggcgataccgacgaccgcggcgccggtggcggcagtggcgacagcactggcggccgacgcgatcgcgctccccgaccaggtcggcgccgctcccgccgcactgtcgctggagcacgcgagcatcgcctacggcagggtgccggtgctacacggcgtgcacggcgtcctccacccgggccggacgctggccctcatcgggcccaacggcgcgggcaagtcaacgctgatcaaggccgtgctcggcctggtgcccgtggtcgacgggctgatcacggtgctgggacgtcccccgggcgccgcccgccgggaggtcgcctacgtgccacaggcggacacgctcgacccggacttcccgatctcggtcggccaggtcgtgctgatgggccgctaccgcgggatcggctggatccgccgtccgggccgcgccgaccgggcggcggcgcaggccgcgctggaggccgtcgggctggcccaccgggcccgggatcgcttcggcacgctctccggagggcagcgccagcgggtgctgctggcccgcgccatcgccgcccagccccgcctgctgctgctcgacgagccgttcaacggcgtggacgtcgtctcgcaggacgccctgctcgccacgctcagtacgctgaccgccgccggcacggccgtcgtcgtctccacccacgacctggccctggcgcagctcatcagcgacgaggtgtgcctgctgagtggccgtcagatcacgttcgggccgcccgccgaggcgctcaccgcggagcccctgcgggccgcctacggcggcgccgcgctggagatcgacggccggggcgtcgtcgtgacccgcgtgtga

SEQ ID NO: 27557 - protein, 505 aa, Frankia sp. EAN1pec
MRTSTPGATRTSGTTRATRRSWSRTSRRGSRRPIRRAPPRTAPTSPATRPSWTSSTGRTSRRSTPSRRTGASWSPTTTRSATTWTGTAWSSSGRSSRASTRPPSSPAGRSTTSSAGSGRPASWRCSPSHPCRRGRRRPSAARRASASSPARVPSTPTRWARRGLMVPPTSKPNGTTRIPSSTPSGETGPTARIYRMDRWSIMTGNAQAPCLTAPDGPDGAPSPSPVAIPTTAAPVAAVATALAADAIALPDQVGAAPAALSLEHASIAYGRVPVLHGVHGVLHPGRTLALIGPNGAGKSTLIKAVLGLVPVVDGLITVLGRPPGAARREVAYVPQADTLDPDFPISVGQVVLMGRYRGIGWIRRPGRADRAAAQAALEAVGLAHRARDRFGTLSGGQRQRVLLARAIAAQPRLLLLDEPFNGVDVVSQDALLATLSTLTAAGTAVVVSTHDLALAQLISDEVCLLSGRQITFGPPAEALTAEPLRAAYGGAALEIDGRGVVVTRV

SEQ ID NO: 27558 - DNA, 1497 bp, Shewanella baltica OS155
  CDS (1)..(1497): transl_table=11
atgcttgatgttgtcgcgaaccaagacaaaagtattgtggttaaacagttgcgatatgggcgtgataatgaggtgctagtcgtcgatgagtggcaactgcatcccgctgaacattgggcgattttcgcgaccgacagctattgtggttccttgctcgggcgaatattaaccggtgatattcagcccgatgaagggacgattgctggcctgccgcaacgtatcggctgggtgtcacttgggttgcaacaagtattgctggagcgagagttagaaaaagacgaattggattacggttcgagtgtcgaattcttagtgttggaatgctgccaagatgccgcacaactcgcgccactattacaaaaggttgggcttgagccgctgcgcctgcgtggtttccggcagttatctacgggcgaaacacgccgagtcatgctggcgcgtgcgctggcaatgttaccgcaattgctgatcttagatgacccttatgctggcctcgatgttgaacatcaggcgagtttatctgagctgctgagtgaagtggctgagcatactcagttgctgatcattacctctcgccaagaggaattgccgccgtgcatcagccatgtggcgctgtttaatggcgagatgctcaaatcggggcagagtgtgcacaaactcagccagcctatgtcgattgagcaatggcacaatcatcctgtgatggcgcagctgaatgcgttatcggcgcagcgtagcaatgaactcttggccttgatggagcggcaaaggcacaacgccgaggcctttgatcctttggtcgagattaaaaatggcaaagtggaatatgtcagtgggctgatttttagcggcgtgaattggcgcatcgaagcggggcaacattggcaagttcgcggcccaaatggctgcggtaaaagcactttgctggggctgattttaggcgaccatccccaatgctatagcaacgacattacgctctttggccgacctcgcggaagcggcgagagtatttggcagattaaacaacggattggcatagtatcgtcggcgctgcacttgcagtatcgcgtcagttgctcggtattagatgtgctgctttcaggcttttttgactctattggtctgtaccagaaacccactaaacctcagctagatttggcgaaggaatggttggcgattctgcacatgacagggttggcgagcacgagttttaagaagctcgattatggtcagcagcggttattgctgataggccgcgccttgattaaacagcccttattactgattttagatgagccgtatcagggcttagattttatcaatcgcaccttagtgatgcgggcgttgaagatgatagccgagcatcatctgagccaattgctgtacgtgtcgcaccatagggaggatgcgctgcccgctatccatcatttcgtggattttattaagcagggcgacggttattcggtgcaggtgagtgatagcgagtccaaggattga

SEQ ID NO: 27559 - protein, 498 aa, Shewanella baltica OS155
MLDVVANQDKSIVVKQLRYGRDNEVLVVDEWQLHPAEHWAIFATDSYCGSLLGRILTGDIQPDEGTIAGLPQRIGWVSLGLQQVLLERELEKDELDYGSSVEFLVLECCQDAAQLAPLLQKVGLEPLRLRGFRQLSTGETRRVMLARALAMLPQLLILDDPYAGLDVEHQASLSELLSEVAEHTQLLIITSRQEELPPCISHVALFNGEMLKSGQSVHKLSQPMSIEQWHNHPVMAQLNALSAQRSNELLALMERQRHNAEAFDPLVEIKNGKVEYVSGLIFSGVNWRIEAGQHWQVRGPNGCGKSTLLGLILGDHPQCYSNDITLFGRPRGSGESIWQIKQRIGIVSSALHLQYRVSCSVLDVLLSGFFDSIGLYQKPTKPQLDLAKEWLAILHMTGLASTSFKKLDYGQQRLLLIGRALIKQPLLLILDEPYQGLDFINRTLVMRALKMIAEHHLSQLLYVSHHREDALPAIHHFVDFIKQGDGYSVQVSDSESKD

SEQ ID NO: 27560 - DNA, 1596 bp, Shewanella amazonensis SB2B
  CDS (1)..(1596): transl_table=11
gtgatcacaaccgccaatatcaccatgcagttcggcgccaagccactgtttgaaaacatctccgtcaagttcggtgacggcaaccgctacggccttatcggtgccaatggttgcggtaaatccacctttatgaagatcctcgccggtgaacttgagccgtccggcggtaacgttcatctggatcccaacgagcgtctgggtaagctgaatcaggatcagttcgcctacgaagagttcagcgtaatcgataccgttatcatgggccacaaagaactgtgggctgttaagcaggaacgtgaccgtatctattctttgcctgaaatgagtgaagaagacggcatcaaggtagccgagcttgaaatggaatttgccgaaatggacggttacaccgccgagagccgtgccggtgaactgctgctgggtgtgggtattcctctggagcaacattttggtcctatgagcgaagtggccccaggctggaaactgcgtgtgctgctggcacaggcactgttctcagacccggacgtgcttctgcttgacgaaccaaccaacaacctggacatcgataccatccgttggttgcaggacatgctgaatcagcgtaacagcaccatgattatcatttcacacgaccgttacttcctgaactctgtgtgtacccacatggcggatctggactacggcgagctgcgtgtgtatccgggcaactacgatgaatacatgatggcagccagccaggcccgtgagcgtttgctggccgacaacgccaagaagaaggcacagattgcagagctgcaaaccttcgtggcgcgtttctctgccaacgcctccaaggccaagcaggccacctcccgtgcccgccagattgacaagatcaagctggacgaagtgaaggcttccagccgtgtgaacccctacatccgtttcgagcaggaaaagaaactgttccgtaacgcgctggtggtagagaacctgagcaagggcttcgatagcaagccgctgttccaaaacttcaacatgattgccgaagtgggtgagcgtatcgccatcctcggtgagaacggtgccggtaaaaccaccctggtgcgtaccctcatccatgaattgccacaggacgaaggcactattcactggtctgagaatgccgctatcggttactacgcccaggatcacgccagtgattttgaaaacgatttgaccgtattcgactggatgagccagtggaagaaagaaggcgacgatgaacaggccgtacgcggtattctgggtcgtatgctgtttggcgccgacgacatcagaaagtcggtcaaggtactgtcgggtggtgagcagggccgcatgctgtttggcaagatgatcatgcaaaagcccaatatcctggtgatggacgaacccactaaccacctggatatggaatctatcgagtcgctcaacaacgcgctggaaatgtacgaaggtacgctgtttttcgtgtcccacgaccgcgcctttgtcagctcgctggccaaccgcattatcgaaatcaccgccaatggcgtgaatgacttcaaaggaacttacgacgagttcctgcgcagtaaaggcatcgaaggctaa

SEQ ID NO: 27561 - protein, 531 aa, Shewanella amazonensis SB2B
MITTANITMQFGAKPLFENISVKFGDGNRYGLIGANGCGKSTFMKILAGELEPSGGNVHLDPNERLGKLNQDQFAYEEFSVIDTVIMGHKELWAVKQERDRIYSLPEMSEEDGIKVAELEMEFAEMDGYTAESRAGELLLGVGIPLEQHFGPMSEVAPGWKLRVLLAQALFSDPDVLLLDEPTNNLDIDTIRWLQDMLNQRNSTMIIISHDRYFLNSVCTHMADLDYGELRVYPGNYDEYMMAASQARERLLADNAKKKAQIAELQTFVARFSANASKAKQATSRARQIDKIKLDEVKASSRVNPYIRFEQEKKLFRNALVVENLSKGFDSKPLFQNFNMIAEVGERIAILGENGAGKTTLVRTLIHELPQDEGTIHWSENAAIGYYAQDHASDFENDLTVFDWMSQWKKEGDDEQAVRGILGRMLFGADDIRKSVKVLSGGEQGRMLFGKMIMQKPNILVMDEPTNHLDMESIESLNNALEMYEGTLFFVSHDRAFVSSLANRIIEITANGVNDFKGTYDEFLRSKGIEG

SEQ ID NO: 27562 - DNA, 2760 bp, Ralstonia metallidurans CH34
  CDS (1)..(2760): transl_table=11
atgaacgtctcgacgggtacgcacgaacacgttgccggcgtcgcgcatgtcacgctgcgctatggcaagacggttgctctcgacgacatctcgctggagtttcccgcgggctgcatgatcggcgtgatcggtcccgatggtgttggcaagtcgagcctgctgtcgctggtggccggcgcacgggccgtgcaggaaggcacggtcaccgcgctcggcggcgacatgtcgcgcaaggaccatcgcgacgccgtctgcccgcgcatcgcctatatgccgcaggggctgggcaagaacctctacccgactttgtcggtcgaggaaaacctgcagttctttgccagactgttcggccacggtgcggccgaacggcgtcatcgcatcgacgacctcacgcgcagcaccggtctgcaaccgttcctggatcgcccggccggcaaactctccggcggcatgaagcagaagcttggcctttgctgcgcgctgatccacgaccccgacctgctgattctggacgagccaaccaccggcgtggatcccctggcacgcgcccagttctgggacctgatcgcccgcatccgccaggatcgtccgggcatgagcgtgatcgtcgccaccgcctatatggatgaagcccagcgcttcgactggctggtggcgatggacagcggcaagatcctcgataccgggacgccggcagaactgctggcccgcaccagcgccgccgatctcgaaggcgcgttcatcgggctgctgcccgaggagaagaagcgtggctacgagcccgtggtgatcgcgccgttggccgtggacgaaaacaccccgatcgccatcgaggcgaaagacctgaccatgcgcttcggcgatttcgtcgcggtggaccacgtgcagttcaagattcggcggggcgagatcttcggatttctcggatccaatggctgcggcaagtccacgacgatgaagatgctgaccggtctgctgcccgccagcgacggacgcgcgtggctgttcggtcaggaagtggatccgcgcgatatcgacacccgccgccgcgtgggctacatgtcacaggcgttctcgctttacaccgaactgacggtgcgccagaacctggtgcttcacgcccagctctttcacgtgcctagggaggacatcgaagtccgtgtggaggaaatggcccagcgcttcgggctgcaggacgtgatggagagcctgcctgacggattgccgcttggtatgcgccagaggctttcgctggccgtggcaatggtgcacaagcccgaactgctgatcctcgacgagccgacctccggcgtcgatcccgtggcgcgtgacaatttctggcggctgttggttgcgctgtcccgcgaggaccatgtcacgatcttcatctccacgcacttcatgaacgaggcggcccgctgcgaccgcatctcgctgatgcacgcgggcaaggtgctggtcagcgatccgcccgagaagatcgtcagcgattgcggcgcggatacgctggaagccgcgtttatcgactacctcgtggcagccggcggcggcacgcaggcagcctcggaaggcgcggaggccccggcgtccccggtagaggccggagccgaagccgaggcaaaaagcaagcatcagtctttctcgctcggccggatgtacagctacctgtggcgcgagtcgctggagcttcaacgcgatccggtgcgcctgaccctggccttgctgggctccgtgatcctgatgcttgtgatgggcttcggcatcagcatggacgttgaggatttgacctatgcggtcctcgaccgcgaccagaccacattgagcgagaactacgcgctcaatattgccggctcgcgctacttcgtccagaagccgccacttgagagctatgccgacatggacgcgcgcctgcgcagcggcaagctggccctggctatcgaaattccgccaggcttcgcacgcgatgtggcgcgtggcaagcaagtccagatcggcgcgtggatcgacggcgcaatgccgatgcgggccgaaaccgttcagggctatgtccagggtatgcaccagatctggctggcggatcaggcgctacggcgttacggtgtgcgagccacatcgaatgtatcgatcgagacccgcttccgctacaacccagacgtcaagagcttgccggcgatggtgccggccgtgattccgctgctactgatgatgatgccggcgatgctgaccgccctgtcggtcgtgcgcgaaaaggaactcggctccatcctgaatctgtacgtcactcccgtcacgcgtaccgagttcttgctgggcaagcagatgccgtatgtcgcccttgggatgctgaacttcttcctgatgtcgttcctggcggtcaccctgtttggggtaccggtgaaaggcaactttctggcgctggtgctggcggcgctgatcttcaacgtcgtgtccacgggcgttggcctgttcgcatcgacgttcacccgcagccagatcgccgccctcttcttcacgatgatcggcacgatgatcccgaccatacagttctcggggcttctgacgccggtatcctcgatggagggcgcgggcaaggtgatcggcggcatttatcccgccacgcacatgctcatcatcagccgtggcgtcttcaacaaggcgcttggtttctccgaccttcacgcttcgtactggccgatgctgatcgccatccccgtcattctcgggttgacggtggcgctgctggccaagcaggacaaatga

SEQ ID NO: 27563 - protein, 919 aa, Ralstonia metallidurans CH34
MNVSTGTHEHVAGVAHVTLRYGKTVALDDISLEFPAGCMIGVIGPDGVGKSSLLSLVAGARAVQEGTVTALGGDMSRKDHRDAVCPRIAYMPQGLGKNLYPTLSVEENLQFFARLFGHGAAERRHRIDDLTRSTGLQPFLDRPAGKLSGGMKQKLGLCCALIHDPDLLILDEPTTGVDPLARAQFWDLIARIRQDRPGMSVIVATAYMDEAQRFDWLVAMDSGKILDTGTPAELLARTSAADLEGAFIGLLPEEKKRGYEPVVIAPLAVDENTPIAIEAKDLTMRFGDFVAVDHVQFKIRRGEIFGFLGSNGCGKSTTMKMLTGLLPASDGRAWLFGQEVDPRDIDTRRRVGYMSQAFSLYTELTVRQNLVLHAQLFHVPREDIEVRVEEMAQRFGLQDVMESLPDGLPLGMRQRLSLAVAMVHKPELLILDEPTSGVDPVARDNFWRLLVALSREDHVTIFISTHFMNEAARCDRISLMHAGKVLVSDPPEKIVSDCGADTLEAAFIDYLVAAGGGTQAASEGAEAPASPVEAGAEAEAKSKHQSFSLGRMYSYLWRESLELQRDPVRLTLALLGSVILMLVMGFGISMDVEDLTYAVLDRDQTTLSENYALNIAGSRYFVQKPPLESYADMDARLRSGKLALAIEIPPGFARDVARGKQVQIGAWIDGAMPMRAETVQGYVQGMHQIWLADQALRRYGVRATSNVSIETRFRYNPDVKSLPAMVPAVIPLLLMMMPAMLTALSVVREKELGSILNLYVTPVTRTEFLLGKQMPYVALGMLNFFLMSFLAVTLFGVPVKGNFLALVLAALIFNVVSTGVGLFASTFTRSQIAALFFTMIGTMIPTIQFSGLLTPVSSMEGAGKVIGGIYPATHMLIISRGVFNKALGFSDLHASYWPMLIAIPVILGLTVALLAKQDK

SEQ ID NO: 27564 - DNA, 1635 bp, Mesorhizobium sp. BNC1
  CDS (1)..(1635): transl_table=11
atgagcctgctccagatcgaaaagctgacgctctcgatcggcggatcgcagatcctcaggagcatcgacatttcgatagagccgggcgaaatcatgggcctggtgggcgaatcaggctccggcaagtccatgacggcgctcagcatcatgaagcttctgccgcctggcgcacgggcgggcggccgcgtgcagttcgacggcatcgacatcctctccgcgcctgaagccgccatgtgccggctgcgcggggacgacatcggcatgatttttcaggaaccgatgacggcgctcaacccggtgaagaccatcggccagcaggtggccgaaggaatccgctggcacacgggcgcgaacagggcagacgcagagagccgcgcccgcgccatgctcgaacgcgtgggactgcccgaaaaggaattccccctcacccgctatccgcacgagctttcgggcggacagcgccagcgcgtcgtgatcgccatcgcctgcgcgctcaagccgaagcttctgatcgcggatgagccgaccacggcgctcgacgtggtgctgcagaggcagattctgacgctcttacgcgagctggtgaacgaaagcggcatgagcctgcttctcatctcgcatgatctggcggtcgtggcggaaatgacggaccgcctgacgatcatccgcgatggcgccgtgatggaggcgggtgaaacggtccagatcctctcgcggaaaacacatccttatacgaggcaacttgcggaagcctccactcacgtcccggcgcgggtggcgatttccaaaccgggcgccgggccgtctgccgcacccctcctcgaagtggagggcctgacgcgcgactatcccgtacgccctgccggtctttttgcacgggcaagcaggttccgcgccgtggaccatgtctccttctcgattttccctggccagagcgtcgctctcgtcggccgctccggttgcgggaaatcgacactggcccgaatgattctggcgcttgatcggccaagttcaggctccatccgctttatgggccaggagatcggcggaagaagcgaggaagcgctgcggcccgcgcgccgcaacatgcaggtggtctttcaggacccctacggctctttcgacccgcgtcatcgcgtggaaaggctagtggccgagcctctgcatcttgccgacgagaaaccgggtgcggcgcgccggcgcgatctggtcgccgaggcgctggagcaagtcggcctttcgcccttggacatcgacaaatatccgcatgagttctcaggcggtcagcggcagcgcctcgccatcgcccgcgcgattatcaccaggccgaagctcatcgtcgccgacgagcccgtttccgcgcttgacgtttcgatcagggcgcagatcctcgatcttttcgcggacctcaacgaccggctgggggtcgcctatctcttcataacgcatgatctaagggttgcccgcgcgatcaccgacacggtgctggtgatgcacgagggaaaaatcgtcgagacggggccgacggaaatcgtcctggacaatcccaggagcgatgcggcccgcgcgcttttggccgccgctcccgacctcgggctgaccctgcgaaaacgtctcgcgcaggatacgggttga

SEQ ID NO: 27565 - protein, 544 aa, Mesorhizobium sp. BNC1
MSLLQIEKLTLSIGGSQILRSIDISIEPGEIMGLVGESGSGKSMTALSIMKLLPPGARAGGRVQFDGIDILSAPEAAMCRLRGDDIGMIFQEPMTALNPVKTIGQQVAEGIRWHTGANRADAESRARAMLERVGLPEKEFPLTRYPHELSGGQRQRVVIAIACALKPKLLIADEPTTALDVVLQRQILTLLRELVNESGMSLLLISHDLAVVAEMTDRLTIIRDGAVMEAGETVQILSRKTHPYTRQLAEASTHVPARVAISKPGAGPSAAPLLEVEGLTRDYPVRPAGLFARASRFRAVDHVSFSIFPGQSVALVGRSGCGKSTLARMILALDRPSSGSIRFMGQEIGGRSEEALRPARRNMQVVFQDPYGSFDPRHRVERLVAEPLHLADEKPGAARRRDLVAEALEQVGLSPLDIDKYPHEFSGGQRQRLAIARAIITRPKLIVADEPVSALDVSIRAQILDLFADLNDRLGVAYLFITHDLRVARAITDTVLVMHEGKIVETGPTEIVLDNPRSDAARALLAAAPDLGLTLRKRLAQDTG

SEQ ID NO: 27566 - DNA, 1629 bp, Mesorhizobium sp. BNC1
  CDS (1)..(1629): transl_table=11
gtgctcgagatagaaaagcttagcatcgttcttccttccggcgccgacagggctctcgcgattaaggacgtttcgttcagcgtgaagtccggttcaacgctttgtcttgtgggcgaatccgggtcggggaaatcggttatcggacaagccgttgcagggctcctaccgcaaacccttcactgtttgaaacagagttccatacgccttggcggccgaaacttgctgtcgctagacgaatgtgcgtggcgccgtattcgagggcgggaaatcggaatggtgtttcaggagccgatgactgccttgaatccgctgatgccagtcgggcagcagattgctgaagtttaccggtcacacggcttgcgcctcaggaaggcggaagtccgggaccgggttgaaggtttgctcgagcgtgtcgggataaaggacccggcccgcatctcgaaatcctacacgttccgcatgtcaggcggtcagaggcagcgtgctatgatagccatggccgtggcaatgaagcccaaggtgcttattgccgatgagccgaccacagcgctcgatgtgacgacgcaaagacaggttcttgacttgttggccgactttcaggctgaaacccgaatggcactcatattcatcacgcatgattttgggatcgtggcggatattgccgacgaagtcgctgtcatggaaagcggaaaccttgtcgagttcggctcgaaggaagatgttttggctcgcgcgcagcaccgctacactcgaaaattgctcgcagctgttccgcgccttcatgagcataaggcttcggttgccgagcgatcgacaccggtgctcgaagtgcgcggcttgagcaaaacgtatggagtggcaacgagcatcttcagaaggcaggacatgagggtcctgaacgatgtcaatttcaaggtttgcaaaggcgaggttgtcgcgcttgtaggggagtccggatccggcaaatcaacaattgcaaaatgcctgacgcgtctcacgtcgatagacaccggttcgatccgtcttgacggggcagatatgctgagcctcaaaggagaggccctaatgaaactgcgccgcaaggtgcagatcgtattccaagatccgtacggatctctgaatcctcgccagaagatcgtggatgcggtatcggccggaccaattgcgcagggggttgcgtcacgcgaagcccgtgaactcgcggagcacctgctcacgattgtcggtctgggacgaaatgcactcgaccgttatcctcatgagttctccggcgggcaacgtcagcgcattggtatcgccagggctctcgccgcgaagccggaggttcttattgcggacgaagctgtctctgctctcgatgttacggttcaagcgcagattttgcgacttcttgcggacctaagggatcgacttggactcaccatgctttttatcacgcacgacctgcgcgtcgccggtcaagtgagcgatcgcataatcgtcttgaaggctgggaatgtagttgaagagggtcccactcaagcaatattcaccaagccatcaaatcagtacacttactctcttctgcaggcaattcccggaatctcatcaaacgagtccgcgttggttcggaataagtgcgtgtgctaa

SEQ ID NO: 27567 - protein, 542 aa, Mesorhizobium sp. BNC1
MLEIEKLSIVLPSGADRALAIKDVSFSVKSGSTLCLVGESGSGKSVIGQAVAGLLPQTLHCLKQSSIRLGGRNLLSLDECAWRRIRGREIGMVFQEPMTALNPLMPVGQQIAEVYRSHGLRLRKAEVRDRVEGLLERVGIKDPARISKSYTFRMSGGQRQRAMIAMAVAMKPKVLIADEPTTALDVTTQRQVLDLLADFQAETRMALIFITHDFGIVADIADEVAVMESGNLVEFGSKEDVLARAQHRYTRKLLAAVPRLHEHKASVAERSTPVLEVRGLSKTYGVATSIFRRQDMRVLNDVNFKVCKGEVVALVGESGSGKSTIAKCLTRLTSIDTGSIRLDGADMLSLKGEALMKLRRKVQIVFQDPYGSLNPRQKIVDAVSAGPIAQGVASREARELAEHLLTIVGLGRNALDRYPHEFSGGQRQRIGIARALAAKPEVLIADEAVSALDVTVQAQILRLLADLRDRLGLTMLFITHDLRVAGQVSDRIIVLKAGNVVEEGPTQAIFTKPSNQYTYSLLQAIPGISSNESALVRNKCVC

SEQ ID NO: 27568 - DNA, 1656 bp, Kineococcus radiotolerans SRS30216
  CDS (1)..(1656): transl_table=11
gtgagcacccccctgctgcaggtcgaggacctgcggatctcctacgccgggcgggacgggcggcgcgaggtcgtccacggcgcgtccttcgacgtgcacccgggcgaggtcgtcgcggtcgtcggcgagtccggctccggcaagagcaccacggcgcacgccgtcgtgggtctgctgcccggcaacggttccgtcgactccggctccgtcctgctggagggcgacgaactggtcgggctgggggagggtgcgtggcgccgggtccgcggggcccgcatcgggctcgtcccgcaggaccccacgctgtcgctgaacccggtcgagcgcatcggcgaccaggtcgccgaggcgctgcacgtccacggcctggcccggggagcggccgcccgggcgcgggccgtcgacctgctcaccgccgccggcctgcccgacgccgccctgcgcgcgcggcagtacccgacggaactctccggcggcatgcgccagcgcgtcctcatcgccatcggcctcgccgccggcccccggctgctcgtcgccgacgaaccgaccagcgccctcgacgtcaccgtccagcggcaggtcctcgaccacctggaggcgctgacccgcgacgccgggacggccgtgctgctcatcacccacgacctcgccgtcgccgcggaccgggcgtcgcgggtcgtggtgatgtccgggggcgaggtcgtcgaggtcggcaccgcgcaccaggtcctcacccggccccgacacccgtacacggcgtccctgctggccagcgcgcccagcctctccagcgcccggatcaccgcccgcccgcgcccccgcaccgcacccccggaacccccggaacccccggcgccccgcgcgtccggaccgctggtccaggtgcgcgacctggtgaaggagttcccgctgcccgggcgcggccgcacccagaccgccgtcgccggggtgagcttcgacgtcgcccgcggcgagaccctcgccctcgtgggggagtccgggtcgggcaagaccaccaccgcccgcctcgtcctggggctggagcggccgacctcgggggaggtgcggttcgacggggaaccgacggccggtctgaggggggcggcctggcgcgaactgcgccggcgggtgcagctggtctaccagaacccctacgcctcgctggacccgcgcgtcgcggtgggggagacggtcgcggaacccctgcgcgccttcgggatcggggaccgggcgtcgcgtcggcggcgcgcggcgtccctgctggaccaggtccggctgccggccggccttctcgaacgccggcccgcggaactgtccggcgggcagcggcagcgggtcgcgatcgcccgcgcgctggccctggaaccggagctcgtggtgtgcgacgaacccgtctccgccctcgacgtctcggtccaggcgcagatcctggaactgctggtgcagctgcaggccgaccacggcctgagctacctgttcatctcccacgacctggccgtggtccgccaggtcagcgaccgggtgggtgtcgtgcgccggggggaactcgtcgagctcggacccaccgacgaggtgttctcccgcccccggcacgagtacaccgtcgaactgctggaggccatccccggccggcgggcgctggaggacgtgtcgtga

SEQ ID NO: 27569 - protein, 551 aa, Kineococcus radiotolerans SRS30216
MSTPLLQVEDLRISYAGRDGRREVVHGASFDVHPGEVVAVVGESGSGKSTTAHAVVGLLPGNGSVDSGSVLLEGDELVGLGEGAWRRVRGARIGLVPQDPTLSLNPVERIGDQVAEALHVHGLARGAAARARAVDLLTAAGLPDAALRARQYPTELSGGMRQRVLIAIGLAAGPRLLVADEPTSALDVTVQRQVLDHLEALTRDAGTAVLLITHDLAVAADRASRVVVMSGGEVVEVGTAHQVLTRPRHPYTASLLASAPSLSSARITARPRPRTAPPEPPEPPAPRASGPLVQVRDLVKEFPLPGRGRTQTAVAGVSFDVARGETLALVGESGSGKTTTARLVLGLERPTSGEVRFDGEPTAGLRGAAWRELRRRVQLVYQNPYASLDPRVAVGETVAEPLRAFGIGDRASRRRRAASLLDQVRLPAGLLERRPAELSGGQRQRVAIARALALEPELVVCDEPVSALDVSVQAQILELLVQLQADHGLSYLFISHDLAVVRQVSDRVGVVRRGELVELGPTDEVFSRPRHEYTVELLEAIPGRRALEDVS

SEQ ID NO: 27570 - DNA, 1593 bp, Silicibacter sp. TM1040
  CDS (1)..(1593): transl_table=11
atgacacaagcgccaattctgcaggtcaaggaccttcgggtcgcctttcgtcaggacggtcagcgggttgaggccgtcaaaggggtgtcctttgccctgtctcgtggcgagacggtggctttggtgggcgagtcgggctccggcaaatcggtctcggcgctttcgacggtgcagctccttggtgatagcgccgaggtctccggctcggtgaactatgacggacaggaaatgatcggcgccgatgaacgtaccctgcgacgggtgcgcggcaatgacatctccttcattttccaggagccgatgacctctctgaacccgctgcatacgatcgaaaaacagttgggcgaggcgcttgcgctacatcagggagtgatgggagaggacgcccgcgcgcgtgtgctggacctgttgaataaggttggtatccgggacgcggaaacccgactgggggcttatccgcaccagctttctggcggtcaacgtcagcgtgtaatgatcgcaatggcgctcgccaacaaacccgacgttctgatcgcggacgagcccacaacggcgctcgatgtgaccattcaggcgcagatcctcgatctccttgcggatctgaaacagagcgaggggatggggcttttgttcatcacccatgacctctcgattgtgcgccgtattgcggatcgggtctgcgtgatgaaatccggtgaaattgtcgaggaaggtccaacggctgagctgtttgcaaacccacagcacccctacacccagaaactcctggcggcagaaccctccggtcgacccgcgccgatcccggaaggggcaaccgaattcgtcagtgccaaggatctcaaggtctggtttcccatccagcgggggctactgaagcgcatggttggccatgtcaaggcggtcaatcccatgtcgctctcggtgcgcgccggggaaactttgggaattgtaggcgaatccggctcgggcaaaaccacgatggcacttgcgatcatgcgccttatcgcctccgaaggcgaggtgcgctttcaggatcaggacctgcgccaatggtccacgcgggacctgcgccggttgcgcaaggacatgcagatcgtgtttcaggatccgtttggctcgctgtctccgcgtatgacatgccagcagatcattgccgaaggtctggcaattcatgaggttgaccaacatcgtaagccgcgtgatcttgtggctgatgtaatgcaggaagtgggtctcgaccctgccaccatggaccgctatccacatgaattctcaggtgggcagcgtcagcgcattgccatcgcccgtgcaatggttctgcgccccaagctggtggttctggacgagccgacctcggcccttgatatgacggtccaggtgcagatcgtgaacctgctgcgcgatcttcaggcccgctacgggcttgcctatctcttcatcagccatgacctcaatgtggtgcgcgccatgtcgcatgacatcctggtgatgaaagccggagacgtgatcgagcaaggccccgccgaggaggtatttgccaatcccaaagaagaatacacacggcatctgctctctgccgtgacgggtgcctag

SEQ ID NO: 27571 - protein, 530 aa, Silicibacter sp. TM1040
MTQAPILQVKDLRVAFRQDGQRVEAVKGVSFALSRGETVALVGESGSGKSVSALSTVQLLGDSAEVSGSVNYDGQEMIGADERTLRRVRGNDISFIFQEPMTSLNPLHTIEKQLGEALALHQGVMGEDARARVLDLLNKVGIRDAETRLGAYPHQLSGGQRQRVMIAMALANKPDVLIADEPTTALDVTIQAQILDLLADLKQSEGMGLLFITHDLSIVRRIADRVCVMKSGEIVEEGPTAELFANPQHPYTQKLLAAEPSGRPAPIPEGATEFVSAKDLKVWFPIQRGLLKRMVGHVKAVNPMSLSVRAGETLGIVGESGSGKTTMALAIMRLIASEGEVRFQDQDLRQWSTRDLRRLRKDMQIVFQDPFGSLSPRMTCQQIIAEGLAIHEVDQHRKPRDLVADVMQEVGLDPATMDRYPHEFSGGQRQRIAIARAMVLRPKLVVLDEPTSALDMTVQVQIVNLLRDLQARYGLAYLFISHDLNVVRAMSHDILVMKAGDVIEQGPAEEVFANPKEEYTRHLLSAVTGA

SEQ ID NO: 27572 - DNA, 1614 bp, Paracoccus denitrificans PD1222
  CDS (1)..(1614): transl_table=11
atgacgccggttctggaagtcagcgacctgcgggtggggttccggcaggacgggcagcttgcgcccgccgtcaagggcgtcagctttaccgtcggcaagggcgagacggtggcgctggtcggcgaatccggctcgggcaaatcggtcacggcgctttcgacggtgcggctgctgggcgaggcggcagaggtctcgggctcggtccgctatgacgggcgcgaattgctgggcgcggccgagccggaactgcgtcgggtgcgcggcaacgacatcagcttcatctttcaagagccgatgacctcgctgaaccccctgcacacgctggagcggcagcttgccgaaagcctggcgctgcatcaggggctgcgcggcgcggcggcgcgggcgcgcatcatcgagctgctgacccgcgtcggcatccgcgacccggaaacgcggcttgccgattacccgcaccagctgtccggcggccagcgccagcgggtgatgatcgccatggcgctggcgaacgggccggaactgctggtcgcggatgagccgacgacggcgctggacgtgaccatccaggcgcagatcatggaactcttggcagagctcaaggctgccgaggggctgtcgatgctgttcatcagccacgacctgggcctggtgcggcgcatcgccgaccgggtctgcgtgatgaagggcggcgagatcgtcgagcagggcccggtcgagcagatctttgcccatccgcagcacgaatatacccgcatgttgctggccgccgagccacagggccgcgccgaccccattcccgccgacgcgccgcaggtcgtggcgacgcaggatctgcgggtctggttcccgatccagcgcggcttcctgcgccgcaccgtcggccatgtgaaggcggtgaacggcgccacgatctcggtccgcgccggcgagaccctgggcatcgtcggtgaatccggctcgggcaagaccacgctggcgctggcgatcatgcggctgatcgagagcgaggggccgatcctctacatgggccgcgacatctcgaaactgccgggtcgggcgctgcgcggcttgcgccgcgacatgcagatcgtattccaggatccctttggcagcctgtcgccgcgcatgacggtcgagcagatcatctccgagggcctgggcgtgcatggcatcgagccgggccgcgaccgccgcgggatggtggacgaaatcatgcgcgaggtcgggctggaccccgccaccatgcaccgctatccgcatgaattcagcggcggccagcgccagcgcatcgccatcgcccgcgccatgatcctgaaccccaggctggtggtgctggacgagccgaccagcgcattggacatgaccgtgcaggtgcagatcgtcgagcttttgcggcggctgcaacgcaagcacgggcttaccttcctgttcatcagccacgacctgcgcgtcgtgcgtgccatgtcgcaccagatcatggtcatgcgcgcgggcgaggtggtcgagcagggatcgacccaggcggtcttcgacaatccgcaaagcgactacactcgccgtctgatcgaggcggcgtttcttacggtaataagtgaagatttttcggtaatttaa

SEQ ID NO: 27573 - protein, 537 aa, Paracoccus denitrificans PD1222
MTPVLEVSDLRVGFRQDGQLAPAVKGVSFTVGKGETVALVGESGSGKSVTALSTVRLLGEAAEVSGSVRYDGRELLGAAEPELRRVRGNDISFIFQEPMTSLNPLHTLERQLAESLALHQGLRGAAARARIIELLTRVGIRDPETRLADYPHQLSGGQRQRVMIAMALANGPELLVADEPTTALDVTIQAQIMELLAELKAAEGLSMLFISHDLGLVRRIADRVCVMKGGEIVEQGPVEQIFAHPQHEYTRMLLAAEPQGRADPIPADAPQVVATQDLRVWFPIQRGFLRRTVGHVKAVNGATISVRAGETLGIVGESGSGKTTLALAIMRLIESEGPILYMGRDISKLPGRALRGLRRDMQIVFQDPFGSLSPRMTVEQIISEGLGVHGIEPGRDRRGMVDEIMREVGLDPATMHRYPHEFSGGQRQRIAIARAMILNPRLVVLDEPTSALDMTVQVQIVELLRRLQRKHGLTFLFISHDLRVVRAMSHQIMVMRAGEVVEQGSTQAVFDNPQSDYTRRLIEAAFLTVISEDFSVI

SEQ ID NO: 27574 - DNA, 2517 bp, Paracoccus denitrificans PD1222
  CDS (1)..(2517): transl_table=11
atgaatacccaaaaacgtgcggcgatgaggaatctgctgatcgtggcggcagggctggtgctgctgccggtcttgctgggccggatcgggctgggcgcgaattccgccgtcgaggtggtgatctatgccctggccgcgatggggctgaacgtgctggtgggttataccggcctcgtctcgttcgggcatggcgtctggttcgggacggcggcctatattgttgggctgaccgcgcggtcgatgggcaatgccagcatggccgtgtcgctgaccgtcggagtggtcgccaccgcgctgatcgcggcgcttgtcggctttctggtgctgcggcggcgcggggtctatttctcgctgatgacgctggcgctgtcggcgatgggcttccagcttgccttccgctggaccgacgtgaccggcggcgagaacggccttggcgggatcgagcgtcccgcgatgctggacgccaatctcagcttctacatcttcgtggcgctgctgggctttgccgtgatcgcgctgcttcagcgggtgctgcaatcgcccttcggctcggtcctcgaagccatccgcgagaacgacggccgcgcgcaggcgcttggctatgacgtgcgccgctacaagctgaaagcctttgtcctatcggccgcgatcaccgggcttgcggggggactgctgctttacaagaaccgcatgacctcggccgagccgatgtcgatcatcttctcgggcgagttgctggcgatggtcgtcatcggcgggatgcgcggctatctgggaccggcgctgggggcgctgttctacatcctcttccgcgaatacctgtcgatgtatagcgagaactggctgctctggttcgggctgatcttcgtcggcttcgtgatctttgcgcgccaaggcatgatcggcatcgggacgcagcttcgccgccgcttctttcccgagcccgagaccggcgccgccatggcggaacgcaggaccggcgactatcccttgccccgcgcgatcgcggaacgcgacggcggtggcggcgacgtgctggtggcggaagggatctcgaagcatttcaatgcgatcaaggcggtggacgatgtctcgctgcgggtcagggatcgcacgcttcacgcgcttctggggcccaacggggcgggcaagaccacggccttcaacctgatgtcggggatcatcccgaccagcgcgggcggcgtctcgttcatggggcaggatatttccggcaagtcggccgaccatatctcgaatctggggctggggcggtcgttccagatcaccaatcttttccccgagctgaccgtgcgcgagaatatccgccttgccgtccaggcccgcgatcccagccgcagtgacatgttgtgttcgaccgccagcatcgcccaggtccatgaaaaggtcgaggagatgatcaactgggtcggccttgccgggatggagaacgcccgcgcgggctcgctgtcctatggcgggcagcggcttctggacctcggcctggcgctggcgaccgagccgcgcatcctgctggcggacgaaccccttgccggcctgtcggtcgcggaacgcgagcgggtcgggttgctgatcaaggacgtctcgaaaagcctgccggtgttgctggtcgagcatgacatcgaccgcgtgttcgagcttgccgaccatgtcaccgtcatggcggacggcaaggtgctggtcgacggcacggtggacgacgcccgcaactcgcgcgaggtgtgcgacatctatatcggttcgggcaccagcgaggtcgcggcctcggcgcggcaggggcagttctcggcggaaaagatcctgcaactggacaaggtgaacctgcattacggcaagagccacatcctgcaggacgtcagcttcgacctgcacaagggcgagatcctggcgctgctgggtcgcaacggcgcgggcaaatcctcggtgctgaaggcggtgacggggatcgtgccgccgtcctcgggttcggtccggctgatggagcatgagcttgccggcctgtccagcgcccggatcgcgcggttgggcatcggctatgtgccgcaaggccgggggcttttcgccggaatgaccgtgcgcgagaacctggagctgggccgcatccgccgccagacgggcgagggcacgcattggtcgctggaagagatcctcgaatacttcccccggctgcgcgagcgactggatacgcctgccgacagcatgtcggggggtgagcagcagatggccgcggtcgcccgcgcgctgtcgggcgatatccgtgtcctgctgctggacgagcccttcgaggggctggccccggcggtggtcgagcagctgttccgcaccttcgacaagctgcgcgaccggctgtcgatcgtgatcgtggaccacaacctcgacctggcgctggcgctttcggaccgcaccatcgtgctggagcgcggtcgcgtgctgcatgaaatcgaatcccgccgcatcgccgaagatatcgagctgcggcgcgaaatgctgtggatgtag

SEQ ID NO: 27575 - protein, 838 aa, Paracoccus denitrificans PD1222
MNTQKRAAMRNLLIVAAGLVLLPVLLGRIGLGANSAVEVVIYALAAMGLNVLVGYTGLVSFGHGVWFGTAAYIVGLTARSMGNASMAVSLTVGVVATALIAALVGFLVLRRRGVYFSLMTLALSAMGFQLAFRWTDVTGGENGLGGIERPAMLDANLSFYIFVALLGFAVIALLQRVLQSPFGSVLEAIRENDGRAQALGYDVRRYKLKAFVLSAAITGLAGGLLLYKNRMTSAEPMSIIFSGELLAMVVIGGMRGYLGPALGALFYILFREYLSMYSENWLLWFGLIFVGFVIFARQGMIGIGTQLRRRFFPEPETGAAMAERRTGDYPLPRAIAERDGGGGDVLVAEGISKHFNAIKAVDDVSLRVRDRTLHALLGPNGAGKTTAFNLMSGIIPTSAGGVSFMGQDISGKSADHISNLGLGRSFQITNLFPELTVRENIRLAVQARDPSRSDMLCSTASIAQVHEKVEEMINWVGLAGMENARAGSLSYGGQRLLDLGLALATEPRILLADEPLAGLSVAERERVGLLIKDVSKSLPVLLVEHDIDRVFELADHVTVMADGKVLVDGTVDDARNSREVCDIYIGSGTSEVAASARQGQFSAEKILQLDKVNLHYGKSHILQDVSFDLHKGEILALLGRNGAGKSSVLKAVTGIVPPSSGSVRLMEHELAGLSSARIARLGIGYVPQGRGLFAGMTVRENLELGRIRRQTGEGTHWSLEEILEYFPRLRERLDTPADSMSGGEQQMAAVARALSGDIRVLLLDEPFEGLAPAVVEQLFRTFDKLRDRLSIVIVDHNLDLALALSDRTIVLERGRVLHEIESRRIAEDIELRREMLWM

SEQ ID NO: 27576 - DNA, 1383 bp, Paracoccus denitrificans PD1222
  CDS (1)..(1383): transl_table=11
atgatccgcgtccgcgacctgtcgctggaccatggcacgcagccgatcctgcgccatgtctcgctggaggtcgcgcgaggcgagacgctggcgctgatcggcccgtcgggcagcggcaagaccagcttggcacggatgatcctgggattgccgccgcagggccgggcgatacgatggcggggcgaggtcacgctggacgggcttgacatgctgcgcgcacctgcccgccacctgcgccgctttcgcgcagcggaaaccggaatgatcgtgcaggcgctttcggacgcgttgaacccgcatctgagcgttgcgcagcacctgcgcgaggcgggcgatccgcaagcgctctgcaccggtttcaacatcccgcccatgctgctgccgcgcctgccgcgcgacctgagcggcggcgagatccagcgcgtgctgaccgcgctcgccatggcgaaatcgccgcgctgtctgatcctcgacgagcccacggcggcgctggatccggccaatcgcgcctgggccaggacgcgcttcgcggccggcgcgcaggatcgggcgcaattgctgatcacccacgacctggagctggcgcgcgcactggccgaccgcatcgccgtcatgcgcgacggcgaattgatcgagatcggcgcggccgcgcaggtgttggcaacccccggccatgcctgcacgcgccggctactgggtttcgatcgcaagccggagctgcgcctgccgtccccggaaccacgcgagagcggcctgctggtcgaggggctgcggcaccggatcggcgacagggtgctgctgcgcgaggtctcggcccgtatcccggccgggcactgccttgccgtgatcggagccagcggttgcggcaagtccacgctggcgcggctgctggcgggttatctgccgctgcagggcggccggatcctgtggcagccgggcgcgcgggcgccgcgcatcgcactggtctcgcagcatccgcaccgggcgctggcccggcatttcaccgtcgagcaggtgctggccgaggctctgcggctggcgggcgagcccctggcacccgcccgcatcgcggccctgctgcgcgagatcggcctgtccgacgcgccgggtttccgtgcccggcgcacggagacgctttcgggcggcgaggcgcagcggctggtgatcgcacgcgccatcgcggtgcgcccggattgcctggtcgcggacgagccgaccagcgcgttggacccggtcagccgcgagcaggtgctgggcctgctgaaccggctcaagcgcgagcggggcgtcgcgctgctgctggtcacccatgacgccgaagtcgcgcgcaccctggccgagcggaccgcccgcctgcatgacgggcggctggccttcgattga

SEQ ID NO: 27577 - protein, 460 aa, Paracoccus denitrificans PD1222
MIRVRDLSLDHGTQPILRHVSLEVARGETLALIGPSGSGKTSLARMILGLPPQGRAIRWRGEVTLDGLDMLRAPARHLRRFRAAETGMIVQALSDALNPHLSVAQHLREAGDPQALCTGFNIPPMLLPRLPRDLSGGEIQRVLTALAMAKSPRCLILDEPTAALDPANRAWARTRFAAGAQDRAQLLITHDLELARALADRIAVMRDGELIEIGAAAQVLATPGHACTRRLLGFDRKPELRLPSPEPRESGLLVEGLRHRIGDRVLLREVSARIPAGHCLAVIGASGCGKSTLARLLAGYLPLQGGRILWQPGARAPRIALVSQHPHRALARHFTVEQVLAEALRLAGEPLAPARIAALLREIGLSDAPGFRARRTETLSGGEAQRLVIARAIAVRPDCLVADEPTSALDPVSREQVLGLLNRLKRERGVALLLVTHDAEVARTLAERTARLHDGRLAFD

SEQ ID NO: 27578 - DNA, 1470 bp, Shewanella frigidimarina NCIMB 400
  CDS (1)..(1470): transl_table=11
atgaaaatcagacttacgcagttgcagtgcagttcatcgagtgtcactgtcgacattaatgattgggttattgagcctcaacaatcttggggggtatttagcaccgaaggtgatgtaggtgcattgcttggccagttattaactcagcaaattgatgcgcaaaccttaacttacagtggcgatattatcggtgtcacgccagcaagtgtggcattagtgtcattgcttgaacagcaatcactgcttgaagctattttagagcaagatgacagcgaatcactgggatataccgatcctaaaacgaccgtgtttggggttgtttttaatcaatgccatgacaatgacttaacccatcaattgctgcaacaattagatttaacgcatttaagcttaagtccttttgctcaattgtctaccggtgaaggccgcagagtaatgcttgctcgtgcagtagcaactcaagtgccttttttagtgctcgacgaaccttatgcaggtcttgatgttgcgcacagacagactctcacagaatatttacaacaattatctcaaaccaaacagatactggtcgtggtgtcgcgtgaagaagatatgccagattggattgaacatgttgctatgtttagtcatggtaaattagacactatgatgaccaaatcacagtgggataaccatcctgttattgcccagttaacggcgcaagcgggtcaacaaagtgatgatatattggcgcttattcgtcgtcacagacacaagccattatttgctaacccggtatttcagttaaacaatggacgagtggcttacagcgataaagtgattttttcgggtgttaactggcgtatcgataatggtgtgcattggcaagtaaaagggcctaatggctgcggtaagagtactttactggggcttatttttggtgaccatccacaatgttacagtaatgatattgatatttttggtaacaaaagaggttctggcgaaagtatttgggaaattaaaaaacacatcggtatggtgtcttcggcattacatctgcaatatcgggttaactgtagcgcactggatgtgattgtttctggcttttatgattctattggtttgtaccaaaaaccgacggcacagcaaatatctgtcgctacagaatggttggccattttacacatgggccatttaagtaaaaccgcttttcgacaattagaatatggccagcaacgtttattactcatcgctcgcgccattgtgaaacaacccactttattgatcctcgatgagccttatcaaggtttggattatttgggacgccgactgattaaaaatgcccttgaactcattgccaaagaacacttaagtcaattgttgtatgtctcgcattatcaagaagatagcctagacagtattcagcactatattgaatttgtgaaagatgaaaatcaagatggttatcgggcggtggtttctcaggggtaa

SEQ ID NO: 27579 - protein, 489 aa, Shewanella frigidimarina NCIMB 400
MKIRLTQLQCSSSSVTVDINDWVIEPQQSWGVFSTEGDVGALLGQLLTQQIDAQTLTYSGDIIGVTPASVALVSLLEQQSLLEAILEQDDSESLGYTDPKTTVFGVVFNQCHDNDLTHQLLQQLDLTHLSLSPFAQLSTGEGRRVMLARAVATQVPFLVLDEPYAGLDVAHRQTLTEYLQQLSQTKQILVVVSREEDMPDWIEHVAMFSHGKLDTMMTKSQWDNHPVIAQLTAQAGQQSDDILALIRRHRHKPLFANPVFQLNNGRVAYSDKVIFSGVNWRIDNGVHWQVKGPNGCGKSTLLGLIFGDHPQCYSNDIDIFGNKRGSGESIWEIKKHIGMVSSALHLQYRVNCSALDVIVSGFYDSIGLYQKPTAQQISVATEWLAILHMGHLSKTAFRQLEYGQQRLLLIARAIVKQPTLLILDEPYQGLDYLGRRLIKNALELIAKEHLSQLLYVSHYQEDSLDSIQHYIEFVKDENQDGYRAVVSQG

SEQ ID NO: 27580 - DNA, 2757 bp, Shewanella frigidimarina NCIMB 400
  CDS (1)..(2757): transl_table=11
atggaccaacaaaattatcctatcgtctgcattaagggtgttacgcatacctataagaaagtgaatgctatcgaagatgtgtcattaaccattccatctgggatgatggttggcttactcggtcctgatggtgttggtaagtcgacgctattggcccttatttcgggtgttcgcaagttacagcatggcagtcttgaggtgcttggtggtgacatggcttcggcccgccaccgctccgaagttggccctcggattgcctacatgccccaaggtctgggtaaaaacctttatagcgagcttagtgttgccgaaaacctggacttctttggaaagttatttggtcagggggtctctgagcgtaaagctcgaatcgatcgtttgactaaagcaacagggcttcactcttttctatcaaggccagcgggcaagttatctggtggcatgaaacaaaaacttgggctctgctgttcgcttatacatgatccagatctgttgatattggatgagccgacgactggtgtcgacccattgtcaaggcgacaattttggcaattaatcaacgctattcgcagcgaaagacccagcatgagtgtgatagtgtccactgcgtacatggacgaagcagaagactttgactggctggttgcaatagatgctggacatatcttggacacaggtactccagcagagctaaaagccaaaactaacaccagtaatttagaaaagacgtttgtgcgcttactaccggaagggaagcggggaagtggtaaagagcttgttatccctccatttgaaaagactgctggcacacctgctatcatagcgaaagggttgactcgatgcttcggtgattttaccgctgtgaacgacgttagttttgaaattcaagctggcgagatttttggttttctcggttctaatggttgtggcaagaccaccacaatgaaaatgctgacgggtttgctgccagcttctgaaggtgaggcttttttattcggaaagttagttgatgcgaacaatctagaaatgcgcaagcgtgtcggatttatgtcacaagctttttcgctgtatggcgaactaacggtgatgcagaatttaaccttgcatgctcgcttatttcatctgtcaccgtcaaaaacaacagagcggataaatacgctggttgaccgttttggtctgcgcaaacaaatagatgatctagcttcatcgctgccacttggcatccgtcagcggctttcgctcgcggttgcggtgatccatgagcccgaaatgctcattcttgacgagcctacttcaggtgttgatcctgtcgcccgtgacgaattttgggagctgcttgttgaattgtcacgtcgagataaagtgaccatatttatttctacccattttatgaatgaggctttacgttgcgatcgcatttcgctcatgcacgctggtgaagtacttgtttatgatgaaccgcaacatctagtagaagccaaaggtgcagcctcgctcgaggaagcatttatcaattacctgaaagaggccattggaacgactgccgaagaatcaaccgatttggcttccgtgcagccagacgattcatcaacgttaataagttcaccttcaaccacattaaaacgccactattttagcttgaataggttattggcatacagctatcttgaaatgatggcggtaatgcgtgacaggatacgtttggcatttgccttttttggcagtgtgatcttattaattgttattgcttacggtatatcgctagatatagaggatctcacttttgccgtgctggatctggatcgtactccagagagccgccaatatttaagtaactttcaagggtcacactattttattgagagaccagaactgcaaagtaaagatgaacttgaatggcgtcttaagtctaacgatataaccttagcgatagagatccctccgggctttggccgtgatttaaaaacgggccaaacgcctagtatttctgcttggattgatggtgctaataccaccagagcaagcactatagaaggatatgtcactggtggccatatacgctatcttaccgagttagcaacaaatgcaggtatcgacgcaagagctctatataaagtagatctacagtctcgatatcgttataacccatcatttgagagcatattttcgattgggccgaaaacgcctgccttgctgttgctctttttccccgcaatcttgatggcggtgagtatctcgcgtgagaaggaggttggcactatcaccaacttttacgtcacgccaacaaacaaacttgaatttctgataggcaaacagctgccttatattggcattggcatggctaacttttttattctgacattcttagtggtatttttgctacaagtaccgctaaaaggtagcctgctgggcttaactgtgggagctttcttttacgtttgcgcttcaacgggtattgggttaattgtttccgcgttaactaagacacaggttaccgctgtttttgcgactacaattgtgtctttattacccacagcacttttctccgggttagttcagccaacatcaacgttagaaggcgggggatatcttatcggtatggcgtggcccgcaacctattacatgcatttgagtgtcgctgcatttaccaaaggattggatttctttgccctagcaggggatttaatgatgctatccatttatggtccgctctttgtcgttttcgctgcagtatgtttgacaaaacaagaggcataa

SEQ ID NO: 27581 - protein, 918 aa, Shewanella frigidimarina NCIMB 400
MDQQNYPIVCIKGVTHTYKKVNAIEDVSLTIPSGMMVGLLGPDGVGKSTLLALISGVRKLQHGSLEVLGGDMASARHRSEVGPRIAYMPQGLGKNLYSELSVAENLDFFGKLFGQGVSERKARIDRLTKATGLHSFLSRPAGKLSGGMKQKLGLCCSLIHDPDLLILDEPTTGVDPLSRRQFWQLINAIRSERPSMSVIVSTAYMDEAEDFDWLVAIDAGHILDTGTPAELKAKTNTSNLEKTFVRLLPEGKRGSGKELVIPPFEKTAGTPAIIAKGLTRCFGDFTAVNDVSFEIQAGEIFGFLGSNGCGKTTTMKMLTGLLPASEGEAFLFGKLVDANNLEMRKRVGFMSQAFSLYGELTVMQNLTLHARLFHLSPSKTTERINTLVDRFGLRKQIDDLASSLPLGIRQRLSLAVAVIHEPEMLILDEPTSGVDPVARDEFWELLVELSRRDKVTIFISTHFMNEALRCDRISLMHAGEVLVYDEPQHLVEAKGAASLEEAFINYLKEAIGTTAEESTDLASVQPDDSSTLISSPSTTLKRHYFSLNRLLAYSYLEMMAVMRDRIRLAFAFFGSVILLIVIAYGISLDIEDLTFAVLDLDRTPESRQYLSNFQGSHYFIERPELQSKDELEWRLKSNDITLAIEIPPGFGRDLKTGQTPSISAWIDGANTTRASTIEGYVTGGHIRYLTELATNAGIDARALYKVDLQSRYRYNPSFESIFSIGPKTPALLLLFFPAILMAVSISREKEVGTITNFYVTPTNKLEFLIGKQLPYIGIGMANFFILTFLVVFLLQVPLKGSLLGLTVGAFFYVCASTGIGLIVSALTKTQVTAVFATTIVSLLPTALFSGLVQPTSTLEGGGYLIGMAWPATYYMHLSVAAFTKGLDFFALAGDLMMLSIYGPLFVVFAAVCLTKQEA

SEQ ID NO: 27582 - DNA, 1611 bp, Burkholderia mallei JHU
  CDS (1)..(1611)
atgagcgcgccgagcgtcgttcgtttttccgacgtcagcctgcgctacggcaagaccgtcgcgctcgagcggatcacgctcgagatcccggccggtctcacgatcgggctgatcgggccggacggcgtcggcaaatcgagcctgctcgcgctcgcggccggcgcgcgcgcgctgcagacgggcgcggtcgacgcgctcggcggcgacatgcgctcgcgccgccatcgcgagcgcgtgtgccggcgcatcgcgtacatgccgcaggggctcggcaagaacctgtatccgacgctctccgtcgaggaaaacctgcagttcttcgcgcgcctgttcggccacgacgccgacgagcgccgccgccggatcgacgcgctcacgcggagcaccggcctctttgcgttcctgtcgcggcccgcgggcaagctctcgggcgggatgaagcagaagctcggcctatgctgcgcgctgatccacgatcccgacctgctgatcctcgacgagccgacgaccggcgttgatccgctcgcgcgcgcgcagttctgggatctgatcgcgcgcattcgctcggagcggccggcgatgagcgtgatcgtcgcgaccgcgtacatggacgaggcgcaacgcttcgactggctgatcgcgatggacgcgggccgcgtgctcgcgacgggcgcgcccgccgagctgctcgcgcgcaccggctgcgattcgctcgaggcggccttcatcgcactgttgcccgaagacgaacggcgcggccacaagccggtgacgctcgagccgctgcgcgccgacgcgcaaaccggcaccgcgatcgaggcgcgcgggctgacgatgcgcttcggcgatttcaccgcggtcgatcacgtgagcttccggatccggcgcggcgagatcttcggctttctcggctcgaacggctgcggcaagtcgacgacgatgaagatgctcaccggcctgctgcccgcgaccgagggcaccgcgcagctgttcggcaagacagtcgatccgaaggacatcaatacgcgccggcgcgtcggctacatgtcgcaggccttctcgctgtatagcgaactgacggtgcggcagaacctcgtgctgcacgcgcggctgttcggcgtgccggccgccgagatcgacgcgcgcgtcgacgagatggcgcgccgcttcggcctcgccgacatctacgacatgctgccggacagcctgccgctcgggatgcggcagcggctgtcgctcgcggtggcgatggtgcacaagccggagctgctgatcctcgacgagccgacctcgggcgtcgatcccgtcgcgcgcgacagcttctggcagttgatgatcgacctcgcgcgccgcgatcgggtgacgatcttcatctcgacgcacttcatgaacgaggcgcagcgctgcgaccggatctcgctgatgcacgcgggccgcgtgctcgcgagcgatgcgccggcggcgctcgtgcgcgcgcgcggcgcggcgacgctcgaggaggccttcatcggctatctcgtcgacgcttcggcgcaggaggcgcaggaggcgcagggcggcgcgggcgagcgccccggcgcgggcgagcgcgcggcgggcgaaagcgtgtag

SEQ ID NO: 27583 - protein, 536 aa, Burkholderia mallei JHU
MSAPSVVRFSDVSLRYGKTVALERITLEIPAGLTIGLIGPDGVGKSSLLALAAGARALQTGAVDALGGDMRSRRHRERVCRRIAYMPQGLGKNLYPTLSVEENLQFFARLFGHDADERRRRIDALTRSTGLFAFLSRPAGKLSGGMKQKLGLCCALIHDPDLLILDEPTTGVDPLARAQFWDLIARIRSERPAMSVIVATAYMDEAQRFDWLIAMDAGRVLATGAPAELLARTGCDSLEAAFIALLPEDERRGHKPVTLEPLRADAQTGTAIEARGLTMRFGDFTAVDHVSFRIRRGEIFGFLGSNGCGKSTTMKMLTGLLPATEGTAQLFGKTVDPKDINTRRRVGYMSQAFSLYSELTVRQNLVLHARLFGVPAAEIDARVDEMARRFGLADIYDMLPDSLPLGMRQRLSLAVAMVHKPELLILDEPTSGVDPVARDSFWQLMIDLARRDRVTIFISTHFMNEAQRCDRISLMHAGRVLASDAPAALVRARGAATLEEAFIGYLVDASAQEAQEAQGGAGERPGAGERAAGESV

SEQ ID NO: 27584 - DNA, 1587 bp, Pseudomonas fluorescens
  CDS (1)..(1587): transl_table=11
ttgatctccacagctaacatcaccatgcagttcggcgccaagccgctgttcgagaacgtttcggtcaagttcaacggcggcaaccgctacggcctgatcggcgccaacggttgcggcaagtcgaccttcatgaaaatcctcggtggcgacctcgagccgtccggcggccaggtcatgctggaaccgaacgtgcgcctgggcaagctgcgccaggaccagttcgcctacgaagaattcaccgtgatcgacaccgtgatcatgggccacgaggagctgtggaaggtcaaggccgagcgcgatcgcatctactcgctgccggaaatgaccgaagaagacggcatggccgtggccgagctggaaaccgaattcgccgagatggacggctacaccgccgagtcccgcgccggtgagctgctgctgggcctgggcattcccctggaacagcatttcggcccgatgaccgaagtcgcgccaggctggaaactgcgagttctgctggctcaggcgctgttctccgatccggaagtgctgctgctggacgaaccgaccaaccacctggacatcaacaccatccgctggctggaaaacattctcacggcgcgtaacagcaccatgatcatcatttcccacgaccggcacttcctcaacagcgtctgcacccacatggccgacctggactacggcgagctgcgcctgttcccgggcaactacgacgagtacatgatcgccgcgacccagtcccgcgagcagttgctgtcggacaacgccaagaagaaagcccagatcgccgagctgcagaccttcgtcagccgcttctcggccaacgcctcgaaagccaagcaggccacgtcccgggccaagcagatcgacaagatccagctggccgaagtcaagccgtctagccgcgtcagcccgttcatccgcttcgaacagaccaagaaactgcaccgccaggcggtgaccctggagcgcatgtccaagggtttcgacggcaagaccctgttccagaacttcagcttcaccgtcgaggccggcgagcgcgtagcgatcatcggccccaacggcatcggcaagaccactctgctgcgcaccctggtgggcgagctgaccccggacgccggcacagtgaaatggaccgaaagcgcggagctgggctactacgcccaggaccacgcccatgacttcgaagacgacgtcagcctgttcgactggatgggccagtggacccagggcgaacagatgatccgcggcaccctgggccggatgctgttctccaacgacgagatcctcaagtcggtgaaggtgatttccggtggtgagcaaggccgcatgctgttcggcaagctgatcctgcaaaagcccaacgtgctggtgatggacgaaccgaccaaccacctggacatggaatccatcgaggcgctgaacctggccctggaaaactacccgggcaccctgatcttcgtcagccacgaccgtgagttcgtatcgtccctggccacccgcatcatcgagttgagcccaagcggcgtgaccgacttcagcggcacctacgacgactacctgcgcagccagggcgtgatgttctaa

SEQ ID NO: 27585 - protein, 528 aa, Pseudomonas fluorescens
MISTANITMQFGAKPLFENVSVKFNGGNRYGLIGANGCGKSTFMKILGGDLEPSGGQVMLEPNVRLGKLRQDQFAYEEFTVIDTVIMGHEELWKVKAERDRIYSLPEMTEEDGMAVAELETEFAEMDGYTAESRAGELLLGLGIPLEQHFGPMTEVAPGWKLRVLLAQALFSDPEVLLLDEPTNHLDINTIRWLENILTARNSTMIIISHDRHFLNSVCTHMADLDYGELRLFPGNYDEYMIAATQSREQLLSDNAKKKAQIAELQTFVSRFSANASKAKQATSRAKQIDKIQLAEVKPSSRVSPFIRFEQTKKLHRQAVTLERMSKGFDGKTLFQNFSFTVEAGERVAIIGPNGIGKTTLLRTLVGELTPDAGTVKWTESAELGYYAQDHAHDFEDDVSLFDWMGQWTQGEQMIRGTLGRMLFSNDEILKSVKVISGGEQGRMLFGKLILQKPNVLVMDEPTNHLDMESIEALNLALENYPGTLIFVSHDREFVSSLATRIIELSPSGVTDFSGTYDDYLRSQGVMF

SEQ ID NO: 27586 - DNA, 1632 bp, Cryptococcus neoformans var
  CDS (1)..(1632)
atgcccccctcatctctacccctcgtaaggctacccccaaaagctgtcgtacatcgtttcggtgcacctacttcagctcctccttcatcggctttacttagatttccggttcaaggatggactatcaacagagaatcagcaaaacctgaaggatgggcaatcgtaggagatgctgacggtcgcaaggttgctgtggagacgctgttgagcagacatcgaatccaacctttttccccgcctccaggcccgttcccttatataacctcgctcatctcctcttccacagactcctggtcttctactactgaagcaccctcgaaacctatccgtcacctggcatttgcacgcccaccaacgacaggtgaatttacagattttactgctcgctatggagctctccttgaagaagacaggctgtcttacagggaaaacttgcagaaccttcacccgagaccgagtgatgaggatattgagagggttgcaaagctcatgaggatagggcacttgctcgatctccctactgtttcattctcatctggtcagactagacggggtagaatcgcaagtgccctgttgacaagacctgttttgttgctgttggaggatcctatggcaggtttggatgttcccagtcgaaaggaagtctccaaccttttgggagagctcaatgcaagtgaaactatcaagattgtcctcatccttagaggtaagggtggtgaagagatgccaacgtggatcacggatgtggccgaggtcagaaatggagaagtatggattggcaaacgggatgaatatgagcagaagcatgcagaagagcaggtccgggatcaggcgaaggtcgagcaggtggctgagaagagtgatgaagttcctggagaacccgtcatcaaacttgatggagtgtctgtatcatatggagagggcaccagacaagttctcaaggatatcaaatggaccgtcaagcccggagagaaatggcatctcattggggccaacggctccggtaagacgacactcctctcgctcatcttaggacaccatccacgctcatactccttgcccgcttcatccctccttctcttctccaagcctcgtcgctccatccctagccctactcttcggactttgattggacacacctctccggaaatcttcgcctctttcccaagagggatggggctgagtgctttggaggctgtcggcagtggttttgaaggcattttctctaggagaaatcttacctcggagcaaaaggaacgagttaaatatcttttgggacaatttaaagaccttttgaaaccgtcttctctttctgggaagcccgcaccggatgtgactgtccaagaaattgccaaccgaaactttgctcacttcactccccctcagcaaggtctccttcttttcctccgtgccattgtacggaaaccaaagcttcttatccttgacgaacctagtcagggcatggacgaagtaatctgggaacgatgtaagggcttattggagaaagagtgggaagatgagggtaagggtatggctgttatcgtggtgagccattatgaagacgaggttccatggaaaaagggtagaggaaaggtcctcaaactcgatcaaggagtcgctactgtacaataa

SEQ ID NO: 27587 - protein, 543 aa, Cryptococcus neoformans var
MPPSSLPLVRLPPKAVVHRFGAPTSAPPSSALLRFPVQGWTINRESAKPEGWAIVGDADGRKVAVETLLSRHRIQPFSPPPGPFPYITSLISSSTDSWSSTTEAPSKPIRHLAFARPPTTGEFTDFTARYGALLEEDRLSYRENLQNLHPRPSDEDIERVAKLMRIGHLLDLPTVSFSSGQTRRGRIASALLTRPVLLLLEDPMAGLDVPSRKEVSNLLGELNASETIKIVLILRGKGGEEMPTWITDVAEVRNGEVWIGKRDEYEQKHAEEQVRDQAKVEQVAEKSDEVPGEPVIKLDGVSVSYGEGTRQVLKDIKWTVKPGEKWHLIGANGSGKTTLLSLILGHHPRSYSLPASSLLLFSKPRRSIPSPTLRTLIGHTSPEIFASFPRGMGLSALEAVGSGFEGIFSRRNLTSEQKERVKYLLGQFKDLLKPSSLSGKPAPDVTVQEIANRNFAHFTPPQQGLLLFLRAIVRKPKLLILDEPSQGMDEVIWERCKGLLEKEWEDEGKGMAVIVVSHYEDEVPWKKGRGKVLKLDQGVATVQ

SEQ ID NO: 27588 - DNA, 1518 bp, Thermoanaerobacter ethanolicus
  CDS (1)..(1518): transl_table=11
atgagcgagtatattcttgaaatgagaaacataacaaaggaatttcctggagttaaagcattggataatgtaaatttcaaagttaaaagaggggaaattcacgcgttagtaggagaaaatggagcgggaaagtctaccttgatgaagatattaagtggtgtttatccttatggaacttataaaggagacataatcatagatggtgaagtgaagcaatttcgaaatattaaagatagtgaaaaaagtggtatagcgattatttatcaggagctcactctggtaaagtatatgacagtaggcgaaaacatatttttaggtgaagagcctgtaaaaggcggaataattgattggatgaaagtttactctgagacttatagacttttgaaagagttgcagattaatgtaaacccctatacaaaagttatgaatttaggaattgggcatcaacaaatggtagaaatagcgaaggctctttcaaaaaaagcgaggattttaatattagatgagcctacttctgcattgacagaaagcgaaacagaacatcttctcaatattttgaaagatttgaagaaaaatggtgtaacttgtatatacatttctcacaagcttaatgaagtatttgaaattgcagattcaatcactgtattaagagatggcaaaacgataatgacggacaaaaaagaaaatttcacagaaaacaaggtaatttctttaatggtagggcgtgagcttacacagagattcccaagagctaagcatacgccaggggaagtggttttcgaggttaaaaattacacagtttatgaccatgaaataccgggcaagaaaattattgacaatgtaagctttaaagccaggagaggcgagatattaggtattgcaggacttatgggagcagggaggacagaacttgctgctagtatatttggtgcatttaaaggtagaaaagaaggggaaatatatttaaatggcaaaaaaattgaaataaacactcccagcgatgcgataaaacatggaattgcctatctttcagaggataggaaaaggtttggccttgtgactttgatggatgtacaagaaaatatagcacttcctaactatgacagactatcaaaatttagtattataaataacaatgcaaaaattaaacatgcagaaaagtatgtaaaagagttaaaaataaaaacaccaaccataagacaaagggttgctaatttaagtggaggaaaccagcaaaaagtggttattgcaaagtggcttatgtcagacccaaaagttttgatactggacgaaccaactagaggaatagatgtgggagctaagtttgaaatatataatctaatgaataaattggttgatatgggcgtgtgtgtaataatgatatcttcagaactgcctgaaatattgggaatgagtgatagaatactggtaattcatgaaggaaaaatcaatggagaatttccaatagaagaagcagaccaagaaaaaatcatgtactgtgcaactggaggtaagtaa

SEQ ID NO: 27589 - protein, 505 aa, Thermoanaerobacter ethanolicus
MSEYILEMRNITKEFPGVKALDNVNFKVKRGEIHALVGENGAGKSTLMKILSGVYPYGTYKGDIIIDGEVKQFRNIKDSEKSGIAIIYQELTLVKYMTVGENIFLGEEPVKGGIIDWMKVYSETYRLLKELQINVNPYTKVMNLGIGHQQMVEIAKALSKKARILILDEPTSALTESETEHLLNILKDLKKNGVTCIYISHKLNEVFEIADSITVLRDGKTIMTDKKENFTENKVISLMVGRELTQRFPRAKHTPGEVVFEVKNYTVYDHEIPGKKIIDNVSFKARRGEILGIAGLMGAGRTELAASIFGAFKGRKEGEIYLNGKKIEINTPSDAIKHGIAYLSEDRKRFGLVTLMDVQENIALPNYDRLSKFSIINNNAKIKHAEKYVKELKIKTPTIRQRVANLSGGNQQKVVIAKWLMSDPKVLILDEPTRGIDVGAKFEIYNLMNKLVDMGVCVIMISSELPEILGMSDRILVIHEGKINGEFPIEEADQEKIMYCATGGK

SEQ ID NO: 27590 - DNA, 1515 bp, Bifidobacterium longum bv
  CDS (1)..(1515): transl_table=11
atgaaaggcattacgattgaattcccgggcgtcaaggccttggatggtgttgatttgactctctacccgggtgaagttcacgccctgatgggtgagaacggtgcaggcaagtccaccatgattaaggctctgaccggtgtgtacaagatcaacgccggctccattatggtggacggcaagcctcagcagttcaacggcaccctcgacgcacaaaacgccggtatcgccaccgtgtatcaggaagtgaacctgtgcaccaacctttccgtcggtgagaacgtgatgctgggccacgaaaagcgcggccccttcggcatcgactggaagaagacccacgaggccgctaagaagtatttggcacagatgggcctcgaatccattgacccgcacactccgctgagctccatctccatcgctatgcagcagctggtcgccatcgcccgcgctatggttatcaacgccaaggtgctgattctcgatgagccgacctcttcgctggatgccaacgaggtcagggacctgttcgcgatcatgcgcaaggtgcgtgactcgggcgtggccatcctcttcgtctcccacttcctcgatcagatttatgagattaccgatcgtctgaccattctgcgtaacggccagttcatcaaggaggtcatgaccaaggacaccccgcgcgacgaactcatcggcatgatgattggtaagtccgccgccgagctgtcccagattggtgccaagaaggctcgccgtgaaatcacccctggcgagaagccgatcgtcgatgtcaagggcctcggcaagaagggcaccatcaacccggttgatgttgacatctacaagggtgaggtcgttggcttcgctggcctgctgggctccggtcgtaccgagcttggtcgactcctgtatggtgccgacaagccggattcgggtacctacacgctcaacggcaagaaggtcaacatctccgatccgtacacggctttgaagaacaaaatcgcgtactccaccgaaaaccgtcgtgatgagggcatcatcggcgacctgaccgtccgccagaacatccttatcgccctgcaggcaacgcgcggtatgttcaagccgattcccaagaaggaagcggacgccatcgttgacaagtacatgaaggaactcaacgttcgtcccgccgacccggatcgcccggtcaagaatctctccggcggcaaccagcagaaggtgctcattggccgttggctggccacgcaccccgagctgctgattctggacgagccgacccgtggtatcgatatcggtgccaaggctgaaattcagcaggtcgtgcttgacctggcttctcagggcatgggcgttgtcttcatctcctccgagcttgaagaggtcgtgcgtctgtccgacgacatcgaggttctcaaggaccgccacaagatcgcagaaatcgaaaacgacgacaccgtctctcaggcgaccatcgtcgaaaccatcgctaacaccaacgtaaacaccggaaaggaggcatga

SEQ ID NO: 27591 - protein, 504 aa, Bifidobacterium longum bv
MKGITIEFPGVKALDGVDLTLYPGEVHALMGENGAGKSTMIKALTGVYKINAGSIMVDGKPQQFNGTLDAQNAGIATVYQEVNLCTNLSVGENVMLGHEKRGPFGIDWKKTHEAAKKYLAQMGLESIDPHTPLSSISIAMQQLVAIARAMVINAKVLILDEPTSSLDANEVRDLFAIMRKVRDSGVAILFVSHFLDQIYEITDRLTILRNGQFIKEVMTKDTPRDELIGMMIGKSAAELSQIGAKKARREITPGEKPIVDVKGLGKKGTINPVDVDIYKGEVVGFAGLLGSGRTELGRLLYGADKPDSGTYTLNGKKVNISDPYTALKNKIAYSTENRRDEGIIGDLTVRQNILIALQATRGMFKPIPKKEADAIVDKYMKELNVRPADPDRPVKNLSGGNQQKVLIGRWLATHPELLILDEPTRGIDIGAKAEIQQVVLDLASQGMGVVFISSELEEVVRLSDDIEVLKDRHKIAEIENDDTVSQATIVETIANTNVNTGKEA

SEQ ID NO: 27592 - DNA, 2691 bp, Salmonella typhimurium
  CDS (1)..(2691): transl_table=11
gtgagccagcattacggaaaaacggtcgcgctgaacaatatcacgctggacattcccgcccgtagtatggtcgggctgattggtccggacggggtgggtaagtcgagcctgctgtcgctgatttctggcgcgcgggtgattgagcaagggaacgttatcgtcctgggcggcgatatgcgcgatgcgaaacatcgccgcgacgtctgtccgcgcatcgcctggatgccgcaggggctggggaaaaacctttatcacacgttatcggtttatgagaacgtcgattttttcgctcgtctctttggtcatgacaaagctgaacgcgaagcgcgtattaccgagctgctgaacagcaccggcctggcgccgtttcgtgaccgtcctgccgggaagctgtccggtgggatgaaacaaaagctggggttgtgctgtgctctgatttatgacccggaattgctgattcttgatgagcctaccaccggcgtggacccgctctcccgcgctcagttctgggacttaatcgacagtatccgccagcgccagaccaatatgagcgtgttggtcgcaacggcctatatggaagaggcggagcgttttgactggctggtggcgatgaatgcgggcgagatactggcaaccggcagcgcgcagcaactgcgggcaaaaacccatagcgcgacgctggaacaggcgtttatcgccctgttgccagaagcgcagcgccaggcgcataagccggtggtgatcccgccgtatcacgctgagcaggaagagattgccattgaggcgaaagatctgaccatgcgcttcggtaagttcgtcgcggttgaccatgttaatttccgtattccgcgcggcgagatttttggcttcctcggttcaaacggttgcggcaaatcgaccaccatgaaaatgctgaccggtctgcttcccgccagcgaaggccaggcctggctatttggccagccggtagacccgaacgacatcgacacccgtcgccgggtcgggtatatgtcgcaggctttttcgctctataacgaactcaccgtgcggcagaatctggaacttcatgcccgcctgtttcatattccgccagcggagatcccggcgcgcgtcgcgcagatgatcgaacgctttatgctaacggaggtggaagatacgctccccgcttcgttgccgctcggtatccgccagcgtttatcgctggcggtagcggtgatccatcgcccggaaatgctgattcttgatgagccaacgtccggcgttgatccggtcgccagggatatgttctggcagcttatggtcgatctttcgcgtcaggataaggtgacgatttttatctcgacccattttatgaacgaagcggaacgttgcgaccgaatgtcattgatgcacgccggtaaagtgctcgccagcggtacgccgcaggaattggtgcaacagcggggcgcggccaatctggaggcggcgtttatttcctggctacaggaagctgcgggagcggcgcctgaaaccccaataccgccatcccagacgcccgccgcgtcaggtaaaccgtcgcggcagggattgagcttccggcgtttgttcagctacagtcgccgcgaagcgctggagctacgccgcgatccggtacgctcgacgctggcgctgctgggaacggtaattctgatgctgattatgggctatggcatcagtatggacgtggagaacctgcgttttgccgtcctcgatcgtgaccagaccgtcagtagtcaggcatggtcgctcaatctggcgggatcccgctattttatcgaacagccgccgctcgccagctatgacgagcttgaccggcggatgcgttcgggagagctggcggttgccattgagatcccgcctaattttggccgcgatattgctcgcggtacgccagcgcagattggcgtctgggtggatggcgccatgcccagccgcgccgagacggtgaaggggtacgttcaggcgatgcaccaaagctggctgcaggaggcggcaagtcgtcagccgaacccggttaaacaggtcgggctgctcaatattgaaacgcgctatcgctataacccggatgtgaaaagtctgcccgctatcgttccggcggtcattccgctgctgctcatgatgatcccgtcaatgcttagcgccctgagcgtggtgcgggagaaagagctggggtcgatgattaatctgtacgtaacgccgacgacgcgcagcgaatttttgctgggtaaacaactgccgtatatcgcgctgggtatgctgaacttcttgctactgtgcgcgctgtcggtctttgtgttcggcgtgccgctgaaaggcagctttctcacgcttaccctcgcggcgctgctttatgtcatcatcgccaccggtctggggctgctgatctccacgtttatgaagagccaaatcgccgctatttttgggacgtcgattattaccctcattccggcaacacaattttccggcatgatcgatccggtggcttcgctggaaggaccgggaagatggatcggcgagatctacccgaccagtcattttctgacgatcgcgcgcgggacgttttccaaagcgttggatctgtccgatctctggccgttatttatgccgttactgattgccgtcccggtggtgatgggtctgagcattctgctgctgaaaaaacaggaggggtaa

SEQ ID NO: 27593 - protein, 896 aa, Salmonella typhimurium
MSQHYGKTVALNNITLDIPARSMVGLIGPDGVGKSSLLSLISGARVIEQGNVIVLGGDMRDAKHRRDVCPRIAWMPQGLGKNLYHTLSVYENVDFFARLFGHDKAEREARITELLNSTGLAPFRDRPAGKLSGGMKQKLGLCCALIYDPELLILDEPTTGVDPLSRAQFWDLIDSIRQRQTNMSVLVATAYMEEAERFDWLVAMNAGEILATGSAQQLRAKTHSATLEQAFIALLPEAQRQAHKPVVIPPYHAEQEEIAIEAKDLTMRFGKFVAVDHVNFRIPRGEIFGFLGSNGCGKSTTMKMLTGLLPASEGQAWLFGQPVDPNDIDTRRRVGYMSQAFSLYNELTVRQNLELHARLFHIPPAEIPARVAQMIERFMLTEVEDTLPASLPLGIRQRLSLAVAVIHRPEMLILDEPTSGVDPVARDMFWQLMVDLSRQDKVTIFISTHFMNEAERCDRMSLMHAGKVLASGTPQELVQQRGAANLEAAFISWLQEAAGAAPETPIPPSQTPAASGKPSRQGLSFRRLFSYSRREALELRRDPVRSTLALLGTVILMLIMGYGISMDVENLRFAVLDRDQTVSSQAWSLNLAGSRYFIEQPPLASYDELDRRMRSGELAVAIEIPPNFGRDIARGTPAQIGVWVDGAMPSRAETVKGYVQAMHQSWLQEAASRQPNPVKQVGLLNIETRYRYNPDVKSLPAIVPAVIPLLLMMIPSMLSALSVVREKELGSMINLYVTPTTRSEFLLGKQLPYIALGMLNFLLLCALSVFVFGVPLKGSFLTLTLAALLYVIIATGLGLLISTFMKSQIAAIFGTSIITLIPATQFSGMIDPVASLEGPGRWIGEIYPTSHFLTIARGTFSKALDLSDLWPLFMPLLIAVPVVMGLSILLLKKQEG

SEQ ID NO: 27594 - DNA, 1476 bp, Treponema denticola
  CDS (1)..(1476): transl_table=11
atgatcaatctgaatgatgtaagctacaaatataacgatactgcggcacaggcaattcaacatatatctctgtccgtaaaaaaaggagaattggttgttattaccggaaaaagcggctgcggaaaaacaacgctgtttcgttgtgtgaatgggctgtgtccccgtttttatgaaggagaaataaccggaagtcttacattaaacggcaaagttctttcgtcgatgcgtatatgcgatatatcaaacattgcagcgtccgtttttcaaaatcctgaaagccagttttttaccaccgatgtactttccgaccttgtatatccgtgcgaaaattgcggtatagaaaaagaagaaatacaagagcggctgcaccgtgttacaaaactgctatcgctggaaccgcttttgaacagaaagctttcggaactctcaggaggtgaaaaacaaaagattgcaatcgcttcggttttaatgttggacacgcgcgttgtactgatggacgagccgtcttccaatctcgattatcaatccgtcgaattgcttacacaaatacttgcacagctaaaatcaaaaggctacacgctgctcatcattgagcaccggctgcattatttggcggaactctgcgaccggctcattgtaatggaaaacgggtccatagtacgggaatatgaaaaagatttgttatgcactatcggtaatgatgagttccataaacaaggacttcgcggcttgcatttatttcaaaataacagcaatacactgattactccgcagcggcaacatacagacaaacggttattgacgctgcatgatattcattttggctatcggaaaaacactgaggttttaaaaggaatacatctttcgatatatcccggagacaagattgctttaatcggtaaaaacggctgcggaaaaacaacgctggggaaaatcctgtgcggattaaaaaaggaacagagcggtaccgttttgttggacggaagatcattccctgcaagggtgcgcagtaagaccgccggttacgtgatgcaaaatgtagactttcagctttttgggtgcagcgtctatgatgatttattgctcggtaacgaagcactgcccgacaaagaaaaccgaatacaaacagtgcttgaaaagctcagtctttcggccttgcaagaacaacacccgacaacgctatcgatgggacaaaaacagcgcttggtagtcgccgcatcatttttacaaaataagcggctcactatttttgacgaaccgacaagcggtttggattacggcagtatgcaaaatgtctgtgcgttaatcgattcgataacgggcaagacaaacgcctccgttattatcacgcatgattatgagttcattttaaacacctgcaatagagcggttcttttggaagacggacaaataaaggaagattttcaattgaacggttcgatgcagttggaatatatttttaaagagaggttataa

SEQ ID NO: 27595 - protein, 491 aa, Treponema denticola
MINLNDVSYKYNDTAAQAIQHISLSVKKGELVVITGKSGCGKTTLFRCVNGLCPRFYEGEITGSLTLNGKVLSSMRICDISNIAASVFQNPESQFFTTDVLSDLVYPCENCGIEKEEIQERLHRVTKLLSLEPLLNRKLSELSGGEKQKIAIASVLMLDTRVVLMDEPSSNLDYQSVELLTQILAQLKSKGYTLLIIEHRLHYLAELCDRLIVMENGSIVREYEKDLLCTIGNDEFHKQGLRGLHLFQNNSNTLITPQRQHTDKRLLTLHDIHFGYRKNTEVLKGIHLSIYPGDKIALIGKNGCGKTTLGKILCGLKKEQSGTVLLDGRSFPARVRSKTAGYVMQNVDFQLFGCSVYDDLLLGNEALPDKENRIQTVLEKLSLSALQEQHPTTLSMGQKQRLVVAASFLQNKRLTIFDEPTSGLDYGSMQNVCALIDSITGKTNASVIITHDYEFILNTCNRAVLLEDGQIKEDFQLNGSMQLEYIFKERL

SEQ ID NO: 27596 - DNA, 1473 bp, Bacillus subtilis
  CDS (1)..(1473): transl_table=11
atgcaagcctttgatgagcttctgacggttgagcagctcagcttctcttatgaagaagacgagaaaccggtttttcaagacatttcgtttgagcttcaaaaaggagaatgtgttttattattaggaccgagcggatgcggtaaaagctcgctcgccctttgtttaaacggtctatatccggaggcttgcgacggcattcagtccggacatgtatttctatttcaaaagccggtcacagatgctgaaacctccgaaacgattactcagcatgccggggtcgtttttcaggatcctgatcagcagttctgcatgctgacggtggaggacgaaatagcgttcgggctggaaaatctgcaaattccaaaagaagaaatgacagagaaaatcaacgccgtattaggaaaattacgcattacccatttaaaagaaaaaatgatctcaaccctttcaggaggacaaaagcagaaagtggctctcgcctgtattttggcgatggagcctgagcttattattttagatgagccgacctctcttttagaccctttctcagctcgggagttcgttcatctgatgaaggatcttcagcgggaaaaaggtttcagcctcctcgtcattgagcaccagcttgatgaatgggcgccttggattgagagaacgatcgtactcgacaaatcaggcaaaaaggcactggatggcctgacgaaaaatctatttcagcatgaagcggagacactaaagaaattgggcatcgcaattccaaaggtctgtcatctgcaggaaaagctgagtatgccgtttactttatcaaaagagatgctgttcaaagagcctattcctgccgggcatgtcaaaaagaagaaagccccttctggggagagtgtgcttgaagtcagcagcctttcgttcgcgagaggacagcaggcgattttcaaagacatcagcttttcgttgcgcgaaggctctttaacggcgcttgtcggtccgaacggaactggaaaatcgacgctcctatcagttctggccagtctcatgaaaccgcaaagcggcaaaatccttctctatgatcagccgctgcagaaatataaagaaaaagaattgcgtaaacggatgggatttgtttttcaaaaccctgagcatcaattcgtcaccgatacggtgtatgacgagcttctgttcggccagaaagcaaatgctgaaactgagaaaaaagcgcaacacctgctgcagcgttttggtcttgcgcatttggctgatcatcatccgtttgcgatcagccaagggcaaaaacggcgactgagcgtagctactatgctcatgcatgacgtaaaggttttattattagacgaaccaacctttggccaggatgcccgcacggcggctgaatgcatggaaatgattcaacgtatcaaggcagagggaactgctgtccttatgattacacaaggatatggagcaagtctcttcgtatgctga

SEQ ID NO: 27597 - protein, 490 aa, Bacillus subtilis
MQAFDELLTVEQLSFSYEEDEKPVFQDISFELQKGECVLLLGPSGCGKSSLALCLNGLYPEACDGIQSGHVFLFQKPVTDAETSETITQHAGVVFQDPDQQFCMLTVEDEIAFGLENLQIPKEEMTEKINAVLGKLRITHLKEKMISTLSGGQKQKVALACILAMEPELIILDEPTSLLDPFSAREFVHLMKDLQREKGFSLLVIEHQLDEWAPWIERTIVLDKSGKKALDGLTKNLFQHEAETLKKLGIAIPKVCHLQEKLSMPFTLSKEMLFKEPIPAGHVKKKKAPSGESVLEVSSLSFARGQQAIFKDISFSLREGSLTALVGPNGTGKSTLLSVLASLMKPQSGKILLYDQPLQKYKEKELRKRMGFVFQNPEHQFVTDTVYDELLFGQKANAETEKKAQHLLQRFGLAHLADHHPFAISQGQKRRLSVATMLMHDVKVLLLDEPTFGQDARTAAECMEMIQRIKAEGTAVLMITQGYGASLFVC

SEQ ID NO: 27598 - DNA, 1707 bp, Enterococcus faecalis
  CDS (1)..(1707): transl_table=11
atgaaaaaaccaatcattacttttaataatttttcctttcaatatcatagccaatctgaaccaacattaaaggggattcaattaaccatctatgaaggagaaaaggttttaatcgttgggcctagtggtagtggtaaatcaacattggcgcaatgtatcaacgggttaattcccaatatttatgaaggtgagattcaaggaacagctacggttgctggtaaaaatatccaagaaacaagtctatttgatttgtcttttgatgtaggaactgttttacaagataccgatgggcagtttatcggtttaacggttgctgaggatattgcttttgctttagaaaacgatgcagttgaacaagcagaaatgaaaaaagcggttcagaaatggtccgagattgttgagctgaatcagttattgcaacaccgtccacaagatttgtcaggtggtcaaaaacaacgtgtatctatggcgggcgttctaattaaccaatcaaaaattttactttttgatgaacctttggctaatcttgacccacgagcgggacaagaaacaatgactttgattgacaccattcaacaagaaacaaaagcgactgttttaataatagaacatcgcttagaggacgttctttgcgaatcagttgatcgaattattgtcatgaatgagggcacaattatttctgatacaacgccagatgaattgttacgtcaagatacgttgacccaacaagggattcgtgaacctttgtacgttacagccatgaaatatgctgggattgatttaacacaagttagtcatttagacaaattagccgaagtatcaggcgaaacggttttgcctaaaatgacacagtggtctgtccaacctagttcagttagtgcagtcaaaggagctgaactattacgtttggaacaagtgtcctatcaatatgatcgtcacggtgaaaaagtgttagatgacttctcagtaactattcatcatggagaaatgatcagcattgtaggaaaaaatggtgccgggaagtctacactttctaaaataatttgcgggttcatcacgcctcaatctggcaagattttatgggaaggacaggatttttccaattattcaatcaaagaacgtgcagataaaattggttatgtgatgcaaaatcccaatcaaatgatttctaaaaaaatgatttttgaagaagtagctttaggattagttttacgagatgtgccacaagcagaaattgaggaacgtgtgacgaatattttacatatttgtgggctgtatcccttccggaactggccgatttctgcgttgagttttgggcagaaaaaacgggtaactattgcatcaatcttagttttagaacctgaattattaattttagatgaaccaacagctgggcaagattttaaacattatacagaaatgatgacatttttagaagaattgaaccgcttaggtgtgactattttaatgatcactcacgatatgcacttaatgttggaatatacaacacgtgcgttagtagtttgtgatggacgtttactagcagatgcgactccagttgctgttttaacagatgaaaaattaattcaagcagcttctttaaaagaaacaagcttgtttacctttgctaaagcgttaggcttggaaaatcccttgctatttacggaaaaatttgttgcttacgatcgtgaggtgcgttttggatga

SEQ ID NO: 27599 - protein, 568 aa, Enterococcus faecalis
MKKPIITFNNFSFQYHSQSEPTLKGIQLTIYEGEKVLIVGPSGSGKSTLAQCINGLIPNIYEGEIQGTATVAGKNIQETSLFDLSFDVGTVLQDTDGQFIGLTVAEDIAFALENDAVEQAEMKKAVQKWSEIVELNQLLQHRPQDLSGGQKQRVSMAGVLINQSKILLFDEPLANLDPRAGQETMTLIDTIQQETKATVLIIEHRLEDVLCESVDRIIVMNEGTIISDTTPDELLRQDTLTQQGIREPLYVTAMKYAGIDLTQVSHLDKLAEVSGETVLPKMTQWSVQPSSVSAVKGAELLRLEQVSYQYDRHGEKVLDDFSVTIHHGEMISIVGKNGAGKSTLSKIICGFITPQSGKILWEGQDFSNYSIKERADKIGYVMQNPNQMISKKMIFEEVALGLVLRDVPQAEIEERVTNILHICGLYPFRNWPISALSFGQKKRVTIASILVLEPELLILDEPTAGQDFKHYTEMMTFLEELNRLGVTILMITHDMHLMLEYTTRALVVCDGRLLADATPVAVLTDEKLIQAASLKETSLFTFAKALGLENPLLFTEKFVAYDREVRFG

SEQ ID NO: 27600 - DNA, 1722 bp, Lactobacillus johnsonii
  CDS (1)..(1722): transl_table=11
atgacagaacctattattgaatttaaagatttttcatttaaatataatagccaagcagaacctactcttaaaaatattaatttgaagattaataaaggagaaaaaattcttttggctggaccttcaggcagcggcaaatccacaattggtcgctgccttaatggtcttattccaaatatcgatcaaggtgaagttaaaggaaaatgtttagtgaatggaaaagatattactagcacaagtctttttgatttttcattcactacttcaactatcttacaagatgctgatagtcaattcattggcctaacagttggtgaagatatcgcttttgctttagaaaatgactgtcaacctaaagataaaatgcaccaaactgtaaaccagtgggctaatgagttaaaaatcaaagaactacttactcaatctccacaaagtctttctggaggtcaaaaacaaattgttgccttagctggagttttagtcgacgagtcacctattttattattcgatgagccacttgctaatctagatcctgcttctgggcttaaaacgatggcaattatcgataaaattcaaaaggaacttaatgcgacagttataattattgaacatcgcgtagaagaagtcctcagtcaactaattgacagaattattttagtaaatgaaggtacgattgttgctgatcagcctactaatcaattgctccactcaaacaccttagaaaaaattggcgttagagagcccctatatctaaaggctcttacagccgctgatgtaaatctaagttctattaaagaagtagaccagatatcaactctccctgtttctgaaaaaatcagcgataaattagcagcttggactaaacaagctaaaatcaccaaaaaagaagtagataatttaccattattaaaattagatcacgttggtcatcaatacagcaagaatcagccctatcccttaaaagatgtttctactactattaatcagggcgactttatttcaatagttggacaaaatggtgcaggtaaaactaccctttgccgaactatttgtggttttatttctaacgaaggaaaaatcactcttaaggaccagaatttaagtgacttatcaattaaagagagagccgaaaaaattggctacgtaatgcaagatcctaatcaaatgatttctcaaaaaatgatctttgatgaaattgctctaggtttacgtttacgcaatgttgatgaagaaacaattaagcaaaaagttgaccaaacgttgaaaatttgtggactttatccctttagacattggccaatttccgcattaagttttggacagaaaaagcgtgtcacaattgctgcaattttggtcttagaaccagagattattattttagatgagccaactgctggtcaagactggaagacctatacggaaattatgagctttttaaagcatctaaacactatggggaaaacaatcattattatcacgcatgatatgcacttgatgcttgagtacactagtcgatctctagcatttgctaagggaaaattaattgcagatactaccccaattgaattattaaccaatcaagctttaattaaagaagcctcattaaagcgcactagtctttacgacctggcaaaacattataacttacctgatccaaataaatttgtgcaggcttatattaattttgaacaacaaaactggaaggatgaagattatgaatga

SEQ ID NO: 27601 - protein, 573 aa, Lactobacillus johnsonii
MTEPIIEFKDFSFKYNSQAEPTLKNINLKINKGEKILLAGPSGSGKSTIGRCLNGLIPNIDQGEVKGKCLVNGKDITSTSLFDFSFTTSTILQDADSQFIGLTVGEDIAFALENDCQPKDKMHQTVNQWANELKIKELLTQSPQSLSGGQKQIVALAGVLVDESPILLFDEPLANLDPASGLKTMAIIDKIQKELNATVIIIEHRVEEVLSQLIDRIILVNEGTIVADQPTNQLLHSNTLEKIGVREPLYLKALTAADVNLSSIKEVDQISTLPVSEKISDKLAAWTKQAKITKKEVDNLPLLKLDHVGHQYSKNQPYPLKDVSTTINQGDFISIVGQNGAGKTTLCRTICGFISNEGKITLKDQNLSDLSIKERAEKIGYVMQDPNQMISQKMIFDEIALGLRLRNVDEETIKQKVDQTLKICGLYPFRHWPISALSFGQKKRVTIAAILVLEPEIIILDEPTAGQDWKTYTEIMSFLKHLNTMGKTIIIITHDMHLMLEYTSRSLAFAKGKLIADTTPIELLTNQALIKEASLKRTSLYDLAKHYNLPDPNKFVQAYINFEQQNWKDEDYE

SEQ ID NO: 27602 - DNA, 1584 bp, Oceanobacillus iheyensis
  CDS (1)..(1584): transl_table=11
gtgaacaaagcgcatcttgatcaacccctatttaaacttgataatttttcatttatgtacaatacaagcgaaactgctagtattcatcagttatctttatcgatctatgaaaatgacattaccattctaatgggggcaagtggttctgggaaaagtactttggcactttgtttaaatggactttatccagaagctgtagaaggaaccacaaaaggaaatattttatataagggtaagaatattgccgagtacccaagaggtataattaaccaagaggttggcatcgtatttcaagacccggaaagtcaattttgtatggttcgagtggaagatgaattagcttttgtactagaaaacctagctattccacgttctgaaatgaaaaaaaagataaagaaggtattacaacaaataggaatgctcgagtacatagatgccgacattcaccgtttatccggaggccagaaacaaaaaatagctttagcttctgtcttactaatggagccaaagtatatcattttagatgaaccaacagcgaatctcgaccctatgtccagattagaatttattgagcttataattgcaatacaaaagaaaacaaataccggcgtactaattattgaacatcaagtcgatgattgggaaatgtatgcagatcggctagtcgtattaagtaaagataatcacattctaatagatgaaaagcccgaaacagctttccaattacatcaaaatatgctgcgaaaccaacaaattgcaattccaatgaagtatctggataaccaagaaactattaagaaagtatcgcacgaaaaatctatgcctgtgtgtttagaagttcatcatcttcactattaccagaagaagtctgctatattaaaggatatttctttttcagttaagcaaggtgaatttattacgatattaggagaaaatggtgctggaaaatctaccctactacaatgcttaatcggattaaaaaagtatcacaatggtaatatcttatttcaaggaaaagatttacaagcatgggatcggaaaatattatcgaaacatactgggtttgtttttcaacaacccgagcatcaatttatttgtgatacggtatttgatgaggtcgcttttggtatgcgcttaaacaattatactactagtgaaattaatcatcgtacgatttctttactgcaggcatttcgactattggatcatcaatggaagaatccttttacactaagcggaggtcaaaaacgtcgtttaagtgtagctacaatgttagatgaaacaccagatttacttttatttgatgaacctacatttggacaggatgctcatactacaaaagaattgatgaacatgatattggaactgcaagctcaaggaacagctattatttttgtaacacatgatatggatttagtagatacatattgtgaacgggcattagtgatagataaaggaagcgtacgttttgatgggaatccacaatcgctttggaatcagaaagagttattacaagatactagattaagagaaccttatcgtgttcgagaatctgttaaacgagaagtggtgcatatgcaatga

SEQ ID NO: 27603 - protein, 527 aa, Oceanobacillus iheyensis
MNKAHLDQPLFKLDNFSFMYNTSETASIHQLSLSIYENDITILMGASGSGKSTLALCLNGLYPEAVEGTTKGNILYKGKNIAEYPRGIINQEVGIVFQDPESQFCMVRVEDELAFVLENLAIPRSEMKKKIKKVLQQIGMLEYIDADIHRLSGGQKQKIALASVLLMEPKYIILDEPTANLDPMSRLEFIELIIAIQKKTNTGVLIIEHQVDDWEMYADRLVVLSKDNHILIDEKPETAFQLHQNMLRNQQIAIPMKYLDNQETIKKVSHEKSMPVCLEVHHLHYYQKKSAILKDISFSVKQGEFITILGENGAGKSTLLQCLIGLKKYHNGNILFQGKDLQAWDRKILSKHTGFVFQQPEHQFICDTVFDEVAFGMRLNNYTTSEINHRTISLLQAFRLLDHQWKNPFTLSGGQKRRLSVATMLDETPDLLLFDEPTFGQDAHTTKELMNMILELQAQGTAIIFVTHDMDLVDTYCERALVIDKGSVRFDGNPQSLWNQKELLQDTRLREPYRVRESVKREVVHMQ

SEQ ID NO: 27604 - DNA, 1677 bp, Streptococcus agalactiae serotype III
  CDS (1)..(1677): transl_table=11
atgaaagattttattgaatggaaggattttacctttcaatatgacgttcaatctgaaccaactttaaaagggattaacttaagcattcctaaaggtgaaaaggtcttgatattaggaccttcagggtcggggaagtcaacgcttggtcattgtttaaatggtattatcccaaatactcataaaggccaatatagtggtatttttacgattaaccataaaaatgcttttgacttgtcaatatatgacaagtctcatttagtttctacggttttacaagacccagatggccaatttataggattgacagtagcagaagatattgcttttgcattagaaaatgacgttgtagcacaggaagaaatgacctctatcgttgaaatgtgggcaaaacgtttagaaatagctcctcttttgtctaaacgtccacaagacttgtcgggaggacaaaaacaacgggttagtttagctggagttttagtagacgatagcccaattctattatttgatgagcctttggctaatctagatccacaatcgggacaagatatcatggcattggttgaccgtattcatcaagagcaagatgcgaccactattattattgaacatcgattggaagatgttctttatgagcgagtagatcgtgtagttctttttagtgatggacaaattatttataatggggagccggatcaacttttaaaaactaattttttatctgaatatggtattcgagaaccactgtatatttctgccctcaaaaatttaggatatgactttgaaaaacaaaatacaatgacgtctattgatgactttgatttcagtgaactattgatacctaaaatgcgagcattagatttagataaacatacagataaattattatcagtacagcatttgtcggtgtcatatgatttagagaataatactttagatgatgtttcgtttgatttatataaaggtcagcggttagctatcgttgggaaaaatggtgcaggtaaatctactttagctaaagcgttatgtcaatttatccctaataatgctactctaatttataataatgaagatgtcagtcaagactctataaaagaaagagcagaacgaattggctatgttttgcaaaatcccaatcagatgataagtcaagcgatggtttttgatgaagttgctctgggtctccgtttaagaggttttagtgataatgatatagaaagtcgtgtctacgatatattaaaggtttgtgggctctaccaatttaggaattggcctatatcggctctatcattcggtcagaaaaaacgtgttacgattgcttcgatactgattttaaatccagaagttattattttggatgaaccaacagctggtcaagatatgaagcattatactgaaatgatgtctttccttgacaaactaagttgtgatggacatagcattgttatgattacacatgatatgcagcttatgttagagtatacagatcgtgcaattgtaatcgacaatggtcttattgctgcagatgatcatcctattaacatcctttcaaatacagagcttttgaaaaagactcatttaaagaaaacgagtttatttgctttagcagacagattagggatatctccacagaaactaacacaatggtacattgataatcaaggaggtaagaatggctaa

SEQ ID NO: 27605 - protein, 558 aa, Streptococcus agalactiae serotype III
MKDFIEWKDFTFQYDVQSEPTLKGINLSIPKGEKVLILGPSGSGKSTLGHCLNGIIPNTHKGQYSGIFTINHKNAFDLSIYDKSHLVSTVLQDPDGQFIGLTVAEDIAFALENDVVAQEEMTSIVEMWAKRLEIAPLLSKRPQDLSGGQKQRVSLAGVLVDDSPILLFDEPLANLDPQSGQDIMALVDRIHQEQDATTIIIEHRLEDVLYERVDRVVLFSDGQIIYNGEPDQLLKTNFLSEYGIREPLYISALKNLGYDFEKQNTMTSIDDFDFSELLIPKMRALDLDKHTDKLLSVQHLSVSYDLENNTLDDVSFDLYKGQRLAIVGKNGAGKSTLAKALCQFIPNNATLIYNNEDVSQDSIKERAERIGYVLQNPNQMISQAMVFDEVALGLRLRGFSDNDIESRVYDILKVCGLYQFRNWPISALSFGQKKRVTIASILILNPEVIILDEPTAGQDMKHYTEMMSFLDKLSCDGHSIVMITHDMQLMLEYTDRAIVIDNGLIAADDHPINILSNTELLKKTHLKKTSLFALADRLGISPQKLTQWYIDNQGGKNG

SEQ ID NO: 27606 - DNA, 1677 bp, Streptococcus agalactiae serotype V
  CDS (1)..(1677): transl_table=11
atgaaagattttattgaatggaaggattttacctttcaatatgacgttcaatctgaaccaactttaaaagggattaacttaagcattcctaaaggtgaaaaggtcttgatattaggaccttcagggtcggggaagtcaacgcttggtcattgtttaaatggtattatcccaaatactcataaaggccaatatagtggtatttttacgattaaccataaaaatgcttttgacttgtcaatatatgacaagtctcatttagtttctacggttttacaagatccagatggccaatttataggattgacagtagcagaagatattgcttttgcattagaaaatgatgttgtagcacaggaagaaatggcctctatcgttgaaatgtgggcaaaacgtttagaaatagctcctcttttgtctaaacgtccacaagacttgtcgggaggacaaaaacaacgggttagtttagctggagttttagtagacgatagcccaattctattatttgatgagcctttggctaatctagatccacaatcgggacaagatatcatggcattggttgaccgtattcatcaagagcaagatgcgaccactattattattgaacatcgattggaagatgttttttatgagcgagtagatcgtgtagttctttttagtgatggacaaattatttataatggggagccggatcaacttttaaaaactaattttttatctgaatatggtattcgagaaccactgtatatttctgctctcaaaaatttaggatatgactttgaaaaacaaaatacaatgacgtctattgatgactttgatttcagtgaactattgatacctaaaatgcgagcattagatttagataaacatacagataaattattatcagtacagcatttgtcggtgtcatatgatttagagaataatactttagatgatgtttcgtttgatttatataaaggtcagcggttagctatcgttgggaaaaatggtgcaggtaaatctactttagctaaagcgttatgtcaatttatccctaataatgctactctaatttataataatgaagatgtcagtcaagactctataaaagaaagagcagaacgaattggctatgttttgcaaaatcccaatcagatgataagtcaagcgatggtttttgatgaagttgctctgggtctccgtttaagaggttttagtgataatgatatagaaagtcgtgtctacgatatattaaaggtttgtgggctctaccaatttaggaattggcctatatcggctctatcattcggtcagaaaaaacgtgttacgattgcttcgatactgattttaaatccagaagttattattttggatgaaccaacagctggtcaagatatgaagcattatactgaaatgatgtctttccttgataaactaagttgtgatggacataccattgttatgattacacatgatatgcagcttatgttagagtatacagatcgtgcaattgtaatcgacaatggtctgattgttgcagatgatcatcctattaacatcctttcaaatacagagcttttgaaaaagactcatttaaagaaaacgagtttatttgctttagcagacagattagggatatctccacagaaactaacacaatggtacattgataatcaaggaggtaagaatggctaa

SEQ ID NO: 27607 - protein, 558 aa, Streptococcus agalactiae serotype V
MKDFIEWKDFTFQYDVQSEPTLKGINLSIPKGEKVLILGPSGSGKSTLGHCLNGIIPNTHKGQYSGIFTINHKNAFDLSIYDKSHLVSTVLQDPDGQFIGLTVAEDIAFALENDVVAQEEMASIVEMWAKRLEIAPLLSKRPQDLSGGQKQRVSLAGVLVDDSPILLFDEPLANLDPQSGQDIMALVDRIHQEQDATTIIIEHRLEDVFYERVDRVVLFSDGQIIYNGEPDQLLKTNFLSEYGIREPLYISALKNLGYDFEKQNTMTSIDDFDFSELLIPKMRALDLDKHTDKLLSVQHLSVSYDLENNTLDDVSFDLYKGQRLAIVGKNGAGKSTLAKALCQFIPNNATLIYNNEDVSQDSIKERAERIGYVLQNPNQMISQAMVFDEVALGLRLRGFSDNDIESRVYDILKVCGLYQFRNWPISALSFGQKKRVTIASILILNPEVIILDEPTAGQDMKHYTEMMSFLDKLSCDGHTIVMITHDMQLMLEYTDRAIVIDNGLIVADDHPINILSNTELLKKTHLKKTSLFALADRLGISPQKLTQWYIDNQGGKNG

SEQ ID NO: 27608 - DNA, 1677 bp, Streptococcus mutans
  CDS (1)..(1677): transl_table=11
atgaaaccatttattgaattcaaggatttttcttttaaatatgatgctcaggcagagccaaccttgaaagaaatcacactttctattgagaaaggggaaaaggtactgattattgggccgtctggaagtggaaagtcaaccatagggcactgtttaaatggcattattcctaatatttataaagggcaggctgaaggttctttgacaatagatggcaaggatgtctttgatctatctatttatgaaaaatctcatcttgtttcaactgttttacaagatccagatgggcaatttattggcttaacagtagcagaagatcttgcttttgccttggaaaatgattgtgtagcccatgagacaatgtttgagagggtggacacttgggcagacaaattagatttaaaagaattgctccaacatcgtccgcaggatttatcaggcggacaaaagcaaagagtcagtttggcaggtgttatgattgatgaaagtcctgttttattatttgacgaacctttagctaatctagatccaaaatctggtcaggacaccatagatttgattgatcatcttcatcagacggcagaaacaactactattattattgaacatcgcttagaagatgttctttatcgacctgttgatcgggttatactgattaatgaaggtcaagttctttttaacggaagtcctaatgatcttttaaagactagtcttttacaagaaaatggtattcgtgagcccctttatgtgactgttttacgtcatcttggtttggatatcaaaaatacttctcatttagccaatcttgaacaacttgatctctctggtgtcagttttgcaggcgatatttccctaaaagaacctcaagagccacaagtcttgtttgatattcaacaccttaattttgcctatagttcagagcgtcccattttgaagaatctctcttttacccttaataagggggaacgtcttgctattgttggcaaaaatggtgcaggtaaatcaacgctggccaaagctctttgtcagtttatttcctacgctggccaaatcttttatcaaggccaggatattgcatctgattctatcaaggaacgctccgagcgtattggctatgttctccaaaatcctaatcaaatgattagtcaaacgatgatttttgatgaagttgctctgggactccgtttacgcggtgttgatgacagtcagatcgaaaagcgcgttttgaaggttttaaagacctgcggtctttatgagtttcgcaagtggcccatttcagccctttccttcgggcagaaaaaacgcgtgaccattgcttctattttggtattgaatccagaggtgattcttttagatgaaccgacagcaggacaagataagaagcattatacagaaatgatgtctttcttaaatgatttgcatgctttggggcatactattattatgattacacatgatatgcaactcatgttagaatattctgatcgagccttggttattagtgatggtcaaattctagctgatcaaagtcccattactctctttaatcaaccggacatactaagaatagccaatcttaaacaaactagcatttttgatttggcgcaaagactgaattgtgacccaattgctctgacacattactatattgatcagcaaggaggagaagatgaataa

SEQ ID NO: 27609 - protein, 558 aa, Streptococcus mutans
MKPFIEFKDFSFKYDAQAEPTLKEITLSIEKGEKVLIIGPSGSGKSTIGHCLNGIIPNIYKGQAEGSLTIDGKDVFDLSIYEKSHLVSTVLQDPDGQFIGLTVAEDLAFALENDCVAHETMFERVDTWADKLDLKELLQHRPQDLSGGQKQRVSLAGVMIDESPVLLFDEPLANLDPKSGQDTIDLIDHLHQTAETTTIIIEHRLEDVLYRPVDRVILINEGQVLFNGSPNDLLKTSLLQENGIREPLYVTVLRHLGLDIKNTSHLANLEQLDLSGVSFAGDISLKEPQEPQVLFDIQHLNFAYSSERPILKNLSFTLNKGERLAIVGKNGAGKSTLAKALCQFISYAGQIFYQGQDIASDSIKERSERIGYVLQNPNQMISQTMIFDEVALGLRLRGVDDSQIEKRVLKVLKTCGLYEFRKWPISALSFGQKKRVTIASILVLNPEVILLDEPTAGQDKKHYTEMMSFLNDLHALGHTIIMITHDMQLMLEYSDRALVISDGQILADQSPITLFNQPDILRIANLKQTSIFDLAQRLNCDPIALTHYYIDQQGGEDE

SEQ ID NO: 27610 - DNA, 1683 bp, Streptococcus pneumoniae
  CDS (1)..(1683)
atgaaagaagctataattgagtggaaggatttctctttccggtatgaaacacaacaagaaccgaccttgcaagggatagacttgaccatttacaagggagagaaagtcttaattgttggaccatctgggtcaggtaaatctaccttgggtcagtgtttgaatgggattattcccaatatttacaagggtcagacatatggagaatttttgataaagggtcaagtagcctttgatatgagcatctatgataagtctcatctggttagcacagttttgcaggatacagatgggcagtttattggcttgtctgtggcagaagatttggcgtttgctctggaaaatgatgtgacagccctagatgagatgaaaggtcgtgtttataaatgggctgaaaagctggaccttcttcctttactggatcagcgtcctcaggatttgtcaggtggacaaaagcagcgagtcagtctggctggtgtcttgattgatgaaagtccgattctcttgtttgatgagccactcgccaatctagatcccaagtcaggtcaggatattatcgaattgattgaccagattcataaggaagaggggacgacgactcttattatcgagcaccgtttggaggacgttctgcatcgccctgtggatcggattgtcttgataaacgatggtcgtatcctttttaatgggagccctgaccagttgcttgcgactgatttattgactcaaaatggaattcgagaacccctttatctaacgactctccgtcaattaggtgtggacttagtcaaggaagaacaattagcgaatctggataacttgtctatctcaaaaggtcaggttcagttgcagaatgaactggcaaaagaaaccccagcattgcagtcactctttagactagaggaagtatctttttcttatgatgatagaccgattttaaaatccctacatttagatattaaaaagggtgaaaagattgctattgtcggaaaaaatggagcagggaaatcaactctagccaaggctataagtagctttattcagacggaaggacgctatctttgggaaaaacaggatataaaaggcgattctgttgcagagcgggcggaacgagtaggatatgtgctacaaaatcctaatcaaatgatttcaaccaatatgatttttgatgaggtggctctagggctccgtttgcgaggtgtggatgagaaggaaattgaaacgagagtatatgaaaccttgaaaatctgtggactttatgaattccgtaattggcctatttctgccctgtcatttggtcagaaaaaacgtgtcaccattgcttcaattttggtcttaggagctgaaattattctcctagatgaaccgactgcaggtcaagatcagaagaactatactgagattatggaatttctcgaagagttacatcaaaaagggcataccattgtcatgattacccatgatatgcaattgatgctggattattcagaccgggtccttgtcatggtggatggagaattgattgccgatactgttccagccagtctgttgagcgatcctgagctgttagtaaaagccaatctaaaagaaacctccatctttaacttggctaagaaactagatgtggatccactggatttaacggcattttacaaagaaaggagagagggatgcaagctaaattaa

SEQ ID NO: 27611 - protein, 560 aa, Streptococcus pneumoniae
MKEAIIEWKDFSFRYETQQEPTLQGIDLTIYKGEKVLIVGPSGSGKSTLGQCLNGIIPNIYKGQTYGEFLIKGQVAFDMSIYDKSHLVSTVLQDTDGQFIGLSVAEDLAFALENDVTALDEMKGRVYKWAEKLDLLPLLDQRPQDLSGGQKQRVSLAGVLIDESPILLFDEPLANLDPKSGQDIIELIDQIHKEEGTTTLIIEHRLEDVLHRPVDRIVLINDGRILFNGSPDQLLATDLLTQNGIREPLYLTTLRQLGVDLVKEEQLANLDNLSISKGQVQLQNELAKETPALQSLFRLEEVSFSYDDRPILKSLHLDIKKGEKIAIVGKNGAGKSTLAKAISSFIQTEGRYLWEKQDIKGDSVAERAERVGYVLQNPNQMISTNMIFDEVALGLRLRGVDEKEIETRVYETLKICGLYEFRNWPISALSFGQKKRVTIASILVLGAEIILLDEPTAGQDQKNYTEIMEFLEELHQKGHTIVMITHDMQLMLDYSDRVLVMVDGELIADTVPASLLSDPELLVKANLKETSIFNLAKKLDVDPLDLTAFYKERREGCKLN

SEQ ID NO: 27612 - DNA, 1683 bp, Streptococcus pneumoniae
  CDS (1)..(1683): transl_table=11
atgaaagaagctataattgaatggaaggatttctctttccggtatgaaacacaacaagaaccgaccttgcaagggatagacttgaccatttacaagggagagaaagtcttaattgttggaccatctgggtcaggtaaatctaccttgggtcagtgtttgaatgggattattcccaatatttacaagggtcatacatatggagaatttttgataaagggtcaagcagcctttgatatgagcatctatgataagtctcatctggttagcacagttttgcaggatacagatgggcagtttattggcttgtctgtggcagaagatttggcgtttgctctggaaaatgatgtgacagccctagatgagatgaaaggtcgtgtttataaatgggctgaaaagctggaccttcttcctttactggatcagcgccctcaggatttgtctggtgggcaaaagcagcgagtcagtctagctggtgtcttgattgatgagagtccgattctcttgtttgatgagccactcgccaatcttgatcccaagtcaggtcaggatattatcgaattgattgaccagattcataaggaggaggggacgacgacccttattatcgagcaccgtttggaggatgttctgcattgccctgtggatcggattgtcttgataaacgatggtcgtatcctttttaatgggagccctgaccagttactggcgactgatttgttgacccaaaatggaattcgcgaacccctttatctcaccactctccgtcaattgggtgtggatttagtcaaggaagaacaattagcagatctggataacttgtctatctcaaaaggtcaggttcagttgcggacggaactggtaaaagaaaccccagaattgcagtcactctttagactagaggacgtgtcgttttcttatgatgatagaccgattttaaaatctcttcatttagatattaaaaagggtgaaaagattgccattgtcggaaaaaatggagcagggaagtcaactctagccaaggccttgagtagctttatccagactgaaggccgctatctttgggaaggacaggatataaaaggagattctgttgcagagcgggcggaacgagtaggctatgtgctgcaaaatcccaatcaaatgatttcaaccaatatgatttttgatgaggtggctctgggactccgtttgcgaggtgtggacgagcaggaaattgaaacgagagtctatgaaaccttgaaaatctgtggtctctatgaattccgtaattggcccatttctgccctgtcatttggtcagaaaaaacgtgtgactattgcctcaattttggtcttaggcgctgaaattatcctcctagatgaaccgactgcgggtcaagaccagaagaactatactgagattatggaatttctcgaagaactgcatcaacaagggcataccattgtcatgattacccatgatatgcaattgatgctggattattcagatcgagcccttgtcatggtggatggggaattgattgctgatactgatccagctagtctgttgagcaatcctgagctgttagtaaaagccaacctaaaagagacttctatcttcaacttggctaagaaactcgacgtggatccacttgctttaacggcattttacaaagaaaggagagaaggatgcaagctaaattaa

SEQ ID NO: 27613 - protein, 560 aa, Streptococcus pneumoniae
MKEAIIEWKDFSFRYETQQEPTLQGIDLTIYKGEKVLIVGPSGSGKSTLGQCLNGIIPNIYKGHTYGEFLIKGQAAFDMSIYDKSHLVSTVLQDTDGQFIGLSVAEDLAFALENDVTALDEMKGRVYKWAEKLDLLPLLDQRPQDLSGGQKQRVSLAGVLIDESPILLFDEPLANLDPKSGQDIIELIDQIHKEEGTTTLIIEHRLEDVLHCPVDRIVLINDGRILFNGSPDQLLATDLLTQNGIREPLYLTTLRQLGVDLVKEEQLADLDNLSISKGQVQLRTELVKETPELQSLFRLEDVSFSYDDRPILKSLHLDIKKGEKIAIVGKNGAGKSTLAKALSSFIQTEGRYLWEGQDIKGDSVAERAERVGYVLQNPNQMISTNMIFDEVALGLRLRGVDEQEIETRVYETLKICGLYEFRNWPISALSFGQKKRVTIASILVLGAEIILLDEPTAGQDQKNYTEIMEFLEELHQQGHTIVMITHDMQLMLDYSDRALVMVDGELIADTDPASLLSNPELLVKANLKETSIFNLAKKLDVDPLALTAFYKERREGCKLN

SEQ ID NO: 27614 - DNA, 1707 bp, Clostridium perfringens
  CDS (1)..(1707): transl_table=11
atggaaagaaaagcaataatagagtttaaagattttactgctcattatacagttcaatcaaagccaactttaaataacataaatttaactatatatgaaggagaaaaagttcttatagctgggccttcagggtcaggaaaaagtacattagctaactgtataaatggattaataccattttcaactgatattgaaatttcaggaagtcttaaaataaagggaaaagagacaaaggatttaagtgtttttgaaatatctaaaatggtaggaactgtacttcaagatccagatagtcaatttataggattaactgtagctgaggatatagcttttaaactagaaaataactgtgtatctcaagaagagatgaagaaaaaagttaattatgtatcaaaaatagttgatatagaaaatagattagacttagctccatatagtctttcaggtggacaaaaacagagggtaaccttagctggaactattgttgatgatgttgatatacttctttttgatgaacctttagcaagcttagatccagcagcaggaaaagcttctatagaacttatagataaaatacaaaaggaagaaaaaaagacagtaataataatagaacatagattagaagaagttttaaattgtgatgtagacagaataatacttatgaatgaaggagaaattattgctgatacaaatccaaatgaaatattagcttctaataaattaaaagagtgtggaataagagaacctttatacataacagctcttaaatatagtggatatgaattaaataaggaaatgaaccttgagaatatagacaagttaaagcttagtgatgatggcgagaaattaaaaacttggtataagagtttaaattttaataagaaagaaagagaagaagacaccctattagaatttaaaaatgtatctttttcttacgataagaaaaaagatatattaagtgatattaattttaaaattaatagaggagacatagtaagtgtagttgggaaaaatggtgcaggtaaatcaactatatctaagatcatatgtggatttttcaaagaatcaaagggagatatattatttgaaggaaaaagtttagatggaaagactattaaggaaagaggagaagaaataggagttgttcttcaaaatccaaatcaaatgatatctaaaacaatgatttttgatgaggttgcattaggcttaagagttagagggattgatgaaaaagaagttaaggaaagagtaattgaaaccctaaagacctgtggtttatatccatatagaaattggccagtttctgcacttagttttggacagaaaaagagggttactatagcttcaatactagttttaaatcctaaggttataatacttgatgaaccaacagcaggacaagactataaacattataatgaaataatggagtttcttctaaaacttaataaaaagggagttacaataattttaataactcatgatatgcatttaatgcttgaatatacagacaaggctattgtaatttcaaatggacgtaaaatagctgatacaacatcagcagaaatacttacagataaagaagttatagaaaaggcaagtttaaaagaaacatcattatatgatttagccttgaaatttaagttggaagaccctaaggattttgtttgtaaatttattgatttcgacaggggggcaagaaattag

SEQ ID NO: 27615 - protein, 568 aa, Clostridium perfringens
MERKAIIEFKDFTAHYTVQSKPTLNNINLTIYEGEKVLIAGPSGSGKSTLANCINGLIPFSTDIEISGSLKIKGKETKDLSVFEISKMVGTVLQDPDSQFIGLTVAEDIAFKLENNCVSQEEMKKKVNYVSKIVDIENRLDLAPYSLSGGQKQRVTLAGTIVDDVDILLFDEPLASLDPAAGKASIELIDKIQKEEKKTVIIIEHRLEEVLNCDVDRIILMNEGEIIADTNPNEILASNKLKECGIREPLYITALKYSGYELNKEMNLENIDKLKLSDDGEKLKTWYKSLNFNKKEREEDTLLEFKNVSFSYDKKKDILSDINFKINRGDIVSVVGKNGAGKSTISKIICGFFKESKGDILFEGKSLDGKTIKERGEEIGVVLQNPNQMISKTMIFDEVALGLRVRGIDEKEVKERVIETLKTCGLYPYRNWPVSALSFGQKKRVTIASILVLNPKVIILDEPTAGQDYKHYNEIMEFLLKLNKKGVTIILITHDMHLMLEYTDKAIVISNGRKIADTTSAEILTDKEVIEKASLKETSLYDLALKFKLEDPKDFVCKFIDFDRGARN

SEQ ID NO: 27616 - DNA, 1701 bp, Lactobacillus plantarum
  CDS (1)..(1701): transl_table=11
atgagcgcacccatcattagctttaaaaatttctcttttcaatataatagccaaacggaaccaactttacgtgatattaatctggatatttaccccggtgaaaaagtgttgattgctggaccttctggctccggtaaatctacattaggccggtgtttgaacggcttgattccgcagtcctatccaggaacagtgacgggccaagcaaggattgctggtcaaaccattactgagagctccatttttgcattatcccaagacgtcggtacggtactgcaagatcctgatagtcagttcgtcggtttgactgtcgtcgaagatatggctttctcattggaaaatgatcagcagacccaaccggccatgcgacaagcaactgaacagtgggcccaaactttagacctccaggacttattgactcaccgcccgcaggaattatctggtgggcaaaagcaacgggtcgccatggctggtgttctgatcgacaatagtaaaatcctattatttgatgaaccgctagcgagtcttgatccggcatcgggtaaagcctcgatggcactcattgatcagctgactcatacgcaggacctgaccgtcatcattattgagcaccgcattgaggacgtgttacagcaaccaatcgaccggctgattgtcatgcaagacggcgcgatcgtcgctaacgaccggccggaaacgattctgcggcaatcactcatgactcaactcgggctacgcgaaccattatacctttcagcgctcaaactagccggtgttgatctagcaacttgccaacacttggataacctccaagccttacaagtacccgacctcaccgcgacgttgcaaaactggaccaccggcgtacaactacagtcacccaccgttcatgaccaaccgttactcgcaattgagcatctgacattcgggtacgatcccgccaaaccaatcatcaacgatatcaccgtcacacttcatcagggtgaaatgattagtctagtgggtcaaaacgggactggtaagtcaacattaagcaatctgattactgggtttttgatgccacagtccggcaaaatgcgatttaacggtcattccctagctgaccaatcagtcaaagaacgtgccgaccaaattggttatatccttcaggaccccaatcaaatgatctctacaacgatgatttttgatgaagttgctgccggtttggtcctccgaggtgtcgctgacgatgaagtaaagcgccgtgtccaggccgttctgaaggtctgtggtctctatgagtttcgccactggcctatttctgcgctcagtttcggtcaaaagaaacgggtcacgattgcggccatcctcgtattagaaccggccatgctaattcttgatgagcctactgcgggccaagacttgcaacactatactgaaatgatgaccttcttaactaagatcaatcaggaacaacacatgacgattatgttgatcacgcatgatatgcacctaatgctagaatacacggatcgcacgattgtgttgggccacggcaacattttgatggatgctcgcccagccgatgtgttgaccaacgcatccattattcagcaagcttccttagccaagacaagtttatacaccctggcagaagcgcaccatttaaacccgacagaattcgtcgcaaaatttgttcaggctgaacgggaggcgcgctaa

SEQ ID NO: 27617 - protein, 566 aa, Lactobacillus plantarum
MSAPIISFKNFSFQYNSQTEPTLRDINLDIYPGEKVLIAGPSGSGKSTLGRCLNGLIPQSYPGTVTGQARIAGQTITESSIFALSQDVGTVLQDPDSQFVGLTVVEDMAFSLENDQQTQPAMRQATEQWAQTLDLQDLLTHRPQELSGGQKQRVAMAGVLIDNSKILLFDEPLASLDPASGKASMALIDQLTHTQDLTVIIIEHRIEDVLQQPIDRLIVMQDGAIVANDRPETILRQSLMTQLGLREPLYLSALKLAGVDLATCQHLDNLQALQVPDLTATLQNWTTGVQLQSPTVHDQPLLAIEHLTFGYDPAKPIINDITVTLHQGEMISLVGQNGTGKSTLSNLITGFLMPQSGKMRFNGHSLADQSVKERADQIGYILQDPNQMISTTMIFDEVAAGLVLRGVADDEVKRRVQAVLKVCGLYEFRHWPISALSFGQKKRVTIAAILVLEPAMLILDEPTAGQDLQHYTEMMTFLTKINQEQHMTIMLITHDMHLMLEYTDRTIVLGHGNILMDARPADVLTNASIIQQASLAKTSLYTLAEAHHLNPTEFVAKFVQAEREAR

SEQ ID NO: 27618 - DNA, 1587 bp, Methanosarcina acetivorans
  CDS (1)..(1587): transl_table=11
atgatagaactcaggaacttttcgtatacctacggaacagcagcaatccctgcgttaaaaaacataaatctggaaatccggaaaggagagctgctccttgttacggggcacagtgcagccggaaaaactaccttagcccttgcaatggcaggcattctccaccacgagatcggaggcaaaattgaggggaacatcagcttccagagcagggatgtaaaagaatttgacggcataaaggaactgagtcgacatataggggtggtttttgacgacgcggaatctcagctgatctttacgactgttgaagaagaaatcttttcaggacttgaaaaccgcggccatccggaaaaagagatggtacgcaggtcaaaagaggcaatggatttctgcgcaatcagccatctgaataaccgggctcctcacatgctttccggagggcagaagcaaaaagttgccctcgcagcaacccttgccctggatacggaagtcctgatccttgacgaagccactgccgaactagactcccaggcagtccgaaaggtattttctgtcctgaagaggctgaaagatgccggaaaaactattataatcatagaccacaatatcgaggatttccttgaaattggggacagggtcgtgcttcttgagaaaggagagataaaggcaataaaaagtccctcggaatttacctcaaagtcttcagatcttacttctacaaatcttacttctacttcagctcttcaaacagaccttcccctttcaagaacagctgagcagccgattatttccgtaaagaacctcacccagcgatatggagaaatcctggcgcttgacaacattgaccttgagatttaccctggggagcttgttgccattctgggggaaaatggttctggtaagactaccctcgtaaaacatttcaatggcctccttcgcccttactccggaaaagtgacagtaaaagggcttgagacctctacaacccccataaacgagcttgtgaaacataccgggctggtcttccagaacccggacaatatgctttttgaagatactgttgaagccgaaatcaatttcgggctgaataacatcggcgtaaaagggcctgaagcagtaggggcaatcctccgttccctggagcttgtaaacctgaatgataagcaaaaagtcttcccccgccatctcagccgaggagaaaggcagaggctggctgttgcctgcataattgcgatgaagcctgagctgatagtgcttgacgagcccaccacaggccttgatgccgaagagtccgaccggatgatgcagctcatgcgcaagctccagcaggaaggccatacaatagtcatggtgactcataacctgcagatcgtaagggaccatgtagaaagagtcattcggatggagtccggaaaagttgtggaggattcggcaaacaggaaattttccggcaaaggatctgtcaaggaagaaagtgactacaaaggacatgtcagtaaagaaattgttagtgaagaaattgttagtgaagaaattgttagtgaagaaagtgttagtgaagaatgtgtaagaggaggcacatgcgcatga

SEQ ID NO: 27619 - protein, 528 aa, Methanosarcina acetivorans
MIELRNFSYTYGTAAIPALKNINLEIRKGELLLVTGHSAAGKTTLALAMAGILHHEIGGKIEGNISFQSRDVKEFDGIKELSRHIGVVFDDAESQLIFTTVEEEIFSGLENRGHPEKEMVRRSKEAMDFCAISHLNNRAPHMLSGGQKQKVALAATLALDTEVLILDEATAELDSQAVRKVFSVLKRLKDAGKTIIIIDHNIEDFLEIGDRVVLLEKGEIKAIKSPSEFTSKSSDLTSTNLTSTSALQTDLPLSRTAEQPIISVKNLTQRYGEILALDNIDLEIYPGELVAILGENGSGKTTLVKHFNGLLRPYSGKVTVKGLETSTTPINELVKHTGLVFQNPDNMLFEDTVEAEINFGLNNIGVKGPEAVGAILRSLELVNLNDKQKVFPRHLSRGERQRLAVACIIAMKPELIVLDEPTTGLDAEESDRMMQLMRKLQQEGHTIVMVTHNLQIVRDHVERVIRMESGKVVEDSANRKFSGKGSVKEESDYKGHVSKEIVSEEIVSEEIVSEESVSEECVRGGTCA

SEQ ID NO: 27620 - DNA, 2343 bp, Bifidobacterium longum
  CDS (1)..(2343)
atgctcaaggacattcgtttcagctatgaccgcggcacctcatgggctttggatggcgtttcactcacggtccatgccggcgagcgcctatgcttggtcggtccgaacgggtcgggcaaatccacgttagcccgtctgattgcgggattgaccgcgccggacggtggtgaagtgacgttactggggcaacgcgtgtacgcagccggcccgaatgccgatgcctatcgtgctgcccgccacggcatcggtatggtgttccagaatcccgaggatcagctggtcaccaccgtgttggaggatgacgtggcctttggcccggagaatctcgggctggagcgcgagctcatcggcgagcgtatcgttgattcattgcaggccgtggggttggcgaacttacgccagtccgacccgacccgtatgagcggcgggcagcagcaacgcgcctccatcgccggcatgctggccatgaacccggcaatgctggtattggatgagccgaccgccatgctggacgaatccgcacgcgccgaagttatgcgcattttggatgatttgcaggcgcgcggcaccactattgtgcatgtcacgcatcatccagatgaaaccgttcatgccgatcgcatcgtgcacatggaggccgggcgaatcattggtatcactgcagccgtcgataatcgatccccgctagcggaggctgtctcgcaaagcgagactgagggtagtatcggcacagaagccgcccccagtcgccctacgaacgacagcccccgccagcgggagcgcgaagacggctccgaactgccgctgctctccgatggcatcggtgatatgacgaaccccattattcgcgtctcgcatctgacctatcgctatccttcggccaaacgggcggttatcgatgacctgtcgttcaccatcgcgcgcggtgaaaccgtggcactgatgggcgtgaatggttcgggcaagtcgacgctggtgcgcatgttgtgcgcactgactgcgccgaccgccggcagcatcgaagtggccggtgttccggtggcctcgaccggcaagcgcggtcgcaacgtgcgcccgaagtcggcgaatcgcaagcaattagcgcaattgcgccggcatgtgggttacgtgatgcagcatccagagcatcagctgttcgctgacacggtagccgaggacgtggcgtacggcccacgcaaccaagggcttggcgagaccgaggtagccgaccgcgtgcgcgaatcactggaactgctgcatatcgggcatcttgccgaccgctcccccttcgacctgtccggcgggcaacaacgattggcagccattgccggcgtgctggcttgcaatcctgacgtgctcatcatggacgagccgaccgcgagtctggacgcccaagccaagaagcgtatccatgagctgttgcgcacgctcaaatcgcgtggcgtgaccgtgctcatcatcacccatgaccgggaggaggccgagcaaatcgccgaccgcgtggtccgtatgccgattgccgcccccgcatccggcggccccgtcacggccaccgtcaccgagccggccgtatcctccaacggccctgcgcactcagtgatacaccgacttgacccgcgcgtgaagatggtgggcttcctggccgccatgttcacgatgttcgcggtgaacacgccaacccagctcgcgctgggcatcgccatcaccctggccgttatcgcggcggcacgcctgaacccgttacgggtgcttgaatccattcatccgattctgatcctgctggtgctgatgggcgtggtcaatctgtttgtggtacgcaccggcacgccggtggtggcgcttggcccgctaagcatcaccgatcagggcgtgaccatagccgtgctgtacgcctgccgtttcgcattggtaatcattctgggcgcggtgttcctcactaccaccacgcctaccgccatgaccgacgccttcgccaccttgatcagtccgctcaaccggctcggtatccatgcccaagaaatcgcgctggtcatgagtctggcattgcgattcattccaacgctgaccgacgaaacccgcgccatcgtcgacgcccaatccgcgcgtggcggttccatcgaaaccggttcactggcccagcgcatcaaggcgatgagcgcgattatcgtgccgattttcgccggcacgttgcgtcacgcggacaacctgagcctcgcacttgacgcccgctgctacgaggagggcatccgccgcacccactggcgtgccctgaccatcgccgcgcgagatctcatattcgccgctgccgtcatcatctacatcgcggccatcatcgcgctgtag

SEQ ID NO: 27621 - protein, 780 aa, Bifidobacterium longum
MLKDIRFSYDRGTSWALDGVSLTVHAGERLCLVGPNGSGKSTLARLIAGLTAPDGGEVTLLGQRVYAAGPNADAYRAARHGIGMVFQNPEDQLVTTVLEDDVAFGPENLGLERELIGERIVDSLQAVGLANLRQSDPTRMSGGQQQRASIAGMLAMNPAMLVLDEPTAMLDESARAEVMRILDDLQARGTTIVHVTHHPDETVHADRIVHMEAGRIIGITAAVDNRSPLAEAVSQSETEGSIGTEAAPSRPTNDSPRQREREDGSELPLLSDGIGDMTNPIIRVSHLTYRYPSAKRAVIDDLSFTIARGETVALMGVNGSGKSTLVRMLCALTAPTAGSIEVAGVPVASTGKRGRNVRPKSANRKQLAQLRRHVGYVMQHPEHQLFADTVAEDVAYGPRNQGLGETEVADRVRESLELLHIGHLADRSPFDLSGGQQRLAAIAGVLACNPDVLIMDEPTASLDAQAKKRIHELLRTLKSRGVTVLIITHDREEAEQIADRVVRMPIAAPASGGPVTATVTEPAVSSNGPAHSVIHRLDPRVKMVGFLAAMFTMFAVNTPTQLALGIAITLAVIAAARLNPLRVLESIHPILILLVLMGVVNLFVVRTGTPVVALGPLSITDQGVTIAVLYACRFALVIILGAVFLTTTTPTAMTDAFATLISPLNRLGIHAQEIALVMSLALRFIPTLTDETRAIVDAQSARGGSIETGSLAQRIKAMSAIIVPIFAGTLRHADNLSLALDARCYEEGIRRTHWRALTIAARDLIFAAAVIIYIAAIIAL

SEQ ID NO: 27622 - DNA, 1695 bp, Photobacterium profundum
  CDS (1)..(1695): transl_table=11
atgactattgaattctctaatttcacgttcaagtattgggcgttagaaaagccaaccctaaaaaatattaacctaacgatagggaaaggcgaaaaagttgttattgttggtccaagcggcagtgggaaatcaacactaggccaatgcttgaatggcttaatcccctttgccgttaaaggcgattgctctggtagcctcaaaattaacggtaaagacacaaaatcattagatcttcatcaatgtaccaatattgttggtacagtattgcaagatactgatggacaatttgtcggtctaagcgtgggcgaagatattgcctttgcacttgaaaaccaaatggttattcaagaagacatgcatactattgttaaagacaccgcaaaaatggttgagcttgatgacatcttagatgtgtctccttttgaccttagtggtggtcaaaaacagcgcgtatctcttgcgggcgttatggtcgatgatgtcgatatcttattgtttgatgaaccgctggcaagcttggatcccaaaacaggcaaagccgccatcgatattattgatcaccttcatcgtgatacaggtaaaacggttatcattattgagcatcgccttgaagatgttcttcatcgccccgttgatcgcatcattatgatggaacaaggtgaaattgttgccaacatgacgcccgaccaactcattgccagtgacctattagaacagcatggaatacgtgagcctctttacatctctgctttaaaagcggctggatgccaaataaccgaagacgataaaccagcttatttttcaacgttaaatcttgataaatttaagcctcaaatcgaaaactggtaccaccaatcattcgttgcatgtactccagaaaacagtgagcgcttgcttactgtcaataacctttcgtactcatacgatggtattaaaaatacgcttgatgatgtgagctttcatatcaataaaggggaatttgtttccattttaggtaagaatggttcagggaaatcaacaataacgcgtttaatcatgggtgtgttagaaccagatactgggtctattttcatgaacggtcaagatttagcacaaagctctatttttgaacgtagccaaaagatcgggattgtattacaaaaccccaatcatatgatttcacaccacatgatttttgatgagattgcatcaggtttacgcaaccgaggaatcaatgaagccacagtagaacgcaaagttttcgatattcttgagctatgcggtttgaaaaaataccgccattggccaattgatgctttaagttatggtcagaagaagcgcgtaacgattgccactatcttagtgcttgagcctgaactcttaattctggatgaaccgacagcaggtcaagactaccatcactacacattaatgatggagtttgtgcgagagcttaaccgcaaactcggcattaccattctgatcatctcgcatgatatgcaccttgttctcgaatatactcagcgtgccattgtcattgctaatagccaattgttagccgatgcacctgtaaacaccatttttagccagccagctctgctagaaaaagccaacttaaccgtaaccagcctgtattcattagcacatgcaatggggattgaacgtatcgataacttcattcattgctttattgaacatgaggcaaagaataaataa

SEQ ID NO: 27623 - protein, 564 aa, Photobacterium profundum
MTIEFSNFTFKYWALEKPTLKNINLTIGKGEKVVIVGPSGSGKSTLGQCLNGLIPFAVKGDCSGSLKINGKDTKSLDLHQCTNIVGTVLQDTDGQFVGLSVGEDIAFALENQMVIQEDMHTIVKDTAKMVELDDILDVSPFDLSGGQKQRVSLAGVMVDDVDILLFDEPLASLDPKTGKAAIDIIDHLHRDTGKTVIIIEHRLEDVLHRPVDRIIMMEQGEIVANMTPDQLIASDLLEQHGIREPLYISALKAAGCQITEDDKPAYFSTLNLDKFKPQIENWYHQSFVACTPENSERLLTVNNLSYSYDGIKNTLDDVSFHINKGEFVSILGKNGSGKSTITRLIMGVLEPDTGSIFMNGQDLAQSSIFERSQKIGIVLQNPNHMISHHMIFDEIASGLRNRGINEATVERKVFDILELCGLKKYRHWPIDALSYGQKKRVTIATILVLEPELLILDEPTAGQDYHHYTLMMEFVRELNRKLGITILIISHDMHLVLEYTQRAIVIANSQLLADAPVNTIFSQPALLEKANLTVTSLYSLAHAMGIERIDNFIHCFIEHEAKNK

SEQ ID NO: 27624 - DNA, 1740 bp, Vibrio parahaemolyticus
  CDS (1)..(1740): transl_table=11
atgacaatcgaattttctaacttctcttttagatatgagtcgctggacaaaccgacgctaaaaaatatcaatctaaggatagagaaaggagagaaaatcgtcattattggtccaagtggtagtggtaaatctacccttgggcaatgtcttaacggactgatcccacacgcaatcaaaggggaaaccagtggaacattgaccatctatggtcaagacaccgcccctttcgacatgcaccaatacactgagcaagttggcaccgtactgcaagatacggacagccaatttgtcggcttgagcattggcgaagacatcgcatttgcgctggaaaaccagctaacttctaacatcgacatgtacccattggtcaaagccacggccaaaatggtcgacttggaacagatgttagatcgctctccccacgatttatctggcgggcagaaacagcgtgtttctttggcaggcattctcgtcgatgacgtcgatatccttttgtttgatgaaccactagctgcgcttgaccctaaaacgggtaaaaaaaccatcgagatcatcgatgatctacaccgcgaaacgggcaaaaccatcgtaatcattgagcatcgtcttgaggacgttctgcatcgctcagttgaccgtattatcttgatggaaagcggcgaaatcattgccgatacaacgccagatgaaattttagcgtcgcctctgctagaagattacggcatccgcgaaccgctttatatttcggctctgaaagaagcaggctgcgcgattgagggcgatgcaaaaccttcgagcttaactaccttaccgttggagcaatataaaccaacagtacaagcgtggtttgatggttcaacagcacaaccacctaaaacgccagccgagactttgcttgaagtccgtggcctcacctattcttacgacggtgagaaaaacgcgctagaagacgtgagttttgacatcaagcgtggcgagtttgtctctgtacttggcaaaaatggctcgggtaaatcgaccatcaccaaactgattatgggcgttattgaagcggatagcggctcaatgagcatgaatggtcaagatctaaacgaactgaccatcttcgagcgcagccagaaagtgggcgtggtgatgcaaaacccgaatcacatgatttcccatcacatgattttcgacgaggtggccttcggcctccgtaatcgtggcattaaagagaaacaaatcgaagctaaagtacttgaagtccttgagctgtgcggtttgagcaaataccgtcactggccaatcgaagcattgagctacggccagaaaaagcgcgtaaccattgcgtcaattttggtcttggaaccagagcttctgatccttgatgaaccgacggcaggtcaggactaccggaactacacgtctatgctgagtttcatcgaaaagctcaatcgcgagttgggcgtaaccgtgatgatcatctctcatgacatgcatttagtgctggaatacactacgcgctctatcgtgattgcagacagtaaattagtcgcggatgcaccaatgacgcaggtattcagcagtccagagctactagaccaagcaaacctcaccacaacaagtctgtttgatttggctacgaaagttggtatcgaagacaccaatggctttatgcagcattttatcaatgtagaaaaagcgcaccgccaacaaaaaagcggcgaagtaaaccaaccagagaaagcggtggcatga

SEQ ID NO: 27625 - protein, 579 aa, Vibrio parahaemolyticus
MTIEFSNFSFRYESLDKPTLKNINLRIEKGEKIVIIGPSGSGKSTLGQCLNGLIPHAIKGETSGTLTIYGQDTAPFDMHQYTEQVGTVLQDTDSQFVGLSIGEDIAFALENQLTSNIDMYPLVKATAKMVDLEQMLDRSPHDLSGGQKQRVSLAGILVDDVDILLFDEPLAALDPKTGKKTIEIIDDLHRETGKTIVIIEHRLEDVLHRSVDRIILMESGEIIADTTPDEILASPLLEDYGIREPLYISALKEAGCAIEGDAKPSSLTTLPLEQYKPTVQAWFDGSTAQPPKTPAETLLEVRGLTYSYDGEKNALEDVSFDIKRGEFVSVLGKNGSGKSTITKLIMGVIEADSGSMSMNGQDLNELTIFERSQKVGVVMQNPNHMISHHMIFDEVAFGLRNRGIKEKQIEAKVLEVLELCGLSKYRHWPIEALSYGQKKRVTIASILVLEPELLILDEPTAGQDYRNYTSMLSFIEKLNRELGVTVMIISHDMHLVLEYTTRSIVIADSKLVADAPMTQVFSSPELLDQANLTTTSLFDLATKVGIEDTNGFMQHFINVEKAHRQQKSGEVNQPEKAVA

SEQ ID NO: 27626 - DNA, 1725 bp, Vibrio vulnificus
  CDS (1)..(1725): transl_table=11
atgacaatcgaattttctaacttctcttttagatatgagtcgctggacaaaccgacgctaagaaatatcaatctaaggatagagaaaggagagaaaatcgtcattattggtccaagtggtagtggtaaatctacccttggccagtgtttaaatgggcttatcccccacgcaatcaaaggtgaagtgtccggctctttgaccatcaacggccaagaaacggcgacgttcgccatgcaccaattcaccgaacaggtggggacagtgctgcaagacaccgacagccaatttgtcggtttaagcatcggtgaagacatcgcgtttgcacttgaaaaccagctcaccgccaatattgagatgtactcgctggtcaaagccaccgcgaagatggtggaccttgagcaaatgttgcaacgctcgccacacgatctctcgggcggacagaaacaacgtgtttcgttggcaggcattctcgtggatgatgtcgatattctgctgtttgatgaacctttggcagcgctcgatccaaaaaccggcaaacgtaccattgaaatcattgatgatctccatcgcaagacaggcaaaaccgtggtcatcatcgagcaccgtctcgaggatgtgctgcatcgtcacgtcgaccgcatcattctgatggatggcggtgagattattgctgataccacgccagacgagctgcttgcttcgccattattggctcaatatggcattcgcgaaccgctttacttaacggcgctaaaatccgctggttgccatcttgcgctagacgatcacccctcaagcttaagcgagttacccttggccaattatcagcacgcaatggcagattggtttcaccaagcgaacacgacaagcaaccacattcgttcagagactttgcttgacgtgcgcaacttaacctactcctacgatggtgagaaaaacgcattagaaggggtaagtttcaatgtgcaacgcggcgaatttgtctcgatattgggcaaaaatggttccggtaaatcgaccatcaccaagctgatcatgggcgtcattgaacccgatgacggcacgatgcacttaaacggccaagatcttagcgagctgaccattttcgagcgcagtcaaaaagtaggtgtggtgatgcaaaaccctaaccacatgatttcgcaccatatgatttttgacgaagtcgcatttggcctgcgcaatcgaggttgggacgagcagcaagtcaacgacaaggtgcttgaagcgctcgaattgtgtggtctcagcaaatatcgtcattggccaattgaagcactcagctacggccagaagaaacgcgtcaccatcgcttcgattctcgccctagagcctgagctattgatgcttgacgagcccaccgcaggtcaggattaccgcaactacacctcaatgctgagtttcattgaaaaactcaatcgagagctaggcatcaccgtcgtgatcatttctcatgacatgcacttggtactggaatacaccacacgctcaatcgtgattgcagatagccagcttgtggcggatgcgccgatgacggatgttttcagtaaccctgcattgctagaccgagcgaacctaaccaccaccagcctgtatgagcttgcgacgcgcttgaacatggctgaaaccaacgcctttatgcagcattttattgatgtagaaaaagcttctcgcttagagaaaaccgttgagagaaatgtggcatga

SEQ ID NO: 27627 - protein, 574 aa, Vibrio vulnificus
MTIEFSNFSFRYESLDKPTLRNINLRIEKGEKIVIIGPSGSGKSTLGQCLNGLIPHAIKGEVSGSLTINGQETATFAMHQFTEQVGTVLQDTDSQFVGLSIGEDIAFALENQLTANIEMYSLVKATAKMVDLEQMLQRSPHDLSGGQKQRVSLAGILVDDVDILLFDEPLAALDPKTGKRTIEIIDDLHRKTGKTVVIIEHRLEDVLHRHVDRIILMDGGEIIADTTPDELLASPLLAQYGIREPLYLTALKSAGCHLALDDHPSSLSELPLANYQHAMADWFHQANTTSNHIRSETLLDVRNLTYSYDGEKNALEGVSFNVQRGEFVSILGKNGSGKSTITKLIMGVIEPDDGTMHLNGQDLSELTIFERSQKVGVVMQNPNHMISHHMIFDEVAFGLRNRGWDEQQVNDKVLEALELCGLSKYRHWPIEALSYGQKKRVTIASILALEPELLMLDEPTAGQDYRNYTSMLSFIEKLNRELGITVVIISHDMHLVLEYTTRSIVIADSQLVADAPMTDVFSNPALLDRANLTTTSLYELATRLNMAETNAFMQHFIDVEKASRLEKTVERNVA

SEQ ID NO: 27628 - DNA, 1593 bp, Escherichia coli O157
  CDS (1)..(1593): transl_table=11
gtgttagtttccagtaacgtcaccatgcagttcggcagtaagccgttgtttgaaaacatttccgtcaaatttggcggcggcaaccgttacggcctgattggcgcgaacggtagtggtaaatccacctttatgaagatcctcggcggcgaccttgagccgacgctgggtaacgtttccctcgatcccaacgagcgcattggtaaactgcgtcaggatcagtttgcctttgaagagttcactgtgctggatacggtgatcatggggcataaagagttgtgggaagtgaagcaggagcgcgaccgcatctatgctttgccggaaatgagtgaagaagacggctataaagtggccgatctggaagttaaatacggcgaaatggacggttactctgcggaagctcgtgccggtgaattgttgcttggcgtgggaattccagtggaacagcactacggcccgatgagtgaagttgctcctggctggaagctgcgtgtgttgctggcgcaggcgctgtttgctgatccggatattctcctgctcgacgaaccgaccaacaacctcgacatcgacaccattcgctggctggaacaggtgctgaacgagcgtgacagcaccatgatcatcatctcgcacgaccgtcacttccttaacatggtctgtacccacatggcggatctggattacggcgagctgcgcgtttatccgggtaactacgatgagtacatgacggcggcgacccaggcgcgtgaacgtctgctggccgataacgccaagaagaaagcgcagattgctgagctgcaatctttcgttagccgctttagcgccaacgcctcgaaatctcgccaggcaacttcgcgcgcgcgccagattgataaaatcaaactggaagaggtgaaagcctccagccgtcagaacccgttcatccgttttgaacaggataagaagctgttccgtaacgcgctggaagtggaaggtctgaccaaagggtttgataacggtccgctgtttaaaaatctcaacctgctgctggaagtcggtgaaaaactggcggtactgggtaccaacggcgtcggtaaatcaacgctgttgaaaacgctggtgggcgatctgcaaccggacagcggcaccgtaaaatggtctgaaaacgcgcgcattggttactatgctcaggaccacgaatatgagtttgaaaatgatctgaccgtgttcgaatggatgagccagtggaagcaggaaggcgatgacgagcaggcggtgcgcagtattctcggtcgtttgctgttcagccaggacgacatcaaaaagcctgctaaagtgctttccggtggagaaaaagggcggatgctttttggtaagttaatgatgcagaagccgaacattctgatcatggacgaaccgaccaaccacctggatatggaatccatcgagtcactgaacatggcgctggaactgtatcagggcacgctgatctttgtttcacacgaccgtgagttcgtaagctccctggcgacccgcattctggaaatcaccccggaacgcgtgatcgactttagcggtaattacgaagattacctgcgtagtaaagggatcgagtaa

SEQ ID NO: 27629 - protein, 530 aa, Escherichia coli O157
MLVSSNVTMQFGSKPLFENISVKFGGGNRYGLIGANGSGKSTFMKILGGDLEPTLGNVSLDPNERIGKLRQDQFAFEEFTVLDTVIMGHKELWEVKQERDRIYALPEMSEEDGYKVADLEVKYGEMDGYSAEARAGELLLGVGIPVEQHYGPMSEVAPGWKLRVLLAQALFADPDILLLDEPTNNLDIDTIRWLEQVLNERDSTMIIISHDRHFLNMVCTHMADLDYGELRVYPGNYDEYMTAATQARERLLADNAKKKAQIAELQSFVSRFSANASKSRQATSRARQIDKIKLEEVKASSRQNPFIRFEQDKKLFRNALEVEGLTKGFDNGPLFKNLNLLLEVGEKLAVLGTNGVGKSTLLKTLVGDLQPDSGTVKWSENARIGYYAQDHEYEFENDLTVFEWMSQWKQEGDDEQAVRSILGRLLFSQDDIKKPAKVLSGGEKGRMLFGKLMMQKPNILIMDEPTNHLDMESIESLNMALELYQGTLIFVSHDREFVSSLATRILEITPERVIDFSGNYEDYLRSKGIE

SEQ ID NO: 27630 - DNA, 1590 bp, Escherichia coli
  CDS (1)..(1590): transl_table=11
atgacgcaaactctgttagcgattgaaaatttgtcggtgggttttcgccatcagcaaaccgtacgtacagtagtcaatgatgtttcactacagattgaggctggcgaaacgctggcgctggtgggtgagtcaggttcaggcaaaagcgttaccgcgctgtcaattttacgcctgctcccttccccgccggttgaatatctctccggcgatattcgttttcatggcgaatcgctgcttcacgccagcgatcaaacgttgcgcggtgtacgcggtaataagatcgccatgatttttcaggaaccgatggtgtcgttaaatccattgcataccctggaaaaacagctttatgaagtgctttcactccaccgcgggatgcgtcgggaagcggctcgtggcgaaattcttaactgccttgatcgcgttggtatccgccaggcggcaaaacggctgacagattatccgcatcagctctccggcggcgaacggcagcgggtgatgattgcgatggcgctgttaacgcgaccggaattattaattgccgatgaaccgaccaccgcactggacgtctctgtccaggcgcagattttacagctgttgcgcgaactgcaaggcgagctgaatatgggcatgctgtttattactcataacctcagcattgtcagaaaactggcccaccgcgtggcggtaatgcaaaacggtcgctgtgtcgagcaaaattacgccgctacgctatttgcatcacccactcatccttacacacaaaagctactcaacagtgaaccgtcaggcgatccagtgccgttgccagaacctgcctcaacgttgctggatgttgaacagcttcaggttgccttccccattcgcaaagggattttgaagcgcattgtggatcataatgtggtggtgaaaaacatcagttttacgctacgagcgggtgaaacactgggtttagtgggcgagtccggttccgggaaaagtacgacgggactggcgctgctgcgactgattaattctcagggcagcatcatctttgacggtcagccactgcaaaatttaaatcgccgccagctgttacctattcgtcatcgcattcaggtggtatttcaggatccaaactcctcgctcaacccacgactcaacgttttgcagattattgaggaaggcttacgggttcaccagccgacgctttctgccgcacaacgcgaacaacaagtgatagccgtgatgcatgaagtgggattagatcctgaaacacgccaccgttatccggcggagttctctggtggtcagcgacaacgtattgcgattgccagggcattaattcttaagccctcgctgatcatacttgatgaaccgacatcatcactcgacaaaacggtacaggcgcaaatattgacgctattgaaatcattgcaacaaaagcatcaactggcctatttgtttatcagccacgatttgcacgttgtccgcgcgttatgtcatcaggttatcatactgcgacaaggggaagtagtggaacaaggaccgtgcgcgcgcgtgtttgccacaccgcagcaggagtatacgcgtcagctactggcgttgagctga

SEQ ID NO: 27631 - protein, 529 aa, Escherichia coli
MTQTLLAIENLSVGFRHQQTVRTVVNDVSLQIEAGETLALVGESGSGKSVTALSILRLLPSPPVEYLSGDIRFHGESLLHASDQTLRGVRGNKIAMIFQEPMVSLNPLHTLEKQLYEVLSLHRGMRREAARGEILNCLDRVGIRQAAKRLTDYPHQLSGGERQRVMIAMALLTRPELLIADEPTTALDVSVQAQILQLLRELQGELNMGMLFITHNLSIVRKLAHRVAVMQNGRCVEQNYAATLFASPTHPYTQKLLNSEPSGDPVPLPEPASTLLDVEQLQVAFPIRKGILKRIVDHNVVVKNISFTLRAGETLGLVGESGSGKSTTGLALLRLINSQGSIIFDGQPLQNLNRRQLLPIRHRIQVVFQDPNSSLNPRLNVLQIIEEGLRVHQPTLSAAQREQQVIAVMHEVGLDPETRHRYPAEFSGGQRQRIAIARALILKPSLIILDEPTSSLDKTVQAQILTLLKSLQQKHQLAYLFISHDLHVVRALCHQVIILRQGEVVEQGPCARVFATPQQEYTRQLLALS

SEQ ID NO: 27632 - DNA, 1512 bp, Escherichia coli
  CDS (1)..(1512): transl_table=11
atgttcacggcaacagaggcagtcccggtagcaaaagtggtggcaggaaataagcgttatcccggcgtcgttgcgctggataacgttaacttcacgctcaataaaggcgaagttcgtgcgctgttaggtaaaaacggcgcgggcaaatcgactctcattcgaatgcttaccggcagcgaacgcccggatagcggtgatatctggattggcgagacgcgactggaaggtgacgaagctacgctgactcgccgtgccgctgaactgggggtgcgcgcggtttatcaggagttaagtctggtggaagggctgacagtggcggaaaacctctgcctcggtcagtggccccgccgcaacggcatgattgattacctgcaaatggcgcaggatgcccaacgttgcttacaggcgctgggcgttgacgttagtcctgaacaacttgtttcaacgctaagcccggcgcaaaagcagctggtggaaattgcgcgggtgatgaagggcgagccgcgcgtggtcattcttgatgaacctaccagttcgcttgcgagtgcggaagttgaactggtgatcagcgcggtgaaaaagatgtcggcactgggcgtggcggtgatttatgtcagccaccggatggaagaaattcgccgcattgcctcctgtgccaccgttatgcgcgatggtcaggtggcgggcgatgtgatgctcgaaaacacctccacgcatcatattgtgtcgctgatgctcgggcgcgatcacgttgatattgcgccggtagcccctcaggaaattgtggatcaggccgtgctggaagtccgtgcgttacgccataagcccaagctggaggatatcagttttacgctacgtcgtggcgaagtgctcggcattgctggtctgctgggggcagggcgcagtgaattgctgaaggcgattgttgggctggaggagtatgaacagggcgaaattgttatcaacggcgagaaaatcacgcgccccgattacggcgacatgctgaaacgcggcattggctatacgccagaaaaccgcaaagaagcggggatcattccctggttgggcgttgacgaaaatacagtgctgaccaatcggcaaaaaatcagcgccaacggtgtgctgcaatggtccaccatccgccgcctgaccgaagaggtgatgcagcggatgacggtcaaggccgccagtagcgaaacacccatcggcacgctttctggtggcaatcagcaaaaagtggtgatcggtcgttgggtctatgctgccagccagattttgttgctcgacgagccaacgcgcggcgtcgatatcgaagccaaacagcagatttaccgtattgtccgtgagctggctgccgaaggaaaaagcgtggtgtttatctccagtgaagtggaggagttgccgctggtgtgtgaccgcatcctgttattacagcacggcacgttctcgcaggagtttcacgctccggtcaatgtggatgagctgatgtccgccattctgtctgtgcactga

SEQ ID NO: 27633 - protein, 503 aa, Escherichia coli
MFTATEAVPVAKVVAGNKRYPGVVALDNVNFTLNKGEVRALLGKNGAGKSTLIRMLTGSERPDSGDIWIGETRLEGDEATLTRRAAELGVRAVYQELSLVEGLTVAENLCLGQWPRRNGMIDYLQMAQDAQRCLQALGVDVSPEQLVSTLSPAQKQLVEIARVMKGEPRVVILDEPTSSLASAEVELVISAVKKMSALGVAVIYVSHRMEEIRRIASCATVMRDGQVAGDVMLENTSTHHIVSLMLGRDHVDIAPVAPQEIVDQAVLEVRALRHKPKLEDISFTLRRGEVLGIAGLLGAGRSELLKAIVGLEEYEQGEIVINGEKITRPDYGDMLKRGIGYTPENRKEAGIIPWLGVDENTVLTNRQKISANGVLQWSTIRRLTEEVMQRMTVKAASSETPIGTLSGGNQQKVVIGRWVYAASQILLLDEPTRGVDIEAKQQIYRIVRELAAEGKSVVFISSEVEELPLVCDRILLLQHGTFSQEFHAPVNVDELMSAILSVH

SEQ ID NO: 27634 - DNA, 25 bp, Artificial sequence
  (1)..(25): primer
atgtcatcgttgcaaattttgcaag

SEQ ID NO: 27635 - DNA, 28 bp, Artificial sequence
  (1)..(28): primer
ttaatatatttttgtcagcacatagcga

SEQ ID NO: 27636 - protein, 762 aa, Artificial sequence
  Variant (2)..(4): xaa in position 2 to 4 is any amino acid
  Variant (6)..(7): xaa in position 6 to 7 is any amino acid
  Variant (9)..(12): xaa in position 9 to 12 is any amino acid
  Variant (16)..(17): xaa in position 16 to 17 is any amino acid
  Variant (18)..(21): xaa in position 18 to 21 is any or no amino acid
  Variant (23)..(23): xaa in position 23 is any amino acid
  Variant (27)..(31): xaa in position 27 to 31 is any amino acid
  Variant (33)..(73): xaa in position 33 to 73 is any amino acid
  Variant (74)..(118): xaa in position 74 to 118 is any or no amino acid
  Variant (120)..(133): xaa in position 120 to 133 is any amino acid
  Variant (134)..(185): xaa in position 134 to 185 is any or no amino acid
  Variant (187)..(192): xaa in position 187 to 192 is any amino acid
  Variant (193)..(203): xaa in position 193 to 203 is any or no amino acid
  Variant (206)..(206): xaa in position 206 is any amino acid
  Variant (208)..(210): xaa in position 208 to 210 is any amino acid
  Variant (212)..(213): xaa in position 212 to 213 is any amino acid
  Variant (215)..(217): xaa in position 215 to 217 is any amino acid
  Variant (219)..(223): xaa in position 219 to 223 is any amino acid
  Variant (227)..(227): xaa in position 227 is any amino acid
  Variant (231)..(233): xaa in position 231 to 233 is any amino acid
  Variant (236)..(245): xaa in position 236 to 245 is any amino acid
  Variant (247)..(248): xaa in position 247 to 248 is any amino acid
  Variant (250)..(253): xaa in position 250 to 253 is any amino acid
  Variant (254)..(264): xaa in position 254 to 264 is any or no amino acid
  Variant (266)..(280): xaa in position 266 to 280 is any amino acid
  Variant (282)..(283): xaa in position 282 to 283 is any amino acid
  Variant (285)..(314): xaa in position 285 to 314 is any amino acid
  Variant (315)..(412): xaa in position 315 to 412 is any or no amino acid
  Variant (414)..(417): xaa in position 414 to 417 is any amino acid
  Variant (419)..(428): xaa in position 419 to 428 is any amino acid
  Variant (429)..(444): xaa in position 429 to 444 is any or no amino acid
  Variant (446)..(447): xaa in position 446 to 447 is any amino acid
  Variant (448)..(448): xaa in position 448 is any or no amino acid
  Variant (450)..(451): xaa in position 450 to 451 is any amino acid
  Variant (453)..(456): xaa in position 453 to 456 is any amino acid
  Variant (458)..(458): xaa in position 458 is any amino acid
  Variant (460)..(461): xaa in position 460 to 461 is any amino acid
  Variant (463)..(463): xaa in position 463 is any amino acid
  Variant (468)..(471): xaa in position 468 to 471 is any amino acid
  Variant (473)..(478): xaa in position 473 to 478 is any amino acid
  Variant (479)..(482): xaa in position 479 to 482 is any or no amino acid
  Variant (484)..(485): xaa in position 484 to 485 is any amino acid
  Variant (486)..(518): xaa in position 486 to 518 is any or no amino acid
  Variant (520)..(521): xaa in position 520 to 521 is any amino acid
  Variant (523)..(531): xaa in position 523 to 531 is any amino acid
  Variant (532)..(561): xaa in position 532 to 561 is any or no amino acid
  Variant (563)..(577): xaa in position 563 to 577 is any amino acid
  Variant (578)..(596): xaa in position 578 to 596 is any or no amino acid
  Variant (598)..(601): xaa in position 598 to 601 is any amino acid
  Variant (603)..(609): xaa in position 603 to 609 is any amino acid
  Variant (610)..(640): xaa in position 610 to 640 is any or no amino acid
  Variant (643)..(643): xaa in position 643 is any amino acid
  Variant (645)..(647): xaa in position 645 to 647 is any amino acid
  Variant (650)..(650): xaa in position 650 is any amino acid
  Variant (653)..(654): xaa in position 653 to 654 is any amino acid
  Variant (656)..(658): xaa in position 656 to 658 is any amino acid
  Variant (660)..(660): xaa in position 660 is any amino acid
  Variant (668)..(669): xaa in position 668 to 669 is any amino acid
  Variant (673)..(682): xaa in position 673 to 682 is any amino acid
  Variant (684)..(690): xaa in position 684 to 690 is any amino acid
  Variant (691)..(742): xaa in position 691 to 742 is any or no amino acid
  Variant (744)..(744): xaa in position 744 is any amino acid
  Variant (747)..(761): xaa in position 747 to 761 is any amino acid
IXXXIXXGXXXXLVGXXXXXXGXGKSXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXXXXXXXXXXXXXXXXXXXXXXXXXXXXXXXXXXXXXXXXXXXXXXXXXXXXXXXXXXLXXXXXXXXXXXXXXXXXLSXGXXXRXXLXXXLXXXXXLLIXDEPXXXLDXXXXXXXXXXLXXLXXXXXXXXXXXXXXXVXXXXXXXXXXXXXXXVXXMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXLXXXXXXXXXXXXXXXXXXXXXXXXXXVXXXVXXGXXXXIXGXXGXGKSTXXXXLXXXXXXXXXXGXXXXXXXXXXXXXXXXXXXXXXXXXXXXXXXXXXXIXXVXXXXXXXXXXXXXXXXXXXXXXXXXXXXXXXXXXXXXXXLXXXXXXXXXXXXXXXXXXXXXXXXXXXXXXXXXXLXXXXLXXXXXXXXXXXXXXXXXXXXXXXXXXXXXXXXXXXXXXLSXGXXXRLXIAXXLXXXPXLLILDEPXXGLDXXXXXXXXXXLXXXXXXXXXXXXXXXXXXXXXXXXXXXXXXXXXXXXXXXXXXXXXXXXXXXXXXXXXXXIXISXXXXXXXXXXXXXXXM

SEQ ID NO: 27637 - protein, 9 aa, Artificial sequence
  Variant (2)..(2): xaa in position 2 is any amino acid
  Variant (3)..(3): xaa in position 3 is Asp, Asn or Ser
  Variant (5)..(5): xaa in position 5 is any amino acid
  Variant (8)..(8): xaa in position 8 is Ser or Thr
  Variant (9)..(9): xaa in position 9 is Ala, Ser, Thr or Val
GXXGXGKXX

SEQ ID NO: 27638 - protein, 29 aa, Artificial sequence
  Variant (2)..(4): xaa in position 2 to 4 is any amino acid
  Variant (5)..(5): xaa in position 5 is Lys or Arg
  Variant (6)..(19): xaa in position 6 to 19 is any amino acid
  Variant (20)..(20): xaa in position 20 is Phe, Ile, Leu or Val
  Variant (21)..(21): xaa in position 21 is any amino acid
  Variant (23)..(23): xaa in position 23 is Asp, Glu, Asn or Gln
  Variant (25)..(27): xaa in position 25 to 27 is any amino acid
  Variant (28)..(28): xaa in position 28 is Ile, Leu or Val
  Variant (29)..(29): xaa in position 29 is Asp or Thr
GXXXXXXXXXXXXXXXXXXXXDXPXXXXX

SEQ ID NO: 27639 - protein, 16 aa, Artificial sequence
  Variant (2)..(5): xaa in position 2 to 5 is any amino acid
  Variant (6)..(6): xaa in position 6 is Phe, Ile, Leu or Val
  Variant (7)..(7): xaa in position 7 is any amino acid
  Variant (9)..(9): xaa in position 9 is any amino acid
  Variant (10)..(10): xaa in position 10 is Asn or Ser
  Variant (12)..(12): xaa in position 12 is any amino acid
  Variant (15)..(15): xaa in position 15 is any or no amino acid
GXXXXXXGXXGXGKXT

SEQ ID NO: 27640 - protein, 29 aa, Artificial sequence
  Variant (2)..(5): xaa in position 2 to 5 is any amino acid
  Variant (6)..(6): xaa in position 6 is Ile, Leu, Met or Val
  Variant (7)..(7): xaa in position 7 is any amino acid
  Variant (8)..(8): xaa in position 8 is Phe, Ile, Leu or Val
  Variant (9)..(17): xaa in position 9 to 17 is any amino acid
  Variant (18)..(18): xaa in position 18 is Phe, Ile, Leu, Met or Val
  Variant (19)..(19): xaa in position 19 is any amino acid
  Variant (20)..(20): xaa in position 20 is Phe, Ile, Leu or Val
  Variant (21)..(21): xaa in position 21 is any amino acid
  Variant (24)..(28): xaa in position 24 to 28 is any amino acid
GXXXXXXXXXXXXXXXXXXXXDEXXXXXD

SEQ ID NO: 27641 - protein, 7 aa, Artificial sequence
  Variant (2)..(2): xaa in position 2 is any amino acid
  Variant (3)..(6): xaa in position 3 to 6 is any or no amino acid
IXXXXXH

SEQ ID NO: 27642 - DNA, 1629 bp, Escherichia coli
  CDS (467)..(1513)
cgaagagccgaataaggttaccctaaccggagacgccaatctggacatgaactccctgttcggtagtcagaaagcgaccatgaaactgaagctgaaagcgctgcccgtgtttgataaagaaaaaggtgcgatcttcctgaaagagatggaagtggtcgatgcgacggtacaaccggaaaaaatgcaaacggtgatgcaaacgttgcttccctatttgaaccaggcattacgcaattactttaaccagcaacctgcttacgtcctgcgcgaagatggcagccagggcgaagcaatggcgaaaaaactggcgaaaggcattgaagtgaagccaggcgaaattgtcattccatttactgattaatcacgagggcgcattcgcgccctttatttttcgtgcaaaggaaaacgtttccgcttatcctttgtgtccggcaaaaacatcccttcagccggagcatagagattaatgactgcaccatcccaggtattaaagatccgccgcccagacgactggcaccttcacctccgcgatggcgacatgttaaaaactgtcgtgccatataccagcgaaatttatggacgggctatcgtaatgcccaatctggctccgcccgtgaccaccgttgaggctgccgtggcgtatcgccagcgtattcttgacgccgtacctgccgggcacgatttcaccccattgatgacctgttatttaacagattcgctggatcctaatgagctggagcgcggatttaacgaaggcgtgttcaccgctgcaaaactttacccggcaaacgcaaccactaactccagccacggcgtgacgtcaattgacgcaatcatgccggtacttgagcgcatggaaaaaatcggtatgccgctactggtgcatggtgaagtgacacatgcagatatcgacatttttgatcgtgaagcgcgctttatagaaagcgtgatggaacctctgcgccagcgcctgactgcgctgaaagtcgtttttgagcacatcaccaccaaagatgctgccgactatgtccgtgacggaaatgaacggctggctgccaccatcactccgcagcatctgatgtttaaccgcaaccatatgctggttggaggcgtgcgtccgcacctgtattgtctacccatcctcaaacgtaatattcaccaacaggcattgcgtgaactggtcgccagcggttttaatcgagtattcctcggtacggattctgcgccacatgcacgtcatcgcaaagagagcagttgcggctgcgcgggctgcttcaacgccccaaccgcgctgggcagttacgctaccgtctttgaagaaatgaatgctttgcagcactttgaagcattctgttctgtaaacggcccgcagttctatgggttgccggtcaacgacacattcatcgaactggtacgtgaagagcaacaggttgctgaaagcatcgcactgactgatgacacgctggtgccattcctcgccggggaaacggtacgctggtccgttaaacaataaaaatcgtagcttcctgttgtcattaggttattttacctgtataaataaccagtatattcaacagggggctattatgcgaattgaagtcaccatagcgaaaacttctccattgccag

SEQ ID NO: 27643 - protein, 348 aa, Escherichia coli [sequence omitted]

SEQ ID NO: 27644 - DNA, 1053 bp, Vibrio cholerae O1 biovar eltor str. N16961
  CDS (1)..(1053): transl_table=11
atgcattcatggtgggagcactcaatgacaacactgacgattacacgcccagacgactggcacgttcaccttcgcgatggcgatgtactggccgatactgtacgcgacatcagccgttataacggccgcgcgctgatcatgcctaacacggttccccctgtaaccaccactgagatggccttagcctatcgtgagcgcattatggccgctcagccacaagcgcactttgaacctttgatggcgctttacctcaccgataacacatcacctgaggaaattcgcaaagccaaagcgtcaggcaaagtcgttgcagctaagctttacccagccggtgcgaccaccaactcggattcaggcgtcacttcagccaaaaacatttacccagttttgcaagcgatgcaggaagtcggtatgttgctgttggtgcacggtgaagtcaccacgcacgaagtcgacatttttgaccgtgaaaagaccttcctagacaccgtgcttgcgccgatcgtgaatgatttcccgcaactgaaaattgtgcttgaacacatcaccaccgccgatgcagtgacctttgtgcaacaagcaggcgataacgttgcggcaacgattaccgcgcaccatttgctgtttaaccgtaaccacatgctggttggcggtattcgcccacatttctactgtttgccaatcctaaagcgtgcgactcaccaacacgcgttagtggcagcggcaacctctggcagcaagaaattcttcctaggtacggactctgccccgcacgccaaaggccgcaaagaagccgcttgtggctgcgcaggttcttacacagcccatgcagctcttgagttgtatgccgaagtgtttgaaaaagaaggtaagctagaaaatctggaagcgttcgctagctttaatggccctgatttctacggcctacctcgcaatcaagagaccgtcacgctcaccaagcaagcctggccagtcgcagaaagcatgccgtttggcagcgatatcgtggtgccaatccgcgccggtgaaaatatcgagtggacagtgaagtaa

SEQ ID NO: 27645 - protein, 350 aa, Vibrio cholerae O1 biovar eltor str. N16961
MHSWWEHSMTTLTITRPDDWHVHLRDGDVLADTVRDISRYNGRALIMPNTVPPVTTTEMALAYRERIMAAQPQAHFEPLMALYLTDNTSPEEIRKAKASGKVVAAKLYPAGATTNSDSGVTSAKNIYPVLQAMQEVGMLLLVHGEVTTHEVDIFDREKTFLDTVLAPIVNDFPQLKIVLEHITTADAVTFVQQAGDNVAATITAHHLLFNRNHMLVGGIRPHFYCLPILKRATHQHALVAAATSGSKKFFLGTDSAPHAKGRKEAACGCAGSYTAHAALELYAEVFEKEGKLENLEAFASFNGPDFYGLPRNQETVTLTKQAWPVAESMPFGSDIVVPIRAGENIEWTVK

SEQ ID NO: 27646 - DNA, 1008 bp, Campylobacter jejuni subsp. jejuni NCTC 11168
  CDS (1)..(1008): transl_table=11
atgaaacttaaaaatcctttagatatgcatttgcatttaagagataaccaaatgttagaacttattgcacctttgagtgcaagagatttttgtgcagctgtgattatgccaaatttaatccctccgctttgcaatttagaagatctaaaagcttataaaatgcgtatccttaaggcttgtaaagatgaaaatttcactcctttaatgacacttttttttaaaaattatgatgagaaatttctttacagtgctaaagatgaaatttttggcattaagctttatccagcaggaattacaacaaattcaaatggtggagtttcaagttttgatatagagtatttaaaacctactttagaggctatgagtgatttaaatattcctttgctagtgcatggtgaaaccaatgattttgtaatggacagggaaagtaattttgctaaaatttatgaaaaattagccaaacattttccacgacttaagattgttatggagcatattaccactaaaactttatgtgaacttttaaaagattatgaaaatttatacgcgacaatcactttacatcatttaatcatcactttagatgatgttatcggaggtaaaatgaatcctcatcttttttgtaagcctatagccaagcgttacgaagataaagaagccctttgcgaacttgcttttagtggttatgaaaaagttatgtttggaagtgatagtgcgcctcatccaaaagatactaaagagtgttgcggttgtgccgcaggtgtatttagtgccccagtgattttacctgttttagctgaattatttaagcaaaatagctcagaagaaaatttgcaaaaatttttaagcgataatacttgtaaaatttatgatttaaaatttaaagaagataaaattttaactttagaagaaaaagaatggcaagtaccaaatgtttatgaagataaatacaatcaagtcgtgccttatatggctggagaaattttgaaatttcaattaaaacattga

SEQ ID NO: 27647 - protein, 335 aa, Campylobacter jejuni subsp. jejuni NCTC 11168
MKLKNPLDMHLHLRDNQMLELIAPLSARDFCAAVIMPNLIPPLCNLEDLKAYKMRILKACKDENFTPLMTLFFKNYDEKFLYSAKDEIFGIKLYPAGITTNSNGGVSSFDIEYLKPTLEAMSDLNIPLLVHGETNDFVMDRESNFAKIYEKLAKHFPRLKIVMEHITTKTLCELLKDYENLYATITLHHLIITLDDVIGGKMNPHLFCKPIAKRYEDKEALCELAFSGYEKVMFGSDSAPHPKDTKECCGCAAGVFSAPVILPVLAELFKQNSSEENLQKFLSDNTCKIYDLKFKEDKILTLEEKEWQVPNVYEDKYNQVVPYMAGEILKFQLKH

SEQ ID NO: 27648 - DNA, 1047 bp, Salmonella typhimurium LT2
  CDS (1)..(1047): transl_table=11
atgactgcaccatcccaggttttaaagatccgccgcccggacgactggcacgttcaccttcgcgatggcgacatgttaaaaacggtcgtaccctataccagcgaaatttatggtcgcgctatcgtgatgccgaacctggcgtcccccatcacgaccgttgatgcagcgatcgcctaccgccagcgtattctcgatgcggtgcccgccgggcatgatttcacgccgttaatgacctgctatttaacggattcgctcgatgccgatgaactggagcgtggtttccatgaaggcgtatttactgcggctaagctttacccggccaatgccaccactaactccagtcatggcgtaacgtcagtcgacgctatcatgccggtactggagcggatggaaaaactcggaataccattgctggtccacggggaggtgacccatgcggatgttgatatattcgatcgtgaagcgcgttttatcgacaccgtaatggaaccgctacgccagcgtctgaccgcgcttaaagtggtctttgagcacatcacgaccaaagatgccgcgcagtatgtacgtgacggcaacgactacctggcggctaccattacgcctcaacatttaatgtttaaccgtaatgatatgctggtcggcggcattcgtcctcacctgtactgtctgccgattctgaaacgcaatattcaccagcaggcgttacgcgaactggttgccagtggttttacgcgcgccttcctggggacggattcagcgccgcattcacgtcatcgtaaagagaccagttgcggctgcgccggttgtttcaacgccccctccgcccttggcagttatgccgccgtgtttgaggaaatgaacgcgctggcgcactttgaagcgttctgttcactgaatggcccgcaattctatggcctgccgatgaatacggggtgggtggaactggttcgcgatgaacaacagataccgggaaatatcgcgctggctgatgattctctggtgccttttttagcgggtgaaacagtacgctggtcagtaaaaaaataa

SEQ ID NO: 27649 - protein, 348 aa, Salmonella typhimurium LT2
MTAPSQVLKIRRPDDWHVHLRDGDMLKTVVPYTSEIYGRAIVMPNLASPITTVDAAIAYRQRILDAVPAGHDFTPLMTCYLTDSLDADELERGFHEGVFTAAKLYPANATTNSSHGVTSVDAIMPVLERMEKLGIPLLVHGEVTHADVDIFDREARFIDTVMEPLRQRLTALKVVFEHITTKDAAQYVRDGNDYLAATITPQHLMFNRNDMLVGGIRPHLYCLPILKRNIHQQALRELVASGFTRAFLGTDSAPHSRHRKETSCGCAGCFNAPSALGSYAAVFEEMNALAHFEAFCSLNGPQFYGLPMNTGWVELVRDEQQIPGNIALADDSLVPFLAGETVRWSVKK

SEQ ID NO: 27650 - DNA, 1182 bp, Agrobacterium tumefaciens str. C58
  CDS (1)..(1182): transl_table=11
atgtctggggtccggaagcgggcaacatctgacgcacgcttcaaaaaaatgacatttacagctgccggatggtctctggcggctgttttcccgcgacaaaagatgctaagcgggcgcaattccatcatgttccgaggtatcccgatgaagtcgctcaccctgcgccgccctgatgactggcacctgcatcttcgtgatggcgccatgctggaaggggtgatcggggatacgagccgccatttcgcccgcgccatcatcatgccgaatctggtgccgcccgtcgtcaccacggccgatgccagcgcctatcgagaacgcatcctcaaggcgatcccggagggtgaccgcttcgagccgctgatgaccctctacctcactgaggatactgttgctgatgacgtggaagagggcaaaaaaagcggcctcatcaccgccgtaaagctctatcctgcgggtgcgaccaccaattctcatggcggcgtgcgcgatttcaacaaggcgatgccggtgctggaacgcatggcaaagatcggcctgccgctctgcgtgcatggcgaggtgacgacgccagacgtcgatattttcgaccgcgagaaggccttcatcgatacggttctggagcccctgcgccagcgcctgccagagttgaaggtgacgatggaacacatcaccacccgcgatggcgtggactacatcaagtcttccaatgccaatctggccggctccatcaccacgcaccacctcatcatcaaccgcaacgccattctggtcggcggtatcaagccgcattattattgcctgcccgtcgccaagcgcgaggagcatcgtctggcgctgcgggctgctgcgacgtcgggtgatgcccgcttcttcctcggcacggattccgccccacatgtggacccgctgaaagaatgcgcctgcggctgtgctggcatctatacttccatcaacaccatgagctgccttgcccatgtcttcgaggatgagaatgccctcgataagctggaggccttcgcctcgctcaacggcccggcctggtatggtcttgcgccgaacgacgagacgatcacgctggtcaagcgcgaggaagcggtggcgtttcccgaaaagatcgaaacgggcgccgggccggtgaccgtattcgatccgatgttcccgcttcattgggatgtaaactga

SEQ ID NO: 27651 - protein, 393 aa, Agrobacterium tumefaciens str. C58
MSGVRKRATSDARFKKMTFTAAGWSLAAVFPRQKMLSGRNSIMFRGIPMKSLTLRRPDDWHLHLRDGAMLEGVIGDTSRHFARAIIMPNLVPPVVTTADASAYRERILKAIPEGDRFEPLMTLYLTEDTVADDVEEGKKSGLITAVKLYPAGATTNSHGGVRDFNKAMPVLERMAKIGLPLCVHGEVTTPDVDIFDREKAFIDTVLEPLRQRLPELKVTMEHITTRDGVDYIKSSNANLAGSITTHHLIINRNAILVGGIKPHYYCLPVAKREEHRLALRAAATSGDARFFLGTDSAPHVDPLKECACGCAGIYTSINTMSCLAHVFEDENALDKLEAFASLNGPAWYGLAPNDETITLVKREEAVAFPEKIETGAGPVTVFDPMFPLHWDVN

SEQ ID NO: 27652 - DNA, 1077 bp, Plasmodium falciparum 3D7
  CDS (1)..(1077)
atgaaaaattacttttatattccaatagctgatgacatgcactgtcacttaaggcaaggcgacatgctggattttacggtaaattccattagaagaggcggctgtaatcgtgttttagtgatgccgaacacgcatcctattataagtacttgtagtgatgcacaaaaatatttatatcaactgaaaagtcgtgatgatgatatagaatatttaatgaccttgtatttgaataagaatacggatgaaaacgatatattaagtaattactataagtgtaatttacaaggcgtaaaaatatatcctagtaatgtaaccactaattcgagtgatggtattactagcctagaaccttattataaggtatttcatgcactagaaaaattaaataagagtatacatatccattgtgaggaaccaaatataaatccattatatgctgaggaaaagtatttaccgcatatacatgatttagccataaagtttccaggtttgaatattgttttagaacatatatcgtcaagcgaatcgataaatgttattaaagaatttcgaaatgtagcaggttccataacacctcatcatttatatttaacaatagatgatgttgttaatatggatatatatgatcatgcaatagataacacatatattgaaaaatatataaaaaatacatatcattattgtaagccattaccaaaattgttagaagataaaattgctttacaagatgttataaaagatgattttccaagagtctttttgggttcggattcagcacctcattacaaagttatgaagcgcaaaccctactataaaccaggaatatacacacaaccatttttaataaattatgttgctcatatattgaacaaattcgatgctttagataagatggaaaattttacctcaaaaaatgcttccctctttctaaatttagcagaaaaaaaaaaattggcaaaatattacatatgtgtggaaaaacatccatttaaattaccaagagaatataatggtgtagtcccctttttggcagggaagactttggattatgacatacattatgtaagtaagttttaa

SEQ ID NO: 27653 - protein, 358 aa, Plasmodium falciparum 3D7
MKNYFYIPIADDMHCHLRQGDMLDFTVNSIRRGGCNRVLVMPNTHPIISTCSDAQKYLYQLKSRDDDIEYLMTLYLNKNTDENDILSNYYKCNLQGVKIYPSNVTTNSSDGITSLEPYYKVFHALEKLNKSIHIHCEEPNINPLYAEEKYLPHIHDLAIKFPGLNIVLEHISSSESINVIKEFRNVAGSITPHHLYLTIDDVVNMDIYDHAIDNTYIEKYIKNTYHYCKPLPKLLEDKIALQDVIKDDFPRVFLGSDSAPHYKVMKRKPYYKPGIYTQPFLINYVAHILNKFDALDKMENFTSKNASLFLNLAEKKKLAKYYICVEKHPFKLPREYNGVVPFLAGKTLDYDIHYVSKF

SEQ ID NO: 27654 - DNA, 1032 bp, Shewanella oneidensis MR-1
  CDS (1)..(1032): transl_table=11
atgaaaacactcacaattacgcgtcctgacgactggcatattcacctaagagacggcgcccaattaaccgataccgttcgcgacatcagccgctatatgggccgcgcgatcgtcatgcctaacttagtgccccccgcgatcgataccgaaaccgccttggcgtactacgatcgcatcaaggcgcgagtgcccgcaggctcgcaatttgagcccttaatggtgctgtatctcaccgacaaaaccagcccagacgaaatccgtaaagctaaagcctcgggcaaagtctttgccgctaagctctatcctgctggcgcgacgacgaactcagactctggcgtcaccgatttaaaaaatatctaccctgccctcgaagcgatgcaggaagtcggcatgttgtttttagtgcacggcgaagtgactgactcatcgattgatattttcgaccgtgagcgcgtgtttattgagaatatcttgagcaagatcgtgactgattttccaaacctcaaaatcgtcctcgagcatatcaccactaaagatgccgtcgattttgtgactcaagcctctgataatgtggccgccacgatcaccgcgcaccatttactttataaccgcaaccatatgttggctggcggtattcgcccgcatttttattgcctaccgattttaaagcgcaatactcaccagcaagcactgttagcggctgcagccagtggcaataaaaagttcttcctcggtactgactcggcgccacacgcgaaagaccgcaaagaggccgcctgcggctgtgcgggttcttatactgcccatgcggcaattgagctgtatgccgaagcctttgaatcggtgaatgcgctggataaattagaagcctttgccagttttaacggcccagatttttacaatctaccccgcaatagcgataccatcaccttggtgaaaaaagcgtgggacattcccgcaagttatccgcttggcgacacaaatgtcgtccccatccgcgctggcgaacaaattgattggcaggttgaataa

SEQ ID NO: 27655 - protein, 343 aa, Shewanella oneidensis MR-1
MKTLTITRPDDWHIHLRDGAQLTDTVRDISRYMGRAIVMPNLVPPAIDTETALAYYDRIKARVPAGSQFEPLMVLYLTDKTSPDEIRKAKASGKVFAAKLYPAGATTNSDSGVTDLKNIYPALEAMQEVGMLFLVHGEVTDSSIDIFDRERVFIENILSKIVTDFPNLKIVLEHITTKDAVDFVTQASDNVAATITAHHLLYNRNHMLAGGIRPHFYCLPILKRNTHQQALLAAAASGNKKFFLGTDSAPHAKDRKEAACGCAGSYTAHAAIELYAEAFESVNALDKLEAFASFNGPDFYNLPRNSDTITLVKKAWDIPASYPLGDTNVVPIRAGEQIDWQVE

SEQ ID NO: 27656 - DNA, 1044 bp, Vibrio vulnificus CMCP6
  CDS (1)..(1044): transl_table=11
atggtgggagcaacaatgacaacacttactattactcgtcctgatgattggcacgtacacttgcgcgatggcgaagttttggcagataccgttcgtgatatcagccgttacaatggccgcgcactcatcatgccaaacactgtcccacccgtcaccacgtctgaaatggcgcttgcctatcgcgatcgcattcaagcacataaccaaacagaacaattttctccgcttatgtcgctgtatttgaccgacaacacaactgcggatgaagtacgcaaagccaaggccagcggtgctgtggtcgcagcaaaactgtatccagcaggcgcgacaactaactccgattctggcgtgacggatgtaaagaaaatttatccagtccttcaagccatgcaagaagtgggcatgttgctactggtacacggcgaagtgaccacacacgatgtggacatctttgatcgcgaaaaaacctttttagacaatgtgttggcgccgattgttcaagacttccctgatttgaaaattgtcctcgaacacatcaccacctcagatgcggttgtgtttgtgaaaaatgccaatgaaaacgttgccgcaaccattaccgctcatcacctgctgtacaaccgcaatcacatgttagtaggcggcatcaagccccacttctactgcttgccaattcttaaacgcaacacccaccagcttgcgttgatctctgctgcgacgagtggcaacaagaagttctttttgggtacggactctgcgccacacgccaaaggcgcaaaagaatccgcttgtggttgcgcgggctcttacacggctcacgccgctgtggaactgtatgcagaagtgtttgagcaagcgggcaagttggaaaatctcgaagcgtttgccagccataacggcccggatttttacggtcttcctcgtaaccaagatacgatcactttggtcaaagacgcatggcctgttcctgcttcaatgccatttggtggtgatattgtggtgccaattcgcgctggtgaaaacatggagtggaaggttaagtaa

SEQ ID NO: 27657 - protein, 347 aa, Vibrio vulnificus CMCP6
MVGATMTTLTITRPDDWHVHLRDGEVLADTVRDISRYNGRALIMPNTVPPVTTSEMALAYRDRIQAHNQTEQFSPLMSLYLTDNTTADEVRKAKASGAVVAAKLYPAGATTNSDSGVTDVKKIYPVLQAMQEVGMLLLVHGEVTTHDVDIFDREKTFLDNVLAPIVQDFPDLKIVLEHITTSDAVVFVKNANENVAATITAHHLLYNRNHMLVGGIKPHFYCLPILKRNTHQLALISAATSGNKKFFLGTDSAPHAKGAKESACGCAGSYTAHAAVELYAEVFEQAGKLENLEAFASHNGPDFYGLPRNQDTITLVKDAWPVPASMPFGGDIVVPIRAGENMEWKVK

SEQ ID NO: 27658 - DNA, 1056 bp, Coxiella burnetii RSA 493
  CDS (1)..(1056): transl_table=11
atggcgtatatgaaaaaaataactttaattcgcccggacgattggcattgtcatctccgcgatggatcttatctcccacgcaccgtcgcagacattgctgctcaatttaatcgagccattgtaatgccaaaccttgtaccgccgatcacgactgtccaacaagcaaaagcgtactatgatcgcattaaagcgcacgttcctaaatccagtaactttgaaccgctgatgacactttatctcaccgaatccaccccccaacaagaaatcaaagccgcgcaacaatcgggaattattgtcgcctgcaaactttatcccgcgggcgctaccactcattctcaagccggggtaaaagatctcaaagcaatttatacgttgttggaaaccatgcaatcggtcgatttaccacttttaattcatggggaggttgttgattacgcagtcgatatttttgaccgtgaagcggtttttattgaacgcgagctcctgcctttagtagaaacatttcctcaacttcgcattgtctttgaacatatttctactaaaattgctgttgattttgttttagaagctccttctaaacttggcgcaaccattacgccgcatcatttgctattcaatcgaaatgatctactaagcggcagcatccgacctcactattactgccttcctattttaaaaaccagcgaagaccaaatggccttaattcaagcagccaccagcggaaatccaaaattttttttgggcaccgatagcgccccccattcgcaaacaaaaaaacaatccatttgcggctctgcgggtatttacaatgcacccgcggctatagcgctttacgcagaaattttcgcgagccaaaatgctctagataaattggagggtttcgccagtcgtttcggcgcagagttttatggattaccactaaataacagccaaattacactcatccatcaaccatggcaggtcgcagagtcgctcccctttggcaatgaactcgttgtgccactttttgcgggccaaaccttgcagtggcagataaaatcccatgaacacaaataa

SEQ ID NO: 27659 - protein, 351 aa, Coxiella burnetii RSA 493
MAYMKKITLIRPDDWHCHLRDGSYLPRTVADIAAQFNRAIVMPNLVPPITTVQQAKAYYDRIKAHVPKSSNFEPLMTLYLTESTPQQEIKAAQQSGIIVACKLYPAGATTHSQAGVKDLKAIYTLLETMQSVDLPLLIHGEVVDYAVDIFDREAVFIERELLPLVETFPQLRIVFEHISTKIAVDFVLEAPSKLGATITPHHLLFNRNDLLSGSIRPHYYCLPILKTSEDQMALIQAATSGNPKFFLGTDSAPHSQTKKQSICGSAGIYNAPAAIALYAEIFASQNALDKLEGFASRFGAEFYGLPLNNSQITLIHQPWQVAESLPFGNELVVPLFAGQTLQWQIKSHEHK

SEQ ID NO: 27660 - DNA, 1050 bp, Nitrosomonas europaea ATCC 19718
  CDS (1)..(1050): transl_table=11
ttgaacgacacagcagacaagctgacttttacccgtccggatgactggcacctgcatttgcgtgacggtaacgccatgcggtcggtgttgcccgataccgcccggcgttttgcgcgcgccatcatcatgccgaacctcaagccgcccatcgtgacgactgaacaggcagctgcctatcgtgtccgtattctgtctgctttaccggctgagctggccgggcggttcgagccgctgatgacgctatacctgacggatacgacatcacccgaagaaattactcgggctcaggcaagtggtatcgtgcaaggtatcaagctctaccctgctggagcgaccacacattccgatgcgggtgtcacggatattgcacgctgcgaggctacgctggagaagatggaagagctcgacatgcctttactcgtgcatggagaagtggtcgatcctgcagtggatgttttcgaccgggaaaaaattttcattgaccgggtactgacgccgctactgcaacgctttcccgggctgcgagtggtattcgaacatatcactaccagagaggcagtcgagtttgtgcagacggctccaaaccggattgctgccacgattaccgcacaccacctgatgctgaaccggaatgccctgtttaccggcggattgcgtccgcatcattactgtttgccggtactgaaacgggaaatacatcgtcaggcactgctggaagcagcgaccagcggtcattccagattcttccttggtaccgacagcgcaccacatccggtcagagacaaagaatcagcctgtgggtgtgcgggtatttacagtgctcatgcagccatcgaattttatgccgaggtattcgaacaggctggccggctcgatcgactggaggcttttaccagctttcacggccccgatttctatggtttaccacgtaataccgatcggatttccctgatcagggaaagctggcagattccggagcaggtcgaattgggtgaagaaaaattgatccccctcagagcaggggaacacgctcgctggaaactggcatga

SEQ ID NO: 27661 - protein, 349 aa, Nitrosomonas europaea ATCC 19718
MNDTADKLTFTRPDDWHLHLRDGNAMRSVLPDTARRFARAIIMPNLKPPIVTTEQAAAYRVRILSALPAELAGRFEPLMTLYLTDTTSPEEITRAQASGIVQGIKLYPAGATTHSDAGVTDIARCEATLEKMEELDMPLLVHGEVVDPAVDVFDREKIFIDRVLTPLLQRFPGLRVVFEHITTREAVEFVQTAPNRIAATITAHHLMLNRNALFTGGLRPHHYCLPVLKREIHRQALLEAATSGHSRFFLGTDSAPHPVRDKESACGCAGIYSAHAAIEFYAEVFEQAGRLDRLEAFTSFHGPDFYGLPRNTDRISLIRESWQIPEQVELGEEKLIPLRAGEHARWKLA

SEQ ID NO: 27662 - DNA, 1032 bp, Helicobacter hepaticus ATCC 51449
  CDS (1)..(1032): transl_table=11
atgccacaaacattacaactcacaaaccctatggatatgcatcttcatttgcgcgagggagaaatgcttagtgctatcttgccttttagtgcaaatccttttagtgctgctgttgttatgccaaatcttaaaacccctattaccactactgcacaagctcttgcatacaaaaggcagattctatcactttgttctacatcatttgaaccacttatgagtatttttcttactccagaccttgacaaacaagaacttatacgtgctaaagaagcaggcattcatattcttaaactttatcctaagggctcaactacgggaagtgagaagggcgttaaagagatgttatgcgaaaagacacttcatatctttgagattgctcaagaattaggctttattctctccatacacggcgagagtaatggcttttgtatggaaagagaatatgaatttttgcctatttttgcccatattgcacaacatttccctcgtcttcgcataatcattgagcatatgagcgataggcgtagtcttgagttgattgaacaatacccaaatctctatgctacacttacattacatcacattactatgaatcttgatgacgtgcttggtggggggattaatcctcatcacttctgcaaacctatgcttaaaaccaaaaaagaccaacaagccttgctgcaagctgctctaaatgctcacccaaaagtaagttttgggtcggattctgcgcctcatttagaatctgcaaaacttaactccaaaggtgcagcggggattttttctgcccctattttactcccagcccttgctgaagtttttgcatttcataacgcccttgattgcttgcaaacatttataagcaatagggctatcgcgaactacaagctaaagcattttccgattaaaaccatcacgcttgagcgtgtggaaaatccagtgcctccttacattaatacacctcttgggcatattataccactccgagcgcaaacaaatctctcttggcgcattaaagaggaaaatagatga

SEQ ID NO: 27663 - protein, 343 aa, Helicobacter hepaticus ATCC 51449
MPQTLQLTNPMDMHLHLREGEMLSAILPFSANPFSAAVVMPNLKTPITTTAQALAYKRQILSLCSTSFEPLMSIFLTPDLDKQELIRAKEAGIHILKLYPKGSTTGSEKGVKEMLCEKTLHIFEIAQELGFILSIHGESNGFCMEREYEFLPIFAHIAQHFPRLRIIIEHMSDRRSLELIEQYPNLYATLTLHHITMNLDDVLGGGINPHHFCKPMLKTKKDQQALLQAALNAHPKVSFGSDSAPHLESAKLNSKGAAGIFSAPILLPALAEVFAFHNALDCLQTFISNRAIANYKLKHFPIKTITLERVENPVPPYINTPLGHIIPLRAQTNLSWRIKEENR

SEQ ID NO: 27664 - DNA, 1050 bp, Wigglesworthia glossinidia endosymbiont of Glossina brevipalpis
  CDS (1)..(1050): transl_table=11
atgttattaaaaataataaagccagatgattttcacatacatctcagagaaaaagaaatactaaaaaaaattcttccttatactagtcaattttttggaagagcattagtaatgcctaatttaaatcaaccaattataaattctcattttgcaagtgtttataaaaaagaaatatgttcttttattcctaaattacataaatttaatccattaatgactttatatttaactgaaaattgcgataaaaagatgttagttgatggatttttaaataaaattttcattgcagctaaaatgtatatatcaaatactactactaattctgaaaaaggaataaaaaattttgaaaatatatttcatatattagaaattatgcaaaaaataggaatgattttatcagttcatggagaaataagcgatgaaaaaacagatatattcgacagagaagctaaatttatagaaaaagtaatgattccaatacgtaaaaattttcctaaattaaaaattgtttttgaacatatttctacaaaaatagctgtggaatatgtaatatcagaagattcattattaggagcaactataactccacatcatttaatgtttaattataatgatatgttatcaaataaaataaaaccacatttatattgttttccaattttaaaaaaaaaaatagatcaatttgccttacataaggctatatctggaaattgtaatagattttttcttggaactgatagtgctcctcatgttttgaaaaacaaagaatctagcatgggattcgcaggaatatttaattctccaattgctcttgaaatgtatgctacagtttttgacaatcttaatattttaaataaattagaaaatttttgttctataaatggagctaatttctataatttaccgatcaataaagaacacattactttttttaaagaaactttttatcctaataaaaaacaaattattaaaataaataaaaataattatctatctccaattttcttcgagaaaaaattaaattggaaaataaaattaaaagaatattaa

SEQ ID NO: 27665 - protein, 349 aa, Wigglesworthia glossinidia endosymbiont of Glossina brevipalpis
MLLKIIKPDDFHIHLREKEILKKILPYTSQFFGRALVMPNLNQPIINSHFASVYKKEICSFIPKLHKFNPLMTLYLTENCDKKMLVDGFLNKIFIAAKMYISNTTTNSEKGIKNFENIFHILEIMQKIGMILSVHGEISDEKTDIFDREAKFIEKVMIPIRKNFPKLKIVFEHISTKIAVEYVISEDSLLGATITPHHLMFNYNDMLSNKIKPHLYCFPILKKKIDQFALHKAISGNCNRFFLGTDSAPHVLKNKESSMGFAGIFNSPIALEMYATVFDNLNILNKLENFCSINGANFYNLPINKEHITFFKETFYPNKKQIIKINKNNYLSPIFFEKKLNWKIKLKEY

SEQ ID NO: 27666 - DNA, 1080 bp, Prochlorococcus marinus subsp. marinus str. CCMP1375
  CDS (1)..(1080): transl_table=11
ttgtctaaagaacgaattactttgcgccaacctgatgattggcatttacatcttagagatggagatattttaaatgctgtggttccccctacagcaaaagtgtttcgtcgtgcagtagtaatgcccaacttgcaaccaccaataacaagtcttcaagctgcaattgattacaagcagagaatcatgaatgcaattcccactgaggttgcattcactcctcttatgactgtatatctcactgatgatatttcttctgaggttttaagagaaggtcacaaagaaggtgttttgatggcagcaaaattatatccagcaaattcaacgactaattcatctggcggtgttactgatataaagaatatttactctattttcgagacaatggaggagattgggttgccattgcttatacatggagaggttacagatcaagatgtagatatttttgatagagaatcagtgtttattgagagatatcttgatcctttgcttactaaatttcctgatatacgaactgttttagaacatattacaacggatgatgctgttcaatatgttcaagcaagtaatgcaaaactagcggccacaataactccccatcatttgcatataaataggaatgcaatttttcaggatggattaagaagtgactttttttgtttgccagtagctaaaagagaacgtcatcgtattgcattgagacgtgcagccataagtggagaaccttgctttttccttgggactgactccgcacctcaccttagagaatccaaggaaagtgcttgtggttgtgccggtatttttaatgcgattaatgcaattgaaagttatgctcaagtttttgatgaagaaggtgccattgaacgcttagaagcttttgcaagcgaattcggcccagcattttataaattaccgttaaatgaaaactctataaccttagttaaaaaagcaattaaaattccttccaggtttgaactgaataatgcagatgatttgtctaattatatagtcccttttcatgctggagagactttgaattggtctttcgaatcaatacaacctttctctcaaaaagtatga

SEQ ID NO: 27667 - protein, 359 aa, Prochlorococcus marinus subsp. marinus str. CCMP1375
MSKERITLRQPDDWHLHLRDGDILNAVVPPTAKVFRRAVVMPNLQPPITSLQAAIDYKQRIMNAIPTEVAFTPLMTVYLTDDISSEVLREGHKEGVLMAAKLYPANSTTNSSGGVTDIKNIYSIFETMEEIGLPLLIHGEVTDQDVDIFDRESVFIERYLDPLLTKFPDIRTVLEHITTDDAVQYVQASNAKLAATITPHHLHINRNAIFQDGLRSDFFCLPVAKRERHRIALRRAAISGEPCFFLGTDSAPHLRESKESACGCAGIFNAINAIESYAQVFDEEGAIERLEAFASEFGPAFYKLPLNENSITLVKKAIKIPSRFELNNADDLSNYIVPFHAGETLNWSFESIQPFSQKV

SEQ ID NO: 27668 - DNA, 1080 bp, Bordetella pertussis Tohama I
  CDS (1)..(1080): transl_table=11
ttgaggcccgcttccatgtccaaccaacacgctacagaacttaccatcacccgcccggacgattggcacctgcacctgcgcgatggcagcgccctcgaggcggtggtgctggatacggcgcggcagttcgcgcgcgccatcgtgatgcccaacctccgcccgccggtgaccaccaccgagcaggcgctggtctatcgcgcgcggatcgaagcggcgctgcgcaaggcgggtggcgatacggctgccttcacgcccttgatgacgctgtacctgaccgacaacacgccggccgaggaaatcgtgcgcgcgcatgagtccgggcaggtcgccgcggtcaagctgtatccggccggggccaccacaaactccgatgccggcgtgaccgacctgctgggcaagtgcggcgccgcgctggctgcgctggagcgctgcggcatgccgctgctggtgcacggcgaggtgaccgatccggcgatcgacgtgttcgaccgcgaagcggtgttcatcgaacgtgtcatgcagccgctgcggcgcgcgtatcccggcctgaaggtggtgttcgagcacatcacgacccgggaaggcgcccactacgtgcgcgacgcggaaggacccaccgccgcgaccatcacgccgcagcacatgctctacaaccgcaatgcgattttcacgggcggcgtgcggccgcattggtattgcctgccgatcctcaagcgcgaggtgcatcgccaggccctggtcgaggcggccaccagcggcagtccgcgtttcttcctgggtaccgacagcgcgccccatgcgcgcggcctgaaggaacatgcctgtggttgcgcgggctgctatacggccctgcatgcaatggagctttacgccaccgcgttcgacgcggtcggccgcctggatcggctggaaggctttgccagcttccacggcccggatttttacggcctgccgcgcaatacgggtacgctcacgctgcggcgcgaagcctacgaaattccggcggaggtcgcgttcggcgatacgaccctggtgccgctgtccggcggcgagtcgctcggctggcgggccctggcctga

SEQ ID NO: 27669 - protein, 359 aa, Bordetella pertussis Tohama I
MRPASMSNQHATELTITRPDDWHLHLRDGSALEAVVLDTARQFARAIVMPNLRPPVTTTEQALVYRARIEAALRKAGGDTAAFTPLMTLYLTDNTPAEEIVRAHESGQVAAVKLYPAGATTNSDAGVTDLLGKCGAALAALERCGMPLLVHGEVTDPAIDVFDREAVFIERVMQPLRRAYPGLKVVFEHITTREGAHYVRDAEGPTAATITPQHMLYNRNAIFTGGVRPHWYCLPILKREVHRQALVEAATSGSPRFFLGTDSAPHARGLKEHACGCAGCYTALHAMELYATAFDAVGRLDRLEGFASFHGPDFYGLPRNTGTLTLRREAYEIPAEVAFGDTTLVPLSGGESLGWRALA

SEQ ID NO: 27670 - DNA, 1080 bp, Bordetella bronchiseptica RB50
  CDS (1)..(1080)
atgaggcccgcttccatgtccaaccaacacgctacagaacttaccatcacccgcccggacgattggcacctgcacctgcgcgatggcagcgccctcgaggcggtggtgctggatacggcgcggcagttcgcgcgcgccatcgtgatgcccaacctccgcccgccggtgaccaccaccgagcaggcgctggcctatcgcgcgcggatcgaagcggcgctgcgcaaggcgggtggcgatacggctgccttcacgcccttgatgacgctgtacctgaccgacaacacgccggccgaggaaatcgtgcgcgcgcatgagtccgggcaggtcgccgcggtcaagctgtatccggccggggccaccacaaactccgatgccggcgtgaccgacctgctgggcaagtgcggcgccgcgctggctgcgctggagcgctgcggcatgccgctgctggtgcacggcgaggtgaccgatccggcgatcgacgtgttcgaccgcgaagcggtgttcatcgaacgtgtcatgcagccgctgcggcgcgcgtatcccggcctgaaggtggtgttcgagcacatcacgacccgggaaggcgcccactacgtgcgcgacgcggaaggacccaccgccgcgaccatcacgccgcagcacatgctctacaaccgcaatgcgattttcacgggcggcgtgcggccgcattggtattgcctgccgatcctcaagcgcgaggtgcatcgccaggccctggtcgaggcggccaccagcggcagtccgcgtttcttcctgggtaccgacagcgcgccccatgcgcgcggcctgaaggaacatgcctgtggttgcgcgggctgctatacggccctgcatgcaatggagctttacgccaccgcgttcgacgcggtcggccgcctggatcggctggaaggctttgccagcttccacggcccggatttttacggcctgccgcgcaatacgggtacgctcacgctgcggcgcgaagcctacgaaattccggcggaggtcgcgttcggcgatacgaccctggtgccgctggccggcggcgagtcgctcggctggcgggccctggcctga

SEQ ID NO: 27671 - protein, 359 aa, Bordetella bronchiseptica RB50
MRPASMSNQHATELTITRPDDWHLHLRDGSALEAVVLDTARQFARAIVMPNLRPPVTTTEQALAYRARIEAALRKAGGDTAAFTPLMTLYLTDNTPAEEIVRAHESGQVAAVKLYPAGATTNSDAGVTDLLGKCGAALAALERCGMPLLVHGEVTDPAIDVFDREAVFIERVMQPLRRAYPGLKVVFEHITTREGAHYVRDAEGPTAATITPQHMLYNRNAIFTGGVRPHWYCLPILKREVHRQALVEAATSGSPRFFLGTDSAPHARGLKEHACGCAGCYTALHAMELYATAFDAVGRLDRLEGFASFHGPDFYGLPRNTGTLTLRREAYEIPAEVAFGDTTLVPLAGGESLGWRALA

SEQ ID NO: 27672 - DNA, 1050 bp, Prochlorococcus marinus subsp. pastoris str. CCMP1986
  CDS (1)..(1050): transl_table=11
ttgaaagaattaactatatcaaaaccggatgattggcatttacatttaagggaaggcattgttttaaaaaatattattaggtttacatctcaatattttggtagggctattgtgatgccaaacaccaaaaacccaataacatctatagaaaaatgtatttcttataaaaattctatatttgaagcattgtctaataattctacatttgagccattaatgacgatatatcttacggacgagacaataaaacatgaattagtagaaggttttaaaaataaagttttctttgctgccaaattgtatcctgctaatgcaacaacaaattccagacatggagttaaaaaaatagaaaatctttatgaaatttttgaagttatgcaagaacttggaatgccacttttaattcatggagaagtcactgaccctgaagtagatatttttgatagggaagaagtttttattgataaagaactttcacctttaatacaacaattcccaagattaaagattgttttagagcatataactacctcttatgcagttgattttgttcagaggaataacttaggagctactattactccacatcatttacacataaatagaaatgcaatgttctttggaggtttaaatagtgacttttactgcttaccagtcgcaaagagagaaaacaatagaattgctttaaggaaagctgctactagtggaaaagaatgttttttcataggcacggattctgctcctcacttaagacagtggaaagctttttgtggttgtgcaggcatttttaattctccagtagcaatagaaagctatttaaaagtttttgaggaggaaaatgcacttaatcaattcgaaaaatttgccagcttgaatgggcctaatttttataatctacctattaataacgaaaaaattagattggtatcaaggtcaaataaaattccagaatttattgaagtaattgaacaaaataaggttgttggacaaataaaaccatttcatggaggtgaaactttaacttggcgagtagagggagttgttaaataa

SEQ ID NO: 27673 - protein, 349 aa, Prochlorococcus marinus subsp. pastoris str. CCMP1986
MKELTISKPDDWHLHLREGIVLKNIIRFTSQYFGRAIVMPNTKNPITSIEKCISYKNSIFEALSNNSTFEPLMTIYLTDETIKHELVEGFKNKVFFAAKLYPANATTNSRHGVKKIENLYEIFEVMQELGMPLLIHGEVTDPEVDIFDREEVFIDKELSPLIQQFPRLKIVLEHITTSYAVDFVQRNNLGATITPHHLHINRNAMFFGGLNSDFYCLPVAKRENNRIALRKAATSGKECFFIGTDSAPHLRQWKAFCGCAGIFNSPVAIESYLKVFEEENALNQFEKFASLNGPNFYNLPINNEKIRLVSRSNKIPEFIEVIEQNKVVGQIKPFHGGETLTWRVEGVVK

SEQ ID NO: 27674 - DNA, 1065 bp, Prochlorococcus marinus str. MIT 9313
  CDS (1)..(1065): transl_table=11
ttggattctttgcccgaccaactcattttgcgtcaaccggatgactggcatgtccatctgagggatggtgccatgctgcatgcggtgctaggcagcacagctcgtgtgtttcgacgagcaatcgtgatgcccaatctcaggccaccaatcacgagtgtagaagcagcaaaaacctatcgcgaccagattttggcagcccttcctgatggtgttccgtttacgccattgatgacggcctacctcaacgaaagcttggctccagatgttttagaacaagggcatcaacagcatgttttcatcgccgccaagctttatccagcccatgccacaactaattccgagcagggggtcagtgatctaagagcgattaactcacttctagagacgatggagaaaattgggatgccattgctcgttcatggtgaggtgagcgatgtcgatatcgacatttttgatagagaagccttttttattgagcaccacctggcaccactaatagggcgttatccaaatcttcgtgtcgtgatggagcacatcacgacgcaagaggcagttcagttcgtggaaacaggtgggccgaatctggcagccactatcactcctcatcatttacatatcaaccgtaatgcaatgtttctcggtggttttcgtagtgatttctactgcttaccagtagccaagcgtgaacgccatcgactctccctgcgtcgagcagcgacaagtggcaaaccatgctttttccttggcactgattcggcaccacaccctcgctctgcaaaggagagtgcttgtagttgtggtggcattttcaatgctcattatgcgatggaaagttatgccgaagtctttgagcaggaaggagcacttgatcgccttgaggccttctccagtgaatacggtccagctttctatggcttgcccctcaataacacctcaatcaaactgatacgaagagctcatgttgtaccagctacttttagcggacaaacgaacgcagattcttctgaacacttagttccatttcatgctggcgaactgttgggctggtctgtttcggttgattga

SEQ ID NO: 27675 - protein, 354 aa, Prochlorococcus marinus str. MIT 9313
MDSLPDQLILRQPDDWHVHLRDGAMLHAVLGSTARVFRRAIVMPNLRPPITSVEAAKTYRDQILAALPDGVPFTPLMTAYLNESLAPDVLEQGHQQHVFIAAKLYPAHATTNSEQGVSDLRAINSLLETMEKIGMPLLVHGEVSDVDIDIFDREAFFIEHHLAPLIGRYPNLRVVMEHITTQEAVQFVETGGPNLAATITPHHLHINRNAMFLGGFRSDFYCLPVAKRERHRLSLRRAATSGKPCFFLGTDSAPHPRSAKESACSCGGIFNAHYAMESYAEVFEQEGALDRLEAFSSEYGPAFYGLPLNNTSIKLIRRAHVVPATFSGQTNADSSEHLVPFHAGELLGWSVSVD

SEQ ID NO: 27676 - DNA, 1032 bp, Synechococcus sp. WH 8102
  CDS (1)..(1032): transl_table=11
atggctgaacagctcacgatcaccgctccggacgattggcacgttcacctcagggatgaggagatgctggaacgggttgtggcctacacagcccgttgcttccggcgggccatcgtgatgcccaacctgcgaccgccggtcacgacggtggatgcagctcgttcgtaccgcgaccgcatcctgtcggcttgtcctgaaggcgtggcattcaccccgttgatgaccgcttatctcacggacaactccgatccagatgatcttgagcggggtttccaggagggggtctacaccgctgccaagctgtatcccgcgaacgccacgaccaattcagccgctggtgtgacggatctcgatcagatcggccgtgtcttgagccggatggaggccatcggcatgcctctgctcattcatggggaagtgacggatgcggatgtcgatgtgttcgaccgggaagcggtgttcattgagcggcatctgaagtccctgcggacccgtcaccctgagctcaaggtggtgttcgagcacatcaccaccgagcaggccgttgattacgtgggttcgtccgatcgcaatctggcggccacgatcaccccccatcacctgcagatcaatcgcaactccatgttccttggcggcttgcgcagtgacttttactgcctgccggtggtcaaacgggagcgccatcgccttgctctgcggcgggccgccaccagcggagatccacggtttttcctgggcactgattccgcccctcatccgagagccggcaaggaaacctcctgcggctgtgccggcatcttcaatgctccctttgcactggagagctacgcccaggtttttgcagaggaagaggccatgcatcacctcgaaggtttcgcctccctgcacggtccagccttctacggcctgcctgcgaacaacgacacggtgacccttgaaaaggttgctgttgacgtgcccgagctggtgaacgggctcgttcccttccatgctggggaaacgctgccctggaggcttcagccatgcatgtga

SEQ ID NO: 27677 - protein, 343 aa, Synechococcus sp. WH 8102
MAEQLTITAPDDWHVHLRDEEMLERVVAYTARCFRRAIVMPNLRPPVTTVDAARSYRDRILSACPEGVAFTPLMTAYLTDNSDPDDLERGFQEGVYTAAKLYPANATTNSAAGVTDLDQIGRVLSRMEAIGMPLLIHGEVTDADVDVFDREAVFIERHLKSLRTRHPELKVVFEHITTEQAVDYVGSSDRNLAATITPHHLQINRNSMFLGGLRSDFYCLPVVKRERHRLALRRAATSGDPRFFLGTDSAPHPRAGKETSCGCAGIFNAPFALESYAQVFAEEEAMHHLEGFASLHGPAFYGLPANNDTVTLEKVAVDVPELVNGLVPFHAGETLPWRLQPCM

SEQ ID NO: 27678 - DNA, 1086 bp, Chromobacterium violaceum ATCC 12472
  CDS (1)..(1086): transl_table=11
atggctttccatcgccattgttttatccatcgttacggcaagccatccaccatgcagactctcaccctgatccgccccgacgactggcatttgcacctgcgcgacgacgccgcgctggccgcggtgctgcccgacacctgtcgccagatgggccgcgccatcgtcatgcccaacctgaagccgccggtcaccaccgtggccgccgccgccgcctaccgcgagcgcattctggccgcgcgcccggccggcagcgccttcgagccgctgatgacgctttatctgaccgataaaaccagcgccgacgaaatccgcaaggccaaggcctgcggcttcgtccacggcgtcaagctgtacccggccggcgccaccaccaattccgaccacggcgtcaccgatatcgcccacgcgatgccggcgctggaggcgatggccgaagccggcatgccgctcttggtgcacggcgaagtcaccgacgccgacatcgacgtgttcgaccgcgaggcggtgttcatcgagcgggtgatgaagcccttgctggccaagctgccgcaactgaaggtggtgttcgagcacatcaccacccgagaggcggccgagttcgtcgccgccgcgccggccaacgtcgccgccaccatcaccgcccatcacctgctgatgaaccgcaacgcgctgtttgtcggcggcatccgcccgcaccactactgtctgccggtgctcaagcgcgagctgcaccgccaggcgctggtgaaggcggcgacgtcgggctcggccaagttctttctcggcaccgacagcgcgccgcacgcgaagggcgccaaggaggcggcttgcggctgcgccggcatgtacaccgccaacgcggcgatcgagctctacgccgaggctttcgaggccgccggcgcgctggacaagctggaggctttcgccagcctgaacggcccggctttctacggcttgccggccaacggcgaccgcatcgagctggtcaaggagagttggacggtgccggccgagctgccttatcccggcgacagcctggtgccgctgcgcgccggcgacagcgtcgcctggcgtctgcggcgctga

SEQ ID NO: 27679 - protein, 361 aa, Chromobacterium violaceum ATCC 12472
MAFHRHCFIHRYGKPSTMQTLTLIRPDDWHLHLRDDAALAAVLPDTCRQMGRAIVMPNLKPPVTTVAAAAAYRERILAARPAGSAFEPLMTLYLTDKTSADEIRKAKACGFVHGVKLYPAGATTNSDHGVTDIAHAMPALEAMAEAGMPLLVHGEVTDADIDVFDREAVFIERVMKPLLAKLPQLKVVFEHITTREAAEFVAAAPANVAATITAHHLLMNRNALFVGGIRPHHYCLPVLKRELHRQALVKAATSGSAKFFLGTDSAPHAKGAKEAACGCAGMYTANAAIELYAEAFEAAGALDKLEAFASLNGPAFYGLPANGDRIELVKESWTVPAELPYPGDSLVPLRAGDSVAWRLRR

SEQ ID NO: 27680 - DNA, 1014 bp, Wolinella succinogenes DSM 1740
  CDS (1)..(1014): transl_table=11
atggagagactcaccctcatcgatcccttggatatgcatcttcacctccgagagggcgaaaccctaaagcgcgtcctcccctacacagcgaatctctttagcggggcagtggtgatgcctaacctcaaaacacccctctgcaccacccaagaggtgctctcctacaaaaagagcattgaggaggcttgccccaaagagcgcttcatcccctttatgacgctcttttttcatgagaatctcactttagaagagctcactttagcccaaatagagggaattagaatcatcaaactctaccctaagggctccaccacgggaagcgaggcgggtgtggcgcagattctcacccctaaaaccctccaaatcctagaaacgatgcaatctcttggtctcatcctctcaatgcatggcgagagcggagggtttgtcctagagagggagtttgagtttttgagtgtctatgaggagattgcacgcacctttccaaagcttcaaatcatcattgagcacatgagcgatgcccgctccttagagcgaatcgagcgttttagcaatctctatggcacgctcaccctccaccacctcctctacacacttgatgacctcctaggccaagccctcaatcctcacctcttctgcaaacctgtcttaaaactccctagagatagagaggcgttgcaaaaggcggcattaggcgcccaccccaaaatctcctttggaagcgatagcgctccccaccccaaagaggccaaagagagcgccaaaggggcagcgggaatctttagcgctcccttgcttttaccccttttagccgagctctttgagcgccacgggaagctagaaaatcttcaggcttttgtctctgataatgcccataggatttatggaatcgcccccttaggcaaaagggtgacccttcttcaagaagaatcgctcatagaggaggattattcgggattcatcccccctgaggcaggcaagagagtccgctggagagtggagagttcgtgctag

SEQ ID NO: 27681 - protein, 337 aa, Wolinella succinogenes DSM 1740
MERLTLIDPLDMHLHLREGETLKRVLPYTANLFSGAVVMPNLKTPLCTTQEVLSYKKSIEEACPKERFIPFMTLFFHENLTLEELTLAQIEGIRIIKLYPKGSTTGSEAGVAQILTPKTLQILETMQSLGLILSMHGESGGFVLEREFEFLSVYEEIARTFPKLQIIIEHMSDARSLERIERFSNLYGTLTLHHLLYTLDDLLGQALNPHLFCKPVLKLPRDREALQKAALGAHPKISFGSDSAPHPKEAKESAKGAAGIFSAPLLLPLLAELFERHGKLENLQAFVSDNAHRIYGIAPLGKRVTLLQEESLIEEDYSGFIPPEAGKRVRWRVESSC

SEQ ID NO: 27682 - DNA, 1080 bp, Oryza sativa (japonica cultivar-group)
  CDS (1)..(1080)
atggccgcgtcgccgtcgccgccgccgctgcaggagctcaccatcacgcggcccgacgactggcacctccacctccgggaaggcgatgtcctcgcggccgtgctcccccacagcgcgatgcattttgggagggccatcgtgatgcccaacctgaagccaccggtgaccacgacagcacgagctttggagtacagggaggagatcctcagggcgctgccgcctgggagcaactttgtgccgctcatgacgctctacctcacggacaatactagcccagaggagatcaagctcgcaaaaaagagtggcgtggtttttgctgtgaagttgtacccttctggagcaactaccaactcccaagatggtgtcactgatatatttgggaagtgcttgcctgtgcttgaggaaatggctaggcaggagatgcctttgcttgttcatggagaagtcacagatcagcatgttgatacctttgatcgtgagaaggttttcattgagaaaatattggcaccacttgtacaaagactgccacagctgaaaattgttatggaacatatcaccactatggatgcggttaacttcgtagaatcatgcaaagaaggtcatgttgctgcaacggtgactccccaacatcttcttctcaacaggaatgcgttatttcagggtggcttgcagccacacaactattgcttaccagtactgaaaagagaaactcatagacaagcaattgtgtctgcggtaacaagtgggagtaaacaatactttcttggtactgacagtgctcctcatgataaacggagaaaagaatgctcctgtggttgtgcaggaatatatagcgctcctgtggctctttctctttatgcgaaagtattcgaacaggccggtgctcttgataagctagaagcatttacaagcttcaatggcccagatttttatggccttccaaggaacacttcaaagattgtccttagaaagagcgcctggaaagtacctgatacatactcatatagttcaggagagatcgtgcctatgtttactggcaacaccctcgaatggcttccatccgatcaacttgaagagtaa

SEQ ID NO: 27683 - protein, 359 aa, Oryza sativa (japonica cultivar-group)
MAASPSPPPLQELTITRPDDWHLHLREGDVLAAVLPHSAMHFGRAIVMPNLKPPVTTTARALEYREEILRALPPGSNFVPLMTLYLTDNTSPEEIKLAKKSGVVFAVKLYPSGATTNSQDGVTDIFGKCLPVLEEMARQEMPLLVHGEVTDQHVDTFDREKVFIEKILAPLVQRLPQLKIVMEHITTMDAVNFVESCKEGHVAATVTPQHLLLNRNALFQGGLQPHNYCLPVLKRETHRQAIVSAVTSGSKQYFLGTDSAPHDKRRKECSCGCAGIYSAPVALSLYAKVFEQAGALDKLEAFTSFNGPDFYGLPRNTSKIVLRKSAWKVPDTYSYSSGEIVPMFTGNTLEWLPSDQLEE

SEQ ID NO: 27684 - DNA, 1044 bp, Vibrio vulnificus YJ016
  CDS (1)..(1044): transl_table=11
atggtgggagcaacaatgacaacacttactattactcgtcctgatgattggcacgtacacttacgcgatggcgaagttttggcagataccgttcgcgatatcagccgttacaatggccgcgcactcatcatgccaaacactgtcccacccgtcaccacgactgaaatggcgcttgcctatcgcgatcgcattcaagcacataaccaaacagaacaattttctccgcttatgtcgctatatttgaccgacaacacaactgcggatgaagtacgcaaagccaaggccagcggtgctgtagtcgcagcaaaactgtacccagcaggcgcgacaactaactccgattctggcgtgacggatgtaaagaaaatttatccagtccttcaagcgatgcaagaagtaggcatgttgctactggtacacggcgaagtgaccacacacgatgtggacatctttgatcgcgaaaaaacctttttagacaatgtgttggcgccgattgttcaagacttccctgatttgaaaattgtcctcgaacacatcaccacctcagatgcggttgtgtttgtgaaaaatgccaatgaaaacgttgccgcaaccattaccgctcatcacctgctgtacaaccgcaatcacatgttagtaggcggcatcaagccccacttctactgcttgccaattcttaaacgcaacacccaccagcttgcgttgatctctgctgcgacgagtggcaacaagaagttctttttgggtacggactctgcgccacacgccaaaggcgcaaaagaatccgcttgtggttgcgcgggctcttacacggctcacgccgctttggaactgtatgcagaagtgtttgagcaagcgggcaagttggaaaatctcgaagcgtttgccagccataacggtccagatttttacggtttgcctcgcaatcaagacacaattacgttggtaaaagacgcatggcctgttcctgcttcaatgccatttggtggtgatattgtggtgccaattcgcgctggtgaaaacatggagtggaaggttaagtaa

SEQ ID NO: 27685 - protein, 347 aa, Vibrio vulnificus YJ016
MVGATMTTLTITRPDDWHVHLRDGEVLADTVRDISRYNGRALIMPNTVPPVTTTEMALAYRDRIQAHNQTEQFSPLMSLYLTDNTTADEVRKAKASGAVVAAKLYPAGATTNSDSGVTDVKKIYPVLQAMQEVGMLLLVHGEVTTHDVDIFDREKTFLDNVLAPIVQDFPDLKIVLEHITTSDAVVFVKNANENVAATITAHHLLYNRNHMLVGGIKPHFYCLPILKRNTHQLALISAATSGNKKFFLGTDSAPHAKGAKESACGCAGSYTAHAALELYAEVFEQAGKLENLEAFASHNGPDFYGLPRNQDTITLVKDAWPVPASMPFGGDIVVPIRAGENMEWKVK

SEQ ID NO: 27686 - DNA, 1086 bp, Eremothecium gossypii
  CDS (1)..(1086)
atggaagagattgaactaggagtcacatgcgacatgcatgtgcatgtcagggagggcccaatggcggagttggtaaccccgacgatcagagaaggcggggtttccgtcgcgtacatcatgcccaacttgcagccgcccgtcacgacgctggagcgtgtaattcagtacaagcagtcgctggagcagatgagcccacagacaacgttcctcatgtcgttctacttgtgccgtgagttgacgcccgaactgatccacgaggcggcgcaagcgggcgcgatccagggtgtgaagtgctatccggcaggagtcaccaccaactctacgagcggtgttgatccgaatgacttctcggccttttaccctgttttccgtgccatggaggaggaaggactggtcctgaatctgcatggtgaaaagccaagtgtctcggatgactccgaggacatccacgtgatgaatgccgaagagtcatttctgcctgcgctgaagcagatccatgcggcctttcccaacctgaagattgtgcttgaacactgcacgacagctgcggccgttgccgcaattgaggagctcaaccgcggcgtgtccgcagccgcggaggtgcgcgttgccgcgaccctgacggcccaccacctttcgctgaccatcgacgactgggcaggcaaccccgtcaacttctgcaaacccgtcgccaagcttcccagcgaccggcgcgccctcgtccgctcggcaaccagcggcaagccctacttcttctttgggtcggactccgcaccgcaccctgtggaaaacaaatcgagacacgccggcgtctgcgccggcgtctactcgcagtcgctggccatcccgtacctcgcgcaggtgtctgatgcgcacggggcgctgccgcagctgacggcgttcgtttccgactttccgctccagttctacggcgtcgggcgcgacacccttcgatccggcgaccgtgctgtgctctacaggtcgcgccagcaggtccccggccacattacggatggccgcggaatcgtggttgatcccttcaaagccggcgagacgctggactgggccgtccgttgggacgcctag

SEQ ID NO: 27687 - protein, 361 aa, Eremothecium gossypii
MEEIELGVTCDMHVHVREGPMAELVTPTIREGGVSVAYIMPNLQPPVTTLERVIQYKQSLEQMSPQTTFLMSFYLCRELTPELIHEAAQAGAIQGVKCYPAGVTTNSTSGVDPNDFSAFYPVFRAMEEEGLVLNLHGEKPSVSDDSEDIHVMNAEESFLPALKQIHAAFPNLKIVLEHCTTAAAVAAIEELNRGVSAAAEVRVAATLTAHHLSLTIDDWAGNPVNFCKPVAKLPSDRRALVRSATSGKPYFFFGSDSAPHPVENKSRHAGVCAGVYSQSLAIPYLAQVSDAHGALPQLTAFVSDFPLQFYGVGRDTLRSGDRAVLYRSRQQVPGHITDGRGIVVDPFKAGETLDWAVRWDA

SEQ ID NO: 27688 - DNA, 1074 bp, Neurospora crassa
  CDS (1)..(1074)
atggctctcaaggactcctacctcctccccgccgcggcggacatgcacgtccacctgcgcaacgcccccggccccattgccgagctggtcaccccgaccatccgcaaggccggcatcgacaccgtcttcgtcatgcccaacttggctcctcgccccgtcgtcaccgtcgatgaggctctcgagtacaagaaggccctccaggcttacgaccccgaggtcaactacctcatgtctctctaccttcacgagagcatcacccccgatgagatccgcaaggccaagaaggccggtattgccggtgtcaaggcctacccccgcggcgccaccaccaactcccaatggggcgttgtttccttcgaccccttccacgaactcctctccaccatggaatccgaaggtctcgtcctcaacctgcacggcgagatgccctcctcgcccaccgacaacgtgaccgtcatgaacgccgagtccaagttcctgcccaccctcgcctctctgcacagcaagtaccccaacctcaagatcgtgctcgagcactgcaccaccgccgacgccgtcgccgccgtgcgcgcctgtggcgccaacgtggtcgccaccatcacggcccaccacctctcgctgctcgtggacgactggtccgccaacgtgcaccactactgcaagccgagcgccaagtcgcccgaggaccgccgcgcgctgctgcaggccttggtcacgagcgagggcaaatttttcctgggcaccgactcggcgccccatgatatctcgagcaagaagggtaaaggcaacacggcggcgggcgtgttcacgcagccgtatgcgttgggctatgtgttgactgcgctggaagagggcattgcgagaggagatatcaaggaggagcaggtgacggaggaggtgttggcgggcttcttgagtgagtttggtcgcaagttttatgagcttgggccggcggagaagcagatcctggtcaagagggatggggcggtggtggaggagagtctcaagacggacaaggtggagattgtgccgtacaggagcggcgagaagacgtggagtgttgagtggcagtga

SEQ ID NO: 27689 - protein, 357 aa, Neurospora crassa
MALKDSYLLPAAADMHVHLRNAPGPIAELVTPTIRKAGIDTVFVMPNLAPRPVVTVDEALEYKKALQAYDPEVNYLMSLYLHESITPDEIRKAKKAGIAGVKAYPRGATTNSQWGVVSFDPFHELLSTMESEGLVLNLHGEMPSSPTDNVTVMNAESKFLPTLASLHSKYPNLKIVLEHCTTADAVAAVRACGANVVATITAHHLSLLVDDWSANVHHYCKPSAKSPEDRRALLQALVTSEGKFFLGTDSAPHDISSKKGKGNTAAGVFTQPYALGYVLTALEEGIARGDIKEEQVTEEVLAGFLSEFGRKFYELGPAEKQILVKRDGAVVEESLKTDKVEIVPYRSGEKTWSVEWQ

SEQ ID NO: 27690 - DNA, 957 bp, Gibberella zeae PH-1
  CDS (1)..(957)
atgcctaatcttctccctcccctcacttcggtcgagcagcgattccaggttcttgactacaagtccaagttgactgccatcactcaagatgtcaactttctcatgtccctttatcttcatccttcagttacccctgaagtgattgctcaagctgccgaggccggtgtcactggtgtcaagctgtatcctcagggtgtcaccaccaactctgaaaatggtgtttctgatatcacagcgttctatgacacatttgctgctatggagaagcacggaatcgtcttgaacatccacggagaagctctcgagtctcttgccccagctgataccaccctggaggaggcttttctccccactttgaagcaacttcacgatcggttccctaagcttcgcattgtactcgagcattgcactaccgctgccgctgtagaggctgtcaaggcctgcggacctaccgttggtgctactattactgcccaccacctttacctcacttcgcacgaggcttgctgcgacccctttgctttttgcaagcccatccctaagaagcccactgacagagacgctctggtcaaggctgtcgtgagcggtaacaacaagttcttctttggaagtgacagtgctcctcactccctgcagtccaagacctctgctgagcaaggcaaggcccctgcaggtgtcttcactcagccttatgttgtgcagcttgttctccttggtctcgaggaagccattgagcgtggggccatatccgaggaagaagttacagaggagaagctcgaaaacttcttcagccgcaatggtcgacgcttctacaagttgcccgatacctctggcaacaagatcatcttggagaggaagggcgagaagatccccactagtgtcaagagtgccgacggaaagtctgaggttggtatttccagacatggcactgaggtgttcagcctgacctgggcctga

SEQ ID NO: 27691 - protein, 318 aa, Gibberella zeae PH-1
MPNLLPPLTSVEQRFQVLDYKSKLTAITQDVNFLMSLYLHPSVTPEVIAQAAEAGVTGVKLYPQGVTTNSENGVSDITAFYDTFAAMEKHGIVLNIHGEALESLAPADTTLEEAFLPTLKQLHDRFPKLRIVLEHCTTAAAVEAVKACGPTVGATITAHHLYLTSHEACCDPFAFCKPIPKKPTDRDALVKAVVSGNNKFFFGSDSAPHSLQSKTSAEQGKAPAGVFTQPYVVQLVLLGLEEAIERGAISEEEVTEEKLENFFSRNGRRFYKLPDTSGNKIILERKGEKIPTSVKSADGKSEVGISRHGTEVFSLTWA

SEQ ID NO: 27692 - DNA, 1185 bp, Ustilago maydis 521
  CDS (1)..(1185)
atgtcagtacaagagatcacgattccggcgccggccgattttcacgtgcatctgcgacaaggaaagatgtcggagctcgtcaccccgcacgtcgccgagggaggcgtctcgcttgcatatgttatgcccaaccttgtacctccgatcacatcgacacagcaagcgatggaatacctcgagcgcttgcgagcgcttgctcctcagaccatgttcgtcggcacgctgtatctatcgcctgacttgacgccggcggaaatcgccaaggcggctcagaatggtgtccgaggtgtcaagagctatcctcgtggagtcactacgaactcggacagcggcatcgaggattacgagacctactatcccatctttgaagagatgcagaaacacgatatggtcctcaacttgcacggcgagcttccttcgaatgcagacgcgggcatctgcgtgttgaatgccgaggaaaagtttttgacgcacctgttcaagatccacggtgaatttcccaagctcaagatcgtgctggagcatgcgaccaccaggaaggcggtcgaagccgtcaagcagtgtggcgacacagtgggctgtaccatcacaccgcatcacctcgagctcatcgtggatgactgggcgggcaagccactcaacttttgcaagccagtcgccaaatatcccgatgaccgacaggcgttgcgcgacgtcattcgccaaggtcatcctcgcttcttcctcggctcagattcggcgccgcacccgttggctaacaagtatccttccgcagtcacacatggcgctcctggaaccaaagcttctgcatctggcagcgatcacctcgaagctactggtgtcgtctcgtgtggttgcgcagcgggcgtctacacctcgtcgatccttgtgcctctttgcgcgacgctgctcgaagcgtttggcgcgttggatcaacttgccaactacgtcagcatcaacgggcgcaacttctatggctacaacgatgatcagcatgccaaacacggcagcataaagcttcgcaaggtgcgcagccgatcatcgatttcgccagcagctgcaaccgttcctgcagtctatgtccatcccgagttccgagaggtgccagattcagatgcatccaaggtgcaagtagtgcctttctgggcgggcaagtgtctcggctgggagatcgtccgttcgtga

SEQ ID NO: 27693 - protein, 394 aa, Ustilago maydis 521
MSVQEITIPAPADFHVHLRQGKMSELVTPHVAEGGVSLAYVMPNLVPPITSTQQAMEYLERLRALAPQTMFVGTLYLSPDLTPAEIAKAAQNGVRGVKSYPRGVTTNSDSGIEDYETYYPIFEEMQKHDMVLNLHGELPSNADAGICVLNAEEKFLTHLFKIHGEFPKLKIVLEHATTRKAVEAVKQCGDTVGCTITPHHLELIVDDWAGKPLNFCKPVAKYPDDRQALRDVIRQGHPRFFLGSDSAPHPLANKYPSAVTHGAPGTKASASGSDHLEATGVVSCGCAAGVYTSSILVPLCATLLEAFGALDQLANYVSINGRNFYGYNDDQHAKHGSIKLRKVRSRSSISPAAATVPAVYVHPEFREVPDSDASKVQVVPFWAGKCLGWEIVRS

SEQ ID NO: 27694 - DNA, 1077 bp, Candida glabrata CBS138
  CDS (1)..(1077)
atgagtgaaattgatttgggtattacttgcgacatgcatgtgcatgtccgtgaaggggatatgtgtgagttggtgactccttctatccgtgatggcggtgtctctgtctgctatgtgatgcctaacttacaaccacctattaccactttggatagagtggttgcgtataagaagaaattgcaagaacttgctcccgagaccaccttcttaatgagtttctacttgtcccgtgatttgactccggaattgatccatgaagctgccagagccaaggctattcaaggtgtgaaatgctatcctgctggtgtaactacaaactcaagtgctggtgttgatccaaacgattttactgccttctatcctatattcaaggctatggaagaagaacatctggtcttgaatcttcatggtgagaaaccctcagtggccaaggaagatatccatgttctaaatgcagaagaatcatttctaccggctctgaagaaattacacacagatttcccaaacttgaaaattatattggaacattgcacaactgaggctgcagtaaatgccatcgaggagattaacaagaatgtgacaaacatatctgatgttaaagtggccgccaccttaacagctcatcacttgtacttaacaatagatgactgggccggtaatccaattaatttctgtaaaccagtggcaaagttgcctagagacagaagagcgctagttgctgcagcaacctctggcaagccatactttttctttggctctgattcagcacctcatcctctggagatgaaaggacgtcacattggtgtctgtgctggtgtatacactcagtcactagctatcccgtacgttgctcaagtgttccatgaagccaatgccatggataaattgaagggttttgtatccgattttggcttggcattctacgatgtaccacaaagtgaaattagatcgacccagcacgcaatcttgtacaaacaagaacaaacagttcaagacaccattcaaggaaagaacaatttgaaggttgctttatttaaaccaggtgagaaattggatttttctgttaagtggcaataa

SEQ ID NO: 27695 - protein, 358 aa, Candida glabrata CBS138
MSEIDLGITCDMHVHVREGDMCELVTPSIRDGGVSVCYVMPNLQPPITTLDRVVAYKKKLQELAPETTFLMSFYLSRDLTPELIHEAARAKAIQGVKCYPAGVTTNSSAGVDPNDFTAFYPIFKAMEEEHLVLNLHGEKPSVAKEDIHVLNAEESFLPALKKLHTDFPNLKIILEHCTTEAAVNAIEEINKNVTNISDVKVAATLTAHHLYLTIDDWAGNPINFCKPVAKLPRDRRALVAAATSGKPYFFFGSDSAPHPLEMKGRHIGVCAGVYTQSLAIPYVAQVFHEANAMDKLKGFVSDFGLAFYDVPQSEIRSTQHAILYKQEQTVQDTIQGKNNLKVALFKPGEKLDFSVKWQ

SEQ ID NO: 27696 - DNA, 1095 bp, Kluyveromyces lactis NRRL Y-1140
  CDS (1)..(1095)
atgtccgaatctcaaactgaatatgatcttggtatcacttgtgatatgcacgtccatttgagagatggcgaaatgtgcaaattgatcactcctactgtgaaggaaggtggtatttctgttgcttatgtgatgccaaacctaagcccaccggttattaccttggaaagagtccaagagtataaatgtaccttggaatctcttgcaccagaaacaacttttttaatgtctttctatctctgcaaagatttgacgcctgaattgatccatgcagcagcaaaagttggtgctattcaaggcgtgaaatgttatcctgctggtgtgactaccaactcggcgcaaggtgtggaccctaacgatttcacagtgttttatccattgtttaaggccatggaagaagagggcatcgtgttgaatttacatggtgaaaaaccaagtgtcgctggtgaaaaagaggatattcatgttttgaatgccgaagaatcattcttgcctgccttaaagaagctccaccttgatttcccaaagttgaagatcattttggaacattgcaccactgctgccgccatcaagaccattgaagagatcaatgctgatgtcaaggatccattggatgtcatggtcgccgctactatcaccgcgcatcatcttttcttgactattgacgattgggctggaaatccaatcaatttctgtaagcctgttgcaaagcttcctagcgataaaagggctctagttcaagctgcaacatccgggaaaccatactttttctttggatctgattctgcgccacatccgatagaaaataaagctaaacatgtaggcgtatgtgccggtgtgttttcgcaatcgctggcaattccatacctggctgaaatattcgaaactcaaggaaaactggacactttaaagaacttcgtaagcgatgcaccattatcattttatgcattgaaaccagaagacatcaagtccaaccaaaacgttacagtcttcaaaaagacaactaatatcccagaaataatcactgatggaaaaggcctcagagttgctccattcaaagctggagatgagttacactgggctgtcagatgggactag

SEQ ID NO: 27697 - protein, 364 aa, Kluyveromyces lactis NRRL Y-1140
MSESQTEYDLGITCDMHVHLRDGEMCKLITPTVKEGGISVAYVMPNLSPPVITLERVQEYKCTLESLAPETTFLMSFYLCKDLTPELIHAAAKVGAIQGVKCYPAGVTTNSAQGVDPNDFTVFYPLFKAMEEEGIVLNLHGEKPSVAGEKEDIHVLNAEESFLPALKKLHLDFPKLKIILEHCTTAAAIKTIEEINADVKDPLDVMVAATITAHHLFLTIDDWAGNPINFCKPVAKLPSDKRALVQAATSGKPYFFFGSDSAPHPIENKAKHVGVCAGVFSQSLAIPYLAEIFETQGKLDTLKNFVSDAPLSFYALKPEDIKSNQNVTVFKKTTNIPEIITDGKGLRVAPFKAGDELHWAVRWD

SEQ ID NO: 27698 - DNA, 1083 bp, Debaryomyces hansenii CBS767
  CDS (1)..(1083)
atggccaaggaaatcgaattaggtatcaccgctgacatgcacgtccacttacgtgatggtaaaatgatggagttaattacacctactgttagagaggggggtatatcgatagcatacgttatgccgaacttggttcccccaattacaactatcgatagggtagttgaatataagcaaaacttagaaaagttgtcaccaaagaccacatttttgatgtcattttatttatcgaaagagttaagtcctgaattgattctggatgccgccaaaataggggccattcatggtgtcaagtgctacccagctggtgttactaccaattctgctgctggtgtcgatcccaacgacttcacacctttctaccctattttcaaagcattggaagagaataatcttgttttgaatttgcatggcgaaaagccaccatcgaaggatggcgaagaggatatccatgtcttgaacgccgaaccaaagttcttaccagccttagaaaaattgcataatgacttcccaaacttgaagatcatcttggaacattgtacaacaaaggatgcaatcgacatgattgaaaaaatcaatgctggtcacaaagacggtgatgatgtcaaggtcgctgctaccatcactgctcatcatttatcgcttacaattgataactgggctggaaatcctatcaacttttgtaagccagttgctaagttgccagctgacaagcgtgccttagtacaggctgcgacgtctgctaaaccatacttcttctttggatctgactctgctcctcatcctttatccgccaaggcaaaacatacgggcgtatgtgccggtgtctacacccaatcgcatgctattgcttacttggcagaggtcttcgaaagtcagaatagattagccaacttgaagaagtttgtgaatgacaacggtaaaggcttctacggaatttgtgaccaagatgttaaatgcaaagataaatgctacttggtacagaatgccaacaatgtccccgaaatgtttggtaacaaggatattactgttgttcctttcaaagctggtgaagaattaaaatggacagttgaatggagatga

SEQ ID NO: 27699 - protein, 360 aa, Debaryomyces hansenii CBS767
MAKEIELGITADMHVHLRDGKMMELITPTVREGGISIAYVMPNLVPPITTIDRVVEYKQNLEKLSPKTTFLMSFYLSKELSPELILDAAKIGAIHGVKCYPAGVTTNSAAGVDPNDFTPFYPIFKALEENNLVLNLHGEKPPSKDGEEDIHVLNAEPKFLPALEKLHNDFPNLKIILEHCTTKDAIDMIEKINAGHKDGDDVKVAATITAHHLSLTIDNWAGNPINFCKPVAKLPADKRALVQAATSAKPYFFFGSDSAPHPLSAKAKHTGVCAGVYTQSHAIAYLAEVFESQNRLANLKKFVNDNGKGFYGICDQDVKCKDKCYLVQNANNVPEMFGNKDITVVPFKAGEELKWTVEWR

SEQ ID NO: 27700 - DNA, 1038 bp, Yarrowia lipolytica CLIB99
  CDS (1)..(1038)
atgacttctatcaaccttggccaccccgtcgacatgcacgtccacctgcgacagggcgagatgatgaagctcgtcacccccaccgtcaagcagggcggtttctccgtcgcctacgtcatgcccaacctggtccctcccgtcacttctcccgagcgagctttggagtacaagcaggagctccaggccctggcccctgacaccgagttcatggtcaccatgtatctgtctccagagatcacccccgaggttgttgctgacgctgctaagaagggagtctccggtatcaaggtctatcctgcgggtgtcaccacaaactccgatcagggagtctcttcatacgagcagtactaccccgtcttccgagccatggaggagcacaaccttgttcttaacctgcacggtgagtgccccagcactccccagagcgacatcaccgttctgaacgccgaggagcggttcctgcccacccttggagagctcaacaagatgttccccaagctgcgaatcgttctcgagcactgcaccaccaaggctgctgttgatgctgtcaacgcctgtgatgacaacgtctccggctctatcactgctcaccacctgtctctgattatcgacaactggtccggtaacgccatcaacttctgcaagcctgttgccaagctgccctctgatcgagacgctctcgtggctgccgccacctccggctcacccaagttcttcttcggatccgactctgctcctcaccctatcaagaacaagcgaacctgcaacaacgcccctgctggtgtcttcactcagagccacgctctgacctacgtcgcccaggtcttcgacaaggccggcaagctcgataatctcaagaagttcgtcaccgataacggccgaaagttttaccagatcgagaacatggccaccagcggccccgaggtcactgttgtcaggaaggaggttgtcattcctggtctcatcggtcctgaggacgacggtgttgttcctttccgagccggcgagaagctcgactggaccattgaatggaactag

SEQ ID NO: 27701 - protein, 345 aa, Yarrowia lipolytica CLIB99
MTSINLGHPVDMHVHLRQGEMMKLVTPTVKQGGFSVAYVMPNLVPPVTSPERALEYKQELQALAPDTEFMVTMYLSPEITPEVVADAAKKGVSGIKVYPAGVTTNSDQGVSSYEQYYPVFRAMEEHNLVLNLHGECPSTPQSDITVLNAEERFLPTLGELNKMFPKLRIVLEHCTTKAAVDAVNACDDNVSGSITAHHLSLIIDNWSGNAINFCKPVAKLPSDRDALVAAATSGSPKFFFGSDSAPHPIKNKRTCNNAPAGVFTQSHALTYVAQVFDKAGKLDNLKKFVTDNGRKFYQIENMATSGPEVTVVRKEVVIPGLIGPEDDGVVPFRAGEKLDWTIEWN

SEQ ID NO: 27702 - DNA, 1062 bp, Cryptococcus neoformans var. neoformans JEC21
  CDS (1)..(1062)
atgctacaagaaatcgctcttccttctcctgctgacttccatgtccatgtgagacaaggaaagatgtgtgagctcgtcactcctcaagttggtaagggaggtgttcgcaccgcgtatgtaatgcccaacctcgtcccacctctcacttccaccgatgctgttttatcctacaaggccgagcttgagaagattgatccctctgttcagtggctcatgaccctttatttgcatcctgacgtaactcccgctgagatccgcaaagctgctaaagcgggcatcaaaggtgtcaagtcttaccctcgaggagtcactaccaactccagttctggcatcgaagattacgaagtctactaccccgtctttaaggctatggaggaagaagacatggtcttgaacttgcacggagaagtgcccagtgatgctgacaagaacatctcaatcctcaatgctgagattcatttcctcgaacatctccgtaaactcgcgaccgctttccccaagcttcgtatcgttcttgagcatgctaccacctctgctgcggtcgagactgttgcttccctcccttccaacgtcgcctgtacaatcactgctcaccatctgtatcttacaatcgatgaggtcgctccccaaccccaccacttctgcaaacctcttgctaaggagcccaaggatagaaaggccctccaagacgccatcaagagcgggaacgagaagttcttcttgggcagtgatagtgctccccaccccttgtccagtaaggcccctgctttaactgataagggcgctgtgagcgcttgtgctgccggtgtatacaccagtcccattttgatcccgctagttgcgacccttttggaaagtttcggtgctttggataagcttgagggattcgtcagtggacacggaaggaaattctatggggagcctgccaaggagggacaggagttaaggttgaggaggacgaaggaggatgaaggtttcgttaagggaacattcaggggtgatggtgtggaagtcatgcctttttgggctggcaagaggctgggttgggaaattgctcaatga

SEQ ID NO: 27703 - protein, 353 aa, Cryptococcus neoformans var. neoformans JEC21
MLQEIALPSPADFHVHVRQGKMCELVTPQVGKGGVRTAYVMPNLVPPLTSTDAVLSYKAELEKIDPSVQWLMTLYLHPDVTPAEIRKAAKAGIKGVKSYPRGVTTNSSSGIEDYEVYYPVFKAMEEEDMVLNLHGEVPSDADKNISILNAEIHFLEHLRKLATAFPKLRIVLEHATTSAAVETVASLPSNVACTITAHHLYLTIDEVAPQPHHFCKPLAKEPKDRKALQDAIKSGNEKFFLGSDSAPHPLSSKAPALTDKGAVSACAAGVYTSPILIPLVATLLESFGALDKLEGFVSGHGRKFYGEPAKEGQELRLRRTKEDEGFVKGTFRGDGVEVMPFWAGKRLGWEIAQ

SEQ ID NO: 27704 - DNA, 1083 bp, Plasmodium berghei
  CDS (1)..(1083)
atggaaagcgggtttagcattccgttagcagatgatatgcattgccatttaaggcaagatgatatgctaaaatttacagtccctgcaataaaaaaaggaggatgtaatcgagttttagtaatgcctaacactataccaattataagtagttgtgaagaagccaagaaatatagagatgaattaataaaatatgatagcagtatagaatatttgatgactctatatttaaataaaaaaactgatgaaaatgatatattaattaattacaaagaatgcaatttacaaggaataaaagtatacccaagtaatgtaacaacgaattctaacgatggtgtatcaagtttagaaccatattataaaatattttctacattagaaaaaataaataaaagtttacatatacattgtgaagaacctaatataaatccagtatatgcagaaaaggaatatttacagcatatacatgatatatctattaaattcccacatttaaaaatagttttagaacacatatcaactgaaaatatgatagagcttgttaaaaaatatccaaatatagcaggatctattactcctcatcatttgcatctaactattgatgatgttgtagatgtaaaaaattatgattactcatttaacaatacagatattgaaaaatatgtaaaaaatgtatataattattgtcctttacctaaaacattagatgataaaatagcattatgcaatattataaaagagggaaaccctaaagtatttttaggttctgactcggctccacattatcaaaaatttaaacaagaacctcattataagcctggtatttttacacagccttttcttttatcatatcttgctcatatatttaataaatttaattcattagacaaaattgaaaattttgcttgtaaaaatgctgcacaatttttaaatttgaaacctaaacccatcgaaaataataaaaatagtattatatacatacaaaaaaaaaattttacaataccaaatgaatattttggagttgttccatttttagctaatcagacaattgattttacagcatcctataaacatgatgtcgtttaa

SEQ ID NO: 27705 - protein, 360 aa, Plasmodium berghei
MESGFSIPLADDMHCHLRQDDMLKFTVPAIKKGGCNRVLVMPNTIPIISSCEEAKKYRDELIKYDSSIEYLMTLYLNKKTDENDILINYKECNLQGIKVYPSNVTTNSNDGVSSLEPYYKIFSTLEKINKSLHIHCEEPNINPVYAEKEYLQHIHDISIKFPHLKIVLEHISTENMIELVKKYPNIAGSITPHHLHLTIDDVVDVKNYDYSFNNTDIEKYVKNVYNYCPLPKTLDDKIALCNIIKEGNPKVFLGSDSAPHYQKFKQEPHYKPGIFTQPFLLSYLAHIFNKFNSLDKIENFACKNAAQFLNLKPKPIENNKNSIIYIQKKNFTIPNEYFGVVPFLANQTIDFTASYKHDVV

SEQ ID NO: 27706 - DNA, 1077 bp, Candida albicans SC5314
  CDS (1)..(1077): transl_table=12
atgtctgatattgaattaggtataactgccgatatgcacgtacatcttcgtgatggtagcatgtgtgaactaattactcctactgttagaacaggaggtattgccatctcttatgttatgccaaatttggttcctccaattacaactaaacaacaagttgttaattatcatactaaactttccaaattagccccacaaaccacatttttaatgtcattttatcttagtaaagatttaactcctgaattaattgaagaatgtgctgatttaatacatggtgttaaatgctacccagcaggagttaccacaaattccaaatacggtgttgacccaaatgatttttcctcattttatccattatttgaagctatgcaaaagcacggaatagttttaaacattcatggtgaaaaaccaggtactagtgaagaagatgaaatcaatgttattaacgctgaaccaaaatttttaccagctttaaagaaattacatgctgatttcccacgtttaaaaatcattttagaacattgtactactagtgatgccgttgaaactgttcgtgaattaaattccaattataaaccaggagatgaattatttgttggtgctacaatcactgctcatcatttatatttgatcattgataattgggccggaaatccaattaatttttgtaaaccagttgccaagtttcaaaaagacagaaaagcacttgttgatgctgcaactagtggagaaccatggtttttctttggttctgatagtgcgccacatccgattcatgcaaagcaaactcacgttggtgtgtgtgctggtgtttacactcaaagccatgctattgcttatgttgccgagattttcgataaagccaacaaattggacaatttgaagaaatttgtcagtgacaatggtattaagttttatggattatcagatgagattttaaagaaacataagaatgaatcagtttggttggttaaaagagataatcaagtcccagaaattattggtaacggtgatgttgaagttgttcctttcaaagctggggaaactttaaagtatgccatcgaatggagatga

SEQ ID NO: 27707 - protein, 358 aa, Candida albicans SC5314
MSDIELGITADMHVHLRDGSMCELITPTVRTGGIAISYVMPNLVPPITTKQQVVNYHTKLSKLAPQTTFLMSFYLSKDLTPELIEECADLIHGVKCYPAGVTTNSKYGVDPNDFSSFYPLFEAMQKHGIVLNIHGEKPGTSEEDEINVINAEPKFLPALKKLHADFPRLKIILEHCTTSDAVETVRELNSNYKPGDELFVGATITAHHLYLIIDNWAGNPINFCKPVAKFQKDRKALVDAATSGEPWFFFGSDSAPHPIHAKQTHVGVCAGVYTQSHAIAYVAEIFDKANKLDNLKKFVSDNGIKFYGLSDEILKKHKNESVWLVKRDNQVPEIIGNGDVEVVPFKAGETLKYAIEWR

SEQ ID NO: 27708 - DNA, 1035 bp, Acinetobacter sp. ADP1
  CDS (1)..(1035): transl_table=11
ttggacacgattactcttttacagccagatgattggcacgcacatttacgtgatggtcttgcccttaaacgtaccgttccagatttagctcaacaatttgcccgcgcaatttgtatgccaaatcttgttccacccgtaaaaactgtagatgaagctgaagcctatcgtgaacgaatcatggcgcatgttccagagggtgtacattttgatccgcgcatggtgctttattttactgaccatacttcaccaagtgaggtcaagaaaattaaagactctgcccatgtcaatgcgatcaagctttatcctgcgggtgcaaccaccaactcagataacggcgtaagtgatattcgtaaagtatatgcagtgattgaacagcttgaagaacatcaggttcctcttttattgcatggtgaagtcacccatcatcacgttgatatttttgatcgtgaaaagcgctttctagatgaagttctttccccgcttctcaaacagtttccaaaacttaaactggtacttgaacacatcaccaccagtgaagctgcacattttgtactcgaacaagaccgtaatgtcgctgcaaccattacaccacagcacttactcttcaaccgcaacgatatgttggtgggtggaattaaaccacatttctattgtttgccaattttaaaacgccaaacacatcagcaaacactgattgaagtggcgaccagcggaaatcctaaatttttcttgggtacagacagcgcaccccactcaaaaaatgccaaagaaaatgcatgtggttgtgcaggctgctatagcgcaccaacagcgattgagctctatgctcaagcattcgatcaagtcaataaaattgaacgtctagaaggctttgcaagtcattttggcgcagatttttacggtttgccacgtaacaccaataccattaccctggtcaaggaagatcagattattcctgaacagcttgactatctggatgatgaaaagattattccactttatgcaggaaaaaccattcaatggagaaaagtgtga

SEQ ID NO: 27709 - protein, 344 aa, Acinetobacter sp. ADP1
MDTITLLQPDDWHAHLRDGLALKRTVPDLAQQFARAICMPNLVPPVKTVDEAEAYRERIMAHVPEGVHFDPRMVLYFTDHTSPSEVKKIKDSAHVNAIKLYPAGATTNSDNGVSDIRKVYAVIEQLEEHQVPLLLHGEVTHHHVDIFDREKRFLDEVLSPLLKQFPKLKLVLEHITTSEAAHFVLEQDRNVAATITPQHLLFNRNDMLVGGIKPHFYCLPILKRQTHQQTLIEVATSGNPKFFLGTDSAPHSKNAKENACGCAGCYSAPTAIELYAQAFDQVNKIERLEGFASHFGADFYGLPRNTNTITLVKEDQIIPEQLDYLDDEKIIPLYAGKTIQWRKV

SEQ ID NO: 27710 - DNA, 1044 bp, Erwinia carotovora subsp. atroseptica SCRI1043
  CDS (1)..(1044)
atgaccgcacagcacactattcttaaaatccgtcgccctgacgattggcacattcacctgcgtgacgatcggatgctggaaaccgttctcccctataccagccgtttcttcggccgtgcgattgttatgccaaatctgacgccaccgattaccagcgtagccagcgctatcgcgtatcgtcagcgtattttagccgcagtcccgcaaggcgataattttcatccactgatgacgtgctatctgactgatacgctagatgccaatgaaatcgtgagtggttttgagcaaggcgtctttaccgctgccaaactctatccagccaacgccacaacgaactccagccatggcgtaactagcgtcgccactatctccgggattctggagaaaatgcagaaaattggcatgccgttactcattcacggtgaagtcaccgatcccgctattgatatattcgatcgggaagctcgctttatcgaaaccattctggaaccgttacgccaggatttccctgaactgaaggtcgtcctcgaacacattacgacgaaagaagcagcggaatacgttattgcaggcaatgattatcttgcagcaaccatcaccccccagcacttgatgttcaaccgcaatcatatgctggttggcggcatccgcactcacttatattgtctaccgatcttaaaacgcaacacgcatcaacaagcgttgcgtgaagccgtcgccagcggctgcgaccgacttttcctcggtacagattcagcgccacatgccaaacacagaaaagaatccagctgcggctgtgctggtgtgttcaatgctcaggctgcattaagtacctacgccaccgtttttgaagaaatgaatgcgcttgataaactcgaagcattctgttccctgaatggcccgcggttttatggcctgccagtgaacgacagctggattgaacttcaccgtgaagcagtcacgttcccagaagaaatcgctctcggcgacgagtcgctaatccccttccttgccggacaaagcctcaactggtcagttcgttaa

SEQ ID NO: 27711 - protein, 347 aa, Erwinia carotovora subsp. atroseptica SCRI1043
MTAQHTILKIRRPDDWHIHLRDDRMLETVLPYTSRFFGRAIVMPNLTPPITSVASAIAYRQRILAAVPQGDNFHPLMTCYLTDTLDANEIVSGFEQGVFTAAKLYPANATTNSSHGVTSVATISGILEKMQKIGMPLLIHGEVTDPAIDIFDREARFIETILEPLRQDFPELKVVLEHITTKEAAEYVIAGNDYLAATITPQHLMFNRNHMLVGGIRTHLYCLPILKRNTHQQALREAVASGCDRLFLGTDSAPHAKHRKESSCGCAGVFNAQAALSTYATVFEEMNALDKLEAFCSLNGPRFYGLPVNDSWIELHREAVTFPEEIALGDESLIPFLAGQSLNWSVR

SEQ ID NO: 27712 - DNA, 1080 bp, Legionella pneumophila subsp. pneumophila str. Philadelphia 1
  CDS (1)..(1080): transl_table=11
atgttattctcttttatcggcaataatgcaggaacctttattatgcaaactctgataattaatcgccctgacgattggcatctccatctcagggatggagagtttctaactcataccgtccaggcgtctgcccaacattttgccagagcgttagtgatgcccaatctcaaaccagcactaaccaatttatctgcaattgagagttatagaaacagaatcatttcggccattcccaaacaaaactcctttattccttatatgactttttatttaaatgagtccgtcaaaccagaagaattacagcaagccgcctctctttcttatatagttggagcaaaactttatccagctggagcgacgacaaattctgaagagggtgctaaatctttgaaagcactctaccccctttttgaaacattgcaagcgaataatttagtcttgcaaattcatggcgaagtcactcatagcgatattttcgagcgtgaagcattatttattgatgaatacctgaaacctatcgccaaacatttccccaaattaagaatcgtgctggagcacatatcgactaaaactgccgtggattatgtttctgaagggcctgctaaccttacagcaacaataactcctcaccatttgctttataatcgcaataagctactcgcagggggcattagacctcattattattgtttgcctattttaaaacacgaaaaagaccaaaaggccttacaaattgcagcgacaagcggaaatccaaaattttttgccggcactgacagtgcccctcatgccatcaatgccaaggaaaatgcatgtggatgcgccggtatttattcagctccatatgcggtagcgctctacacgcagatctttgatgaacttaaccaattaaaaaaacttaatgattttcttagtcgatttggtgcagagttttaccaactccctattaatcaacagcaattggaactcattaaatcacctcaaactatccccaactcaatgccatttggatcaactcatgttgtgcctattgctgctggagacactataaactggagtattaatggtttctcgcaataa

SEQ ID NO: 27713 - protein, 359 aa, Legionella pneumophila subsp. pneumophila str. Philadelphia 1
MLFSFIGNNAGTFIMQTLIINRPDDWHLHLRDGEFLTHTVQASAQHFARALVMPNLKPALTNLSAIESYRNRIISAIPKQNSFIPYMTFYLNESVKPEELQQAASLSYIVGAKLYPAGATTNSEEGAKSLKALYPLFETLQANNLVLQIHGEVTHSDIFEREALFIDEYLKPIAKHFPKLRIVLEHISTKTAVDYVSEGPANLTATITPHHLLYNRNKLLAGGIRPHYYCLPILKHEKDQKALQIAATSGNPKFFAGTDSAPHAINAKENACGCAGIYSAPYAVALYTQIFDELNQLKKLNDFLSRFGAEFYQLPINQQQLELIKSPQTIPNSMPFGSTHVVPIAAGDTINWSINGFSQ

SEQ ID NO: 27714 - DNA, 1059 bp, Burkholderia mallei ATCC 23344
  CDS (1)..(1059): transl_table=11
atgaatgcttccgttcccgcctcgctgaccctcgcccgccccgacgactggcacctgcacgtgcgcgacggcgcgatgctcgcggccgtcctgccgcacaccgctcgccagttcggccgcgcgatcatcatgccgaacctgaagccgcccgtcacgacgaccgcgcaggcgcaggcctaccgcgagcgcatcctggccgcggtgccggccggcatgacgttcgagccgttgatgacgctgtacctgaccgacaacacgcccgccgacgaaatccgccgcgcacgcgaaagcggctgcgtgcacggcgtgaagctctatccggcgggcgcgacgacgaactcggacgccggcgtgaccgacctgctcggcaagtgcgcgaagacgctcgaggcgatgcaggaagtcgggatgccgctgctcgtgcacggcgaggtgacggatccgtcgatcgacctgttcgaccgcgagaaggtgttcatcgatcgcgtgatggagccgctgcgccgcgcgctgccggggctcaaggtggtgttcgagcatattacgacgaaggatgcggccgactacgtgcgcgatgccgacgcggcgtcaggccggatcggcgcgacgatcaccgcgcaccatctgctgtacaaccgcaatgcgatgtttttcggcggcatccgtccacattactactgcctgccggtgctcaagcgcgagacgcatcggatcgcgctcgtcgaggcggcgacgtcgggcaatccgcgcttcttcctcggcaccgacagcgcgccgcacgcgaaaggcgcgaaggaagccgcgtgcggctgcgcgggctgctacaccgcgctgcacgcgctcgagctgtacgcggaggcattcgaccaggcgggcgcgctcgacaagctcgaaggcttcgcgagcttcttcggcgcggacttctacggtttgccgcgcagcgccgagacggtgacgctgcgccgcgagacgtgggagctgccgcgcgagatcgacgcgggcgccggcccggtcgtgccgctgcgcggcggcgaggcgatcggctggcggctcgtctga

SEQ ID NO: 27715 - protein, 352 aa, Burkholderia mallei ATCC 23344
MNASVPASLTLARPDDWHLHVRDGAMLAAVLPHTARQFGRAIIMPNLKPPVTTTAQAQAYRERILAAVPAGMTFEPLMTLYLTDNTPADEIRRARESGCVHGVKLYPAGATTNSDAGVTDLLGKCAKTLEAMQEVGMPLLVHGEVTDPSIDLFDREKVFIDRVMEPLRRALPGLKVVFEHITTKDAADYVRDADAASGRIGATITAHHLLYNRNAMFFGGIRPHYYCLPVLKRETHRIALVEAATSGNPRFFLGTDSAPHAKGAKEAACGCAGCYTALHALELYAEAFDQAGALDKLEGFASFFGADFYGLPRSAETVTLRRETWELPREIDAGAGPVVPLRGGEAIGWRLV

SEQ ID NO: 27716 - DNA, 1044 bp, Methylococcus capsulatus str. Bath
  CDS (1)..(1044): transl_table=11
atggactcgatcacgctggcgacacccgacgactggcatctgcacctgcgcgacggcgcagccatggcggacatcgtggaccacagtgcccgccagttcggccgggcggtcgtcatgcccaacctgaagccaccggtgacgacggtgacggccgcactggaataccgtggccgtatcctggcggccctgccggacgacgcgcgttttgagccgctgatggcgctttatctgacggatgccacgccggccgatgaagtccggcgcgcggccgaaacgcccgaaatcatcggcttcaagctctacccggccggcgccacgacccactccgaggccggcgtcacggccatcggaaagatccagcggacgctcgaagccctggaacggcatgatgtacccctgctcgttcacggcgaggtcaccgacgcggaaatcgacattttcgaccgggaagcgcgtttcatcgaatcggtcctcaagccgctggtcaggcgcttcccggcattgcgcatcgtcctggaacacgtgacgacgaaggagggtgtggagttcgtgcaaggctgcggtccccggatcggggccaccatcacggcccaccatctgctctataaccgcaatgccttgctggccggcggcatccgccctcaccactactgcctgccggtgctcaagcgcgaatcccaccggcaggcactggtatcggccgcgaccagcggcgacgcccacttctttctgggcaccgacagcgctccccacccccggccacacaaggagagtgcctgcggttgcgccggctgctacacggcattcacggccgtggaactttacgcccttgcattcgagcgggccggcgcgctggacaagctcgagcgcttcgccagccacaacggcgccgatttctacggcctccccaggaaccgcggaaccctcaccctgcaccgggcgccgtggcggattcccgacgctctgccattcgggcgggacagcctggttcccgccatggccggagaagacatcccttggcgggcatcccgccacccgggttag

SEQ ID NO: 27717 - protein, 347 aa, Methylococcus capsulatus str. Bath
MDSITLATPDDWHLHLRDGAAMADIVDHSARQFGRAVVMPNLKPPVTTVTAALEYRGRILAALPDDARFEPLMALYLTDATPADEVRRAAETPEIIGFKLYPAGATTHSEAGVTAIGKIQRTLEALERHDVPLLVHGEVTDAEIDIFDREARFIESVLKPLVRRFPALRIVLEHVTTKEGVEFVQGCGPRIGATITAHHLLYNRNALLAGGIRPHHYCLPVLKRESHRQALVSAATSGDAHFFLGTDSAPHPRPHKESACGCAGCYTAFTAVELYALAFERAGALDKLERFASHNGADFYGLPRNRGTLTLHRAPWRIPDALPFGRDSLVPAMAGEDIPWRASRHPG

SEQ ID NO: 27718 - DNA, 1038 bp, Legionella pneumophila str. Paris
  CDS (1)..(1038): transl_table=11
atgcaaactctgataattaatcgccctgacgattggcatctccatcttcgggatggagagtttctaactcataccgtccaggcgtctgcccaacattttgccagagcgttagtgatgcccaatctcaaaccagcactaactaatttagccgcaattgagagttatagaaacagaatcatttcggctattcccaaacaaaactcctttattccttatatgactttttatttaaatgagtccgttaaaccagaagaattacagcaagccgcctctctttcttatatagtgggagcaaaactttatccggctggagcgacgacaaattctgaagagggtgctaaatctttgaaagcactctaccctctttttgaaacattgcaaacgagtaatttagtcttgcaaattcatggcgaagtcactcatagtgatattttcgaacgcgaagcactatttattgatgaatacctgaaacccattgctaaacatttccccaaattaagaatcgttctggagcacatatcaaccaaagctgccgtggattatgtttcagaaggacctgctaaccttacagcaacaataactcctcaccatttgctttataatcgcaataagctactcgcagggggcattagacctcattactattgtttgcctattttaaaacacgaaaaagaccaaaaggccttacaaattgcagcgacgagtggaaatccaaaattttttgccggcactgacagtgcccctcatgccatcaatgccaaggaaaatgcatgtggatgcgccggtatttactcagctccatttgcggtagcgctctacacgcagatctttgatgaacttaaccaattaaaaaaacttaatgattttcttagtcgatttggcgcagagttttaccaactccctattaatcaacagcaattggaactcattaaagcacctcaaactatccccaactcaatgccatttggatcaactcatgttgtgcctattgctgctggagacactataaactggagtattaatggcttctcacaataa

SEQ ID NO: 27719 - protein, 345 aa, Legionella pneumophila str. Paris
MQTLIINRPDDWHLHLRDGEFLTHTVQASAQHFARALVMPNLKPALTNLAAIESYRNRIISAIPKQNSFIPYMTFYLNESVKPEELQQAASLSYIVGAKLYPAGATTNSEEGAKSLKALYPLFETLQTSNLVLQIHGEVTHSDIFEREALFIDEYLKPIAKHFPKLRIVLEHISTKAAVDYVSEGPANLTATITPHHLLYNRNKLLAGGIRPHYYCLPILKHEKDQKALQIAATSGNPKFFAGTDSAPHAINAKENACGCAGIYSAPFAVALYTQIFDELNQLKKLNDFLSRFGAEFYQLPINQQQLELIKAPQTIPNSMPFGSTHVVPIAAGDTINWSINGFSQ

SEQ ID NO: 27720 - DNA, 1038 bp, Legionella pneumophila str. Lens
  CDS (1)..(1038): transl_table=11
atgcaaactctgataattaatcgccctgacgattggcatctccatctccgggatggagagtttctaactcataccgtccaggcgtctgcccaacattttgccagagcgttagtgatgcccaatctcaaaccagcactaactaatttacccgcaattgagagttatagaaacagaatcatttcggccattcccaaacaaagctcctttattccttatatgaccttttatttaaatgagtccgttaaaccagaagaactacaccaagccgcctctctttcttatatagttggagcaaaactttatccagctggagcgacgacaaattctgaagagggtgctaaatctttgaaagcactctaccctctttttgaaacattgcaaacgagtaatttagtcttgcaaattcatggcgaagtcactcatagtgatattttcgaacgcgaagcactatttattgatgaatacctgaaacccattgccaaacatttccccaaattaagaatcgttctggagcatatatcaaccaaagctgccgtggattatgtttcagaaggacctgctaaccttacagcaacaataactcctcaccatttactttataatcgcaataagctactcgcagggggcattagacctcattattattgtttgcctattttaaaacacgaaaaagaccaaaaggccttacaagttgcagcaacgagcggaaatccaaagttttttgccggcactgacagtgcccctcatgccatcaatgccaaggaaaatgcatgtggatgcgccggtatttattcagctccatatgcggtagcgctctacacgcagatctttgatgaacttaaccaattaaaaaaacttaatgattttcttagtcgatttggcgcagagttttaccaactccctattaatcaacagcaattggaactcattaaatcacctcaaactatccccaactcaatgccatttggttcaactcatgttgtgcctattgctgctggagacactataaactggagtattaatggtttctcgcaataa

SEQ ID NO: 27721 - protein, 345 aa, Legionella pneumophila str. Lens
MQTLIINRPDDWHLHLRDGEFLTHTVQASAQHFARALVMPNLKPALTNLPAIESYRNRIISAIPKQSSFIPYMTFYLNESVKPEELHQAASLSYIVGAKLYPAGATTNSEEGAKSLKALYPLFETLQTSNLVLQIHGEVTHSDIFEREALFIDEYLKPIAKHFPKLRIVLEHISTKAAVDYVSEGPANLTATITPHHLLYNRNKLLAGGIRPHYYCLPILKHEKDQKALQVAATSGNPKFFAGTDSAPHAINAKENACGCAGIYSAPYAVALYTQIFDELNQLKKLNDFLSRFGAEFYQLPINQQQLELIKSPQTIPNSMPFGSTHVVPIAAGDTINWSINGFSQ

SEQ ID NO: 27722 - DNA, 1029 bp, Photobacterium profundum SS9
  CDS (1)..(1029): transl_table=11
atgacaacgattacaattacacgtcctgacgactggcatgtgcatttacgcgatggcgacgtattaaaagatactgttcgtgacatcagccggtatatgggacgagcgataatcatgcctaacttgatcccacccgttattgatacagaatctgcactatcttaccgcgaacgtattattgcccaaggccctcaaggcaacttctccccgctaatggttatctatttaaccgacaatacttccgcagaagaaatccacaaagccaaagcatctggccatgtatacgctgccaaactttaccctgcaggtgcaaccaccaattcagactcgggcgtaacatccattgatcatattcgccctgcacttcaagcaatgcaagaagcaggtatgcagctgcttattcatggtgaagtaaccgctcacgatatcgatattttcgaccgtgaaaaagtattcctagagacggttttagcaccgattgttgagcaattccccaaccttagaatggtattggaacatatcacaacagcagatgccgttgagtttgtaacaaatgcaggccctaatgttggagccacaattaccgctcaccacctcatgtttaaccgtaaccatatgttagtcggtggcattcgtccgcatttctattgcttaccaattctaaagcgtaatattcaccaagacgcattggttaaagctgcaacaagtggtaaccctaaattcttcttgggtacagactctgcaccacacgcacaaggtcgtaaagaatcagcttgtggttgtgctggctcttacactgcgcacgcggcaatcgagctgtatgctgaagtattcgaagcagcagacgcattagataaattagaagcattctcaagctttaatggtcctgacttttacaaccttccacgtaatacagacaccattacactcaaaaaagaaagctggaacgtgcctgaaacaatggcatttggtggcgatgaagtagtaccaatccgtgcaggcgaagcaatgctatggaaagttatctaa

SEQ ID NO: 27723 - protein, 342 aa, Photobacterium profundum SS9
MTTITITRPDDWHVHLRDGDVLKDTVRDISRYMGRAIIMPNLIPPVIDTESALSYRERIIAQGPQGNFSPLMVIYLTDNTSAEEIHKAKASGHVYAAKLYPAGATTNSDSGVTSIDHIRPALQAMQEAGMQLLIHGEVTAHDIDIFDREKVFLETVLAPIVEQFPNLRMVLEHITTADAVEFVTNAGPNVGATITAHHLMFNRNHMLVGGIRPHFYCLPILKRNIHQDALVKAATSGNPKFFLGTDSAPHAQGRKESACGCAGSYTAHAAIELYAEVFEAADALDKLEAFSSFNGPDFYNLPRNTDTITLKKESWNVPETMAFGGDEVVPIRAGEAMLWKVI

SEQ ID NO: 27724 - DNA, 1047 bp, Salmonella enterica subsp. enterica serovar Paratyphi A str. ATCC
  CDS (1)..(1047): transl_table=11
atgactgcaccatcccaggttttaaagatccgccgcccggacgactggcacgttcaccttcgcgatggcgacatgttaaaaacggtcgtaccctataccagcgaaatttatggtcgcgctatcgtgatgccgaacctggcgtcccccatcacgaccgttgatgcagcgatcgcctaccgccagcgtattctcgatgcggtgcccgccgggcatgatttcacgccgttaatgacctgctatttaacggattcgctcgatgccgatgaactggagcgtggtttccatgaaggcgtgtttactgcggccaagctttacccggccaatgccaccactaactccagtcatggcgtaacgtcagtcgacgctatcatgccggtactggagcggatggaaaaactcggaatgccattgctggtccacggtgaggtgacccatgcggatgttgatatcttcgatcgcgaagcgcgttttatcgacaccgtaatggaaccgctacgccagcgtctgaccgcgcttaaagtggtctttgaacacatcacaaccaaagatgccgcgcagtatgtacgtgacggcagcgacaacctggcggcgaccattacgcctcaacatttaatgtttaaccgtaatgatatgctggtcggcggcattcgtcctcacctgtactgtctgccgattctgaaacgcaatattcaccagcaggcgttacgcgacctggtcgccagtggttttacgcgcgccttcctggggacggattcagcgccgcattcacgtcatcgtaaagagacccgttgcggctgcgccggttgtttcaacgccccctccgctcttggcagttatgccgccgtgtttgaggaaatgaacgcgctggcgcactttgaagcgttctgttcactgaatggcccgcaattctatggcctgccggtgaatacggggtgggtggaactggttcgcgatgaacaacagataccggaaaatatcgcgctggctgatgattcgctggtgccttttttagcgggtgaaacagtacgctggtcagtaaaaaaataa

SEQ ID NO: 27725 - protein, 348 aa, Salmonella enterica subsp. enterica serovar Paratyphi A str. ATCC
MTAPSQVLKIRRPDDWHVHLRDGDMLKTVVPYTSEIYGRAIVMPNLASPITTVDAAIAYRQRILDAVPAGHDFTPLMTCYLTDSLDADELERGFHEGVFTAAKLYPANATTNSSHGVTSVDAIMPVLERMEKLGMPLLVHGEVTHADVDIFDREARFIDTVMEPLRQRLTALKVVFEHITTKDAAQYVRDGSDNLAATITPQHLMFNRNDMLVGGIRPHLYCLPILKRNIHQQALRDLVASGFTRAFLGTDSAPHSRHRKETRCGCAGCFNAPSALGSYAAVFEEMNALAHFEAFCSLNGPQFYGLPVNTGWVELVRDEQQIPENIALADDSLVPFLAGETVRWSVKK

SEQ ID NO: 27726 - DNA, 1035 bp, Idiomarina loihiensis L2TR
  CDS (1)..(1035): transl_table=11
atgcaaagcttaacaattccaagacctgatgactggcacctgcatttacgcgatggtgctatgttacaaacaaccgtacctgcaactgcggcagtgtttcatcgtgctgtggttatgccaaacctggtccccccggtaacaaccgtagcggccgctatggaatatcgtgagagaattttggccgagatccctgctggcatgagttttaatccgcttatggctctgtatcttacggcagacacaactcctgcagaaattgctgaagctgctgcgaacgagcatgttattggcttcaagctatatccgtcaggagccaccacaaattctgccgctggagtgaagtcggtagaagctctggctccggtactggcagctatgcaggagcatcaggtacctttgctggtgcatggtgaagtaaccgacagcgacatcgatatctttgaccgcgaaagagtttttattgaacggcatttaattccgataaccgagcgcttcccgcagttaaagctggtgctggagcatataaccaccgccgacgcggttaagtttgttgaaaacgccaacagtaatgtcgcagccacaatgaccccgcaacacttactgatgaaccgcaacgacttgctggtcggtggtattcgtccacataattactgtctgccaattttaaaacgtcggtcacatcaacaagccttgcagcaggcggccttgtccggtaaccctaagtttttcctcggaactgactcagccccgcatgtgcaggcaaataaagagactgcttgtggttgcgcgggttgttattcagctccagcagcaattgagctttatgccgagttttttagccagcataacgcgctggataaattggcaaattttgccagtgtttttggggctgacttttatcagttaccccgcaacactgagaccattgaactggttcaacaaccatggactgttgctgaaacggtagacacggcaacagggcctatggtgccttattgggcaggatctgatttgcaatggaaactgcgcggttag

SEQ ID NO: 27727 - protein, 344 aa, Idiomarina loihiensis L2TR
MQSLTIPRPDDWHLHLRDGAMLQTTVPATAAVFHRAVVMPNLVPPVTTVAAAMEYRERILAEIPAGMSFNPLMALYLTADTTPAEIAEAAANEHVIGFKLYPSGATTNSAAGVKSVEALAPVLAAMQEHQVPLLVHGEVTDSDIDIFDRERVFIERHLIPITERFPQLKLVLEHITTADAVKFVENANSNVAATMTPQHLLMNRNDLLVGGIRPHNYCLPILKRRSHQQALQQAALSGNPKFFLGTDSAPHVQANKETACGCAGCYSAPAAIELYAEFFSQHNALDKLANFASVFGADFYQLPRNTETIELVQQPWTVAETVDTATGPMVPYWAGSDLQWKLRG

SEQ ID NO: 27728 - DNA, 1035 bp, Azoarcus sp. EbN1
  CDS (1)..(1035): transl_table=11
atgcagacgatttccctgatccgccccgacgactggcatctgcacgtgcgcgacggcgcagcgctggcgaccgtcgtgccgcacaccgctcgccgtttcggtcgcgcgctgatcatgccgaacctgcgcccgccggtgacgactgccgcgcaggcactcgaataccgcgcccgcatcctcgccgcggtgccgcccggccagcacttcgagccgctgatgagcctgtacctcaccgacaacacctcgcccgatgaaatcgaccgcgcgaaggcgagcggcgcggtcgtcgccgtcaagctgtatccggccggtgcgacgacgaactccgacgcgggcgtgaccgccatcgaaaaagtccacgccgtgctcgagcgcatggaaaagctcggcatggtgctgtgcgtgcatggcgaagtcacacacggcgacgtggatgtgttcgaccgcgagcaggtgttcatcgagcaggtcctggcgccgctggtggcgcgctttcccgctctgcgcgtcgtcttcgagcacatcacgaccgccgaggcagcgcgcttcgtgcaggacgccggaccgaacgtcgcggcgaccgtgacggcacatcacctgctgctcaaccgcaacgcgattttcgctggcggcatccgcccgcatcattactgcctgccggtgctcaagcgcgaaacccaccgccgcgcgctggttgaagcggcgacgtcgggcaacgcgaaattcttcctcggcaccgactccgcgccgcattcgcgcgccgcgaaagagaccgcctgcggctgcgcaggctgctacaccgcgcacgccgcgatcgagctgtacgccgaggccttcgagcaggccggagcgctcgaccggctcgaggctttcgcgagcctgaacgggccggcgttctacggccttgcgccgaacgccgagcggatcacgctggcgaaagacgcgtgggaagtgccgggcgaatacgaatacctgcacgacgacccgctggtgccgctgcgtgccggcgaaacagtcgcttggcgcgtgctctga

SEQ ID NO: 27729 - protein, 344 aa, Azoarcus sp. EbN1
MQTISLIRPDDWHLHVRDGAALATVVPHTARRFGRALIMPNLRPPVTTAAQALEYRARILAAVPPGQHFEPLMSLYLTDNTSPDEIDRAKASGAVVAVKLYPAGATTNSDAGVTAIEKVHAVLERMEKLGMVLCVHGEVTHGDVDVFDREQVFIEQVLAPLVARFPALRVVFEHITTAEAARFVQDAGPNVAATVTAHHLLLNRNAIFAGGIRPHHYCLPVLKRETHRRALVEAATSGNAKFFLGTDSAPHSRAAKETACGCAGCYTAHAAIELYAEAFEQAGALDRLEAFASLNGPAFYGLAPNAERITLAKDAWEVPGEYEYLHDDPLVPLRAGETVAWRVL

SEQ ID NO: 27730 - DNA, 1041 bp, Silicibacter pomeroyi DSS-3
  CDS (1)..(1041): transl_table=11
atgacccagagcctcacgatccgccgccccgacgactggcacctgcatctgcgcgacggcgccatgctggccgccgtcctgcccgaaaccgcgcgccatttcgctcgcgccatcgtcatgccgaacctggtaccgccggtggtgaccggggcgcaggcggccgcctatcgcgaccggatcctggcgacgctgcccaagggcatgaatttcgaaccgctgatgacgctctacctgaccgagcagaccgatcccgacgatctggccgcggcgcacaccagcgggctgatcacctcggtcaagctctacccggcgggcgccaccaccaattccgcgagcggcgtgaaggattttgacaaggtacgtccggtgctcgaacgcatggccgaaatcggctgtccactctgcgtacatggcgaggtcacggatcgcgagatcgacattttcgaccgcgaggcggtgttcatcgaccgggtgcttgacccgatccgccgcgcgacaccggggctgcgcgtgatcatggagcatatcaccacaaaggatggggccgattacgtagccgccaaccccgagggtctgggggcgacgatcaccgtccagcacctgatgttcgaccgcaatgacatgctggtgggcggcatgcgcccgcattactactgcctgccgatcctcaagcgccgccatcaccgcgaggcgctggtcgccgccgccacgtcgggcgatgcgcggtacttccttggcaccgacagcgcgccccatccgacccacgccaaagaggccgaatgctgcgccgcgggctgttttaccgcgccaatcgcgctgtcctgccttgcccatgtgttcgaggaagcgggtgcattggacaagctggaaggcttcacctcgctgaacggtcccgccttttatggcctgcctgtcaatgccgacacgatcacgctcagcaaggccgacccgcttgacatccccaagaccctgcccgccggagagcataccgtcaccgtgttcgatcccggtgtcccactgcattggagggtgacgaggtaa

SEQ ID NO: 27731 - protein, 346 aa, Silicibacter pomeroyi DSS-3
MTQSLTIRRPDDWHLHLRDGAMLAAVLPETARHFARAIVMPNLVPPVVTGAQAAAYRDRILATLPKGMNFEPLMTLYLTEQTDPDDLAAAHTSGLITSVKLYPAGATTNSASGVKDFDKVRPVLERMAEIGCPLCVHGEVTDREIDIFDREAVFIDRVLDPIRRATPGLRVIMEHITTKDGADYVAANPEGLGATITVQHLMFDRNDMLVGGMRPHYYCLPILKRRHHREALVAAATSGDARYFLGTDSAPHPTHAKEAECCAAGCFTAPIALSCLAHVFEEAGALDKLEGFTSLNGPAFYGLPVNADTITLSKADPLDIPKTLPAGEHTVTVFDPGVPLHWRVTR

SEQ ID NO: 27732 - DNA, 996 bp, Campylobacter jejuni RM1221
  CDS (1)..(996): transl_table=11
atgaaacttaaaaaccctttggatatgcatttacatttacgcgatgaaagtatgcttgagcttgtagctccttttagtgcaaaagactttaaggcaggggttatcatgccaaatttaatcaccccacttactgaaatagatgtattaaaagcttataaagaacgcattttaaaagcatgtaaaaatgaagattttacgcctttgatgactttgtttttcaaagactatgatgagcaatttttagaaaaagctaaagacgagctttttgctatcaaactttatcctgcaggtatcactaccaactcagataatggaatttcaagttttgatatagaaaagttaaaacctacattaattactatgagcgaattaaacatacccttacttgtgcatggagaaaccaatgattttgtcatggatagagaagcaaattttgccaaaatatatgaaaaattagctaaaaactttccaaaattaaaaattgtaatggagcatattaccactaaggttttgtgtgatttattaaaagattatgaaaatttatacgcaactattactttgcatcatttaatgataacgcttgatgatgtagtgggtggtaaaatggatccacatttattttgcaagcctattgcaaaacgctatgaagataaagacgctttatgtgggcttgcttttagtggctatgaaaaggctatgtttggaagcgatagcgcgcctcatccattgcacactaaagaatgttgtggttgtgcggctggagtttttagcgcaccggtgattttacctgtattagttgaactttttgaaaaatattcaaatgaaacaaatttgcaaaaatttatttcagataatgcttgcaaaatccataatcttaaatttgaaaatgacaaaattatcactttagaaaaacaagaatggcaagtagcgcaaaaatacggcgatgtagtgccatttatggcagggaaaactttaaatttcaaagtcgcaaattaa

SEQ ID NO: 27733 - protein, 331 aa, Campylobacter jejuni RM1221
MKLKNPLDMHLHLRDESMLELVAPFSAKDFKAGVIMPNLITPLTEIDVLKAYKERILKACKNEDFTPLMTLFFKDYDEQFLEKAKDELFAIKLYPAGITTNSDNGISSFDIEKLKPTLITMSELNIPLLVHGETNDFVMDREANFAKIYEKLAKNFPKLKIVMEHITTKVLCDLLKDYENLYATITLHHLMITLDDVVGGKMDPHLFCKPIAKRYEDKDALCGLAFSGYEKAMFGSDSAPHPLHTKECCGCAAGVFSAPVILPVLVELFEKYSNETNLQKFISDNACKIHNLKFENDKIITLEKQEWQVAQKYGDVVPFMAGKTLNFKVAN

SEQ ID NO: 27734 - DNA, 1029 bp, Vibrio fischeri ES114
  CDS (1)..(1029): transl_table=11
atgacaactttaacaattactcgtcctgatgattggcatttacacttacgtgatggtgatgtgttaactgacacagttcgtgactctggtcgttacaacggcagagctttaatcatgccaaaccttgtaccacctgtaacaactaccgaacaagcattaagttaccgtgaacgcattcaggctgaaaacaaatctgattcttttgctcctcttatgtctctttatctaacagaaaagacaacatcagaagagatccgaaaagcgaaagcgactggacatatcgtagcagcaaaactgtatccagctggtgctacaacaaactcagactctggtgtaagcgacgttaaaaacgtttaccctattctaaaaacgatgcaagaagaaggcatgcttttacttattcatggggaagtaacaactcatgatattgatatcttcgatcgtgaaaagactttccttgatacagttttagcgcctatcgttaatgattttcctgagctaaaaattgtacttgagcacatcacaactaaagatgcggcagattttgttaaaaacgcaggtccaaacgttgctgcaaccattacagcgcatcacttattgtttaaccgtaaccacatgttagttggtggtattaaacctcacttctactgtttaccaattttaaaacgcaatacacaccaacaagctctagtggaagctgcaacaagcggtaatcctaaatttttcttaggtactgattcagcacctcatgcaaaagacaaaaaagaagcggcttgtggttgtgctggttcatatactgcccacgcttcaatcgagctttatgcagaagtatttgaaaacgaaggtaagttagaaaacctagaagcattcgcaagctttaatggtccagatttttataacctacctcgcaacactgacacaataacgcttgtaaaagaagcgtggattgcaccagagacaatggcatttggaaatgactttgttgtaccaattcgtgctggtgaagctgttgagtggctagtaaagtaa

SEQ ID NO: 27735 - protein, 342 aa, Vibrio fischeri ES114
MTTLTITRPDDWHLHLRDGDVLTDTVRDSGRYNGRALIMPNLVPPVTTTEQALSYRERIQAENKSDSFAPLMSLYLTEKTTSEEIRKAKATGHIVAAKLYPAGATTNSDSGVSDVKNVYPILKTMQEEGMLLLIHGEVTTHDIDIFDREKTFLDTVLAPIVNDFPELKIVLEHITTKDAADFVKNAGPNVAATITAHHLLFNRNHMLVGGIKPHFYCLPILKRNTHQQALVEAATSGNPKFFLGTDSAPHAKDKKEAACGCAGSYTAHASIELYAEVFENEGKLENLEAFASFNGPDFYNLPRNTDTITLVKEAWIAPETMAFGNDFVVPIRAGEAVEWLVK

SEQ ID NO: 27736 - DNA, 1047 bp, Salmonella enterica subsp. enterica serovar Choleraesuis str
  CDS (1)..(1047): transl_table=11
atgactgcaccatcccaggttttaaagatccgccgcccggacgactggcacgttcaccttcgcgatggcgacatgttaaaaacggtcgtaccctataccagcgaaatttatggtcgcgctatcgtgatgccgaacctggcgtcccccatcacgaccgttgatgcagcgatcgcctaccgccagcgtattctcgatgcggtgcccgccgggcatgatttcacaccgttaatgacctgctatttaacggattcgctcgatgccgatgaactagagcgtggtttccatgaaggcgtatttactgcggctaagctttacccggccaatgccaccactaactccagtcatggcgtaacgtcagtcgacgctatcatgccggtactggagcggatggaaaaactcggaatgccattactggtccacggggaggtgacccatgcggatgttgatatcttcgatcgcgaagcgcgttttatcgacactgtaatggaaccgctacgccagcgtctgaccacgcttaaagtggtctttgagcacatcacgaccaaagatgccgcgcagtatgtccgtgacggcaacgactacctggcggctaccattacgcctcaacatttaatgtttaaccgtaatgatatgctggtcggcggcattcgtcctcacctgtactgtctgccgattctgaaacgcaatattcaccagcaggcgttacgcgaactggttgccagtggttttacgcgcgccttcctggggacggattcagcgccgcattcacgtcatcgtaaagagaccagttgcggctgcgccggttgtttcaacgccccctccgcccttggcagttatgccgccgtgtttgaggaaatgaacgcgctggcgcactttgaagcgttctgttcactgaatggcccgcaattctatggcctgccggtgaatacggggtgggtggaactggttcgcgatgaacaacaggtaccggaaaatatcgcgctggctgatgattcgctggtgccttttttagcgggtgaaacagtacgctggtcagtaaaaaaataa

SEQ ID NO: 27737 - protein, 348 aa, Salmonella enterica subsp. enterica serovar Choleraesuis str
MTAPSQVLKIRRPDDWHVHLRDGDMLKTVVPYTSEIYGRAIVMPNLASPITTVDAAIAYRQRILDAVPAGHDFTPLMTCYLTDSLDADELERGFHEGVFTAAKLYPANATTNSSHGVTSVDAIMPVLERMEKLGMPLLVHGEVTHADVDIFDREARFIDTVMEPLRQRLTTLKVVFEHITTKDAAQYVRDGNDYLAATITPQHLMFNRNDMLVGGIRPHLYCLPILKRNIHQQALRELVASGFTRAFLGTDSAPHSRHRKETSCGCAGCFNAPSALGSYAAVFEEMNALAHFEAFCSLNGPQFYGLPVNTGWVELVRDEQQVPENIALADDSLVPFLAGETVRWSVKK

SEQ ID NO: 27738 - DNA, 1044 bp, Pseudomonas syringae pv. syringae B728a
  CDS (1)..(1044)
atgtctgaccgcctgaccctcctgcgtcccgacgactggcatattcacctccgtgacggagctgtcttgcctcataccgttgctgacgtagcgcgaacttttggccgcgcaatcatcatgcccaacctcgtgcctccggtacgcaacgcgcagcaagccgatgcctatcgccagcgcattctggcggcacgtccggccaccagccgcttcgagccattgatggtgctgtacctcaccgaccagaccacgcccgacgacatccgcaccgccaaggccagtggcttcgtgtatgcggccaagctgtatccggccggcgcgaccaccaactccgattccggtgtcaccagcatcgacaagatcttccctgccctcgaagccatggccgacgtcggcatgctgctgctggtgcacggggaagtaacacgtggcgaaatcgacgtgttcgatcgcgagaaggtcttcatcgatgagcacctgcgccgtgtagtcgagcgcttcccgagcctgaaagtggtgttcgaacacatcaccaccggtgaagcggtgcagttcgtcaatgaagcttcagccaatgtcgcggcgaccatcaccgcgcaccacctgctgtacaaccgtaaccacatgctggtcggcgggattcgtccgcacttctattgcctgccgatcctcaagcgcaatactcatcagacagccctgctcgacgcggccaccagcggcagcggcaagttcttcctgggcaccgactcggcgccgcatgcccagcatgccaaggaaaacgcttgcggttgcgccgggtgctacaccgcctacgcagccatcgaactgtatgcagaagctttcgagcaacgtaacgccctggacaagctggaaggcttcgccagccttcacggtccggcgttctacggcttgcccgccaatcaggacaccatcacgctggtgcgtgacgagtggaccgcccctgccagcctgccgtttggcgagttgaccgttatcccgctgcgcgcaggtgaaacactgcgctggcgtctggaggaacacgcgtga

SEQ ID NO: 27739 - protein, 347 aa, Pseudomonas syringae pv. syringae B728a
MSDRLTLLRPDDWHIHLRDGAVLPHTVADVARTFGRAIIMPNLVPPVRNAQQADAYRQRILAARPATSRFEPLMVLYLTDQTTPDDIRTAKASGFVYAAKLYPAGATTNSDSGVTSIDKIFPALEAMADVGMLLLVHGEVTRGEIDVFDREKVFIDEHLRRVVERFPSLKVVFEHITTGEAVQFVNEASANVAATITAHHLLYNRNHMLVGGIRPHFYCLPILKRNTHQTALLDAATSGSGKFFLGTDSAPHAQHAKENACGCAGCYTAYAAIELYAEAFEQRNALDKLEGFASLHGPAFYGLPANQDTITLVRDEWTAPASLPFGELTVIPLRAGETLRWRLEEHA

SEQ ID NO: 27740 - DNA, 1041 bp, Rhodobacter sphaeroides 2.4.1
  CDS (1)..(1041)
atgacccagagcctgaccctgcgccgccccgacgactggcacctccacctgcgcgacggcgcgatgctggagggggtgctgcccgaaaccacacggcacttcgcccgcgccatcgtgatgccgaacctcgtgccgccggtggtgaccgcggcggaggcccaggcctaccgggcccggatcctgcgcgccctgcccgagggcgcgcggttcgagccgctgatggtgctctatctgaccgagacgaccgatccggccgatgtgcgcgcggcggcggcctcgggcctcgtgacggcggtgaagctctatcccgcgggggccacgaccaattcggcctcgggcgtgcgcgacttcgaccgggtgcgcggcgtgctcgagactatggccgagatcggcctgccgctctgcgtgcatggcgaggtgacggatccggccgtggacatcttcgatcgcgaggccgtgttcctcgaccgggtgctggatccgatccggcgcgcgacgccggggctccgggtcgtgctcgaacatgtgaccacgcgggaggggctcgattatgtgcgcggcggggggccggacatggccggcacgctcaccacgcatcacctgatcatcaaccgcaaccacatcctcgcgggcggcatccggccgcattactactgcctgccggtggccaagcgcgagacgcatcggctggcgctccgcgctgccgcgacggggggcgaggcctgcttcttcctcggcaccgacagcgcgccgcatgtcgatgcggccaaggagagcggctgcggctgcgcgggctgcttcaccgcccccaacacgctctcgatcctcgcccatgtgttcgaggaggagggcgcgctcgaccggctggaagggttcgtgtcgctccacgggcccgccttctaccgcctgccggcgaacgaggagcgcatcaccctgcgcaagggggcggctctcgcgctgcccggcaagatcgagacgggcgccgggccggtcacggtcttcgatcccggcttcccgcttctgtggcacgtcgaaccctga

SEQ ID NO: 27741 - protein, 346 aa, Rhodobacter sphaeroides 2.4.1
MTQSLTLRRPDDWHLHLRDGAMLEGVLPETTRHFARAIVMPNLVPPVVTAAEAQAYRARILRALPEGARFEPLMVLYLTETTDPADVRAAAASGLVTAVKLYPAGATTNSASGVRDFDRVRGVLETMAEIGLPLCVHGEVTDPAVDIFDREAVFLDRVLDPIRRATPGLRVVLEHVTTREGLDYVRGGGPDMAGTLTTHHLIINRNHILAGGIRPHYYCLPVAKRETHRLALRAAATGGEACFFLGTDSAPHVDAAKESGCGCAGCFTAPNTLSILAHVFEEEGALDRLEGFVSLHGPAFYRLPANEERITLRKGAALALPGKIETGAGPVTVFDPGFPLLWHVEP

SEQ ID NO: 27742 - DNA, 1047 bp, Pseudomonas aeruginosa UCBPP-PA14
  CDS (1)..(1047)
atgtccgaccgtctcaccctcctgcgccccgacgactggcacattcacctgcgtgacggtgccgcgctggccaataccgtcggcgacgccgcccgcaccttcggccgcgccatcgtcatgccgaacctggtgccgccggtgcgcaacgccgccgaagccgacgcctaccggcagcgcatcctcgccgcccgtcccgccgccagccgcttcgagccgctgatggtgctgtacctcaccgaccgcaccagcgccgaggaaatccgtaccgccaaggccagcggcttcgtgcatgccgccaagctctatccggcaggcgccaccaccaactcggactctggcgtgacccgcatcgacaatatcttcgaagcgctcgaggcgatggccgaggtcggcatgccactgctggtgcatggcgaggtgacccgcgccgaggtcgacgtattcgatcgcgagaagcagttcatcgacgagcacctgcgccgggtggtcgagcgcttcccgaccctgaaagtggtcttcgagcacatcaccaccggcgacgccgcccagttcgtccgggaagccccggccaacgtcggcgcgaccattaccgcccatcacctgctgtacaaccgcaaccacatgctggtcggcggtatccgcccgcatttctattgcctgccgatcctcaagcgcaacacccaccaggaagccctgctggacgccgcggtgagcggcaacccgaaattcttcctcggcaccgactcggcgccgcacgcccgccacgccaaggaaaccgcctgcggttgcgccggctgctacagcgcctacgccgccatcgagctgtatgccgaggccttcgaacagcgcaatgcgctggacaagctggaaggcttcgccagcctgcatggcccggatttctatggcctgccgcgcaacaccgaccggatcaccctggtccgcgaggagtggcaggcgcccgccagcctccccttcggcgacttcgacgtggtaccgctgcgcgccggcgagacactccgctggaaactgctggaggccggggcatga

SEQ ID NO: 27743 - protein, 348 aa, Pseudomonas aeruginosa UCBPP-PA14
MSDRLTLLRPDDWHIHLRDGAALANTVGDAARTFGRAIVMPNLVPPVRNAAEADAYRQRILAARPAASRFEPLMVLYLTDRTSAEEIRTAKASGFVHAAKLYPAGATTNSDSGVTRIDNIFEALEAMAEVGMPLLVHGEVTRAEVDVFDREKQFIDEHLRRVVERFPTLKVVFEHITTGDAAQFVREAPANVGATITAHHLLYNRNHMLVGGIRPHFYCLPILKRNTHQEALLDAAVSGNPKFFLGTDSAPHARHAKETACGCAGCYSAYAAIELYAEAFEQRNALDKLEGFASLHGPDFYGLPRNTDRITLVREEWQAPASLPFGDFDVVPLRAGETLRWKLLEAGA

SEQ ID NO: 27744 - DNA, 1077 bp, Psychrobacter sp. 273-4
  CDS (1)..(1077)
atgactgattcaattagagaattgactatcctgcagcccgatgattggcacatgcatttgcgtgatgacaaggcgctagcaaccacagtccctcatgcggcagagagctttaatcgggttatctgtatgccaaaccttgtgccgccggtcaaaaacgttgaagatgctcgcgcttaccgtgcgcgtatcatgcagcatctagaagccagtaatgtgagcgctgagcgtaaagcagcatttgatccgcgtatgaccttgtatcttaccgatcataccactgcacaagatatcgagttggcagcacaatctggcatcgtgcaagcggtcaagctgtatcctgctggcgccaccaccaactctgctgatggcgtcactgatatcaatgcctgcgttgatgtatttgaagcgcttgaaaaatataaccttcctctattactgcatggcgaagtcactcacgaccacgtcgatattttcgatcgtgaaaagcgctttttggatgaggtgatggtacaaatcatcgcaaagttcccaactatgaaaattgtgatggagcatatcaccaccagtgatgccgctgattttgtcttgtcacagggcaatcaaatcgctgccactattacgccgcaacatttgatgtttaaccgcaatcacctgctgctcggtggtatcaagccccacttttactgcttgcctatcttaaagcgtgaaagccatcaaaaagtattattagatgtcgccaccagcggcaacccaaaattctttttgggcacagactccgccccccatgcaaccgataaaaaagaagccgcttgtggctgtgcgggctgctatagcgctgctacagcgctaccgttatatgccacagcgtttgatagcgttggtaaaattgatagattagaagggtttactagccgttttggtgcccaattctacggtttgcccgttaacgagagcactattacgattatcaatacgccgatgcaaatcccggcatcttacccttactttgatggcagctctctaacaccactcatggcaggtgagaccttaccttggtcgattaaaaaatcactttaa

SEQ ID NO: 27745 - protein, 358 aa, Psychrobacter sp. 273-4
MTDSIRELTILQPDDWHMHLRDDKALATTVPHAAESFNRVICMPNLVPPVKNVEDARAYRARIMQHLEASNVSAERKAAFDPRMTLYLTDHTTAQDIELAAQSGIVQAVKLYPAGATTNSADGVTDINACVDVFEALEKYNLPLLLHGEVTHDHVDIFDREKRFLDEVMVQIIAKFPTMKIVMEHITTSDAADFVLSQGNQIAATITPQHLMFNRNHLLLGGIKPHFYCLPILKRESHQKVLLDVATSGNPKFFLGTDSAPHATDKKEAACGCAGCYSAATALPLYATAFDSVGKIDRLEGFTSRFGAQFYGLPVNESTITIINTPMQIPASYPYFDGSSLTPLMAGETLPWSIKKSL

SEQ ID NO: 27746 - DNA, 1032 bp, Dechloromonas aromatica RCB
  CDS (1)..(1032)
atgcaactgaccatcacccgtcccgacgactggcatctccacctgcgcgacggcgaagcgctggcgtccgtccttgcccataccgctcgccagttcggtcgcgccattgtgatgccgaacctgaaaccgccggtgacgaccgtcgagcaggccgctgcctatcgcgaccgtatcgtggccgcgctgccggtcggcgcctgcttcgagccgttgatgacgctgtatctgaccggcaacacgccggccagtgaaattgccaaagccgctgcctcgggcttcgtcaaggcggtaaagctttacccggccggggcgacgaccaattccgatgctggtctgaccgacatcgccaaggcctacgacacgctggccgaaatggagcgcgtcggcctgccgctgctggtgcacggcgaggtgaccgatccgaagatcgacctcttcgaccgcgaaaaggtcttcatcgacaccgtgctgctaccgctgaccctgcgcttcccgacgctgaaggtggtcatggagcacatcacgaccaaggatgcggccgagttcgtggccggctcgccggccaacgtggcggcgaccatcaccgcccaccacttgctgtacaaccgcaacgccattttccagggcggtgtccggccgcactggtactgcctgcctgtcttgaagcgcgagacgcatcgcgaggcgctggtcgcggcggcgatttccggcaatccgaaattcttcctcggcaccgattcggcgccgcatgccaagggcgccaaggaggcggcctgcggctgtgccggctgttacaccgcctatgcggcgatcgagctgtatgccgaagccttcgagcaggctggcgggctcgacaagctggaagctttcgccagcttcaatggcccggactggtacggcctgccgcgcaacagtggcaccgtcacgctggtcaaggaaaactggaccgtgccggccgactacccgtacatcagcaccgacaccatcgttccgctgcgcgccggcgaaacgctgtcctggaaaatgctctga

SEQ ID NO: 27747 - protein, 343 aa, Dechloromonas aromatica RCB
MQLTITRPDDWHLHLRDGEALASVLAHTARQFGRAIVMPNLKPPVTTVEQAAAYRDRIVAALPVGACFEPLMTLYLTGNTPASEIAKAAASGFVKAVKLYPAGATTNSDAGLTDIAKAYDTLAEMERVGLPLLVHGEVTDPKIDLFDREKVFIDTVLLPLTLRFPTLKVVMEHITTKDAAEFVAGSPANVAATITAHHLLYNRNAIFQGGVRPHWYCLPVLKRETHREALVAAAISGNPKFFLGTDSAPHAKGAKEAACGCAGCYTAYAAIELYAEAFEQAGGLDKLEAFASFNGPDWYGLPRNSGTVTLVKENWTVPADYPYISTDTIVPLRAGETLSWKML

SEQ ID NO: 27748 - DNA, 1035 bp, Ralstonia eutropha JMP134
  CDS (1)..(1035)
atgactcagaagctcaccatcacccgcccggacgactggcacctgcacctgcgcgacggcgcggcgctcgcggccgtgttgcccgacaccgcgcgccagttcggccgcgcgatcatcatgcctaacttgaagccgcccgtgaccacggtcgagcaggcgcaggcctaccgcgcccgaatcctggctgcgctgccggccggcatgagcttcgagccgctgatgacgctgtacctgaccgacaacaccccggccgaggaaatcgtcgcggccaaggcgagcggcttcgtgcatggcgtcaagctgtatcctgcgggcgctacgaccaacagcgatgccggcgtgaccgacatccgccgctgcgcgggcgcgctggaggcgatgcagcgtgtgggcctgccgctgctcgtgcacggcgaagtcactgatggcgacatcgatatcttcgatcgcgaagccgtcttcatcgaccgtgtcatgacgccgctgcgccgcgacttcccggaactgaaggtggtgttcgagcacatcacgaccagggatgcggcccagtacgtgcgcgatgcgagcggcccggtgggtgccaccatcacggcgcatcacctgctgtacaaccgcaatgcgatcttcaccggcggcatccgcccgcattactactgcctgccggtgctcaagcgcgagacgcatcgcgaggcgctggtcgcggccgcgacctcgggtagcgaccgtttcttcctcggcaccgacagcgcgccgcacgcgcgtggcctgaaggagcatgcctgcggctgcgccggctgctacaccgcgctgcacgccatggaactctatgcagaggccttcgacgccgctggtgcgctcgataagctggaagcgttcgcaagcttcaacggcccggcgttctacgggctgccgcgcaataccggcacgctgacgctggagcgcgaagactggcaactgccggcggaactgccgtatggcgatgccaccctggtgccgctgcgcgccggcgagacgctgcgctggaaggcgcgctga

SEQ ID NO: 27749 - protein, 344 aa, Ralstonia eutropha JMP134
MTQKLTITRPDDWHLHLRDGAALAAVLPDTARQFGRAIIMPNLKPPVTTVEQAQAYRARILAALPAGMSFEPLMTLYLTDNTPAEEIVAAKASGFVHGVKLYPAGATTNSDAGVTDIRRCAGALEAMQRVGLPLLVHGEVTDGDIDIFDREAVFIDRVMTPLRRDFPELKVVFEHITTRDAAQYVRDASGPVGATITAHHLLYNRNAIFTGGIRPHYYCLPVLKRETHREALVAAATSGSDRFFLGTDSAPHARGLKEHACGCAGCYTALHAMELYAEAFDAAGALDKLEAFASFNGPAFYGLPRNTGTLTLEREDWQLPAELPYGDATLVPLRAGETLRWKAR

SEQ ID NO: 27750 - DNA, 1065 bp, Burkholderia cepacia R18194
  CDS (1)..(1065)
atgactgcctcgaacgcttcttccccggcgacgctctcgctcgcccgtcccgacgactggcacctgcacctgcgagacggcgacatgctggccgccgtgctgccgcacaccgcacgccagttcggccgtgcaatcgtcatgccgaacctgaagccgccggtgacgaccaccgcgcaggcgcaggcctatcgcgagcgcatcctcgccgcgctgccggccgggatgacgttcgaaccgctgatgacgctgtacctgaccgacaacacgccgcccgacgagatccgccgcgcgcgcgaaagcggcttcgtgcacggcgtgaagctgtatccggccggcgcgacgacgaattccgaccacggcgtcaccgatctcgcgaaatgcgcgaagacgctcgaggcgatgcaggaaactggcatgccgctgctggtgcacggcgaagtgaccgatgcgtcgatcgacctgttcgaccgcgagaaggtcttcatcgaccgcgtgatgacgccgctgcgccgcgatttcccgggcctgaaggtcgtgttcgaacacatcacgacgaaggatgcggccgactacgtgcgcgacgccgacgcggcgcccggcctgctcggcgcgacgatcaccgcgcatcacctgctgtacaaccgcaatgcgctgttcgtcggcgggattcgcccgcattactactgcctgccggtgctgaagcgcgagacgcatcgcgtcgcgctcgtcgaggccgcgacgtcgggcaacccgcgcttcttcctcggtaccgacagcgcgccgcatgcgcgcgacgcgaaggaaaccgcgtgcggctgcgcgggctgctacacggcgctgcatgcgctcgaactgtatgcggaagcgttcgacacggccggcgcgctcgacaagctggaaggcttcgcgagcttcttcggcgccgatttctacgggctgccgcgcagcgccgagacggtcacgctgcgtcgcgaggcatgggagctgccgcgcgagatcttcgcaggcgatacgcccgtcgtgccgctgcgcggcggcgagacgatcggctggaaactggcgtga

SEQ ID NO: 27751 - protein, 354 aa, Burkholderia cepacia R18194
MTASNASSPATLSLARPDDWHLHLRDGDMLAAVLPHTARQFGRAIVMPNLKPPVTTTAQAQAYRERILAALPAGMTFEPLMTLYLTDNTPPDEIRRARESGFVHGVKLYPAGATTNSDHGVTDLAKCAKTLEAMQETGMPLLVHGEVTDASIDLFDREKVFIDRVMTPLRRDFPGLKVVFEHITTKDAADYVRDADAAPGLLGATITAHHLLYNRNALFVGGIRPHYYCLPVLKRETHRVALVEAATSGNPRFFLGTDSAPHARDAKETACGCAGCYTALHALELYAEAFDTAGALDKLEGFASFFGADFYGLPRSAETVTLRREAWELPREIFAGDTPVVPLRGGETIGWKLA

SEQ ID NO: 27752 - DNA, 1047 bp, Rubrivivax gelatinosus PM1
  CDS (1)..(1047)
atgagttctgctgccccggacaccctgaccctgagtcggcccgacgactggcacctgcacgtgcgcgatggcgccgcgctggcggccgtcgtgccgcacaccgcgcgacagttcggccgcgcgatcatcatgcccaatctcaagccgccggtcaccactgcggcccaggcgctggcctaccgcgagcgcatcctcgcggctgtgccggccggcctcgcgttcgagccgctgatgacgctctacctgaccgacaacatgccgcccgaggagatcggccgcgcgaaggcggccggcgtcgtggccgtcaagctctacccggcgggcgccaccaccaacagcgatgccggcgtgaccgacctgcgcaagacccaggccacgctcgaggcgatgcagcgcgagggcctgcctctgctggtgcacggcgaggtcaccgatgccgagatcgacctgttcgaccgcgaggcggtgttcatcgaccgccagctgatcccgctgcggcgcgacttcccggccctgaagatcgtgttcgagcacatcaccacccgcgaggccgcgcagtacgtggccggggccgggccgcacaccgcggccacgatcaccgcccaccacctgctctacaaccgcaacgccatcttcaccggcggcatccggccgcactactactgcctgccggtgctcaagcgcgagctgcatcgcgaggcgctggtggccgccgccacctcgggcagcgaccgctatttcctcggtaccgacagcgcaccgcatccggcccacctgaaagagcacgccagcggctgtgccggctgctacaccgcgttcagtgcgctggagctgtatgccgaggccttcgacgccgccggcgcgctggatcggctggaaggcttcgccagcgtccacggtccggccttctacggcctgccgcgcaacgccggcacggtgacgctgcgccggcaggcctggacgccacccgagacgctgccgttcggcgaagcgacgctcaagccgctgcgcggcggcgagtcgctggcctggcggcaggtcgagtga

SEQ ID NO: 27753 - protein, 348 aa, Rubrivivax gelatinosus PM1
MSSAAPDTLTLSRPDDWHLHVRDGAALAAVVPHTARQFGRAIIMPNLKPPVTTAAQALAYRERILAAVPAGLAFEPLMTLYLTDNMPPEEIGRAKAAGVVAVKLYPAGATTNSDAGVTDLRKTQATLEAMQREGLPLLVHGEVTDAEIDLFDREAVFIDRQLIPLRRDFPALKIVFEHITTREAAQYVAGAGPHTAATITAHHLLYNRNAIFTGGIRPHYYCLPVLKRELHREALVAAATSGSDRYFLGTDSAPHPAHLKEHASGCAGCYTAFSALELYAEAFDAAGALDRLEGFASVHGPAFYGLPRNAGTVTLRRQAWTPPETLPFGEATLKPLRGGESLAWRQVE

SEQ ID NO: 27754 - DNA, 1062 bp, Burkholderia fungorum LB400
  CDS (1)..(1062)
atgaccgcttccaacgcttccctcgactccatcacgctcgcccggccggacgactggcacctgcacgtccgcgacggcgcgatgctggccgccgtgctgccggacaccgcgcgccagttcggccgcgcgatcatcatgccgaacctgaagccgccggtcacgaccaccgcaatggcgcaggcttatcgcgagcggatcgtcaccgcgattcccgaaggcgcgaagttcgaaccgctgatgacgctgtacctgaccgacaacacgccgcccgacgaaatccgccgcgcgcgcgaaagcggcttcgtgcacggtgtgaagctgtacccggcgggcgcgacgaccaattcggacgcgggcgtcaccgacatcatgaagtgcgcgaaaacgctcgaagtgatgcaggaactgggcatgccgctgctggtgcacggcgaagtgacggatgcgtcgatcgatctgttcgaccgcgagaaggtgttcatcgaccgggtcatgacgccgctgcgccgcgcgtttccggcgctgaaggtggtgttcgagcacatcaccacgaaagacgcggtcgactatatccgcgaagccggcgtggcgccggaagtgctgggcgcgacgatcaccgcgcatcatctgctgtacaaccgcaacgcgatcttccagggcggtattcgcccgcattactactgcttgcccgtgttgaagcgggagacgcatcgggtggcgctggtcgaggcggcgacgtcgggcaatccgcgctttttcctcggaacggacagcgcgccgcacccgaaggggctgaaagagcatgcgtgcggctgcgcgggctgctacacggcgctgcacgctttggagctctatacggaagcattcgacaaggccggcgcgctggacaagctcgaaggtttcgcgagctttttcggcgcggatttctatggtctgccgcgtaacgaagagaaggtcacgttgcgtcgcgaggaatggacgctgccggccgaactgccggtcggcgatacgccggtcgtgccgctgcgcggcggcgagtcgatcggctggcgcctggtttaa

SEQ ID NO: 27755 - protein, 353 aa, Burkholderia fungorum LB400
MTASNASLDSITLARPDDWHLHVRDGAMLAAVLPDTARQFGRAIIMPNLKPPVTTTAMAQAYRERIVTAIPEGAKFEPLMTLYLTDNTPPDEIRRARESGFVHGVKLYPAGATTNSDAGVTDIMKCAKTLEVMQELGMPLLVHGEVTDASIDLFDREKVFIDRVMTPLRRAFPALKVVFEHITTKDAVDYIREAGVAPEVLGATITAHHLLYNRNAIFQGGIRPHYYCLPVLKRETHRVALVEAATSGNPRFFLGTDSAPHPKGLKEHACGCAGCYTALHALELYTEAFDKAGALDKLEGFASFFGADFYGLPRNEEKVTLRREEWTLPAELPVGDTPVVPLRGGESIGWRLV

SEQ ID NO: 27756 - DNA, 1041 bp, Novosphingobium aromaticivorans DSM 12444
  CDS (1)..(1041)
atgaccgagacgctgacgatccgccgccccgacgactggcatgtccacctgcgcgaccgcgacgtactgcggggcgtcgttccctataccgcccggcagtttgcccgcgccatcgtcatgcccaacctttcgccgccgatgaccgacgttgcgggcgttgccgcctatcgcgatcgcatccttgccgccctgccgcagggtagcgccttcacgccgctgatgacgctgtaccttaccgattcgaccgacatcgaagaggttgcgcgcggctttgccgaaggcgtgttcgtcgccgccaagctctatccagcccatgcgacgaccggttccgcgcacggcgtcaccgacatccgcaacatctatccggtgctggagaagatgcaggagatcgggatgccactgctgatccacggcgaggtgaccgattcccatgtcgacatcttcgaccgcgaagccgtgttcatcgagcggacgctgacccgcctcgtggccgacatgccggcccttcgcatcgtcttcgagcatatcacgaccgaggaggcggcccagttcgtggaaggcgcgggcgacagcatcgccgcgacgatcacgccgcagcatctccacatcaaccgcaacgccatgctcgtcggcggcatccgtccgcacgccttctgcctgccggtcgccaagcgcgagaagcaccggcttgccctgcgcaagcttgccacctcgggcttttcgcgggtgttcctgggaaccgataccgcgcctcatgccaagcacctgaaggaagcggcatgcggctgtgcggggatattcaacgcgcccttcgcgctcgaaagctatgtcacggtcttcgacgaggaaggcgcgctcgaccggttcgaggcctttgcctcgctcaacgggcccgcgttctaccggatgccggtgaacgaggaccgcatcgtgctggaaagggcgcccatcgaggtgcctgaggtgatcgactgcaacggcaccgcaatcgtgcccttccacgccggtgagacgctcggctggcgaatcgccgcggcctga

SEQ ID NO: 27757 - protein, 346 aa, Novosphingobium aromaticivorans DSM 12444
MTETLTIRRPDDWHVHLRDRDVLRGVVPYTARQFARAIVMPNLSPPMTDVAGVAAYRDRILAALPQGSAFTPLMTLYLTDSTDIEEVARGFAEGVFVAAKLYPAHATTGSAHGVTDIRNIYPVLEKMQEIGMPLLIHGEVTDSHVDIFDREAVFIERTLTRLVADMPALRIVFEHITTEEAAQFVEGAGDSIAATITPQHLHINRNAMLVGGIRPHAFCLPVAKREKHRLALRKLATSGFSRVFLGTDTAPHAKHLKEAACGCAGIFNAPFALESYVTVFDEEGALDRFEAFASLNGPAFYRMPVNEDRIVLERAPIEVPEVIDCNGTAIVPFHAGETLGWRIAAA

SEQ ID NO: 27758 - DNA, 1080 bp, Microbulbifer degradans 2-40
  CDS (1)..(1080)
atggccacaggcttgaatgccaataagcagcaagaactcatgtctgaaaaaattactcttaccgcccccgatgactggcacattcacctgcgcgacggcgatgccctcgcatacaccgtatccgatgccgcccgcaactttcgccgcgccattattatgcctaaccttgtgccccccgtactaaacgccaagcaggcactagattacaaagcacgcattcttgcccacgcaccggaagacgccgactttaccccgctaatggtgttataccttaccgaaaaaaccagccccgcagacatagcagaggcagcggccaaaggcatagtggcctgtaagctctaccccgccggcgccacaaccaattcagactcaggcgttaccgacataaaaaactgttacgacgcccttgctgccatgcaagagcacaatattaagcttttggtacacggcgaagttaccgatgcagatatcgatatttttgaccgcgaagcaacctttctaagccgcacaatggagcagcttgttaaggacttcccaacgctaaaaatcgttttagagcacattactaccgaagatgcggtcaagtttgtacttaaatcaggccccaacgtagcggcaaccattactgcgcaccaccttttgtacaaccgcaaccacatgctcgcaggcggtatacgcccacactattactgtttgcctattttaaagcgcagctcgcaccagcaagctctaattagtgctgcaatcagtggtaacccaaagttctttttaggcaccgactctgccccccacgcaaaaagtaaaaaagaagctgcttgtggctgtgcaggtagctacaccgcttttgccgcgctaccactttatgctgaggcattcgaagaagccggcgcactcgacaaactagaagattttgccagccattttggccccgacttttacggcctaccgcgcaacacaacaaaagtgaccctcaccaagcaagcatggacagtaccgtccaacctgcccttcggaagtgatacgctagtgccagttaaagctggcgaaacgttgaattggactctgacaccagcggaataa

SEQ ID NO: 27759 - protein, 359 aa, Microbulbifer degradans 2-40
MATGLNANKQQELMSEKITLTAPDDWHIHLRDGDALAYTVSDAARNFRRAIIMPNLVPPVLNAKQALDYKARILAHAPEDADFTPLMVLYLTEKTSPADIAEAAAKGIVACKLYPAGATTNSDSGVTDIKNCYDALAAMQEHNIKLLVHGEVTDADIDIFDREATFLSRTMEQLVKDFPTLKIVLEHITTEDAVKFVLKSGPNVAATITAHHLLYNRNHMLAGGIRPHYYCLPILKRSSHQQALISAAISGNPKFFLGTDSAPHAKSKKEAACGCAGSYTAFAALPLYAEAFEEAGALDKLEDFASHFGPDFYGLPRNTTKVTLTKQAWTVPSNLPFGSDTLVPVKAGETLNWTLTPAE

SEQ ID NO: 27760 - DNA, 1035 bp, Thiobacillus denitrificans ATCC 25259
  CDS (1)..(1035)
atgaccgacacgctcacgatcacccgccccgacgactggcacatccacttccgcgacggcgccgcgatgcagagcgtgatcggcgacaccgcacgcgtcttcggccgcgcgatcgcgatgccgaatctgaaaccgccggtcgtgacgctcgccgatgccctcgcctaccgcgagcgcctgctcgccgcgtcggcaggaaccggcttcgaaccgctgatggtgctctatctcaccgacaatacgcgggccgacgacatccgccgcgcgcaggcgagcggcctggttcacgccgtgaagtactacccggccggggcgacgacgaactcggactcgggcgtcaccgaactcaccaaggcctacggcgcgatcgcggcgatggaggaggtcggcctgccgctgcttttgcacggcgaagtcgtcgaccccgaggtcgacgtgttcgaccgcgaggccgtgttcatcgagcgacacctggtgaagttgctggaggattttccgcgtctgaagatcgtgctcgaacacgtcacgacgcggcaggcggtcgagttcgtcggcacggcgccgtccaacgtcgcggcgacgatcacggtccatcatctgctctacaaccgcaatgcgatgttccgcggcggcctgcgtccccatctctactgcctgccggtgctgaagcgcgagcggcaccgcgaggcgctcgtcgccgctgcggtctcgggcaatcccaaattctttctcggcagcgattccgcgccgcacccgatcggcgccaaggagagcgcttgcgggtgcgcgggcgtctattcggcgcatgcggcgatcgaactgtacgccgaggcgttcgaagatgccggtgccctcgacaggctcgaagccttcgcgagtttccacggcgccgatttctacgggctgccgcgcaacgccgcatcgatcaccttacggcgcgaatcctgggaggtgccggcccgcctcgcgctcggtgacgaagcgctggtgcctctgcgggcgggcgagaaggtgcgctggcgcgtggtcggctga

SEQ ID NO: 27761 - protein, 344 aa, Thiobacillus denitrificans ATCC 25259
MTDTLTITRPDDWHIHFRDGAAMQSVIGDTARVFGRAIAMPNLKPPVVTLADALAYRERLLAASAGTGFEPLMVLYLTDNTRADDIRRAQASGLVHAVKYYPAGATTNSDSGVTELTKAYGAIAAMEEVGLPLLLHGEVVDPEVDVFDREAVFIERHLVKLLEDFPRLKIVLEHVTTRQAVEFVGTAPSNVAATITVHHLLYNRNAMFRGGLRPHLYCLPVLKRERHREALVAAAVSGNPKFFLGSDSAPHPIGAKESACGCAGVYSAHAAIELYAEAFEDAGALDRLEAFASFHGADFYGLPRNAASITLRRESWEVPARLALGDEALVPLRAGEKVRWRVVG

SEQ ID NO: 27762 - DNA, 996 bp, Chloroflexus aurantiacus
  CDS (1)..(996)
atgacagttacattatttgccccacttgacatgcatctgcacctgcgcgaaggcgccatgttgcgcctcgtcgcgccattctctgctgcgcagttcgctggtgccgtgatcatgccgaatctcgtaccaccggtggataacgccgaccgccttgcccgctatcacgaggagattcgggctgcggttgacccgtacccgtttctcccgctgatgaccctgttttttcgcccctacgatgcccaaaccttgcaggcattgcgtgagcatatcttcgcgattaagctctacccggaaggcgtaacgaccaatagcgccggtggggtcagcgacctgacggcgattgagccaacgctggcaatgatggaagagttgggtattccgctcctggtacacggcgagagtcacgggtttgtgctggatcgtgaagccgagtttttgccggtgtatgagcgttgggcccgcacgttcccacgcctgcggattgtaatggagcatatcacaacggctgccgccctcgacctgctggatcgttatccgaatttgtttgccaccgtcaccctgcaccacctcttgatcactctcgacgatgtggccggtggtctgttgcagccgcatctcttctgtaagccgattgccaaacgtccgactgaccgtgatgcactgctggctgcggcattagccggccatcccaaactgatgtttggcagcgactcggcaccgcatccgatagatcgcaaagaagccgcgttctgcgctgccggtgtcttctcagcgccggtgttgctgccgatgctggtcgaattgttcgagcgtcacaacgccctcgaccgcctgcccgacttcgtgagtgggaatgcccggcggattcacggcctgaacccgccgccccgcaccgtgcgattggtcgaagacccctggcaggtaccgatgcgttatggcgatgtcgttccgttcgccgccggccagacgctacgctggcaggtggttgctgagtag

SEQ ID NO: 27763 - protein, 331 aa, Chloroflexus aurantiacus
MTVTLFAPLDMHLHLREGAMLRLVAPFSAAQFAGAVIMPNLVPPVDNADRLARYHEEIRAAVDPYPFLPLMTLFFRPYDAQTLQALREHIFAIKLYPEGVTTNSAGGVSDLTAIEPTLAMMEELGIPLLVHGESHGFVLDREAEFLPVYERWARTFPRLRIVMEHITTAAALDLLDRYPNLFATVTLHHLLITLDDVAGGLLQPHLFCKPIAKRPTDRDALLAAALAGHPKLMFGSDSAPHPIDRKEAAFCAAGVFSAPVLLPMLVELFERHNALDRLPDFVSGNARRIHGLNPPPRTVRLVEDPWQVPMRYGDVVPFAAGQTLRWQVVAE

SEQ ID NO: 27764 - DNA, 1005 bp, Campylobacter coli RM2228
  CDS (1)..(1005): transl_table=11
atgacacttaaaaacccactagatatgcatttgcatttaagagataaaaacatgctaagcttggttgcaccttttagtgctaaagattttcgtgcgggtgtgattatgccaaatttagttccaccgctttgtgatttagagagtttaaaatcttataaaacgcgtataataaatgcttgtgaaaatgagaatttcactcctttaatgactcttttttttaaaaattatgatgaaaaatttcttaaaagtgctaaggatgaaatttttggtatcaagctttatcctgcgggcatcaccacaaattcaaaaggtggggtttcaagttttgatatagagaatttaaaacccactttagaagcgatgagtgatttgcaaattccacttttggtacatggagaaaccaatgattttgtgatggatagggaaagcaattttgctaaaatctatgaaaatttagctaaaaattttccgcgtcttaagattgttatggagcatattacgactcaaaccttatgtgaacttttgaaagattatgaaaatttatatgcaaccattactttacatcatttaatcatcactttagatgatgttatcggtggaaaaatgcagccccatcttttttgcaagcctatagcaaagcattataaagataaagaagcgctttgtgagcttgcttttggtggatatgaaaaagtgatgtttggaagcgatagtgcaccacatcctaagcatgaaaaagaatgttgcggttgtgcagcgggtgtatttagtgcgagtgtagcactttgtgttttggctgatctttttagtaaaaattcaaatgaagttaatttgcaaaagtttatttcggataatgcttgtaaagtgcataatttaacctttgaaaaagaaaaaatcattgttttagaaaatcaagaatggcaagttccaaacgaatataaaaacgagaatgaaaaagtagttccttttatggcgggggaaagtttaaaatttagagtaaaataa

SEQ ID NO: 27765 - protein, 334 aa, Campylobacter coli RM2228
MTLKNPLDMHLHLRDKNMLSLVAPFSAKDFRAGVIMPNLVPPLCDLESLKSYKTRIINACENENFTPLMTLFFKNYDEKFLKSAKDEIFGIKLYPAGITTNSKGGVSSFDIENLKPTLEAMSDLQIPLLVHGETNDFVMDRESNFAKIYENLAKNFPRLKIVMEHITTQTLCELLKDYENLYATITLHHLIITLDDVIGGKMQPHLFCKPIAKHYKDKEALCELAFGGYEKVMFGSDSAPHPKHEKECCGCAAGVFSASVALCVLADLFSKNSNEVNLQKFISDNACKVHNLTFEKEKIIVLENQEWQVPNEYKNENEKVVPFMAGESLKFRVK

SEQ ID NO: 27766 - DNA, 993 bp, Campylobacter lari RM2100
  CDS (1)..(993): transl_table=11
atgacacttaaaaaccctttggacatgcatttacatttacgcgatgaaagtatgcttgaacttgtagccccatatagtgcaaaagactttaaagcgggggttatcatgccaaatttaatcaccccacttactgaaacaactgcacttaaagcttataaagaacgcattttaaaagcttgtaaaaatgaagattttacacctttaatgactttgttttttcaaaactatgatgagaaatttttagaacaagcaaaagatgaaatttttactataaagctttatccagctggaatcactacaaattcagataatggaatttcaagctttgatatagaaaaactaaaacctacactaaatgctatgagtgagcttaatttgcctttgcttgtgcatggagaaaccaatgattttgtcatggatagagaagcaaattttgctaaaatctatgaaaaattagctcaaaattttccaaaattaaaaattgtaatggagcatattaccactaaagttttatgtgatttattgaaaaattatgaaaatttatatgcaactataactttacatcatttaatgataacacttgatgatgtaataggtggcaagatggatcctcatttattttgcaagcctatagcaaaacgctatgaagacaaagatgctttatgtgagcttgcttttagcggttatgaaaaggctatgtttggaagcgatagcgcaccacatcctttacatactaaagaatgctgtggttgtgcagctggagtatttagtgctcctgttatactacctgttttggctgagctttttgaaaaaaattcaaatgaagaaaatttacaaaaattcataagtgacaatgcttgcaaaattcataatctcaaatttgaaaaagaaaaaatcatcaccttagaaaaaaacacatggcaagttccacaaaaatacggcgatgtagtgccttttatggccggaaaaactctaaatttcaaggttatttaa

SEQ ID NO: 27767 - protein, 330 aa, Campylobacter lari RM2100
MTLKNPLDMHLHLRDESMLELVAPYSAKDFKAGVIMPNLITPLTETTALKAYKERILKACKNEDFTPLMTLFFQNYDEKFLEQAKDEIFTIKLYPAGITTNSDNGISSFDIEKLKPTLNAMSELNLPLLVHGETNDFVMDREANFAKIYEKLAQNFPKLKIVMEHITTKVLCDLLKNYENLYATITLHHLMITLDDVIGGKMDPHLFCKPIAKRYEDKDALCELAFSGYEKAMFGSDSAPHPLHTKECCGCAAGVFSAPVILPVLAELFEKNSNEENLQKFISDNACKIHNLKFEKEKIITLEKNTWQVPQKYGDVVPFMAGKTLNFKVI

SEQ ID NO: 27768 - DNA, 1002 bp, Campylobacter upsaliensis RM3195
  CDS (1)..(1002): transl_table=11
atgaaacttatcaatcctcttgacatgcacctacacttaagagacacgcctatgctcgagtgcgttaccccctactcggcaaaggattttagagcagctgtaattatgccgaatttaatccctccactttgcgacttaaatgctttaaaagcctataaaagtcgcattataaaagcaagtgaaaatgagcttttcacgcctttaatgacccttttttttcagcattatgatgagaaatttttagaagaagcaaggagcgaaatttttggcattaagctttatcctgctgggattacgacaaattcaagtggaggtgtttcaagttttgacttagaagctttaaagcctacacttttggcaatgagtgctttagaaatccctcttttaattcacggcgaaacgaatgattttgtaatggatagagaggcgaattttgccaaaatttatgagaaacttgcccttaattttccaaaacttaaaatcgtaatggaacacatcaccacaaaaaccctttgcaaacttttaaaagactatgaaaatttatacgcgactataaccttacatcatcttattttaagccttgatgatgttatcggcggtaaaatgcaacctcatcttttttgcaaacccatagcaaaaacctacgaagatagagaagccttatgtgagctagcttttagtgggtatgaaaaagcgatgtttggaagcgattctgcccctcacccacaaagtgaaaaagagtgctgtggctgtgctgctggagtgttttcttctcctgtggctttaagcgttttagcggagctttttgaaaaaaattcaaatgaaagcaatttgcaaaaattcctttcaaataatgcttgtggaattcataagctaagctttgaaaaagacaaaatgattgagcttaaaaaagaaaaatggcaagtcaaagaaaattaccataaaatcgtgccttttatggctgaaaaatgcttggaatttaagccttttatcctagaataa

SEQ ID NO: 27769 - protein, 333 aa, Campylobacter upsaliensis RM3195
MKLINPLDMHLHLRDTPMLECVTPYSAKDFRAAVIMPNLIPPLCDLNALKAYKSRIIKASENELFTPLMTLFFQHYDEKFLEEARSEIFGIKLYPAGITTNSSGGVSSFDLEALKPTLLAMSALEIPLLIHGETNDFVMDREANFAKIYEKLALNFPKLKIVMEHITTKTLCKLLKDYENLYATITLHHLILSLDDVIGGKMQPHLFCKPIAKTYEDREALCELAFSGYEKAMFGSDSAPHPQSEKECCGCAAGVFSSPVALSVLAELFEKNSNESNLQKFLSNNACGIHKLSFEKDKMIELKKEKWQVKENYHKIVPFMAEKCLEFKPFILE

SEQ ID NO: 27770 - DNA, 1065 bp, Erythrobacter litoralis HTCC2594
  CDS (1)..(1065): transl_table=11
atgcggcgtgccgcactagagcagcgcgcgatgaccgagacgctgacgatccgccgccccgacgactggcacctccatttccgcgacggcgcgatgatgcgcggcgtcgtgccctataccgcgcgccagttcgcccgcgcgatcgtaatgcccaacctgacccctccggtaacgacgacagcgctgggggctgcctatcgcgagcggatcctcgctgccgtgccggagggcgttgattttaggccgctgatgaccgcctatctcaccgacgaaaccgacgccgacgatctcatcgacggttacacgcacggcgtgtttacggctgccaagctttaccccgccaatgccacgaccaattctgcgtcgggcgtgaccgatgtcgaagcgctctatccggtgttcgagcggatggcagcagctggcatggtcctgtgcattcacggcgaggttaccgacgccgacgtcgacgtgttcgaccgcgagaaagagttcatcgagcggaccatggcaccgcttcacgccgcgatcccggcgctcaagatcgcgttcgagcatatcacgaccagcgatgcggtcgatttcgtagtcggcgcaaacgacaatatcggcgcgaccatcacgccgcagcacctgcacatcaaccgtaatgccatgctggtcggcggcatccagccgcataattactgcctgccggtcgccaagcgcgagacgcatcggctggcgctacgccaggcggcgacctccggtccgcccaaattcttcctcggcaccgacagcgcgccgcatgaaaagcacaccaaggaaagcgcctgcggctgcgcgggcatcttcggcgcgccctatgcgctggagagctatctcgcggtgttcgaagaggaagatgcgcttgataagttcgaagccttcgcctcgctcaacggtcctgcgttttatggcctgccggtcaatgacgagacaatcacgctggagcgggtgccgcataatgtgcccgattctctggagacggaaggcggcaaggtcgtgccattccacgccgggcaggagcttaactggcggcttaaatga

SEQ ID NO: 27771 - protein, 354 aa, Erythrobacter litoralis HTCC2594
MRRAALEQRAMTETLTIRRPDDWHLHFRDGAMMRGVVPYTARQFARAIVMPNLTPPVTTTALGAAYRERILAAVPEGVDFRPLMTAYLTDETDADDLIDGYTHGVFTAAKLYPANATTNSASGVTDVEALYPVFERMAAAGMVLCIHGEVTDADVDVFDREKEFIERTMAPLHAAIPALKIAFEHITTSDAVDFVVGANDNIGATITPQHLHINRNAMLVGGIQPHNYCLPVAKRETHRLALRQAATSGPPKFFLGTDSAPHEKHTKESACGCAGIFGAPYALESYLAVFEEEDALDKFEAFASLNGPAFYGLPVNDETITLERVPHNVPDSLETEGGKVVPFHAGQELNWRLK

SEQ ID NO: 27772 - DNA, 1080 bp, Azotobacter vinelandii AvOP
  CDS (1)..(1080): transl_table=11
atgcacggcagcctcacttttctggaagtctcgatgcccgatagactgatactgctacgccctgatgactggcatattcatcttcgcgatggtgccgccctgagccgaacggtgacggatgcagcacgcacgttcggtcgcgccatcgtcatgcccaatctggttccacccgtacgcaacgcgtccgaggcgggcgcctatcggcaacgcatccaggccgcacgccctgcggacagtcgcttcgaacccctgatgaccctctacctcacggacaagacctccccagaggatatccgaaccgccaaggcccaaggctttgtgcatgcagcaaaattatatcctgcgggcgccacaaccaattcggatgccggggtcacacgcatcgacaacatctttccaatactggaagcgatggccgaggcaggcctgccacttctagtacacggagaggtgactcacagcgaagtcgatgtattcgatcgcgaaaagcgcttcatagatgaaaatctggtccgcataatcgagcacttccctacacttaaggtggtattcgaacacatcactacccgagatgccgttcaatttgtggaaaccagtagcagcaatgttggcgccaccattaccgcccatcaccttctgtacaaccgcaaccacatgctggtcggcggcatacgcccccacttctactgcttgccaatcctcaaacgcaggactcaccaggaggccttgctggatgcggccaccagcggtaacacaaaattctttcttggtaccgactcggcgccacacgcccgtcacgccaaggaagcggcttgcggctgcgccggctgctatacggcgtacgcagccatcgagttgtatgctgaagccttcgagcaacgcagcgccctggaccggctggaggcctttgccagccaccatggcgccgacttctacggcattccgcggaacaccgaccacataacgctaattcgcgaggagtggacagcaccagcctgcatgacatttggcgagcatagtctggttccattgcgcgcaggagaaaagctgcgctggcgtctgctggaggaaaaaatgtga

SEQ ID NO: 27773 - protein, 359 aa, Azotobacter vinelandii AvOP
MHGSLTFLEVSMPDRLILLRPDDWHIHLRDGAALSRTVTDAARTFGRAIVMPNLVPPVRNASEAGAYRQRIQAARPADSRFEPLMTLYLTDKTSPEDIRTAKAQGFVHAAKLYPAGATTNSDAGVTRIDNIFPILEAMAEAGLPLLVHGEVTHSEVDVFDREKRFIDENLVRIIEHFPTLKVVFEHITTRDAVQFVETSSSNVGATITAHHLLYNRNHMLVGGIRPHFYCLPILKRRTHQEALLDAATSGNTKFFLGTDSAPHARHAKEAACGCAGCYTAYAAIELYAEAFEQRSALDRLEAFASHHGADFYGIPRNTDHITLIREEWTAPACMTFGEHSLVPLRAGEKLRWRLLEEKM

SEQ ID NO: 27774 - DNA, 1095 bp, Burkholderia vietnamiensis G4
  CDS (1)..(1095): transl_table=11
atggccagcccgttcctcacgacgcctcctatgactgcctcgaacgcttcctccccggcgacgctcacgctcgcccgtcccgacgacctgcatctgcacctgcgcgacggcgacatgctggccgcggtgctgccgcacaccgcacgccagttcgcgcgcgcgatcgtgatgccgaacctgaagccgcccgtcacgacgaccgcgcacgcgcaggcctatcgcgaccggatcctggccgcgctgccggccggcagcgcgttcgagccgctgatgacgctgtacctgaccgacaacacggcgcccgacgaagttcgtcgcgcgcgcgacagcggcttcgtgcacggcgtgaagctgtatccggccggcgcgacgacgaactcggatcacggcgtgagcgacctcgcgaagtgcgcgaagacgctcgaggcgatgcaggaaaccggcatgccgctgctcgtgcacggcgaggtgacggacccgtcgatcgacatgttcgatcgcgagaaggtgttcatcgaccgcgtgatgacgccgctgcgccgcgatttccccgcgctgaaggtcgtgttcgagcacatcacgacgaaggatgcggccgactacgtgcgcgacgccgatgcggcgccgggcttgctcggcgcgacgatcacgccgcagcatctgctgtacagccgcaacgcgctgttcgtcggcggcattcgcccgcattactactgcctgccggtgctcaagcgcgagacgcaccgcgtcgcgctcgtcgaagcggcgacctccggcaacccgcgcttcttcctcggcaccgacagcgcgccgcatgcgcgcggcgcgaaggaaaccgcctgcggctgcgccggctgctacacggcgctgcacgcgctcgagctgtatgcggaagcgttcgaccaggccggcgcgctcgacaagctggagaatttcgcgagccgcttcggcgccgatttctacggcctggcgcacagcaccgacacggtcacactgcgccgcgagacctgggagctgccgaccgaggtgttcgcgggcgatacgccggtcgtgccgctgcgcgctggcgagacgatcggctggaagttcgcgtga

SEQ ID NO: 27775 - protein, 364 aa, Burkholderia vietnamiensis G4
MASPFLTTPPMTASNASSPATLTLARPDDLHLHLRDGDMLAAVLPHTARQFARAIVMPNLKPPVTTTAHAQAYRDRILAALPAGSAFEPLMTLYLTDNTAPDEVRRARDSGFVHGVKLYPAGATTNSDHGVSDLAKCAKTLEAMQETGMPLLVHGEVTDPSIDMFDREKVFIDRVMTPLRRDFPALKVVFEHITTKDAADYVRDADAAPGLLGATITPQHLLYSRNALFVGGIRPHYYCLPVLKRETHRVALVEAATSGNPRFFLGTDSAPHARGAKETACGCAGCYTALHALELYAEAFDQAGALDKLENFASRFGADFYGLAHSTDTVTLRRETWELPTEVFAGDTPVVPLRAGETIGWKFA

SEQ ID NO: 27776 - DNA, 1095 bp, Burkholderia cenocepacia AU 1054
  CDS (1)..(1095): transl_table=11
atggcaagcccgttcctcacgacgcctcctatgactgcctcgaacgcttcttccccggcgacgctttcgctcgcccgtcccgacgactggcacctgcacctgcgcgacggcgacatgctcgccgccgtgctgccgcacaccgcccgccagttcggccgcgccatcgtcatgccgaacctgaagccgccggtcacgaccaccgcgcaggcgcaggcctatcgcgagcgcatcctcgccgcgctgccggccgggatgacgttcgagccgctgatgacgctgtacctgaccgacaacacgccgcccgacgaaatccgccgcgcgcgcgaaagcggcttcgtgcacggcgtgaagctgtatccggcaggcgccacgacgaattccgaccatggcgtcaccgatctcgcgaaatgcgcgaagacgctcgaggcgatgcaggacaccggcatgccgctgctcgtgcacggcgaggtgaccgatgcgtcgatcgacctgttcgaccgcgagaaggtgttcatcgaccgcgtgatgacgccgctgcgccgcgatttcccgggcctgaaggtcgtgttcgagcacatcacgacgaaggacgcggccgactacgtgcgcgatgccgacgcggcgcccggcctgctcggcgcgacgatcaccgcgcatcacctgctgtacaaccgcaacgcgctgttcgtcggcgggattcgcccgcattactactgcctgccggtgctcaagcgcgagacgcatcgcgtggcgctggtcgaggccgcgacgtcgggcaacccgcgcttcttcctcggcaccgacagcgcgccgcatgcgcgcgacgcgaaggaaaccgcgtgcggctgcgcgggctgctacacggcgctgcacgcgctcgaactgtacgcggaagcgttcgacacggccggcgcgctcgacaagctggaagggttcgcgagcttcttcggcgccgatttctacgggctgccgcgcagcgccgagacggtcacgctgcgccgcgagccgtgggaactgccgcgcgagatcctcgcgggcgatacgccggtcgtgccgctgcgcggcggcgagacgatcggctggaagctggcgtga

SEQ ID NO: 27777 - protein, 364 aa, Burkholderia cenocepacia AU 1054
MASPFLTTPPMTASNASSPATLSLARPDDWHLHLRDGDMLAAVLPHTARQFGRAIVMPNLKPPVTTTAQAQAYRERILAALPAGMTFEPLMTLYLTDNTPPDEIRRARESGFVHGVKLYPAGATTNSDHGVTDLAKCAKTLEAMQDTGMPLLVHGEVTDASIDLFDREKVFIDRVMTPLRRDFPGLKVVFEHITTKDAADYVRDADAAPGLLGATITAHHLLYNRNALFVGGIRPHYYCLPVLKRETHRVALVEAATSGNPRFFLGTDSAPHARDAKETACGCAGCYTALHALELYAEAFDTAGALDKLEGFASFFGADFYGLPRSAETVTLRREPWELPREILAGDTPVVPLRGGETIGWKLA

SEQ ID NO: 27778 - DNA, 1056 bp, Chromohalobacter salexigens DSM 3043
  CDS (1)..(1056): transl_table=11
atgtccgagtcccctacccgcctgcgaatccgtcgccccgacgactggcaccttcacctgcgcgacggcgacgtgatgcgcctggtgctgccggcgaccagccgtgtcttcgcacgcgccatcgtgatgcccaacctgatgccgccggtcaccaccctggatgccgccgaggcgtatcgcgcgcggatcctcgaggcgttgccggcagggcatgacttcacgccgctgatgacctgctatctcaacgagagcgtcagcgccgagacgctggaggcggggcatgccagcggattgctgacggcggccaagctgtacccggccaatgccaccaccaactcgcaacatggcgtcaagcgtatccaggacatctacccgttgctcgaggtgatgcagcgcatcggcatgccgctgctggtgcatggcgaagtcacgcgtggcgagatcgacatcttcgatcgcgaaaaggccttcatcgacgaggtgatgacaccgctgtgcgagcatttcccggcgctcaaggtggtgttcgagcacatcaccacggcggaggcggcgcagtacgtcctggagggcaacgacaatctggccgcgacgctgacgccgcagcacctggcgcacaatcgcaacgacatgctggtcggcggcattcgcccgcacctttattgcctgccgatcctcaagcgcgccgagcaccagcgggcgctgcgcgcggcggtcgccagcggtcatccgcggttctttctgggcaccgactcggcaccgcacgtggtcgccgccaaggagaccagttgcggctgtgccggggtgttcaacgcccaggccgcgctctcggtctatgcggaggtattcgaggaagaaggcgcgctcgagcacttcgcggcgttctgctcggaaaacgggccgcgcttctatggcctgccgctcaacgaggatcacatcgagctcgtgcgccagccgacgaccatgcccgaacgcatcgaaggccatggcgaaacgttgaagcccttcaaggccggggaaaccctggcctggacggtcgccgccgggcgcgattga

SEQ ID NO: 27779 - protein, 351 aa, Chromohalobacter salexigens DSM 3043
MSESPTRLRIRRPDDWHLHLRDGDVMRLVLPATSRVFARAIVMPNLMPPVTTLDAAEAYRARILEALPAGHDFTPLMTCYLNESVSAETLEAGHASGLLTAAKLYPANATTNSQHGVKRIQDIYPLLEVMQRIGMPLLVHGEVTRGEIDIFDREKAFIDEVMTPLCEHFPALKVVFEHITTAEAAQYVLEGNDNLAATLTPQHLAHNRNDMLVGGIRPHLYCLPILKRAEHQRALRAAVASGHPRFFLGTDSAPHVVAAKETSCGCAGVFNAQAALSVYAEVFEEEGALEHFAAFCSENGPRFYGLPLNEDHIELVRQPTTMPERIEGHGETLKPFKAGETLAWTVAAGRD

SEQ ID NO: 27780 - DNA, 1059 bp, Burkholderia pseudomallei 668
  CDS (1)..(1059)
atgaatgcttccgttcccgcctcgctgaccctcgcccgccccgacgactggcacctgcacgtgcgcgacggcgcgatgctcgcggccgtcctgccgcacaccgcccgccagttcggccgcgcgatcatcatgccgaacctgaagccgcccgtcacgacgaccgcgcaggcgcaggcctaccgcgagcgcatcctggccgcggtgccggccggcatgacgttcgagccgttgatgacgctgtacctgaccgacaacacgcccgccgacgaaatccgccgcgcacgcgaaagcggctgcgtgcacggcgtgaagctctatccggcgggcgcgacgacgaactcggacgccggcgtgaccgacctgctcggcaagtgcgcgaagacgctcgaggcgatgcaggaagtcgggatgccgctgctcgtgcacggcgaggtgacggatccgtcgatcgacctgttcgaccgcgagaaggtgttcatcgatcgcgtgatggagccgctgcgccgcgcgctgccggggctcaaggtggtgttcgagcatattacgacgaaggatgcggccgactacgtgcgcgatgccgacgcggcgtcaggccggatcggcgcgacgatcaccgcgcaccatctgctgtacaaccgcaatgcgatgtttctcggcggcatccgtccacattactactgcctgccggtgctcaagcgcgagacgcatcggatcgcgctcgtcgaggcggcgacgtcgggcaatccgcgcttcttcctcggcaccgacagcgcgccgcacgcgaaaggcgcgaaggaagccgcgtgcggctgcgcgggctgctacaccgcgctgcacgcgctcgagctgtacgcggaggcattcgagcaggcgggcgcgctcgacaagctcgaaggcttcgcgagcttcttcggcgcggacttctacggtttgccgcgcagcgccgagacggtgacgctgcgccgcgagacgtgggagctgccgcgcgagatcgacgcgggcgccggcccggtcgtgccgctgcgcggcggcgaggcgatcggctggcggctcgtctga

SEQ ID NO: 27781 - protein, 352 aa, Burkholderia pseudomallei 668
MNASVPASLTLARPDDWHLHVRDGAMLAAVLPHTARQFGRAIIMPNLKPPVTTTAQAQAYRERILAAVPAGMTFEPLMTLYLTDNTPADEIRRARESGCVHGVKLYPAGATTNSDAGVTDLLGKCAKTLEAMQEVGMPLLVHGEVTDPSIDLFDREKVFIDRVMEPLRRALPGLKVVFEHITTKDAADYVRDADAASGRIGATITAHHLLYNRNAMFLGGIRPHYYCLPVLKRETHRIALVEAATSGNPRFFLGTDSAPHAKGAKEAACGCAGCYTALHALELYAEAFEQAGALDKLEGFASFFGADFYGLPRSAETVTLRRETWELPREIDAGAGPVVPLRGGEAIGWRLV

SEQ ID NO: 27782 - DNA, 1068 bp, Polaromonas sp. JS666
  CDS (1)..(1068): transl_table=11
atgacttcagccatcagcaccccggtttccaccctgaccatcacccgccccgacgactggcacctgcatgtgcgggacggcgacgcattgagcacggtggtgccgcataccgccgcccagtttggccgggccatcatcatgcccaacctgcgcccgccggtgaccaccgcggcccaggctgttgcctaccgcgagcgcatccaggccgccgtgcccgcgggcgtggctttcgagccgctgatgacgctgtatttgaccgacaacctgccgcccgacgagatcaagcgggccaaagaggccggcgtggtcgccaccaagctctacccggccggcgccaccaccaacagcgatgcgggcgtgaccgacctgcgcaagacctacaagacactcgaagcgatgcagcgcgaaggcctgctgctgctggtgcatggcgaggtgacctcgcccgacattgacctgtttgaccgcgaggcggtgttcatcgacacgcagctgattccactgcgccgcgatttccctgagctgaagatcgtgtttgagcacatcaccacgaaagaagccgcgcagtatgtgcatgacgccgaccgcttcacgggcgccaccatcaccgcgcaccatctgctgtacaaccgcaacgcgattttcaccggcggcatccggccgcactactactgcctgcccgtgctcaagcgcgaaacgcatcgcgtcgcgctggtcgaggcggccaccagtggcaaccaccggtttttcctcggcacggacagcgcaccgcacccggcccacctcaaggagcatgccaccggctgcgccggctgctacaccgcccatgcggcgatggagctgtatgccgaagcctttgatgcggcgggcgcactcgacaagctcgaggcctttgccagtttcaacggcgcggacttctatggcttgccgcgcaaccagggcaccatcaccctgaaaaaggaaagctggcggccccccgagagttatgcgtttggcgaggctgaactcaagccgctgcgctcgggtgaaagcctgccatggaagctttactccacccggagcgaatga

SEQ ID NO: 27783 - protein, 355 aa, Polaromonas sp. JS666
MTSAISTPVSTLTITRPDDWHLHVRDGDALSTVVPHTAAQFGRAIIMPNLRPPVTTAAQAVAYRERIQAAVPAGVAFEPLMTLYLTDNLPPDEIKRAKEAGVVATKLYPAGATTNSDAGVTDLRKTYKTLEAMQREGLLLLVHGEVTSPDIDLFDREAVFIDTQLIPLRRDFPELKIVFEHITTKEAAQYVHDADRFTGATITAHHLLYNRNAIFTGGIRPHYYCLPVLKRETHRVALVEAATSGNHRFFLGTDSAPHPAHLKEHATGCAGCYTAHAAMELYAEAFDAAGALDKLEAFASFNGADFYGLPRNQGTITLKKESWRPPESYAFGEAELKPLRSGESLPWKLYSTRSE

SEQ ID NO: 27784 - DNA, 1341 bp, Jannaschia sp. CCS1
  CDS (1)..(1341): transl_table=11
ttgcccgccatccagcagcgacacgcgccattcatagagcatcatgggccgtctcctcgtcctcgcctgcgtaaggaacgtggcgcgcgggcatcatcgcgacaagtaagacaatccgccggtcaggaccgcgcgaatgcaggcaacgccttgcggatctcctacggctccagcaccagccccccggacgaatcacggatcagcgcagggccgacgcggatcacctttgcccgtgatcccgcctcaaatcgcgcgcccctctttccgcacgtcgcgacctgctataacacacggcccatgacccaatccctcacgatccgccgccccgacgactggcacctgcacctgcgcgacggcgcgatgatgcgggccgttctgcctgaaaccgcccgtcattttgcccgcgcgatcatcatgcccaacctcgtgccgcccgtggtcacagcccaggatgcgctggcctaccgcgaccggattgaggcggcgctgccggacggcgcggatttcacgccactgatgacgctttatctaaccgaacagacggacccggacgacgtggaggcggcgtttgccgatgggctgatccatgcggtcaaactctatccggcgggggccacgacaaattcccaatccggcgttgcgacgctgaaaaacgtctatccggtgctggagcgtatggcccagatcggcctgccgctgtgtatccatggcgaggtcaccgatccgcaggtcgacatcttcgaccgggaacaggccttcatcgataccgtcctgatcccgctgcgcgccgacctgccggacctgaaggtcacgctggagcatatcaccacctcccacggcatcgattatgtggtgggcgcggacggggacattgccggcacgatcacaacgcatcacctgatgatcaaccgcaaccatatgctcgtgggcggcatccgaccgcactattattgcctgcccatcgtcaaacgcgcctcccaccaacacgccctgcgccgggccgcgacatcgggccacccgcgcttctttctgggcaccgactcggccccccacctggacggcgcgaaggaaaccgcctgcgggtgcgcgggcgtcttctcagccaccaacacgatgtcctgcctcgcccatgtgttcgacgaagacggcgcgctggtgaaccttgaggccttcacctccctcaacggccccgcccgctatggcctggcgccgaacgcggccacgatgacgctggaaaagcgcgaccatcccaccaattaccctgccaaatttgacacagatgacggccccctgaccctcttcgatccctccacgccgctctattggcatgtgaaggactga

SEQ ID NO: 27785 - protein, 446 aa, Jannaschia sp. CCS1
MPAIQQRHAPFIEHHGPSPRPRLRKERGARASSRQVRQSAGQDRANAGNALRISYGSSTSPPDESRISAGPTRITFARDPASNRAPLFPHVATCYNTRPMTQSLTIRRPDDWHLHLRDGAMMRAVLPETARHFARAIIMPNLVPPVVTAQDALAYRDRIEAALPDGADFTPLMTLYLTEQTDPDDVEAAFADGLIHAVKLYPAGATTNSQSGVATLKNVYPVLERMAQIGLPLCIHGEVTDPQVDIFDREQAFIDTVLIPLRADLPDLKVTLEHITTSHGIDYVVGADGDIAGTITTHHLMINRNHMLVGGIRPHYYCLPIVKRASHQHALRRAATSGHPRFFLGTDSAPHLDGAKETACGCAGVFSATNTMSCLAHVFDEDGALVNLEAFTSLNGPARYGLAPNAATMTLEKRDHPTNYPAKFDTDDGPLTLFDPSTPLYWHVKD

SEQ ID NO: 27786 - DNA, 1038 bp, Methylobacillus flagellatus KT
  CDS (1)..(1038): transl_table=11
atgacgactaccattactatcacgcgccccgatgattggcaccttcatttgcgcgatggcgcagccttgtctgcagtgctgccagattcggcaaggcgctttgggcgggcgattgtcatgcccaacctgcgtccgccggtgacgaccacggcattggcgtatgcatatcgtgagcgcattatgcaggcaatgcctgctgggtcaggatttgagccattgatgaccttgtacctcactgacaataccagtgcagaagagattgaccgcgccaaggctagcggtattgtgcatggcgtgaagctttatcctgccggggcgaccaccaattccgactcgggggtgactaacatcgggcattgcgtcaaggcgctcgaggcgatggaaaagcacgggattcccctgctggtgcatgcggaagtgactgatgtcgatgtggatgtgtttgaccgcgagcgggtgttcatcgagcgcaatatggtcccgctgctggaacgattccaggggttgcgggtggtgtttgagcacattaccaccaaggatgcggccaacttcgtcgctggggcaccggagaacgtcgctgccaccatcacggcgcaccacctgctcatgaaccgcaatgccatgttcaacgggggtatccgaccgcatcattattgcctgcccgtgctcaagcgtgaggagcatcgacttgccttggtcgcggcggcgacctccggcaatccaaagttctttctgggcaccgatagcgcgccgcatgcgaagtccgccaaagaggcggcttgtggctgtgccggcatgtataccgcacatgccggaattgaactgtataccgaggtgtttgatgcagctggctcgcttgacaggctggaggcatttgcaagcttccatgggccggatttttaccgtctgccgcgcaatacggacaagatcactcttgaaaaaactgcgtgggaagtgcctgcaagcttgccgtttgccggggatgagctggttccgctgagagctggcagccatatttcctggagattaaaagactaa

SEQ ID NO: 27787 - protein, 345 aa, Methylobacillus flagellatus KT
MTTTITITRPDDWHLHLRDGAALSAVLPDSARRFGRAIVMPNLRPPVTTTALAYAYRERIMQAMPAGSGFEPLMTLYLTDNTSAEEIDRAKASGIVHGVKLYPAGATTNSDSGVTNIGHCVKALEAMEKHGIPLLVHAEVTDVDVDVFDRERVFIERNMVPLLERFQGLRVVFEHITTKDAANFVAGAPENVAATITAHHLLMNRNAMFNGGIRPHHYCLPVLKREEHRLALVAAATSGNPKFFLGTDSAPHAKSAKEAACGCAGMYTAHAGIELYTEVFDAAGSLDRLEAFASFHGPDFYRLPRNTDKITLEKTAWEVPASLPFAGDELVPLRAGSHISWRLKD

SEQ ID NO: 27788 - DNA, 1023 bp, Sphingopyxis alaskensis RB2256
  CDS (1)..(1023): transl_table=11
atgaccgaccgcctgacgatccgccgccccgacgactggcacgtccatctgcgcgacggcgcgatgcttgcccatgtcgcgccctataccgcgcgccagtttgcgcgcgcgatcgtcatgcccaatctgtcgccgccggtgacgaccgccgaagaaggccgcgcctatcgcgaccgcatcaccgccgcggtgcccgcggacctcgacttcaccccgctgatcgtcgcctatctgaccgacgccaccgacgcggacgagatcgcgcgcggccatgccgagggcgtgttcaccgccgccaagctctatcccgcgcacgccaccaccggcagcgcgcacggcgtcaccgacgtcgcgaacatcatgggtgtgctcgagcggatgcaggacatcggcatgccgctgctcatccacggcgaagtcaccgaccatgacgtcgacattttcgaccgcgaggcggtgttcatcgagcgcacgcttgaaccgctggtgcgcgcgctgcccggcctcaagatcgttttcgagcatatcacgacggcggaggccgcgcagtttgtcgccgacgcgcccgccaatgtcgccgcgacgatcacgccgcagcatctccacatcaaccgcaacgcgatgcttgtcggcggcatccgcccgcacgcctattgcctgcccgtcgcgaagcgcgagcatcaccggctcgcggtgcgcgccgccgcgacatcgggctcgcccaaattcttcctcggcaccgacagcgcgccgcacgcggtgcatatgaaggaagcgtcgtgcggctgcgcaggcattttcaacgcgccctttgcgctcgaaagctatgcgatggcgttcgatcaggatggcgcgctggccaatttcgagggtttcgccagcgagcatggtccgcgcttctatggcctgccgctcaacgagggcacggtgacgttggaacgcgccgaaatcaccgtccccgaccggatcggcgacgtcgtgcccttccacgcgggcgaaaccatcggctggcggctggtctga

SEQ ID NO: 27789 - protein, 340 aa, Sphingopyxis alaskensis RB2256
MTDRLTIRRPDDWHVHLRDGAMLAHVAPYTARQFARAIVMPNLSPPVTTAEEGRAYRDRITAAVPADLDFTPLIVAYLTDATDADEIARGHAEGVFTAAKLYPAHATTGSAHGVTDVANIMGVLERMQDIGMPLLIHGEVTDHDVDIFDREAVFIERTLEPLVRALPGLKIVFEHITTAEAAQFVADAPANVAATITPQHLHINRNAMLVGGIRPHAYCLPVAKREHHRLAVRAAATSGSPKFFLGTDSAPHAVHMKEASCGCAGIFNAPFALESYAMAFDQDGALANFEGFASEHGPRFYGLPLNEGTVTLERAEITVPDRIGDVVPFHAGETIGWRLV

SEQ ID NO: 27790 - DNA, 1032 bp, Shewanella baltica OS155
  CDS (1)..(1032): transl_table=11
atgaccacaataacaatcactcgcccagacgactggcatattcatttaagagacggcgcccagcttaaagataccgtgcgcgacatcagccgctatatgggccgcgccatcgtgatgccaaacttagtgccccccgctatcgataccgaaaccgcactgacttattacgaccgcattaaagcgcaggtgccagcgggctcacagttcgaacctttgatggtgctgtatttaaccgacaaaaccagcccagatgaaatccgcaaagccaaagcttcgggtaaaattgtcgccgcgaaactctaccctgcgggcgcgacgaccaactcggattcaggcgtaaccgaattgaagaacatctacccagccctcgaagccatgcaagaagtcggtatgttgtttttagtgcacggtgaagtcacggattcatcgattgatattttcgaccgcgagcgcgtctttatcgaaaatatcctcagcaaaatcgttgccgatttcccagaacttaaaatcgtgcttgaacatatcaccactaaagatgcggtcgattttgtcacccaagcctctgataatgtggccgcgactattacagcccaccatttgctgtataaccgcaaccacatgctggctggcggtattcgcccacatttttactgcctaccgattttaaaacgcaatacccaccagcaggcgttattggccgctgcagcaagcggtagcaagaagttcttcttaggcacagattcggcgccccacgctaaagataagaaagaagccgcctgtggctgcgcgggttcgtacacggcccatgccgcaattgagctgtatgccgaagccttcgaatcggtgaatgcgctagataaactcgaagcatttgcaagcttcaatggcccagatttttacaatctgccacgtaacgccgacacgatcacgctagtgaaaaaaccatggaatgtccctgcaacttacccgctgggcgacactaacgtagtgccgattcgtgcaggcgaagccattgattggcaagttgagtaa

SEQ ID NO: 27791 - protein, 343 aa, Shewanella baltica OS155
MTTITITRPDDWHIHLRDGAQLKDTVRDISRYMGRAIVMPNLVPPAIDTETALTYYDRIKAQVPAGSQFEPLMVLYLTDKTSPDEIRKAKASGKIVAAKLYPAGATTNSDSGVTELKNIYPALEAMQEVGMLFLVHGEVTDSSIDIFDRERVFIENILSKIVADFPELKIVLEHITTKDAVDFVTQASDNVAATITAHHLLYNRNHMLAGGIRPHFYCLPILKRNTHQQALLAAAASGSKKFFLGTDSAPHAKDKKEAACGCAGSYTAHAAIELYAEAFESVNALDKLEAFASFNGPDFYNLPRNADTITLVKKPWNVPATYPLGDTNVVPIRAGEAIDWQVE

SEQ ID NO: 27792 - DNA, 1029 bp, Shewanella amazonensis SB2B
  CDS (1)..(1029): transl_table=11
atgactcatttgaccctcacccgtcccgatgactggcatatccacctgcgcgacggcgactcccttgccgacactgtgcgcgacgccggtcgttacatgggccgtgccatagtaatgcccaatctggtgccgccggtgaccactacagaagccgcgattgcctactacgagcgcatcaaggcccacagcagcactgccttcgagcccttaatggtgctgtatctcaccgacaagaccagcccggatgaaatccgcgccgccaaggcctccggcaaggtggttgccgccaagctttatcctgccggtgccaccaccaactctgattcgggcgtgaccgacgtcaacaacatctatggcgtgctcaaggccatggaagaagaaggtttactgctgctggtacacggtgaggtcactgattctgctatcgatattttcgacagggagcgcatctttatcgaaaacatcctctccaaagtggtcgccgactttcccggcctcaagatagtgctcgagcacatcactaccaaggatgcggtggatttcgtgatgtctgccggtgacaatgtcgccgccaccatcacagcccatcacctgctgtataaccgcaaccatatgctggccggcggtattcgcccgcacttctactgcctgcccatccttaagcgcaatacccaccagcaggcgctgttggcagcggccaccagcggcagcaagaagtttttccttggcaccgactcggctccccacgccaaagacaaaaaagaagccgcctgtggctgcgccggttcttacacagcccacgcggcactggaactgtacgctgaagcctttgaggcggaaggtgccctggacaagctggaagcctttgccagctttaatggcccggacttctacggcctgccccgcaatgccgataccgttgctctggtgaaaagtccctggcaggtgcccgagtcttatcccctgggcagcaccactgtggtgcctatccgtgcaggtgaaatcattggctggaaagtcgaagactga

SEQ ID NO: 27793 - protein, 342 aa, Shewanella amazonensis SB2B
MTHLTLTRPDDWHIHLRDGDSLADTVRDAGRYMGRAIVMPNLVPPVTTTEAAIAYYERIKAHSSTAFEPLMVLYLTDKTSPDEIRAAKASGKVVAAKLYPAGATTNSDSGVTDVNNIYGVLKAMEEEGLLLLVHGEVTDSAIDIFDRERIFIENILSKVVADFPGLKIVLEHITTKDAVDFVMSAGDNVAATITAHHLLYNRNHMLAGGIRPHFYCLPILKRNTHQQALLAAATSGSKKFFLGTDSAPHAKDKKEAACGCAGSYTAHAALELYAEAFEAEGALDKLEAFASFNGPDFYGLPRNADTVALVKSPWQVPESYPLGSTTVVPIRAGEIIGWKVED

SEQ ID NO: 27794 - DNA, 1035 bp, Ralstonia metallidurans CH34
  CDS (1)..(1035): transl_table=11
atgacccagaaactcaccatcacccgcccggacgactggcacctgcacctgcgcgatggcgcggcgctggcggccgtactgcccgacacggcacgccagttcgcacgtgccatcatcatgccgaacctgaagccgcccgtgaccacggtggatcaggccagtgcctaccgcgcgcgcattctggccgcgctgccggccggcatggcgttcgagccgctgatgacgctgtacctgaccgacaacacgccgccggaggaaatcgtcgcggcccgtgccagcggtttcgtccacggcgtcaagctgtatccggccggcgccaccaccaacagcgatgccggcgtgaccgatatccgccgctgcgccgccacgcttgaggcgatgcagcgtgaaggtgtgccgctgctggtccacggcgaggtcactgatggcgacatcgacatcttcgatcgcgaggccgtgttcatcgaccgcgtgatgaagccgctgcgccgcgacttcccggagctcaaggtggtgttcgaacacatcaccacccgcgatgcggcccagtacgtggccgaggccgaaggcccggtcggcgcgacgattaccgcgcaccacctgctgtacaaccgtaatgcgatcttcacgggcgggattcgtccgcactactactgcctgccggtgctcaagcgcgagatccaccgcgaggcgctggtcaaggccgcgacgtcgggcagcccgcgtttcttccttggcactgacagcgcaccccacgcacgcggcctcaaggagcacgcatgcggctgcgccggctgctacacggcgctccatgcgatggagctctatgccgaagcgttcgacgctgccggcgcgctggacaagctcgaggcattctccagcttcaacggcccggccttctacggcctgccgcgcaatagcggcacgctgacgctgacgcgcgaagactgggaactgccggccgagctgccgtacggtgataccacgctggtgccgctgcgcgccggcgaaacgctgcgctggaaggcgagctga

SEQ ID NO: 27795 - protein, 344 aa, Ralstonia metallidurans CH34
MTQKLTITRPDDWHLHLRDGAALAAVLPDTARQFARAIIMPNLKPPVTTVDQASAYRARILAALPAGMAFEPLMTLYLTDNTPPEEIVAARASGFVHGVKLYPAGATTNSDAGVTDIRRCAATLEAMQREGVPLLVHGEVTDGDIDIFDREAVFIDRVMKPLRRDFPELKVVFEHITTRDAAQYVAEAEGPVGATITAHHLLYNRNAIFTGGIRPHYYCLPVLKREIHREALVKAATSGSPRFFLGTDSAPHARGLKEHACGCAGCYTALHAMELYAEAFDAAGALDKLEAFSSFNGPAFYGLPRNSGTLTLTREDWELPAELPYGDTTLVPLRAGETLRWKAS

SEQ ID NO: 27796 - DNA, 1041 bp, Mesorhizobium sp. BNC1
  CDS (1)..(1041): transl_table=11
atgaaaacacttaccatcagacagccggacgactggcacctacacctgcgcgatggctccgtgcttcaggcggtggcggagcactcggcggctcactttgcccgcgccatcatcatgccgaatctggtgccgcccgtcgtgaccacaagggatgcggcggcctatcgcgagcgcatcctggcggcgctgtctgaaggcagcgcctttacgcctctgatgacgctctatctcacggaatcgagctgcgctgacgatatcgaggcagggttccgcagcggcctgatcaaggcggtcaagctctatccggcgggagccaccaccaactcccaaagcggcgtgcgcaacatcgaggccgtctacccggtgctggagcgcatggcgaaaatcggcctgccgctctgcgtgcatggcgaagtcaccgatcccgcggtcgatatcttcgaccgagaggcggtgttcatcgagcgggtgctgcagcccttgcgccgccgcctgccggaactgcgcatcgtcatggagcatgtgacgacgaaggacggcgtcgattttgcgctgtcgcaggatgagaatgtcggcgcgacgatcacgacgcatcacctgatcatcaaccgcaatgcaatcctcgccggcggcattcgcccgcattattactgcctgcccgtcgccaagcgggagtcccatcgcctcgcgctgcgcgcggccgccatctccggcgaaggccgcttcttcctcggcacggattctgcgccgcatctggatccgctcaaggaatgcgcctgcgggtgcgcaggcgtcttcaatgcaccgaacaccatggcctgtctggcgcatgtgttcgaggaggagggcgcgctcgaccggctggaggctttcacctccttaaacggtcccgccttctaccgcctgccgccgaacgagaagcgcatcacgctcaggcgttacgacgagccgctggaaatggaacggaaagtcagcgtgggggacgaggctatcaccgtcttcgacccgatgttcccgatccactggaaagttgaggattag

SEQ ID NO: 27797 - protein, 346 aa, Mesorhizobium sp. BNC1
MKTLTIRQPDDWHLHLRDGSVLQAVAEHSAAHFARAIIMPNLVPPVVTTRDAAAYRERILAALSEGSAFTPLMTLYLTESSCADDIEAGFRSGLIKAVKLYPAGATTNSQSGVRNIEAVYPVLERMAKIGLPLCVHGEVTDPAVDIFDREAVFIERVLQPLRRRLPELRIVMEHVTTKDGVDFALSQDENVGATITTHHLIINRNAILAGGIRPHYYCLPVAKRESHRLALRAAAISGEGRFFLGTDSAPHLDPLKECACGCAGVFNAPNTMACLAHVFEEEGALDRLEAFTSLNGPAFYRLPPNEKRITLRRYDEPLEMERKVSVGDEAITVFDPMFPIHWKVED

SEQ ID NO: 27798 - DNA, 1041 bp, Silicibacter sp. TM1040
  CDS (1)..(1041): transl_table=11
atgacccagagcctgacgatcacccgccccgacgactggcatctgcatctgcgcgacggcgacatgctgcgcgcggtgctgccggaaacagcccgccattttggccgcgccatcatcatgcccaatctcgtgcccccggttgtcaccggcgccgaggccagcgcctatcgcgaccgcattcttgccgcactccctgagggcatgacgttcgagcccctgatgacgctctatctcaccgaggacacggaccctgcagatgtcgcagccgcccatgcctcgggtctggtcaaagccgtcaagctctaccccgctggcgccaccaccaactcctcgtccggtgtgcgcgatttcgacaaggtccgccccgtgcttgagaaaatggccgaaatcggcctgccgctctgcacccatggcgaggtcaccgaccacgacatcgacatctttgaccgcgaggccgtctttatcgatcgcgtgctggacccgatccgccaatccacaccgggcctgcgtgtggtgatggagcatatcaccaccaaggacgcggcggattatgtgcgatcgcaggacaaggatcttggcgcgacaatcaccacgcaccacctgatcatcaatcgcaaccacatcctcgtgggcgggatcaagccacactattactgcctgcctgtcgccaagcgcgaagagcaccgcctcgccctgcgccaagctgcgacctccggtgatgcgcggttcttccttggtaccgactcagcgccccacaccgatgccaacaagctccagacctgtggctgcgcgggttgtttcacggcgaccaacaccatggctctgctggcccatgtatttgaggaagaaggcgcgctcgacaagctcgaagggtttgcctccaagaacggccccgccttttatcgcttacccgaaaacgatggtcagatcacactggtgaaacaggacgcgcccgtcgctttcccggaacagatcgacacgccggacggccccgtgaccgtctttgatccaagctttgcggtgcattggaccgtcacctga

SEQ ID NO: 27799 - protein, 346 aa, Silicibacter sp. TM1040
MTQSLTITRPDDWHLHLRDGDMLRAVLPETARHFGRAIIMPNLVPPVVTGAEASAYRDRILAALPEGMTFEPLMTLYLTEDTDPADVAAAHASGLVKAVKLYPAGATTNSSSGVRDFDKVRPVLEKMAEIGLPLCTHGEVTDHDIDIFDREAVFIDRVLDPIRQSTPGLRVVMEHITTKDAADYVRSQDKDLGATITTHHLIINRNHILVGGIKPHYYCLPVAKREEHRLALRQAATSGDARFFLGTDSAPHTDANKLQTCGCAGCFTATNTMALLAHVFEEEGALDKLEGFASKNGPAFYRLPENDGQITLVKQDAPVAFPEQIDTPDGPVTVFDPSFAVHWTVT

SEQ ID NO: 27800 - DNA, 1044 bp, Paracoccus denitrificans PD1222
  CDS (1)..(1044): transl_table=11
atgaccaaatccgtgacgctccgacgccccgacgactggcacctgcacctgcgcgatggcgccatgctgcaggcagtggcttcattttccggccattttggccgggcgatcatcatgccgaacctggtgccgcccgtggtgacgggggcgcaggcggccgcctatcgcgaccggatccgggccgcgctgggtccgaaagtgacgttgcgtccattgatgacgctctacctgaccgaaaccaccgatccggccgatgtggtggccgcccatgccgggggaatcatctcggccgtcaagctttatccggccggggcgaccaccaattcggcctcgggcgtgcgcgacttcgacaaggtgcgaggcgtgctggaagccatggccgaagccggcatcccgctgctcttccatggcgaggtcaccgatccggcggtggacatcttcgaccgcgaggcggcgttcatcgaccgcgtgctggacccgatccgccgcgccacgcccggcctgcgcgtggtgatggaacatatcaccacgtcggacggcgtggattatgtcgccgccaacgacgatatcggcgcgaccatcaccacccaccacctggtcatcaaccgcaaccacatcctggcgggcggcatccggccgcattactactgcctgccggtcgccaagcgcgaaacccaccggctggcgctgcgcaaagcggcggtctcgggcgatgggcgcttcttcctcggcaccgactcggcgccgcatcccgaccgcgccaaggaagcggcctgcggctgcgccggctgcttcaccgcgccgaacaccatgtccatcctggcgcaggtcttcgaggaggaaggcgcgctcgaccggctcgaaggcttcgcctcgctcaacggcgccgccttctacggcatggagccgaaccaggaccgcatccggctggtccggcgcgacacgcccgccgaatatccgacccatatcgccgccggcgacgaaaccgtcaccgtcttcgaccccggcttcccgctctactggcacgttgaggaccccgcatga

SEQ ID NO: 27801 - protein, 347 aa, Paracoccus denitrificans PD1222
MTKSVTLRRPDDWHLHLRDGAMLQAVASFSGHFGRAIIMPNLVPPVVTGAQAAAYRDRIRAALGPKVTLRPLMTLYLTETTDPADVVAAHAGGIISAVKLYPAGATTNSASGVRDFDKVRGVLEAMAEAGIPLLFHGEVTDPAVDIFDREAAFIDRVLDPIRRATPGLRVVMEHITTSDGVDYVAANDDIGATITTHHLVINRNHILAGGIRPHYYCLPVAKRETHRLALRKAAVSGDGRFFLGTDSAPHPDRAKEAACGCAGCFTAPNTMSILAQVFEEEGALDRLEGFASLNGAAFYGMEPNQDRIRLVRRDTPAEYPTHIAAGDETVTVFDPGFPLYWHVEDPA

SEQ ID NO: 27802 - DNA, 1035 bp, Shewanella denitrificans OS-217
  CDS (1)..(1035): transl_table=11
atgatgagtttaaccataactaggccagatgattggcatgtccacctcagggatggcattcagcttaacgatacggtgcgagacattagccgttatatgggccgcgctatcattatgcctaaccttatgccccccgcgacgtgtaccgataccgcgctggcttatcgcgagcgtattgttgccgctaaaacgccggataatcagtttgaacctttaatggtgctttatttaacggataacactagcccagatgaaattcgtaaagctaaggctactgggcttattcatgcggctaagttgtatcctgcgggggcgaccaccaattcagattctggggtgaccagcatcagcaacttatacccagtgcttgaagccatggctgaagtgggtatgttgttgctagttcatggcgaagtaacggattcaagtatcgatattttcgatcgtgagaaagtgtttttagagaccattctggcccaagtggtgacagatttccctaagcttaaaatagtgcttgagcacattactacctcagatgctgtggagttcgtcaataaagcaccggacaatgtggcagcgaccatcaccgctcatcatttactctataaccgtaaccatatgctagcgggtggtattaggcctcatttctattgtttgcccattcttaagcgcaatacccatcagcaggcgttaattgccgcagccaccagtggcagcaaaaaattcttccttggcacggattctgctccccaccttaaagacaaaaaagaagcctcctgtggttgtgcaggctcttacacggcccacgcagccattgagctatatgccgaagcgtttgaagccgcgggcgccttagataaactcgaagcctttgccagtttttatggtgccgatttttatggtttaccccgtaatacagacaccattaccctagaaaaaaccccatggcaagtgccagactcttaccccttagccaacgacagggtggtgcctattcgcgccggtgaaatgctggattggcaagtcataagctga

SEQ ID NO: 27803 - protein, 344 aa, Shewanella denitrificans OS-217
MMSLTITRPDDWHVHLRDGIQLNDTVRDISRYMGRAIIMPNLMPPATCTDTALAYRERIVAAKTPDNQFEPLMVLYLTDNTSPDEIRKAKATGLIHAAKLYPAGATTNSDSGVTSISNLYPVLEAMAEVGMLLLVHGEVTDSSIDIFDREKVFLETILAQVVTDFPKLKIVLEHITTSDAVEFVNKAPDNVAATITAHHLLYNRNHMLAGGIRPHFYCLPILKRNTHQQALIAAATSGSKKFFLGTDSAPHLKDKKEASCGCAGSYTAHAAIELYAEAFEAAGALDKLEAFASFYGADFYGLPRNTDTITLEKTPWQVPDSYPLANDRVVPIRAGEMLDWQVIS

SEQ ID NO: 27804 - DNA, 1038 bp, Shewanella frigidimarina NCIMB 400
  CDS (1)..(1038): transl_table=11
atgacgcaaattaccttaaccactcccgatgattggcatcttcattttcgagatggggatatgctaggtgaaacggttcctgcaacggctcgattgtttcaacgcgcgattgtcatgcctaatttagttccaccagtaacgacagcggcaatggctttagcttatcgagatcgtattttggctgctcgcccacaaggtagcaattttgaaccattaatgaccttgtttttaacaaacaacaccagcgcccaagatattatcgatgctaaagcggcaggggttgtggcaggaaagttatacccagcaggtgcgaccacaaattcagatgcagcagttaaagctttggatgagttgtttcctatatttgaggttatggcacaacaaggcatgttgctattagtgcatggcgaagtgacagaatcgcatattgatatttttgatcgcgaaaaaatgtttatcgatcgctatttatcgcgcattgtcgaagccattcctagccttaaagtggtgtttgaacatatcaccactaaagaagcggctgagtttgtggcagaggcttcagctaatgttgctgcaactattaccccacagcatttattgttaaatcgtaatgatttactcgtcggtggtgttcgtccacataacttttgcttacccgtattaaaacgcaatattcaccagcatgcattacaagctgctgtggcgacaggctcaagtaaattctttttaggtactgattctgccccgcatgaaaaacaccgcaaagagtcagcctgtggctgcgcaggttgttacagtgcctggagtgcattagaactctatgcgcaagtttttgataacttaggggcattagataagttagaaggctttgccagcttacatggcgcagacttttatggcttaccacgcaacagcggcactgtgacgctagtgaaacaagaatggacggtaccagaagagattattctgccaaacggcaatcctatcgtgccattttttgcaggacaaaaagtgaattggaaagtgaaaacggcttaa

SEQ ID NO: 27805 - protein, 345 aa, Shewanella frigidimarina NCIMB 400
MTQITLTTPDDWHLHFRDGDMLGETVPATARLFQRAIVMPNLVPPVTTAAMALAYRDRILAARPQGSNFEPLMTLFLTNNTSAQDIIDAKAAGVVAGKLYPAGATTNSDAAVKALDELFPIFEVMAQQGMLLLVHGEVTESHIDIFDREKMFIDRYLSRIVEAIPSLKVVFEHITTKEAAEFVAEASANVAATITPQHLLLNRNDLLVGGVRPHNFCLPVLKRNIHQHALQAAVATGSSKFFLGTDSAPHEKHRKESACGCAGCYSAWSALELYAQVFDNLGALDKLEGFASLHGADFYGLPRNSGTVTLVKQEWTVPEEIILPNGNPIVPFFAGQKVNWKVKTA

SEQ ID NO: 27806 - DNA, 1047 bp, Pseudomonas fluorescens
  CDS (1)..(1047): transl_table=11
atgtccgaccgcctgaccctgctgcgtcccgacgactggcatattcatcttcgcgatggggccgtgttgcccaatacagtcgcagatgtcgcgcgcacctttggccgcgccatcatcatgcccaacctggtacctccggtgcgcaacgccgcggaagccgacgcctatcgccagcgcattctagctgcgcgcccggccggcagccgcttcgagccactgatggtgctctacctgaccgaccgtacccagccggaggaaatccgcgcggccaaggcctgcggtttcgtccacgccgccaagctgtacccggccggcgcgaccaccaactcggattcgggcgtgaccagcatcgacaagattttcccggtgcttgaagccatggccgaagtcggcctgccgctgttgatccacggcgaggtaacccgcggcgacgtcgatgtcttcgaccgcgagaaaatcttcatcgacgagcacatgcggcgtgtggttgaacgcttccccagcctgaaagtggtgttcgaacacatcaccaccgctgaagccgtgcagttcgtcaaggaggcttcggctaacgtcggcgccaccatcactgcgcatcacctgctgtacaaccgcaaccacatgctggtgggcggtattcgtccgcacttctattgcctgccgatcctcaagcgcaacacccaccaggaagccctgctggatgcggccaccagcggcaacgcgaagttcttcctcggcaccgactcggcacctcacgcccagcacgccaaggaagccgcttgcggttgcgccggctgctacagcgcctacgccgccatcgagctgtacgccgaagcgttcgaacaacgcaatgccctggatcagctggaagctttcgccagcctcaacggcccgcgcttctacggcctgccggccaacaccgacagcatcaccctggtccgtgaagaatggaccgctcctgccagcctgccgtttggcgagctgactgtcattccgctgcgcgccggtgaaaaactgcgctggcgcctgctggaggatcactcgtga

SEQ ID NO: 27807 - protein, 348 aa, Pseudomonas fluorescens
MSDRLTLLRPDDWHIHLRDGAVLPNTVADVARTFGRAIIMPNLVPPVRNAAEADAYRQRILAARPAGSRFEPLMVLYLTDRTQPEEIRAAKACGFVHAAKLYPAGATTNSDSGVTSIDKIFPVLEAMAEVGLPLLIHGEVTRGDVDVFDREKIFIDEHMRRVVERFPSLKVVFEHITTAEAVQFVKEASANVGATITAHHLLYNRNHMLVGGIRPHFYCLPILKRNTHQEALLDAATSGNAKFFLGTDSAPHAQHAKEAACGCAGCYSAYAAIELYAEAFEQRNALDQLEAFASLNGPRFYGLPANTDSITLVREEWTAPASLPFGELTVIPLRAGEKLRWRLLEDHS

SEQ ID NO: 27808 - DNA, 888 bp, Theileria parva
  CDS (1)..(888)
atgcagtttttgtacgcggatgacttacactgtcatctcagacagggtgaacttatggagaaggtcgtcaaatacgttcgaaaaggtggatggttcgtacttaacacatataatagagtgcttgttatgccgaatactgtgcctgagattacaagctgttctcaggctcttgagtataggaaaaagttactggaacttgacccgaatgtagagtacctcatgactctttatctcacagacgatttatcttccgaagatttaaggaataacgctaaaaaatgtcatgtgcagggggtcaaatgttacccttctggagtcacaactaattctgatagaggttttaatagttttgagaagtattacccgctattttctgagatggagaaaattggtgtttcacttcacttacacggagaattacctggagctcctccgctgactgctgaaaaggagtttttaccaatcgttgaaaacgtttgtaggaaattctcctctttaaaggttgttttggaacatgtaacttcgaaagattctctacaagttgttaaaaggattcaaaatctagcagccacaattacgcctcaccacatgagactaacagttttggacgttctaaacactgctgaaaatgtaacattacaaaacgtgaccaaacatttgagggacccttatgcatactgtaaacccttagctaagtttgaggaggatcgtcacgctattttggaaaccctaaaatcaggacatccaagattctttctaggatcagattcagcacctcatacacagtataacactattcatactattatcttgacagtaagagatcagttaaccctccagctggaatttacactcaaccatttctgctgcaggaccagagtactttga

SEQ ID NO: 27809 - protein, 295 aa, Theileria parva
MQFLYADDLHCHLRQGELMEKVVKYVRKGGWFVLNTYNRVLVMPNTVPEITSCSQALEYRKKLLELDPNVEYLMTLYLTDDLSSEDLRNNAKKCHVQGVKCYPSGVTTNSDRGFNSFEKYYPLFSEMEKIGVSLHLHGELPGAPPLTAEKEFLPIVENVCRKFSSLKVVLEHVTSKDSLQVVKRIQNLAATITPHHMRLTVLDVLNTAENVTLQNVTKHLRDPYAYCKPLAKFEEDRHAILETLKSGHPRFFLGSDSAPHTQYNTIHTIILTVRDQLTLQLEFTLNHFCCRTRVL

SEQ ID NO: 27810 - DNA, 1053 bp, Theileria annulata
  CDS (1)..(1053)
atgcagtttttgtacgcagatgacttacactgtcatctcagacagggagaactcatgaagaaggtcgtaaaatacattcgaaaaggaggatgtaatagagtgctcgtaatgcctaatactgtccctgagataacaagctgttctcaggctctcgaatacagaaaaaggctcctggaactcgatcccaacgtcgattacctcatgactctttatctgacagatgagctgtctgtcgaagatttaaagaataacgccaaaaaatgccacgtccagggggtcaaatgttatcccttaggtgtgacaactaattctgatagaagttttgaggttacgaatagaaataagagttttgagaagtactatccggtattttctgagatggagaaaattggagtttcactccacttacacggagagttatcaggcgctcctcctctgaccgctgaaaaggactttttaaccccaatagaaaacatttgtaggaggttcccctcgttgaaggtcgttttggagcacgtaacgtctcgagagtctctggaagtagttaaaaggctccaaaatctctcagccacagttactcctcaccacatgagactcacagtctcagacgttctcaacaccactgaaaatgtaactctggaaaatataactagacaccttaaggacccattcgcatactgcaaacccgtggctaaatttgaggaggaccgacaggcaattttggaaaccctaaagtcaggacacccgagactcttcttgggatcagattcagcacctcacacatgtgatagcaaaaggtcagataaccctccagctggcatttatactcagccgtttctgttacagtacctttctgacacgtttgaggattttggattttttgataaactggagaacttttgctgcaaaaacggccaggagtttttgcaattaccgcccaaagaacctgaatactttgaacttgtaaaacagccctttaaagttcccgaagaagtcgaaggaatcgtgccattcagagcaggccaatttctcaattattcaattttattctaa

SEQ ID NO: 27811 - protein, 350 aa, Theileria annulata
MQFLYADDLHCHLRQGELMKKVVKYIRKGGCNRVLVMPNTVPEITSCSQALEYRKRLLELDPNVDYLMTLYLTDELSVEDLKNNAKKCHVQGVKCYPLGVTTNSDRSFEVTNRNKSFEKYYPVFSEMEKIGVSLHLHGELSGAPPLTAEKDFLTPIENICRRFPSLKVVLEHVTSRESLEVVKRLQNLSATVTPHHMRLTVSDVLNTTENVTLENITRHLKDPFAYCKPVAKFEEDRQAILETLKSGHPRLFLGSDSAPHTCDSKRSDNPPAGIYTQPFLLQYLSDTFEDFGFFDKLENFCCKNGQEFLQLPPKEPEYFELVKQPFKVPEEVEGIVPFRAGQFLNYSILF

SEQ ID NO: 27812 - DNA, 1005 bp, Aspergillus fumigatus Af293
  CDS (1)..(1005)
atgatcctgaaagagacaacccggctggagctgccggcggcggccgacatgcacgtccaccttcgtcaaggcaagatgatggaattggttgtgccgcagattcgcaacggaggcgtcgataccgtttttgtcatgcctgctgacttggtcccttaccaatccgtgacccccgagactatcagggaagcagctgcagctggtatcaccggtgtcaaggtgtatccccagggcgtgacgaccaactccgcggccggcgtccgcgactatgacgaattcttccccgtcttcgcggagatggaaaagcacgacatggtgctcaacctccacggcgaggtccccggctcgcccggctcgggcatcaccgacatgaacgccgaggaaaagttccttcccacgctcacgatgctcaatgagaagttccccaagctgcggattatcctcgagcattgcagcaccgaggcggcgctggaggctgtccgctcctgctcctcgacggttgccgcgaccatcaccgcgcaccacctctaccttacccaccacagctgcgagaacccgctcgccttctgcaagcctctccccaagacatccaaggaccgcgatgcgcttctccgcgcggtctgcagcggcgatcccaaattcttctttggaagcgacagcgccccccacccgcgtctcgcaaagcaaggcggcgcagagggcacagccaaaccgccggcgggtgtgtttacgcagccctgtgtcgtgcagtatgtgcttctggcgctcgaggagggcgtggaacgcggcgtcatcgccaacgaggatattaccccggagaagctggcgaattttctcagtgggtatggacgtcggttctacaagttgccggaggcgacggagaggattgtgctggagcggaagggggaggttatcccggagagtgtgaagagtgaggatgggagtgtggaggtggccttgtctcggggcggagagaaggtgtttagcttgacgtggaagacctcgtag

SEQ ID NO: 27813 - protein, 334 aa, Aspergillus fumigatus Af293
MILKETTRLELPAAADMHVHLRQGKMMELVVPQIRNGGVDTVFVMPADLVPYQSVTPETIREAAAAGITGVKVYPQGVTTNSAAGVRDYDEFFPVFAEMEKHDMVLNLHGEVPGSPGSGITDMNAEEKFLPTLTMLNEKFPKLRIILEHCSTEAALEAVRSCSSTVAATITAHHLYLTHHSCENPLAFCKPLPKTSKDRDALLRAVCSGDPKFFFGSDSAPHPRLAKQGGAEGTAKPPAGVFTQPCVVQYVLLALEEGVERGVIANEDITPEKLANFLSGYGRRFYKLPEATERIVLERKGEVIPESVKSEDGSVEVALSRGGEKVFSLTWKTS

SEQ ID NO: 27814 - DNA, 1086 bp, Plasmodium chabaudi
  CDS (1)..(1086)
atggaaaacggatttcgtattccgttagcagatgatatgcattgccatttaaggcaagatgaaatgttaaagtttactgtccccgcaataaaaaaaggaggatgcaatcgagttttagtcatgcctaatactacaccaattgtaagcagttgtgaggaagccaagagatatagagaggaattaataaaatatgatgatagtgtagaatatttgatgactctatatttaaataaaaaaactgatgaaaacgatatattaaataattataaagaatgcaatttacaaggaataaaaatatatcctagtaatgtaacaacaaattctaatgatggtgtatcaagtttagaaccatattataaaatattttctacattagaaaaaataaataaaagcttacacatacattgtgaagaaccaaatataaatccagtatatgcagaaaaggaatatttacaacatatacatgatatagctattaaattcccacacctaaaaatagttttagaacatatatcaactgaaaacatgatagaaattattaaaaaatatccaaatgtagcaggatctattactcctcatcatttgcatctaactattgatgatgttgttgatataaaaaattatgattattcattcaataatactgacattgaaaaatatgtcaaaaatgtatataattattgtaagcctttacctaaaacattagatgataaaatagcattatgtaatattataaaagaggggaaccctaaagtatttttaggttcagactcggctccacattatcaaaaatttaaacaagaacctcattataaacctggtatttttacccagccttttcttttatcatatcttgctcatgtatttaataaatttgattcattagacaagattgaaaattttgcttgtaaaaatgctgcaaattttttaaacttaaaacctaaatgtgttgaaaataatcaaaatggtacgatatatatacaaaaaaaaaattttacaataccaagtgactattttggcgttattccatttttagctagccagacaattgattttactgcatcctataaatgtgatgtcgtttag

SEQ ID NO: 27815 - protein, 361 aa, Plasmodium chabaudi
MENGFRIPLADDMHCHLRQDEMLKFTVPAIKKGGCNRVLVMPNTTPIVSSCEEAKRYREELIKYDDSVEYLMTLYLNKKTDENDILNNYKECNLQGIKIYPSNVTTNSNDGVSSLEPYYKIFSTLEKINKSLHIHCEEPNINPVYAEKEYLQHIHDIAIKFPHLKIVLEHISTENMIEIIKKYPNVAGSITPHHLHLTIDDVVDIKNYDYSFNNTDIEKYVKNVYNYCKPLPKTLDDKIALCNIIKEGNPKVFLGSDSAPHYQKFKQEPHYKPGIFTQPFLLSYLAHVFNKFDSLDKIENFACKNAANFLNLKPKCVENNQNGTIYIQKKNFTIPSDYFGVIPFLASQTIDFTASYKCDVV

SEQ ID NO: 27816 - DNA, 1086 bp, Plasmodium yoelii yoelii
  CDS (1)..(1086)
atggaaaacgggtttagcattccgttagcagatgatatgcattgtcatttaaggcaagatgagatgttaaaatttacagtccctgcaataaaaaaaggaggatgtaatcgagttttagtaatgcctaacactacaccaattataagtagttgcgaagaagccaagaaatatagagatgaattaataaaatatgataacagtatagaatatttgatgactctatatttaaataaaaaaactgatgaaaatgatatattaaataattataaagaatgtaatttacaaggaataaaaatatacccaagtaatgtaacaacgaattctaacgatggtgtgtcaaatttagaaccatattataaaatattttctacattagaaaaaataaataaaagtttacatatacattgtgaagaacctaatataaatccagtatatgcagaaaaagaatatttacaacatatacatgatatatctattaaatttccacatttaaaaatagttttagaacatatatcaactgaaaatatgatagaaatggttaaaaaatatccaaatgtagcaggatctattacacctcatcatttacatctaactattgatgatgttgtagatataaaaaattatgattattcatttaacaatacagatattgaaaaatatgtaaaaaatgtatataattattgtaagcctttacctaaaacattagatgataaaatagcattatgcaatattataaaagagggaaaccctaaagtatttttaggttctgactcggctccacattatcaaaaatttaaacaagaacctcattataagcctggtatttttacacaaccttttcttttatcatatcttgctcatatatttaataaatttaattccttagacaaaattgaaaattttgcttgtaaaaatgctgcacaatttttaaatttggaacctaaatctatcgaaaataatcaaaatagtattatatacatacaaaaaaaaaatcttacaataccaaatgactattttggagttgttccatttttagctaatcaaacaattgattttactgcatcctataaatatgatgtcgtttaa

SEQ ID NO: 27817 - protein, 361 aa, Plasmodium yoelii yoelii
MENGFSIPLADDMHCHLRQDEMLKFTVPAIKKGGCNRVLVMPNTTPIISSCEEAKKYRDELIKYDNSIEYLMTLYLNKKTDENDILNNYKECNLQGIKIYPSNVTTNSNDGVSNLEPYYKIFSTLEKINKSLHIHCEEPNINPVYAEKEYLQHIHDISIKFPHLKIVLEHISTENMIEMVKKYPNVAGSITPHHLHLTIDDVVDIKNYDYSFNNTDIEKYVKNVYNYCKPLPKTLDDKIALCNIIKEGNPKVFLGSDSAPHYQKFKQEPHYKPGIFTQPFLLSYLAHIFNKFNSLDKIENFACKNAAQFLNLEPKSIENNQNSIIYIQKKNLTIPNDYFGVVPFLANQTIDFTASYKYDVV

SEQ ID NO: 27818 - DNA, 1212 bp, Toxoplasma gondii
  CDS (1)..(1212)
atggcaatgactggtgaagaaaagggggggaatggggcaagcaactcttgctgcggccaggcaagagcaaaacctctggtcatgccgcttataagcgacatgcatacgcacctcagacaagatgaaatggcagagttcgtcaccccaatgatcaaaaagggagggtgccggtgtgtcctggtcatgcccaacaccattcctcccgtcaccacatgtgctcaagccgctgcatacagagagcgcctcgtcaggatagaccccaacgtggactatatgatgacgctgtttctctctccggaagtgtcggccgatgacttgcggcagaatgccaagatgtgccatgtcaccggaatcaagagctacccgaaaggagtgacgacaaactctgaccagggcgtcgagagctacgaacagtattacggaatcttcgaggcaatgcaggagcttggactaacgcttcatttgcacggggaagtgcctggagttgctcctctggatgcagaggaggctttcattccctttttcgagcagatccattcaagatttcctagtctaaaaatcgtccttgagcatgtctccaccgctgcggcgatccaagcggtcaagcgcatgcctgcgaacgtggcggcaaccatcacgccccaccacctaatgctgacggttgatgacgtcgtgaagccggacgcgatcaaaagggcaatggagactgcagcacacagaggactctgctgtgcagaggcagtcgagaagccccacaacttctgcaagccgttggcgaagaccaagagagaccgtgacgcactccgacaggtcatccaggatggtgacacgcactttttcctcggctccgattcagcgccgcatcccagacttgccaaggaatcgtccccgccagctgcaggggtatttacgcagccgcttcttctagcttacctggttagcatattcgcggaacttggttgcatctccaaacttcgggaattcgcagatggccatgctgcagcgtttttcggctttgaggctgcaaccctggaagagaaccttgagtgtgccgttatccagcctacgcctcagcgggttccttccattttcaagttccctggccaagaaaacgaaggcgtcgtgccgtttatggcatcgcttgagctgccttacacagtggaagtacggcgcttcagcccttctctactgaaggaatgcgacgaaatttaa

SEQ ID NO: 27819 - protein, 403 aa, Toxoplasma gondii
MAMTGEEKGGNGASNSCCGQARAKPLVMPLISDMHTHLRQDEMAEFVTPMIKKGGCRCVLVMPNTIPPVTTCAQAAAYRERLVRIDPNVDYMMTLFLSPEVSADDLRQNAKMCHVTGIKSYPKGVTTNSDQGVESYEQYYGIFEAMQELGLTLHLHGEVPGVAPLDAEEAFIPFFEQIHSRFPSLKIVLEHVSTAAAIQAVKRMPANVAATITPHHLMLTVDDVVKPDAIKRAMETAAHRGLCCAEAVEKPHNFCKPLAKTKRDRDALRQVIQDGDTHFFLGSDSAPHPRLAKESSPPAAGVFTQPLLLAYLVSIFAELGCISKLREFADGHAAAFFGFEAATLEENLECAVIQPTPQRVPSIFKFPGQENEGVVPFMASLELPYTVEVRRFSPSLLKECDEI

SEQ ID NO: 27820 - DNA, 1038 bp, Beta vulgaris
  CDS (1)..(1038)
atggaactgactcttacacgccctgatgactggcatctacatctccgcgatggagatcttcttgctgctgttgctcctcacagtgcaagacattttggaagggcaatcgttatgccgaatctaaggcctcctgttactactacaggtgctgctattgcttaccgaaagtctattatggaagtattgcctgatgatagcgacttcaatcctctcatgacactttatttgactgatacgaccagccctaatgagatcaagcttgccagaaaaagtgaggtggtatatgctgtcaaattataccctgctggcgcaacaactaattctcaggacggtgtcactgatcttttaggaaagtgtctgcctgtgcttgaagagatggctgagcaagatatgcctcttctggtccatggagaagttacagatcctgatgtagatatatttgatcgtgaaaaggtttttattgagtcagttttaagacctttaattcagaaattaccacagctaaaggttgtgatggaacacatcactactgctgatgctgtcaagtttattgagtcctgtaatggaggaaatgtagcagccactgtgacgccgcagcaccttgttctgaatagaaactctctcttccaaggagggttgcaaccgcataactattgtcttccagtgctcaaaagagaaatccatagacaggcacttgtttcagcggtaaccagcgggagcaagcaatattttcttgggactgatagtgctcctcatgaaaggcggaggaaagaatgttcgtgtggatgtgctggaatctataattcccctgttgctctatcactatatgccaaagtatttgaagaggctggtgcccttgacaagttagaggcatttacaagctttaatggacccgatttctatggtcttccaaggaatacgtcgaagatcaagttgaaaaaagaaccatggaaagtcctagagcgtatacctttcccatccggagaaataatccctatgtttgctggacaaatgcttgactggaagccatctttctga

SEQ ID NO: 27821 - protein, 345 aa, Beta vulgaris
MELTLTRPDDWHLHLRDGDLLAAVAPHSARHFGRAIVMPNLRPPVTTTGAAIAYRKSIMEVLPDDSDFNPLMTLYLTDTTSPNEIKLARKSEVVYAVKLYPAGATTNSQDGVTDLLGKCLPVLEEMAEQDMPLLVHGEVTDPDVDIFDREKVFIESVLRPLIQKLPQLKVVMEHITTADAVKFIESCNGGNVAATVTPQHLVLNRNSLFQGGLQPHNYCLPVLKREIHRQALVSAVTSGSKQYFLGTDSAPHERRRKECSCGCAGIYNSPVALSLYAKVFEEAGALDKLEAFTSFNGPDFYGLPRNTSKIKLKKEPWKVLERIPFPSGEIIPMFAGQMLDWKPSF

SEQ ID NO: 27822 - DNA, 1038 bp, Agrobacterium tumefaciens
  CDS (1)..(1038)
atgaagtcgctcaccctgcgccgccctgatgactggcacctgcatcttcgtgatggcgccatgctggaaggggtgatcggggatacgagccgccatttcgcccgcgccatcatcatgccgaatctggtgccgcccgtcgtcaccacggccgatgccagcgcctatcgagaacgcatcctcaaggcgatcccggagggtgaccgcttcgagccgctgatgaccctctacctcactgaggatactgttgctgatgacgtggaagagggcaaaaaaagcggcctcatcaccgccgtaaagctctatcctgcgggtgcgaccaccaattctcatggcggcgtgcgcgatttcaacaaggcgatgccggtgctggaacgcatggcaaagatcggcctgccgctctgcgtgcatggcgaggtgacgacgccagacgtcgatattttcgaccgcgagaaggccttcatcgatacggttctggagcccctgcgccagcgcctgccagagttgaaggtgacgatggaacacatcaccacccgcgatggcgtggactacatcaagtcttccaatgccaatctggccggctccatcaccacgcaccacctcatcatcaaccgcaacgccattctggtcggcggtatcaagccgcattattattgcctgcccgtcgccaagcgcgaggagcatcgtctggcgctgcgggctgctgcgacgtcgggtgatgcccgcttcttcctcggcacggattccgccccacatgtggacccgctgaaagaatgcgcctgcggctgtgctggcatctatacttccatcaacaccatgagctgccttgcccatgtcttcgaggatgagaatgccctcgataagctggaggccttcgcctcgctcaacggcccggcctggtatggtcttgcgccgaacgacgagacgatcacgctggtcaagcgcgaggaagcggtggcgtttcccgaaaagatcgaaacgggcgccgggccggtgaccgtattcgatccgatgttcccgcttcattgggatgtaaactga

SEQ ID NO: 27823 - protein, 345 aa, Agrobacterium tumefaciens
MKSLTLRRPDDWHLHLRDGAMLEGVIGDTSRHFARAIIMPNLVPPVVTTADASAYRERILKAIPEGDRFEPLMTLYLTEDTVADDVEEGKKSGLITAVKLYPAGATTNSHGGVRDFNKAMPVLERMAKIGLPLCVHGEVTTPDVDIFDREKAFIDTVLEPLRQRLPELKVTMEHITTRDGVDYIKSSNANLAGSITTHHLIINRNAILVGGIKPHYYCLPVAKREEHRLALRAAATSGDARFFLGTDSAPHVDPLKECACGCAGIYTSINTMSCLAHVFEDENALDKLEAFASLNGPAWYGLAPNDETITLVKREEAVAFPEKIETGAGPVTVFDPMFPLHWDVN

SEQ ID NO: 27824 - DNA, 1269 bp, Aquifex aeolicus
  CDS (1)..(1269): transl_table=11
atgctaaagttaatcgtgaaaaacggttacgtaatagacccctcgcaaaatctcgagggggagtttgatatcctcgtagaaaatggaaagataaagaagatagataaaaacatcctagtccccgaggcggaaatcatagatgcaaagggtttaatagtgtgcccgggatttatagacatacacgttcacctgagagatccggggcagacttacaaggaggatatagagagcggaagcaggtgtgccgttgcgggaggttttacgactatcgtatgcatgccgaacacaaaccctcccattgataacacaacggtggttaattacattctccagaagtctaaaagtgtcggactttgcagggttcttcctactgggactataaccaagggaagaaagggaaaggaaattgcggatttttactctttaaaagaggcgggatgtgtggcttttacggacgacggcagtcccgtaatggacagttccgtgatgagaaaagccttagaactcgcctcacagctcggtgttcctataatggatcactgcgaggacgacaaactcgcctacggtgtgataaacgagggcgaggtttccgcccttctgggactttcctcaagggctccggaggctgaggagatccagatagcgagagatgggatactggcacagagaacagggggacacgtccacatacagcacgtatccacaaagctttccttagaaataatagagtttttcaaagaaaagggagtgaagataacctgcgaggtaaacccgaaccacctcctctttacggaaagggaagttttgaactcgggggcaaacgcaagggtaaaccctccactcagaaagaaagaggacaggttggccctgatagaaggtgtgaaaagaggaattatagactgctttgccacagatcacgccccgcaccagacttttgaaaaggagctcgttgagtttgcgatgcccggtattattgggctccagacagctttaccctcggctcttgaactctacagaaagggaataatttcactcaagaagttgatagagatgtttacaatcaaccctgcaaggataatcggtgtagacctcggaaccttgaaactgggaagtcccgcggacataactatttttgatcccaataaggaatggattttgaacgaagagacgaacctttcgaagagcaggaacacacccctctggggcaaagttctcaagggtaaagtgatttacaccataaaagacgggaagatggtgtataaagattaa

SEQ ID NO: 27825 - protein, 422 aa, Aquifex aeolicus
MLKLIVKNGYVIDPSQNLEGEFDILVENGKIKKIDKNILVPEAEIIDAKGLIVCPGFIDIHVHLRDPGQTYKEDIESGSRCAVAGGFTTIVCMPNTNPPIDNTTVVNYILQKSKSVGLCRVLPTGTITKGRKGKEIADFYSLKEAGCVAFTDDGSPVMDSSVMRKALELASQLGVPIMDHCEDDKLAYGVINEGEVSALLGLSSRAPEAEEIQIARDGILAQRTGGHVHIQHVSTKLSLEIIEFFKEKGVKITCEVNPNHLLFTEREVLNSGANARVNPPLRKKEDRLALIEGVKRGIIDCFATDHAPHQTFEKELVEFAMPGIIGLQTALPSALELYRKGIISLKKLIEMFTINPARIIGVDLGTLKLGSPADITIFDPNKEWILNEETNLSKSRNTPLWGKVLKGKVIYTIKDGKMVYKD

SEQ ID NO: 27826 - DNA, 1134 bp, Arabidopsis thaliana
  CDS (1)..(1134)
atgataaagactttggtctctccttatagtggatttggatctcagaagttgaagtttgacagatcttctgagaaagtgaagacgagagcagtaagaatggagctcacaatcactcaacctgatgattggcatcttcatctccgtgacggtgatcttcttcatgctgttgttccccacagtgcgagtaattttaagagagcgattgtgatgccgaatctgaagcctcctgtcacctccactgcagctgccattatttaccggaaatttatcatgaaagctttgccatctgagagtagctttgatccacttatgacactttatttgactgacaaaactctacctgaagagatcaggcttgcaagggaaagtggtgtggtttatgcggtgaagctgtaccctgccggagcaacaaccaactctcaagatggtgtcacggatctctttggaaaatgcttaccggtactagaagagatggtcaaacaaaacatgcctttgctggttcatggggaggtcacagatccgagtatcgatgtctttgaccgcgagaaaatcttcattgagacagttctgcagcctctaatccaacgccttccgcagctgaaagtagtgatggaacacatcacaaccatggatgctgtgaattttgttgaatcttgcaaagaagggtctgtgggtgcaacagtcacaccacaacatctccttctcaacaggaacgcccttttccaaggtggattacaacctcacaactactgtcttcccgttctcaaaagagaaatacatagagaagccattgtcaaagctgtaactagtggaagcaagaagttcttcctcggcacagatagtgctccacatgaacggagtagaaaagaatcatcctgcggatgtgctggtatttacagcgctcccattgccttgtccctatacgccaaggtctttgatgaggcgggtgcgctggacaagttggaagctttcaccagtttcaatggacctgatttctatggccttccgagaaactcgtcaaagatcacactgaagaaatctccttggaaggttccagacgttttcaacttcccattcggagagatcgtccctatgtttgctggagaaacccttcaatggcaaccgttgaaataa

SEQ ID NO: 27827 - protein, 377 aa, Arabidopsis thaliana
MIKTLVSPYSGFGSQKLKFDRSSEKVKTRAVRMELTITQPDDWHLHLRDGDLLHAVVPHSASNFKRAIVMPNLKPPVTSTAAAIIYRKFIMKALPSESSFDPLMTLYLTDKTLPEEIRLARESGVVYAVKLYPAGATTNSQDGVTDLFGKCLPVLEEMVKQNMPLLVHGEVTDPSIDVFDREKIFIETVLQPLIQRLPQLKVVMEHITTMDAVNFVESCKEGSVGATVTPQHLLLNRNALFQGGLQPHNYCLPVLKREIHREAIVKAVTSGSKKFFLGTDSAPHERSRKESSCGCAGIYSAPIALSLYAKVFDEAGALDKLEAFTSFNGPDFYGLPRNSSKITLKKSPWKVPDVFNFPFGEIVPMFAGETLQWQPLK

SEQ ID NO: 27828 - DNA, 1053 bp, Buchnera aphidicola
  CDS (1)..(1053): transl_table=11
atgtctaaatttgtcaaaaaaataaaaatcattaaacctgatgattggcatgttcatttaagagacaatgagattttaaatcaagttataaagtatactggtaaattttataaaagagctgttattatgccaaatcttaatagtccgattacgagttgtttgaaaagcattgcgtatcgtaatagaattttaaaatcaatgcacttgaattataaattcaaaccgttaatgacttgttatttaactaattccacaagccctaaagaactagaatttggtttttctaaaaaaatatttgtagcagctaaattctatccaaatggttgcacgaccaattcaaaaactggtataaaaaaaattagtgatattactcctgttttagaatgtatggaaaaaataggaatgccattactaattcatggtgaagagattaaccaaaatattgatatctatgatagagaagcaaaatttattgaaaaaacgttagatcctttaagaaaaaaatttccaaagttaaagatagtattagaacatattacaaccaaagaatctgtagaatatatcaaaaataacgatgttaattacttatctgcaactattacaccacatcatttaatgctaaatcgaaatgatatgttttatggtgggattcaaccatatctttactgtttaccgattttaaaaaaaaacaaacatcgaatggcactaagaaaagccatctctaatggagataaacatttttttttaggaagcgatacagctccacatcttcataaaaataaaattaatatgcttggatgtgcgggtatatttaatgctccatcatctctattatcttatgttaaagtatttgaggaaatgagagcgttaaaatatttacaatctttttgttctgaaaatggtcctaaattttataacatgccaattaacaaagaaaccataacaataatcaaaaaaccgtgtaaaattattaaaaaaataaatgttggaagaaatgtgattattccatttttatcaggtgaaattttaaactggtcaattgaaagtgattaa

SEQ ID NO: 27829 - protein, 350 aa, Buchnera aphidicola
MSKFVKKIKIIKPDDWHVHLRDNEILNQVIKYTGKFYKRAVIMPNLNSPITSCLKSIAYRNRILKSMHLNYKFKPLMTCYLTNSTSPKELEFGFSKKIFVAAKFYPNGCTTNSKTGIKKISDITPVLECMEKIGMPLLIHGEEINQNIDIYDREAKFIEKTLDPLRKKFPKLKIVLEHITTKESVEYIKNNDVNYLSATITPHHLMLNRNDMFYGGIQPYLYCLPILKKNKHRMALRKAISNGDKHFFLGSDTAPHLHKNKINMLGCAGIFNAPSSLLSYVKVFEEMRALKYLQSFCSENGPKFYNMPINKETITIIKKPCKIIKKINVGRNVIIPFLSGEILNWSIESD

SEQ ID NO: 27830 - DNA, 1050 bp, Buchnera aphidicola
  CDS (1)..(1050): transl_table=11
atgtctaaatttttaaaaaaaattaaaattataaaacctgatgactggcatgttcatttaagagataatgaaattttaaaaaaagtttctcaatacactggaacattttataaacgtgcaatcattatgcctaatctcgaagaacctattacaaattgttttagatcaatctcttatcgtcgtagaattttaaattctatgacaccaaatactgcatttcaaccattaatgatttgttacttaacagaaaaaacttctcctgaagaattacaacaaggtttttttaaaaaaatttttgtaggagcaaaattatatcctcattgttctacaactaattcaaaatacggtataaaaaatattaacaatatctatcatttatttaatattatggaaaaaataaaaatgccattacttattcatggagaagaaaataatttaaatatcgacatatatgatagagaagcaaaatttattgaaaatacactaaaaccattacgtaaaaaatttccagaattaaaaataatactagaacatattacaacagaagaagcaatatcgtacattgaggaatgtaattcttcatatttagctggtactattacacctcatcacttaatgttaaaccgaaataatatgtttattgatggaattcaaccacatctttattgtttacctcttttaaaaagaaaaaaacatcaaatagctttgagaaatgtcatatcaagtggtagtaaaaatttttttttaggcagtgatacagctccacactttcataaaaataaaatcaacacttttggttgcgcaggtatatttaatgctccatcttctttattatgttatgttagcgtttttgaagaaatgaatgcattacagcattttcaatctttttgctccgaaaacggacctaacttttataatatgccaattaataaagaaaccattacacttgtcaaaaaacctcataaaattttagaaaaaattaatattggtaaaaatattattgttccctttttagctgggaaaagactagattggtctattgaaaagtaa

SEQ ID NO: 27831 - protein, 349 aa, Buchnera aphidicola
MSKFLKKIKIIKPDDWHVHLRDNEILKKVSQYTGTFYKRAIIMPNLEEPITNCFRSISYRRRILNSMTPNTAFQPLMICYLTEKTSPEELQQGFFKKIFVGAKLYPHCSTTNSKYGIKNINNIYHLFNIMEKIKMPLLIHGEENNLNIDIYDREAKFIENTLKPLRKKFPELKIILEHITTEEAISYIEECNSSYLAGTITPHHLMLNRNNMFIDGIQPHLYCLPLLKRKKHQIALRNVISSGSKNFFLGSDTAPHFHKNKINTFGCAGIFNAPSSLLCYVSVFEEMNALQHFQSFCSENGPNFYNMPINKETITLVKKPHKILEKINIGKNIIVPFLAGKRLDWSIEK

SEQ ID NO: 27832 - DNA, 1020 bp, Helicobacter pylori J99
  CDS (1)..(1020): transl_table=11
atggaaatcacgctttttgaccccatagacgcccacttgcatgtgcgagaaaacgcgcttttaaaagcggtgttggaatattctagcgaaccttttagcgccgcagtgatcatgcccaatctcagtaagcctttgattgacactccaatcaccctagaatatgaagaagaaattttaaaaaattcttcaaacttcaagcctttaatgagtttgtattttaacgatggtttgactttagaagaattgcaacgagctaaaaacaaaggcattaaatttttaaaactctaccccaaaggcatgaccacaaacgcgcaaaatggcacttcggatttgttgggtgaaaagactttggaggttttagaaaacgcccaaaaattaggctttattttatgcgtccatgcagaacaagctgggttttgtttggataaagaatttttatgccatagcgttttagaaactttcgccctttcattccctaaactcaaaatcattatagagcatttgagcgattggcgcagtatcgctttgattgaaaagcatgacaacctctatgcgactttgaccttacaccatatcagcatgactttagatgacttattaggggggagtttggacccgcattgtttttgcaaacccttaatcaaaaccaaaaaagaccaagaaaggctcttatcccttgctttaaaagcccaccctaaaatctcttttggatcggacagtgccccgcatttcatttctaaaaagcatagcgctaacatcccggcgggcatcttttctgcccctattttgttgcctgcgttgtgcgaactttttgaaaaacacaacgctttagaaaatttgcaagcctttatcagtgataacgctaaaaaaatctacgcgctagacaatttacccagtaaaaaagcgcatttgtctaaaaaaccctttatagtccctacgcacacgctttgcttgaatgaaaaaatcgctatcttaagagggggcgaaacgctatcttggaaccttcaagaaatcgcctaa

SEQ ID NO: 27833 - protein, 339 aa, Helicobacter pylori J99
MEITLFDPIDAHLHVRENALLKAVLEYSSEPFSAAVIMPNLSKPLIDTPITLEYEEEILKNSSNFKPLMSLYFNDGLTLEELQRAKNKGIKFLKLYPKGMTTNAQNGTSDLLGEKTLEVLENAQKLGFILCVHAEQAGFCLDKEFLCHSVLETFALSFPKLKIIIEHLSDWRSIALIEKHDNLYATLTLHHISMTLDDLLGGSLDPHCFCKPLIKTKKDQERLLSLALKAHPKISFGSDSAPHFISKKHSANIPAGIFSAPILLPALCELFEKHNALENLQAFISDNAKKIYALDNLPSKKAHLSKKPFIVPTHTLCLNEKIAILRGGETLSWNLQEIA

SEQ ID NO: 27834 - DNA, 1020 bp, Helicobacter pylori
  CDS (1)..(1020): transl_table=11
atggaaatcacgctttttgaccccatagacgcccacttgcatgtgcgagaaaacgcacttttaaaagcggtgttaggatattctagcgagccttttagtgctgcagtgatcatgcctaatctcagtaagcccttgattgacactccaaccacccttgaatacgaagaagaaattttaaaccattcttcaaacttcaagcctctaatgagtttgtatttcaatgatggcttgactttagaagaattgcaatgcgcaaaagaaaaaggcgtcaggtttttaaagctctaccccaaaggcatgaccacaaacgcgcaaaacggcacttcggatttgttgggtgaaaaaactttagaggttttagaaaacgcccaaaaattaggctttattttatgcatccatgcagaacaaaccgggttttgtttggataaagaatttttatgccatagcgttttagaaacttttgccctttcattccctaaactcaaaatcattatagagcatttgagcgactggcgcagtatcgctttgattgaaaaacatgacaatctctatgcgactttgactttacaccatatcagcatgactttagatgatttattaggggggagtttgaacccgcattgtttttgcaaacccttaatcaaaaccaaaaaagaccaagaaaggcttttatcccttgctttaaaagcccaccctaaaatctcttttggctctgatagcgccccgcatttcatttctaaaaagcatagcgctaacatcccggcgggcatcttttctgcccctattttattgcctgcgttgtgcgaactttttgaaaaacacaacgctttagaaaacttgcaagcctttatcagcgataacgctaaaacaatctatgggctagaaaatttgcccagtaaaaaagcgcgtttgtctaaaaaaccctttatgatccctacacacacgctttgcttgaatgaaaaaatcgctatcttaagagggggcgaaacgctatcttggaaccttcaagaaatcgcctaa

SEQ ID NO: 27835 - protein, 339 aa, Helicobacter pylori
MEITLFDPIDAHLHVRENALLKAVLGYSSEPFSAAVIMPNLSKPLIDTPTTLEYEEEILNHSSNFKPLMSLYFNDGLTLEELQCAKEKGVRFLKLYPKGMTTNAQNGTSDLLGEKTLEVLENAQKLGFILCIHAEQTGFCLDKEFLCHSVLETFALSFPKLKIIIEHLSDWRSIALIEKHDNLYATLTLHHISMTLDDLLGGSLNPHCFCKPLIKTKKDQERLLSLALKAHPKISFGSDSAPHFISKKHSANIPAGIFSAPILLPALCELFEKHNALENLQAFISDNAKTIYGLENLPSKKARLSKKPFMIPTHTLCLNEKIAILRGGETLSWNLQEIA

SEQ ID NO: 27836 - DNA, 1281 bp, Listeria innocua
  CDS (1)..(1281): transl_table=11
atgtacgtattaaaaaatggtcaagtgttaaatgaatcaggcgaactagagaacaaagatgtacttattcaaaacggcaaagtcaacttgattgcagattcgattgaagtaacaagtggcgaagaatttgatgcaacgggaaaactaatcgcaccaggctttatcgatgttcacgtacatcttcgcgaaccaggcggagaacataaagaaaccattttgacaggaacaaaagcagcagcacgcggaggttatacaacgatttgttcgatgcctaatacaaaacctgttccagattccaaagaagtaatgaacagtttacaagcaaaaattaaagaaacagcagaagttcgagtgttaccatacgcatccattacaacgagtcttggaacggacgagctagtagattttgaagctttaaaagaagctggagcatttgcttttacagatgatggcgtgggcgtacagctagccggaacaatgtatgaggcaatgaaacgagcagcagcactagatatggcaatcgttgctcactgtgaagacaactcgctcatttacggcggagtggtccacgacgggatttttgctgaaaaagaaggacttaaaggcattccaaacattgcagaatcggttcaaatcgcgcgtgatgttttactagcagaagcagccggctgtcactatcatgtttgccatatttcgactaaagaatctgttcgcgtggtacgtgatgcaaaacgagcgggtattcgtgtcacagcagaagtttcgccacatcacttgatactcgacgaagaggacattccgggaaatgacggcaactggaaaatgaatccaccacttcgcagcaaagaagatcgcgcagcacttttagaaggattactagatggaacgattgattttatcgcaactgaccacgcaccacacgcagcggaagaaaaaaatgtcccaatggagcaagccgcatttggtattgttggtttagaaacggctttcccgctgctatacacccattttgtcaaaacgaacgaatggacgttaaaacaacttatcgactggatgacagtgaagccagcagagtgctttaaactcccatacggaaaactagaagaaggcgcagtagcagatattgtcgtacttgatttagaaaaagaagcaactattgatccagctactttttactcaaaaggaaaaaatacaccatttgttggagaaacgtgtatcggctggccggtagcaacgtttgcagaaggagaacttgtatacaatgagggggaaaacaaatga

SEQ ID NO: 27837 - protein, 426 aa, Listeria innocua
MYVLKNGQVLNESGELENKDVLIQNGKVNLIADSIEVTSGEEFDATGKLIAPGFIDVHVHLREPGGEHKETILTGTKAAARGGYTTICSMPNTKPVPDSKEVMNSLQAKIKETAEVRVLPYASITTSLGTDELVDFEALKEAGAFAFTDDGVGVQLAGTMYEAMKRAAALDMAIVAHCEDNSLIYGGVVHDGIFAEKEGLKGIPNIAESVQIARDVLLAEAAGCHYHVCHISTKESVRVVRDAKRAGIRVTAEVSPHHLILDEEDIPGNDGNWKMNPPLRSKEDRAALLEGLLDGTIDFIATDHAPHAAEEKNVPMEQAAFGIVGLETAFPLLYTHFVKTNEWTLKQLIDWMTVKPAECFKLPYGKLEEGAVADIVVLDLEKEATIDPATFYSKGKNTPFVGETCIGWPVATFAEGELVYNEGENK

SEQ ID NO: 27838 - DNA, 1281 bp, Listeria monocytogenes
  CDS (1)..(1281): transl_table=11
atgtacgtattaaaaaatgggcaagtattaaacgcgtcaggtgaactggaaaacaaagatgtacttattcaaaacggtaaagtcaatttgattgcggattccattgaagtaacaagcggcgaggaatttgatgcgacagggaaattaattgccccaggttttatcgacgtccatgtacatcttcgtgagccgggcggggaacataaagaaaccattttaacaggaacacaagcggcggcacgcggtggctatacgacaatttgttcgatgccgaatacaaaacctgttccagattccaaagaagtaatggaaagtttacaagcaaaaattaaagaaacagcgaaagttcgcgtgttaccatatgcttcgattacaacaagccttggaacggacgaattagttgattttgaagctttaaaagaagctggtgcatttgcttttacagatgacggggtaggcgtgcagttagctggaacaatgtatgaagcgatgaaacgagcagcagcactagatatggcgattgtggctcactgtgaagataactcacttatctatggtggcgttgtccatgacgggatttttgctgaaaaagaaggtctgaaaggtattccgaatattgctgaatctgtccaaatcgcacgtgacgttttactagcagaagctgcaggttgtcattatcatgtctgtcatatttcaacaaaagaatctgttcgtgttgtgcgagatgcaaaacgggcgggaattcgtgtcactgctgaagtttcaccacatcacttaattttagatgaagaagctattccaggaaatgacggtaattggaaaatgaaccccccacttcgcagcaaagaagatcgggcggcacttttagaaggcttactggatggtacgatagattttatcgcaactgatcatgctccacacgcagcggaagaaaaaaatgtaccgatggagcaagctgctttcggaattgtaggtctagaaacggcattcccattactatatacccattttgttaaaacgaacgaatggacattaaaacagctaatcgactggatgactgtaaaaccagcggaatgctttaaactcccatacgggaaattagaagaaggcagcgtagctgatatcgtcgtacttgatttagaaaaagaagcgaatattgacccagctactttttattcaaaaggaaaaaacacaccatttgtaggagaaacgtgtattggatggccagtagcaacgttttcggaaggcacacttgtatacaatgagggggaaattaaatga

SEQ ID NO: 27839 - protein, 426 aa, Listeria monocytogenes
MYVLKNGQVLNASGELENKDVLIQNGKVNLIADSIEVTSGEEFDATGKLIAPGFIDVHVHLREPGGEHKETILTGTQAAARGGYTTICSMPNTKPVPDSKEVMESLQAKIKETAKVRVLPYASITTSLGTDELVDFEALKEAGAFAFTDDGVGVQLAGTMYEAMKRAAALDMAIVAHCEDNSLIYGGVVHDGIFAEKEGLKGIPNIAESVQIARDVLLAEAAGCHYHVCHISTKESVRVVRDAKRAGIRVTAEVSPHHLILDEEAIPGNDGNWKMNPPLRSKEDRAALLEGLLDGTIDFIATDHAPHAAEEKNVPMEQAAFGIVGLETAFPLLYTHFVKTNEWTLKQLIDWMTVKPAECFKLPYGKLEEGSVADIVVLDLEKEANIDPATFYSKGKNTPFVGETCIGWPVATFSEGTLVYNEGEIK

SEQ ID NO: 27840 - DNA, 1281 bp, Listeria monocytogenes
  CDS (1)..(1281): transl_table=11
atgtacgtattaaaaaatggacaagtgctaaacgcgtcagggaaactagaaagtaaagatgtactcattcaaaacggcaaagtcaacttgattgccgattcaattgaagtaacaagtggtgaggaatttgacgccacaggtaagctaattacaccaggctttatcgacgtccatgtacatcttcgtgagccaggcggggaacataaggaaaccattttgacaggaacgaaagctgctgcacgcggtggctatacgacaatttgttcgatgccgaatacaaaacctgttccagattctaaagaagtaatggaaagtatacaagcaaaaattaaagaaacagcgaaagttcgcgtgttaccatatgcttcgattacgaccagccttggaacggacgaattagtagattttgaagctttaaaagaagctggcgcatttgctttcacagatgatggtgtaggagtgcagttagctggaacaatgtatgaagcgatgaaacgagcggcagcactagatatggcaattgtggctcactgtgaagataactcacttatatacggtggagttgtccatgacgggatttttgctgaaaaagaaggacttaaaggcattccaaatattgctgaatctgtccaaatcgcacgtgacgttttactagcagaagctgcaggttgtcattatcatgtctgtcatatttcaacaaaagaatctgttcgtgttgtgcgagatgcaaaacgggcgggaattcgtgtcactgctgaagtttcaccacatcacttaattttagatgaagaagctattccaggaaatgatggtaattggaaaatgaaccccccacttcgcagcaaagaagatcgggcggcacttttagaaggcttactggatggtacgatagattttatcgcaactgatcatgctccacacgcagcggaagaaaaaaatgtaccgatggagcaagctgctttcggaattgtaggtctagaaacagcattcccattactatatacacattttgttaaaacgaacgaatggacattaaaacagctaatcgactggatgactgtgaaaccagcggaatgctttaaactgccatacgggaaattagaagaaggcagcgtagcagatatagtcgtacttgatttagaaaaagaagcgaatattgacccagacactttttattcaaaaggaaaaaacacaccatttgttggagaaacatgtattggttggccagtagccacgtttgcagaaggaacgcttgtatacaatgagggggaaattaaatga

SEQ ID NO: 27841 - protein, 426 aa, Listeria monocytogenes
MYVLKNGQVLNASGKLESKDVLIQNGKVNLIADSIEVTSGEEFDATGKLITPGFIDVHVHLREPGGEHKETILTGTKAAARGGYTTICSMPNTKPVPDSKEVMESIQAKIKETAKVRVLPYASITTSLGTDELVDFEALKEAGAFAFTDDGVGVQLAGTMYEAMKRAAALDMAIVAHCEDNSLIYGGVVHDGIFAEKEGLKGIPNIAESVQIARDVLLAEAAGCHYHVCHISTKESVRVVRDAKRAGIRVTAEVSPHHLILDEEAIPGNDGNWKMNPPLRSKEDRAALLEGLLDGTIDFIATDHAPHAAEEKNVPMEQAAFGIVGLETAFPLLYTHFVKTNEWTLKQLIDWMTVKPAECFKLPYGKLEEGSVADIVVLDLEKEANIDPDTFYSKGKNTPFVGETCIGWPVATFAEGTLVYNEGEIK

SEQ ID NO: 27842 - DNA, 1035 bp, Neisseria meningitidis
  CDS (1)..(1035): transl_table=11
atgcaaaccctgaccattatccgccccgacgatatgcacctgcacctgcgcgacggcgacgcgctcaaagccgttgccccttataccgcccgccaaatggggcgcgccgtcattatgcccaacctcaaaccgcctgtcgtcagtgtagccgacgcgcttgcctacaaagcgcgcattatggcggcgttgcccgaaggtagcgcgtttgagccgttgatgacgctttatttgactgataacgccacgcccgaacttgtacgcgaagccaaagccgccggcatcgtcgccttcaaactctaccctgccggcgcgaccaccaattccgattccggcgtaaccgacctgttcaagctcatccccgtgttggaagaaatggcgaaacagggcattttgttcctcgttcacggcgaagtaaccgaccccgaaatcgacatcttcgaccgcgaagccgcctttatcgggcgcgtgatgaaacccgttttggcgcaagtgccgaatcttaaagtcgtgttcgaacacatcaccaccgccgaagccgcccgcctggttttggaagcaggcgacaacgtagccgccaccgttaccccgcaacacctcctgctcaaccgcaacgacctcttggtcggcggcgtgcgcccccatcatttctgcctgcccgtactcaaacgcgaaacccaccgtcaggcattggtcgccgccgttaccggcgagaaggcgcataaattcttcctcggcaccgactccgcgccgcacgccaaatccgccaaagaaaacgcctgcggctgcgccggtatgttcagtgcgatgaccgctatcgagctttacgccgaagtatttgaaaaagcaggcgcgttggacaaactcgaagccttcgcctcaaaaaacggcgcaaggttctacggcattcctgaaaataccgacacgatcaccctcgtcaaacaaagccaaaccgttcccgcaagtgttccctacggcgacggcgaacttgtcccgatgcgcgcgggcggcgaaatcggctggacggtgcagtattga

SEQ ID NO: 27843 - protein, 344 aa, Neisseria meningitidis
MQTLTIIRPDDMHLHLRDGDALKAVAPYTARQMGRAVIMPNLKPPVVSVADALAYKARIMAALPEGSAFEPLMTLYLTDNATPELVREAKAAGIVAFKLYPAGATTNSDSGVTDLFKLIPVLEEMAKQGILFLVHGEVTDPEIDIFDREAAFIGRVMKPVLAQVPNLKVVFEHITTAEAARLVLEAGDNVAATVTPQHLLLNRNDLLVGGVRPHHFCLPVLKRETHRQALVAAVTGEKAHKFFLGTDSAPHAKSAKENACGCAGMFSAMTAIELYAEVFEKAGALDKLEAFASKNGARFYGIPENTDTITLVKQSQTVPASVPYGDGELVPMRAGGEIGWTVQY

SEQ ID NO: 27844 - DNA, 1047 bp, Pseudomonas aeruginosa
  CDS (1)..(1047): transl_table=11
atgtccgaccgtctcaccctcctgcgccccgacgactggcacattcacctgcgtgacggtgccgcgctggccaataccgtcggcgacgccgcccgcaccttcggccgcgccatcgtcatgccgaacctggtgccgccggtgcgcaacgccgccgaagccgacgcctaccggcagcgcatcctcgccgcccgtcccgccgccagccgcttcgagccgctgatggtgctgtacctcaccgaccgcaccagcaccgaggaaatccgtaccgccaaggccagcggcttcgtgcatgccgccaagctctatccggcaggcgccaccaccaactcggactctggcgtgacccgcatcgacaatatcttcgaagcgctcgaggcgatggccgaggtcggcatgccgctgctggtgcatggcgaggtgacccgcgccgaggtcgacgtattcgatcgcgagaagcagttcatcgacgagcacctgcgccgggtggtcgagcgcttcccgaccctgaaagtggtcttcgagcacatcaccaccggcgacgccgcccagttcgtccgggaagccccggccaacgtcggcgcgaccattaccgcccatcacctgctgtacaaccgcaaccacatgctggtcggcggtatccgtccgcacttctattgcctgccgatcctcaagcgcaacacccaccaggaagccctgctggacgccgcggtgagcggcaatccgaaattcttcctcggcaccgactcggcgccgcacgcccgccacgccaaggaagccgcctgcggttgcgccggctgctacagcgcctacgccgccatcgagctgtatgccgaggccttcgaacagcgcaatgcgctggacaagctggaaggcttcgccagcctgcacggcccggacttctatggcctgccgcgcaacaccgaccggatcaccctggtccgcgaggaatggcaggcgcccgccagcctccccttcggcgacttcgacgtggtgccgctgcgcgccggagagacactccgctggaaactgctggaggccggggcatga

SEQ ID NO: 27845 - protein, 348 aa, Pseudomonas aeruginosa
MSDRLTLLRPDDWHIHLRDGAALANTVGDAARTFGRAIVMPNLVPPVRNAAEADAYRQRILAARPAASRFEPLMVLYLTDRTSTEEIRTAKASGFVHAAKLYPAGATTNSDSGVTRIDNIFEALEAMAEVGMPLLVHGEVTRAEVDVFDREKQFIDEHLRRVVERFPTLKVVFEHITTGDAAQFVREAPANVGATITAHHLLYNRNHMLVGGIRPHFYCLPILKRNTHQEALLDAAVSGNPKFFLGTDSAPHARHAKEAACGCAGCYSAYAAIELYAEAFEQRNALDKLEGFASLHGPDFYGLPRNTDRITLVREEWQAPASLPFGDFDVVPLRAGETLRWKLLEAGA

SEQ ID NO: 27846 - DNA, 1047 bp, Pseudomonas putida
  CDS (1)..(1047): transl_table=11
atgtccgatcgcctgaccctcctgcgccccgacgactggcacatccatctgcgcgatggtgccgtcctgccccacaccgttggcgacgtggcgcgtaccttcgcccgtgccatcatcatgcccaacctcgtgccgcccgtgcgcaatgtcaccgaggccggcgcctaccgtgagcgcattctggctgcccgcccggccggcagccgcttcgagccgctgatggtgctgtacctcaccgaccgcaccagccccgaggacgtccgcgcggccaaggccagcggtttcgtgtacgccgccaagttgtacccggccggcgccaccaccaactccgattccggcgtgaccagcatcgacaacatcttcccggccatagaggcactggcggaagtgggcatgccgctgctggtgcatggcgaagtgacccgcagcgagatcgacgtgttcgaccgcgagaagcgcttcatcgacgagcacatgcgccgtgtggtcgagcgcttcccgacgctgaaagtggtgttcgaacacatcaccaccagtgatgccgcgcagttcgtcaccgaggccccggccaacgtcggtgcgaccatcaccgcccagcacctgctgtacaaccgcaaccacatgctggtcggcggcattcgcccgcacttctactgcctgccgatcctcaagcgcaacacccaccaggtggccttgctggacgcagccaccagcggcaatccgaagttcttcctcggcaccgactcggcacctcatgcccgtcacgccaaggaagcagcctgcggttgcgcgggttgctacaccgcctatgcggccatcgagatgtacgccgaagcgttcgagcagcgtaacgcgctggacaagctggaaggcttcgccagcctgcacggcccggccttctatggcctgccggcgaacaccgacaccattaccctggtccgcgaagaatggaccgctccggaaagcctgccatttggcgagcaaaccgtagtcccgctgcgcgctggcgaaaaactgcgctggcgcctgctggagaaaaacgcgtga

SEQ ID NO: 27847 - protein, 348 aa, Pseudomonas putida
MSDRLTLLRPDDWHIHLRDGAVLPHTVGDVARTFARAIIMPNLVPPVRNVTEAGAYRERILAARPAGSRFEPLMVLYLTDRTSPEDVRAAKASGFVYAAKLYPAGATTNSDSGVTSIDNIFPAIEALAEVGMPLLVHGEVTRSEIDVFDREKRFIDEHMRRVVERFPTLKVVFEHITTSDAAQFVTEAPANVGATITAQHLLYNRNHMLVGGIRPHFYCLPILKRNTHQVALLDAATSGNPKFFLGTDSAPHARHAKEAACGCAGCYTAYAAIEMYAEAFEQRNALDKLEGFASLHGPAFYGLPANTDTITLVREEWTAPESLPFGEQTVVPLRAGEKLRWRLLEKNA

SEQ ID NO: 27848 - DNA, 1035 bp, Ralstonia solanacearum
  CDS (1)..(1035): transl_table=11
atgatcgataccctgaccatcgtccgccctgatgactggcacctgcacctgcgcgatggcgacgcgctcgccgacgtggtgggcgacaccgcgcgccagttcggccgggcgatcatcatgcccaacctcaagccgccggtgacgaccaccgcgcaggctcgcgcctaccgcgagcgcatcctcgccgcgctgccggcgggcacgcgcttcgagccgctgatgacgctgtacctgaccgacaacaccacgcccgaggaagtccgcgccgcccgtgccagcggcttcgtgcatggcgtcaagctctacccggccggtgccaccaccaacagcgatgccggcgtgaccgacctgcgccgctgcgccaagacgctcgaagcgatgcaggacgtcggcatgcccctgctggtgcacggcgaagtgaccgaccccacggtcgacatcttcgatcgcgaagccgtcttcatcgacaccgtgatgcagccgctgcgccgcgattttccggcgctcaaggtcgtgttcgagcacatcaccaccaagcacgccgccgaatacgtgcgcgacgcgcaggggccggtcggcgcgaccatcacggcacaccacctgctgtacaaccgcaacgcgctgttcgttggcggcattcgtccgcactactactgcctgccggtgctcaagcgcgaaacgcaccgcctggcgctggtggcggcggccacctcgggccatccgcgcttcttcctcggcaccgacagcgcaccgcatgccaagggcctgaaggagcacgcctgcggctgcgccggctgctataccgcgctgcacgcgatggagctgtacgccgaagcctttgaagacgccaacgcgctcgacaagctcgaaggcttcgccagcctgcacggcccggacttctacggcctgccgcgcaacgccggcacgctcacgctcacgcgctcgcagtggcagctgcccgccgaggtgcccttcggcgagcagatgctggtgccgctgcgcggcggcgagatgctgcgctggaagacggtctga

SEQ ID NO: 27849 - protein, 344 aa, Ralstonia solanacearum
MIDTLTIVRPDDWHLHLRDGDALADVVGDTARQFGRAIIMPNLKPPVTTTAQARAYRERILAALPAGTRFEPLMTLYLTDNTTPEEVRAARASGFVHGVKLYPAGATTNSDAGVTDLRRCAKTLEAMQDVGMPLLVHGEVTDPTVDIFDREAVFIDTVMQPLRRDFPALKVVFEHITTKHAAEYVRDAQGPVGATITAHHLLYNRNALFVGGIRPHYYCLPVLKRETHRLALVAAATSGHPRFFLGTDSAPHAKGLKEHACGCAGCYTALHAMELYAEAFEDANALDKLEGFASLHGPDFYGLPRNAGTLTLTRSQWQLPAEVPFGEQMLVPLRGGEMLRWKTV

SEQ ID NO: 27850 - DNA, 1044 bp, Rhizobium meliloti
  CDS (1)..(1044): transl_table=11
atgcaagacctcgttatacgccgccctgatgattggcatcttcaccttcgcgacggcggcatgctgcgcggcgtgattgccgatacgagccgccatttcgcgcgcgccatcatcatgcccaatctggtgccgcccgtggtgacctccgccgatgcggccgcctatcgcgagcgcatcctcgccgccattcccgcaggggaccggttcgagccgctgatgacgctgtatcttaccgagggcaccgatccgggagatgtggaagccgggttcaggagcggcctcgtcaaggccgtcaagctctatccggccggcgccacaaccaattcgtcgagcggcgtccgcgatatcgacaaggccatgccggtgctcgagcgcatggccgagatcggcctgccgctctgcgtccatggcgaggtgacgacggccgaggtcgacattttcgaccgcgaggcggtcttcatcgaaaccgttctcgacccgctccgccggcgcctgcccgatctcaggatcaccatggagcatgtgacgacgaaggacggcgtcgactacatccgcgagcatgcggccaatcttgccggctccatcaccacccatcacctgatcatcaaccgcaacgccatcctcgtcggcggcatcaagccgcattactactgtctgccggtggcgaagcgcgaggcgcatcggctggcgcttcgccaggcggcgatctcgggcgacgtccgcttcttcctgggcacggactctgccccgcatgtcgacccgcttaaggagtgcgcctgcggctgtgccggcatctacacatcgatcaacaccttgagctgcctcgctcacgtcttcgaggaagagggtgcgctcgaccggctggaagccttcacctcgctgaacggccccgcctggtacggcctgccggcaaacgaggagacgatcacgctgcgcaagcaggaggagccggtcagctaccctgccaggatcgagaccgaagccggtccggtcacggttttcgacccgatgttcccgctccactgggccgtgacacaggcctga

SEQ ID NO: 27851 - protein, 347 aa, Rhizobium meliloti
MQDLVIRRPDDWHLHLRDGGMLRGVIADTSRHFARAIIMPNLVPPVVTSADAAAYRERILAAIPAGDRFEPLMTLYLTEGTDPGDVEAGFRSGLVKAVKLYPAGATTNSSSGVRDIDKAMPVLERMAEIGLPLCVHGEVTTAEVDIFDREAVFIETVLDPLRRRLPDLRITMEHVTTKDGVDYIREHAANLAGSITTHHLIINRNAILVGGIKPHYYCLPVAKREAHRLALRQAAISGDVRFFLGTDSAPHVDPLKECACGCAGIYTSINTLSCLAHVFEEEGALDRLEAFTSLNGPAWYGLPANEETITLRKQEEPVSYPARIETEAGPVTVFDPMFPLHWAVTQA

SEQ ID NO: 27852 - DNA, 1047 bp, Salmonella typhimurium; identical to SEQ ID NO: 27648
  CDS (1)..(1047)

SEQ ID NO: 27853 - protein, 348 aa, Salmonella typhimurium; identical to SEQ ID NO: 27649

SEQ ID NO: 27854 - DNA, 1014 bp, Schizosaccharomyces pombe
  CDS (1)..(1014)
atgagtttgaaaatacctggtttggctgatatgcatgttcatctaaggcaagataatatgttaaaagctgtagttccaacggtcgcagagggtggagtctctgttgcgtatgtaatgcctaatttaatccccccaattactaccgttgatgcctgtttgcaatataaaaaagaaattgagcagcttgactccaagaccacctatttaatgagtctttatctctcaccggaaactacacctgaggttatttacgaagctgcaaaaaagggaattcgaggagttaaatcatatccgaaaggagctactaccaattctgaaagtggtgttgaaagctacgaacccttttatcctacctttgctgcaatgcaagaaacaggtatgattctgaacattcacggagaagttcccccctctaaggataacaccgtttttacggctgagcccaagtttcttcctactttactagaccttcaccaaagatttccaaaactcaagattgtgcttgaacattgcaccactgccgacgctgttgaggcagtaaaagcatgcggtgaaagtgttgcgggtactataactgcccatcatctttatctcacacaaaaagattggcaggatgatccttattgtttctgcaagccggtagccaaaaccgaacgagaccgacgtgctcttattgaagctgctaccagtaaaaatcccaagtttttctttgggagtgattctgcacctcatcctaggtcttctaaactgaagacgccaccggcagctggtgtttttacccaacctttcgctgcttcgtacttagctgaagtgtttgataaagagggtcgtttagatgctttgaaggattttgcatgtatttttggtaggaaattttattgtattcctttagacttcaaagagtctaatatcgtcttaaaaaaggagtcgtttcgcgtacctgaaagtgttgccaatgatttggttccttttcatccaaacgaagttcttcaatggcactgttcatgggagtaa

SEQ ID NO: 27855 - protein, 337 aa, Schizosaccharomyces pombe
MSLKIPGLADMHVHLRQDNMLKAVVPTVAEGGVSVAYVMPNLIPPITTVDACLQYKKEIEQLDSKTTYLMSLYLSPETTPEVIYEAAKKGIRGVKSYPKGATTNSESGVESYEPFYPTFAAMQETGMILNIHGEVPPSKDNTVFTAEPKFLPTLLDLHQRFPKLKIVLEHCTTADAVEAVKACGESVAGTITAHHLYLTQKDWQDDPYCFCKPVAKTERDRRALIEAATSKNPKFFFGSDSAPHPRSSKLKTPPAAGVFTQPFAASYLAEVFDKEGRLDALKDFACIFGRKFYCIPLDFKESNIVLKKESFRVPESVANDLVPFHPNEVLQWHCSWE

SEQ ID NO: 27856 - DNA, 1278 bp, Staphylococcus epidermidis
  CDS (1)..(1278): transl_table=11
atgaaattaattaaaaacggaaaaatcttaaaaaacggtatcctaaaagacacagaaattttaatcgacggtaaacgtattaaacaaattagtagtaaaattaatgcttcatcttcaaatattgaagttattgatgcaaaaggaaatttaattgctcccggttttgtagatgttcatgtgcacctacgtgaaccaggtggtgaacataaagaaacaattgaaagtggtacaaaagccgctgcaagaggtggttttactacagtatgtcctatgcctaatacaagacctgtaccagatacagttgaacatgttagagaattaagacaacgaatttctgaaacagcacaagttagggtgttgccttatgctgctattactaagagacaagcaggtactgaacttgttgattttgaaaaattagcactagaaggtgtgtttgcatttactgacgatggtgtgggagttcaaacagcaagtatgatgtatgctgctatgaagcaagctgtaaaagttaaaaaaccgattgtcgcacactgtgaagataatagcttaatctatggtggtgcaatgcataaaggtaaacgtagtgaagaattaggcatacctggtattccaaatattgctgaatctgtacaaattgctagagatgtattattggctgaagcaactggttgtcactatcatgtgtgtcatgtttcaactaaggaaagtgttcgagtaatcagagacgctaaaaaagctggtatccatgtaacagcagaagttacaccacatcatttattattaactgaaaatgatgttcctggcgatgattcaaactacaaaatgaatccaccattaagaagtaatgaagatagagaagcacttttagaaggcttattagatggaacaattgattgtattgcaacggatcatgcacctcacgctaaagaagaaaaagcacaacctatgacaaaagcacctttcggcatcgtaggtagtgaaacagcattcccattactttatacacactttgtaagacgaggtaattggtcactgcaacaattagttgattatttcactattaaaccagctactattttcaacttaaattatggaaaattacacaaagatagttacgctgatttaacaataattgatcttaatactgaaaaagaaatcaaaagtgaagatttcttatctaaagctgataacactccatttattggtgaaaaagtttatggaaatccaacactaacaatgcttaaaggtgaagtagtattcgaggaggaaaagtag

SEQ ID NO: 27857 - protein, 425 aa, Staphylococcus epidermidis
MKLIKNGKILKNGILKDTEILIDGKRIKQISSKINASSSNIEVIDAKGNLIAPGFVDVHVHLREPGGEHKETIESGTKAAARGGFTTVCPMPNTRPVPDTVEHVRELRQRISETAQVRVLPYAAITKRQAGTELVDFEKLALEGVFAFTDDGVGVQTASMMYAAMKQAVKVKKPIVAHCEDNSLIYGGAMHKGKRSEELGIPGIPNIAESVQIARDVLLAEATGCHYHVCHVSTKESVRVIRDAKKAGIHVTAEVTPHHLLLTENDVPGDDSNYKMNPPLRSNEDREALLEGLLDGTIDCIATDHAPHAKEEKAQPMTKAPFGIVGSETAFPLLYTHFVRRGNWSLQQLVDYFTIKPATIFNLNYGKLHKDSYADLTIIDLNTEKEIKSEDFLSKADNTPFIGEKVYGNPTLTMLKGEVVFEEEK

SEQ ID NO: 27858 - DNA, 1278 bp, Staphylococcus epidermidis
  CDS (1)..(1278): transl_table=11
atgaaattaattaaaaacggaaaaatcttaaaaaacggtatcctaaaagacacagaaatattaatcgatggtaaacgtattaaacaaattagtagtaagataaatgcttcatcttcaaatattgaagttattgatgcaaaaggaaatttaattgctccaggttttgtagatgttcatgtgcacctacgtgaaccaggtggtgaacataaagaaacaattgaaagtggtacaaaagccgctgcaagaggtggttttactacagtatgtcctatgcctaatacaagacctgtaccagatacagttgaacatgttagagaattaagacaacgaatttctgaaacagcacaagttagggtgttgccttatgctgctattactaagagacaagcaggtactgaacttgttgattttgaaaaattagcactagaaggtgtgtttgcatttacagatgatggtgtgggtgttcaaacagcaagtatgatgtatgctgctatgaagcaagctgcaaaagttaaaaaaccgattgtcgcacactgcgaagataatagcttaatctatggtggtgcaatgcataaaggtaaacgtagtgaagaattaggcatacctggtattccaaatattgctgaatctgtacaaattgctagagatgtactattagctgaagcaactggttgtcactatcatgtgtgccatgtttcaactaaggaaagtgttcgagtaatcagagacgctaaaaaagctggtatccatgtaacagcagaagttacaccacatcatttattattaactgaaaatgatgttcctggtgatgattcaaactacaaaatgaatccaccattaagaagtaatgaagatagagaagcacttttagaaggcttattagatggaacaattgattgtattgcaacggatcatgcacctcacgctaaagaagaaaaagaacaacctatgacaaaagcacctttcggtatcgtaggtagtgaaacagcattcccattactttatacacactttgtaagacgaggtaattggtcactgcaacaattagttgattatttcactattaaaccagctactattttcaacttaaattatggaaaattacacaaagatagttacgctgatttaacaattattgatctaaatactgaaaaagaaatcaaaagtgaagatttcttatctaaagctgataacactccatttattggtgaaaaagtttatggaaatccaacactaacaatgcttaaaggtgaagtagtattcgaggaggaaaagtag

SEQ ID NO: 27859 - protein, 425 aa, Staphylococcus epidermidis
MKLIKNGKILKNGILKDTEILIDGKRIKQISSKINASSSNIEVIDAKGNLIAPGFVDVHVHLREPGGEHKETIESGTKAAARGGFTTVCPMPNTRPVPDTVEHVRELRQRISETAQVRVLPYAAITKRQAGTELVDFEKLALEGVFAFTDDGVGVQTASMMYAAMKQAAKVKKPIVAHCEDNSLIYGGAMHKGKRSEELGIPGIPNIAESVQIARDVLLAEATGCHYHVCHVSTKESVRVIRDAKKAGIHVTAEVTPHHLLLTENDVPGDDSNYKMNPPLRSNEDREALLEGLLDGTIDCIATDHAPHAKEEKEQPMTKAPFGIVGSETAFPLLYTHFVRRGNWSLQQLVDYFTIKPATIFNLNYGKLHKDSYADLTIIDLNTEKEIKSEDFLSKADNTPFIGEKVYGNPTLTMLKGEVVFEEEK

SEQ ID NO: 27860 - DNA, 1029 bp, Synechocystis sp
  CDS (1)..(1029): transl_table=11
atggaaaagcttaccatcactcgacccgacgactggcacctgcatctacgggatggagcggccctgaaagcagttctaccccacactgtccgtcaatttgctagggcgatcgtcatgcccaatttgaagcctccggtgcgttccgtggctgatgccgccgcctatcgggaaaggattctcgccgccatacctgcgggaggccagtttgaaccgctgatgaccctttatctaacggataatactaatcccgaagaaattattgcggccaaagcatcccagtttgttaaagcagtaaaatactatcccgctggagccaccaccaattctgactttggcgtcacggatatccatcgatgtgatgcagtgttggcagccatggaacaggtggacttgcccctattactccacggcgaagtaacggacagtaatattgatattttcgaccgagaaaaagtattcattgaaaaatatttaattcctctcagggaaaaatttccccggctgcgggtagtgctggaacatattactacttcagatgcagtgcaatttgttttatctgctaataatattgcagccactattacgccccaacatttactatttagtcgcaacgctttattcaaaggtggcatttgtccccacttttattgcctgccaattctgaagcgggaagaacatcgtttatcattgctacacgcggccacatctggtaatcctaaattttttctcggcactgatagtgctccccacgctcgcaatagtaaagagagtttatgtggctgtgctggttgctattctgccctccatgctatggagctatatgccgaagcttttgaaagtgttaattccctggataagctagaagcctttgctagcttttatggcccagatttttaccaattgccccgtaatacagcacaaattacgttgatgaaaaacccttggcgtattcctgctgaattacctttccctgaatctggattggtgcctctgcgggccggcgaggaaataacttggcaaatggtgtga

SEQ ID NO: 27861 - protein, 342 aa, Synechocystis sp
MEKLTITRPDDWHLHLRDGAALKAVLPHTVRQFARAIVMPNLKPPVRSVADAAAYRERILAAIPAGGQFEPLMTLYLTDNTNPEEIIAAKASQFVKAVKYYPAGATTNSDFGVTDIHRCDAVLAAMEQVDLPLLLHGEVTDSNIDIFDREKVFIEKYLIPLREKFPRLRVVLEHITTSDAVQFVLSANNIAATITPQHLLFSRNALFKGGICPHFYCLPILKREEHRLSLLHAATSGNPKFFLGTDSAPHARNSKESLCGCAGCYSALHAMELYAEAFESVNSLDKLEAFASFYGPDFYQLPRNTAQITLMKNPWRIPAELPFPESGLVPLRAGEEITWQMV

SEQ ID NO: 27862 - DNA, 1176 bp, Ustilago maydis
  CDS (1)..(1176)
atgtcagtacaagagatcacgattccggcgccgggcgattttcacgtgcatctgcgacaaggaaagatgtcggagctcgtcaccccgcacgtcgccgagggaggcgtctcgcttgcatatgttatgcccaaccttgtacctccgatcacatcgacacagcaagcgatggaatacctcgagcgcttggcagccgttgctcctcagaccatgttcgtcggcacgctgtatctatcgcctgacttgacgccggcggaaattgccgaaggcgctcagaatggtgtccgaggtgtcaagagctatcctcgtggagtcactacgaactcggacagcggcatcgaggattacgagacctactatcccatctttgaagagatgcagaaacacgatatggtcctcaacttgcacggcgagcttccttcgaatgcagacgcgggcatctgcgtgttgaatgccgaggaaaagtttttgacgcacctgttcaagatgcacggtgaatttcccaagctcaagatcgtgctggagcatgcgaccaccaggaaggcggtcgaagccgtcaagcagtgtggcgacacagtgggctgtaccatcacaccgcatcacctcgagctcatcgtggatgactgggcgggcaagccactcaacttttgcaagccagtcgccaaatatcccgatgaccgacaggcgttgcgcgacgtcattcgccaaggtcatcctcgcttcttcctcggctcagattcggcgccgcacccgttggctaacaagtatccttccgcagtcacacatggcgctcctggaaccaaagcttctgactctggcagcgatcacctcgaagctactggtgtcgtctcgtgtggttgcgcagcggccgtctacacctcgtcgatccttgtgcctctttggccgacgctgctcgaagcgtttggcgcgttggatcaacttgccaactacgtcagcatcaacgggcgcaacttctatggctacaacgatgatcagcatgccaaacacggcagcataaagcttcgcaaggtgcgcagccgatcatgcatttcgccagcagctgcaaccgttcctgcagtctatgtccatcccgagttccgagaggtgccagattcagatcgatccaaggtgcaagtagtgcctttctgggctgtctcggctgggatcgtccgttcgtga

SEQ ID NO: 27863 - protein, 391 aa, Ustilago maydis
MSVQEITIPAPGDFHVHLRQGKMSELVTPHVAEGGVSLAYVMPNLVPPITSTQQAMEYLERLAAVAPQTMFVGTLYLSPDLTPAEIAEGAQNGVRGVKSYPRGVTTNSDSGIEDYETYYPIFEEMQKHDMVLNLHGELPSNADAGICVLNAEEKFLTHLFKMHGEFPKLKIVLEHATTRKAVEAVKQCGDTVGCTITPHHLELIVDDWAGKPLNFCKPVAKYPDDRQALRDVIRQGHPRFFLGSDSAPHPLANKYPSAVTHGAPGTKASDSGSDHLEATGVVSCGCAAAVYTSSILVPLWPTLLEAFGALDQLANYVSINGRNFYGYNDDQHAKHGSIKLRKVRSRSCISPAAATVPAVYVHPEFREVPDSDRSKVQVVPFWAVSAGIVRS

SEQ ID NO: 27864 - DNA, 1029 bp, Vibrio cholerae
  CDS (1)..(1029)
atgacaacactgacgattacacgcccagacgactggcacgttcaccttcgcgatggcgatgtactggccgatactgtacgcgacatcagccgttataacggccgcgcgctgatcatgcctaacacggttccccctgtaaccaccactgagatggccttagcctatcgtgagcgcattatggccgctcagccacaagcgcactttgaacctttgatggcgctttacctcaccgataacacatcacctgaggaaattcgcaaagccaaagcgtcaggcaaagtcgttgcagctaagctttacccagccggtgcgaccaccaactcggattcaggcgtcacttcagccaaaaacatttacccagttttgcaagcgatgcaggaagtcggtatgttgctgttggtgcacggtgaagtcaccacgcacgaagtcgacatttttgaccgtgaaaagaccttcctagacaccgtgcttgcgccgatcgtgaatgatttcccgcaactgaaaattgtgcttgaacacatcaccaccgccgatgcagtgacctttgtgcaacaagcaggcgataacgttgcggcaacgattaccgcgcaccatttgctgtttaaccgtaaccacatgctggttggcggtattcgcccacatttctactgtttgccaatcctaaagcgtgcgactcaccaacacgcgttagtggcagcggcaacctctggcagcaagaaattcttcctaggtacggactctgccccgcacgccaaaggccgcaaagaagccgcttgtggctgcgcaggttcttacacagcccatgcagctcttgagttgtatgccgaagtgtttgaaaaagaaggtaagctagaaaatctggaagcgttcgctagctttaatggccctgatttctacggcctacctcgcaatcaagagaccgtcacgctcaccaagcaagcctggccagtcgcagaaagcatgccgtttggcagcgatatcgtggtgccaatccgcgccggtgaaaatatcgagtggacagtgaagtaa

SEQ ID NO: 27865 - protein, 342 aa, Vibrio cholerae
MTTLTITRPDDWHVHLRDGDVLADTVRDISRYNGRALIMPNTVPPVTTTEMALAYRERIMAAQPQAHFEPLMALYLTDNTSPEEIRKAKASGKVVAAKLYPAGATTNSDSGVTSAKNIYPVLQAMQEVGMLLLVHGEVTTHEVDIFDREKTFLDTVLAPIVNDFPQLKIVLEHITTADAVTFVQQAGDNVAATITAHHLLFNRNHMLVGGIRPHFYCLPILKRATHQHALVAAATSGSKKFFLGTDSAPHAKGRKEAACGCAGSYTAHAALELYAEVFEKEGKLENLEAFASFNGPDFYGLPRNQETVTLTKQAWPVAESMPFGSDIVVPIRAGENIEWTVK

SEQ ID NO: 27866 - DNA, 1029 bp, Vibrio parahaemolyticus
  CDS (1)..(1029): transl_table=11
atgacaacactgactattactcgtcctgacgactggcacgttcacttacgcgatggtgaagttctaaaagacaccgttcgcgatatcagccgctacaatggccgcgcgctgatcatgccaaacaccgtcccacctgttaccaataccgaaatggcacttgcctaccgcgatcgaattctgaaagagcagcacggcgaacaattcgaacctctgatggcgctttacctaaccgataacaccacgccagaagagattcgcgcagcaaaagcaaccggtaaaattgtcgcagcgaagctttacccagcaggtgcaacgactaactcagattctggtgtgaccgatgcgaagaacatttaccacgttctcgaagccatggaagaagtcgggatgttgcttttggttcatggagaagtcacccatcaccacgttgatatcttcgaccgagaaaaagaattccttgataccgtcctcgctcctatcgttaatgacttcccaaatcttaaaatcgttctagaacatatcaccaccgccgacgcagcacagttcgttaacaacgcgtctgataatgttgccgctaccattactgctcaccaccttcttttcaaccgcaatcacatgcttgtcggtggcattaagcctcatttctactgcttaccgattctaaagcgcaacacccaccagcaagcgctaatcgaagccgcaaccagtggtagcaagaagtttttcctaggtaccgactctgctccgcatgcaaaaggcgcgaaagaatcggcttgcggttgtgccggttcttacactgcgcacgcggcgttagaactttatgcagaagtctttgaaaaagaaggcaagctggaaaacttggaagcgttcgcaagcttcaacggtcctgatttttacggtattgcgcgcaacgcagatacggtgacgctagaaaaatcggcttgggatgttcctgaatctatgccatttggcaacgacatcgttgtgcctattcgtgcaaacgaacaaattgagtggaaagtgaagtaa

SEQ ID NO: 27867 - protein, 342 aa, Vibrio parahaemolyticus
MTTLTITRPDDWHVHLRDGEVLKDTVRDISRYNGRALIMPNTVPPVTNTEMALAYRDRILKEQHGEQFEPLMALYLTDNTTPEEIRAAKATGKIVAAKLYPAGATTNSDSGVTDAKNIYHVLEAMEEVGMLLLVHGEVTHHHVDIFDREKEFLDTVLAPIVNDFPNLKIVLEHITTADAAQFVNNASDNVAATITAHHLLFNRNHMLVGGIKPHFYCLPILKRNTHQQALIEAATSGSKKFFLGTDSAPHAKGAKESACGCAGSYTAHAALELYAEVFEKEGKLENLEAFASFNGPDFYGIARNADTVTLEKSAWDVPESMPFGNDIVVPIRANEQIEWKVK

SEQ ID NO: 27868 - DNA, 1029 bp, Vibrio vulnificus
  CDS (1)..(1029)
atgacaacacttactattactcgtcctgatgattggcacgtacacttgcgcgatggcgaagttttggcagataccgttcgtgatatcagccgttacaatggccgcgcactcatcatgccaaacactgtcccacccgtcaccacgtctgaaatggcgcttgcctatcgcgatcgcattcaagcacataaccaaacagaacaattttctccgcttatgtcgctgtatttgaccgacaacacaactgcggatgaagtacgcaaagccaaggccagcggtgctgtggtcgcagcaaaactgtatccagcaggcgcgacaactaactccgattctggcgtgacggatgtaaagaaaatttatccagtccttcaagccatgcaagaagtgggcatgttgctactggtacacggcgaagtgaccacacacgatgtggacatctttgatcgcgaaaaaacctttttagacaatgtgttggcgccgattgttcaagacttccctgatttgaaaattgtcctcgaacacatcaccacctcagatgcggttgtgtttgtgaaaaatgccaatgaaaacgttgccgcaaccattaccgctcatcacctgctgtacaaccgcaatcacatgttagtaggcggcatcaagccccacttctactgcttgccaattcttaaacgcaacacccaccagcttgcgttgatctctgctgcgacgagtggcaacaagaagttctttttgggtacggactctgcgccacacgccaaaggcgcaaaagaatccgcttgtggttgcgcgggctcttacacggctcacgccgctgtggaactgtatgcagaagtgtttgagcaagcgggcaagttggaaaatctcgaagcgtttgccagccataacggcccggatttttacggtcttcctcgtaaccaagatacgatcactttggtcaaagacgcatggcctgttcctgcttcaatgccatttggtggtgatattgtggtgccaattcgcgctggtgaaaacatggagtggaaggttaagtaa

SEQ ID NO: 27869 - protein, 342 aa, Vibrio vulnificus
MTTLTITRPDDWHVHLRDGEVLADTVRDISRYNGRALIMPNTVPPVTTSEMALAYRDRIQAHNQTEQFSPLMSLYLTDNTTADEVRKAKASGAVVAAKLYPAGATTNSDSGVTDVKKIYPVLQAMQEVGMLLLVHGEVTTHDVDIFDREKTFLDNVLAPIVQDFPDLKIVLEHITTSDAVVFVKNANENVAATITAHHLLYNRNHMLVGGIKPHFYCLPILKRNTHQLALISAATSGNKKFFLGTDSAPHAKGAKESACGCAGSYTAHAAVELYAEVFEQAGKLENLEAFASHNGPDFYGLPRNQDTITLVKDAWPVPASMPFGGDIVVPIRAGENMEWKVK

SEQ ID NO: 27870 - DNA, 1029 bp, Vibrio vulnificus
  CDS (1)..(1029)
atgacaacacttactattactcgtcctgatgattggcacgtacacttacgcgatggcgaagttttggcagataccgttcgcgatatcagccgttacaatggccgcgcactcatcatgccaaacactgtcccacccgtcaccacgactgaaatggcgcttgcctatcgcgatcgcattcaagcacataaccaaacagaacaattttctccgcttatgtcgctatatttgaccgacaacacaactgcggatgaagtacgcaaagccaaggccagcggtgctgtagtcgcagcaaaactgtacccagcaggcgcgacaactaactccgattctggcgtgacggatgtaaagaaaatttatccagtccttcaagcgatgcaagaagtaggcatgttgctactggtacacggcgaagtgaccacacacgatgtggacatctttgatcgcgaaaaaacctttttagacaatgtgttggcgccgattgttcaagacttccctgatttgaaaattgtcctcgaacacatcaccacctcagatgcggttgtgtttgtgaaaaatgccaatgaaaacgttgccgcaaccattaccgctcatcacctgctgtacaaccgcaatcacatgttagtaggcggcatcaagccccacttctactgcttgccaattcttaaacgcaacacccaccagcttgcgttgatctctgctgcgacgagtggcaacaagaagttctttttgggtacggactctgcgccacacgccaaaggcgcaaaagaatccgcttgtggttgcgcgggctcttacacggctcacgccgctttggaactgtatgcagaagtgtttgagcaagcgggcaagttggaaaatctcgaagcgtttgccagccataacggtccagatttttacggtttgcctcgcaatcaagacacaattacgttggtaaaagacgcatggcctgttcctgcttcaatgccatttggtggtgatattgtggtgccaattcgcgctggtgaaaacatggagtggaaggttaagtaa

SEQ ID NO: 27871 - protein, 342 aa, Vibrio vulnificus
MTTLTITRPDDWHVHLRDGEVLADTVRDISRYNGRALIMPNTVPPVTTTEMALAYRDRIQAHNQTEQFSPLMSLYLTDNTTADEVRKAKASGAVVAAKLYPAGATTNSDSGVTDVKKIYPVLQAMQEVGMLLLVHGEVTTHDVDIFDREKTFLDNVLAPIVQDFPDLKIVLEHITTSDAVVFVKNANENVAATITAHHLLYNRNHMLVGGIKPHFYCLPILKRNTHQLALISAATSGNKKFFLGTDSAPHAKGAKESACGCAGSYTAHAALELYAEVFEQAGKLENLEAFASHNGPDFYGLPRNQDTITLVKDAWPVPASMPFGGDIVVPIRAGENMEWKVK

SEQ ID NO: 27872 - DNA, 1095 bp, Saccharomyces cerevisiae
  CDS (1)..(1095)
atggtacaagaaatcgatttaggtttgacatgtgatatgcatgttcatgtaagagagggtgcgatgtgtgaactagtcacccccaagattagagatggtggggtttcaattgcttacatcatgccaaatttacaacctccaattaccacactagatagagtgattgaatacaaaaagacactgcagaaactagctcctaaaactaccttcttaatgagtttttatctttcaaaagacttaactccagatttaattcatgaagctgcccaacaacatgccattcgtggagtaaagtgttatccagcgggagtaacaacaaattcggctgctggggtggatccaaatgacttcagcgcattttacccaattttcaaggctatgcaagaagagaacctggtattaaatttgcatggggaaaaaccttctgtccatgatggagacaaagaacctattcatgtattgaatgcagaggaagcctttttgccagccttgaaaaaattgcataatgatttcccaaacctgaaaataattctggaacactgcactagcgagtcggcaataaagacaatcgaggatataaataagaacgtgaagaaagccactgacgtaaaggttgctgccacattaacggctcatcacttatttttaacaattgatgattgggccggaaatccggtaaatttttgcaaacctgttgcgaaacttccaaatgacaaaaaggctctagtcaaagctgctgtatcagggaaaccatattttttctttggatctgattcagcacctcatcctgtacaaaataaggccaattacgagggtgtttgcgcaggagtttactcacaatcttttgcgatcccttatatcgcccaagtttttgaagagcaaaatgccttggagaacttaaagggctttgtttccgacttcggaatttccttttatgaggttaaagatagcgaagtggcttcttcagataaggcaatattattcaaaaaagaacaagttatccctcaggttatcagcgatggcaaagacataagcatcatcccatttaaagcaggtgataaactaagttggtcggtgagatgggaacctcgttaa

SEQ ID NO: 27873 - protein, 364 aa, Saccharomyces cerevisiae
MVQEIDLGLTCDMHVHVREGAMCELVTPKIRDGGVSIAYIMPNLQPPITTLDRVIEYKKTLQKLAPKTTFLMSFYLSKDLTPDLIHEAAQQHAIRGVKCYPAGVTTNSAAGVDPNDFSAFYPIFKAMQEENLVLNLHGEKPSVHDGDKEPIHVLNAEEAFLPALKKLHNDFPNLKIILEHCTSESAIKTIEDINKNVKKATDVKVAATLTAHHLFLTIDDWAGNPVNFCKPVAKLPNDKKALVKAAVSGKPYFFFGSDSAPHPVQNKANYEGVCAGVYSQSFAIPYIAQVFEEQNALENLKGFVSDFGISFYEVKDSEVASSDKAILFKKEQVIPQVISDGKDISIIPFKAGDKLSWSVRWEPR

SEQ ID NO: 27874 - DNA, 1047 bp, Yersinia pestis
  CDS (1)..(1047): transl_table=11
atgactgcacaaccccaaaccctaaaaattcgccgcccggatgactggcacattcatctacgtgatgatgaaatgctcagtaccgtgttgccctatacctccgaagtattcgcccgcgctattgttatgccaaatctagcccagccaattacaacggttgccagtgctattgcttatcgggagcgtattttagcagcggttcctgcgggccataaattcaccccgttgatgacgtgttacctgactaatagccttgatgctaaagagttgaccacgggttttgagcaaggcgtttttaccgcggccaaactgtatccggccaatgccaccaccaactccactcacggtgtatctgacatcccggcaatttacccgttgtttgaacaaatgcaaaagataggcatgcccctgcttattcacggtgaggtaacagatgcggccgttgacatctttgatcgtgaagcccgttttattgaccaaattttagagcccattcgccaaaagtttcccgaactaaaaattgtctttgagcatatcacgaccaaagatgcggcagattatgtgctggcaggcaatcgtttccttggggcaaccgtcacgccacaacacttgatgtttaaccgcaatcacatgctggtaggcggtattcgcccccacttgttctgcctgccaatattgaagcgcagcacccatcagcaagcattgcgcgcagccgtcgccagtggttctgatcgcttcttccttgggaccgattcagctccccatgccaaacatcgtaaagagtcatcttgcggctgtgcgggtgtattcaacgccccagcggcattgcctgcttatgcttccgtgtttgaggaactgaatgcattgcaacatctggaagcgttttgcgccttaaatggcccacgattttatggcttgcctgttaatgatgacgttgttgaattggttcgcactccattcctgcagccagaagagatcccattaggcaatgaatcggttattcctttccttgcgggtcaaacgcttaattggtcagtgaaacgctaa

SEQ ID NO: 27875 - protein, 348 aa, Yersinia pestis
MTAQPQTLKIRRPDDWHIHLRDDEMLSTVLPYTSEVFARAIVMPNLAQPITTVASAIAYRERILAAVPAGHKFTPLMTCYLTNSLDAKELTTGFEQGVFTAAKLYPANATTNSTHGVSDIPAIYPLFEQMQKIGMPLLIHGEVTDAAVDIFDREARFIDQILEPIRQKFPELKIVFEHITTKDAADYVLAGNRFLGATVTPQHLMFNRNHMLVGGIRPHLFCLPILKRSTHQQALRAAVASGSDRFFLGTDSAPHAKHRKESSCGCAGVFNAPAALPAYASVFEELNALQHLEAFCALNGPRFYGLPVNDDVVELVRTPFLQPEEIPLGNESVIPFLAGQTLNWSVKR

SEQ ID NO: 27876 - DNA, 23 bp, Artificial sequence
  (1)..(23): primer
atgactgcaccatcccaggtatt

SEQ ID NO: 27877 - DNA, 24 bp, Artificial sequence
  (1)..(24): primer
ttattgtttaacggaccagcgtac

SEQ ID NO: 27878 - protein, 478 aa, Artificial sequence
  Variant (2)..(2): xaa in position 2 is any amino acid
  Variant (4)..(5): xaa in position 4 to 5 is any amino acid
  Variant (7)..(7): xaa in position 7 is any amino acid
  Variant (9)..(9): xaa in position 9 is any amino acid
  Variant (15)..(16): xaa in position 15 to 16 is any or no amino acid
  Variant (19)..(20): xaa in position 19 to 20 is any amino acid
  Variant (22)..(33): xaa in position 22 to 33 is any amino acid
  Variant (34)..(41): xaa in position 34 to 41 is any or no amino acid
  Variant (49)..(49): xaa in position 49 is any or no amino acid
  Variant (51)..(51): xaa in position 51 is any or no amino acid
  Variant (54)..(58): xaa in position 54 to 58 is any amino acid
  Variant (59)..(61): xaa in position 59 to 61 is any or no amino acid
  Variant (64)..(64): xaa in position 64 is any amino acid
  Variant (65)..(65): xaa in position 65 is any or no amino acid
  Variant (67)..(84): xaa in position 67 to 84 is any or no amino acid
  Variant (88)..(89): xaa in position 88 to 89 is any or no amino acid
  Variant (92)..(92): xaa in position 92 is any amino acid
  Variant (93)..(98): xaa in position 93 to 98 is any or no amino acid
  Variant (101)..(102): xaa in position 101 to 102 is any amino acid
  Variant (104)..(106): xaa in position 104 to 106 is any amino acid
  Variant (107)..(108): xaa in position 107 to 108 is any or no amino acid
  Variant (110)..(110): xaa in position 110 is any amino acid
  Variant (112)..(112): xaa in position 112 is any amino acid
  Variant (118)..(119): xaa in position 118 to 119 is any amino acid
  Variant (124)..(125): xaa in position 124 to 125 is any amino acid
  Variant (128)..(139): xaa in position 128 to 139 is any amino acid
  Variant (140)..(145): xaa in position 140 to 145 is any or no amino acid
  Variant (147)..(150): xaa in position 147 to 150 is any amino acid
  Variant (152)..(152): xaa in position 152 is any amino acid
  Variant (154)..(154): xaa in position 154 is any amino acid
  Variant (159)..(161): xaa in position 159 to 161 is any amino acid
  Variant (162)..(181): xaa in position 162 to 181 is any or no amino acid
  Variant (183)..(185): xaa in position 183 to 185 is any amino acid
  Variant (187)..(188): xaa in position 187 to 188 is any amino acid
  Variant (191)..(192): xaa in position 191 to 192 is any amino acid
  Variant (193)..(203): xaa in position 193 to 203 is any or no amino acid
  Variant (205)..(206): xaa in position 205 to 206 is any amino acid
  Variant (208)..(211): xaa in position 208 to 211 is any amino acid
  Variant (213)..(213): xaa in position 213 is any amino acid
  Variant (218)..(218): xaa in position 218 is any amino acid
  Variant (224)..(225): xaa in position 224 to 225 is any amino acid
  Variant (227)..(229): xaa in position 227 to 229 is any amino acid
  Variant (231)..(235): xaa in position 231 to 235 is any amino acid
  Variant (236)..(244): xaa in position 236 to 244 is any or no amino acid
  Variant (246)..(246): xaa in position 246 is any or no amino acid
  Variant (251)..(252): xaa in position 251 to 252 is any amino acid
  Variant (255)..(260): xaa in position 255 to 260 is any amino acid
  Variant (262)..(264): xaa in position 262 to 264 is any amino acid
  Variant (265)..(265): xaa in position 265 is any or no amino acid
  Variant (267)..(288): xaa in position 267 to 288 is any or no amino acid
  Variant (290)..(290): xaa in position 290 is any or no amino acid
  Variant (293)..(293): xaa in position 293 is any amino acid
  Variant (296)..(296): xaa in position 296 is any amino acid
  Variant (298)..(303): xaa in position 298 to 303 is any amino acid
  Variant (306)..(310): xaa in position 306 to 310 is any amino acid
  Variant (311)..(311): xaa in position 311 is any or no amino acid
  Variant (314)..(315): xaa in position 314 to 315 is any amino acid
  Variant (317)..(317): xaa in position 317 is any amino acid
  Variant (319)..(319): xaa in position 319 is any amino acid
  Variant (327)..(330): xaa in position 327 to 330 is any amino acid
  Variant (332)..(364): xaa in position 332 to 364 is any or no amino acid
  Variant (367)..(367): xaa in position 367 is any amino acid
  Variant (369)..(369): xaa in position 369 is any amino acid
  Variant (371)..(373): xaa in position 371 to 373 is any amino acid
  Variant (375)..(375): xaa in position 375 is any amino acid
  Variant (376)..(390): xaa in position 376 to 390 is any or no amino acid
  Variant (393)..(395): xaa in position 393 to 395 is any amino acid
  Variant (396)..(396): xaa in position 396 is any or no amino acid
  Variant (398)..(399): xaa in position 398 to 399 is any amino acid
  Variant (401)..(402): xaa in position 401 to 402 is any amino acid
  Variant (404)..(404): xaa in position 404 is any amino acid
  Variant (406)..(407): xaa in position 406 to 407 is any amino acid
  Variant (409)..(410): xaa in position 409 to 410 is any amino acid
  Variant (413)..(413): xaa in position 413 is any amino acid
  Variant (415)..(420): xaa in position 415 to 420 is any amino acid
  Variant (421)..(426): xaa in position 421 to 426 is any or no amino acid
  Variant (428)..(428): xaa in position 428 is any amino acid
  Variant (430)..(430): xaa in position 430 is any amino acid
  Variant (432)..(441): xaa in position 432 to 441 is any amino acid
  Variant (442)..(466): xaa in position 442 to 466 is any or no amino acid
  Variant (468)..(468): xaa in position 468 is any amino acid
  Variant (470)..(472): xaa in position 470 to 472 is any amino acid
  Variant (474)..(475): xaa in position 474 to 475 is any amino acid
  Variant (477)..(477): xaa in position 477 is any amino acid
LXIXXPXDXHLHLRXXDGXXLXXXXXXXXXXXXXXXXXXXXAIVMPNLXPXPVXXXXXXXXYRXXIXXXXXXXXXXXXXXXXXXPLMXXYLXXXXXXXEIXXAXXXXXVXAXKLYPAXXTTNSXXGVXXXXXXXXXXXXXXXXXXMXXXXMXLXVHGEXXXXXXXXXXXXXXXXXXXXXXXIXXXEXXFIXXXXXXXXXXXXXLXXLXXXXPXLKIVXEHITTXXAXXXVXXXXXXXXXXXXXXVXATITXXHLXXXXXXMXXXXIXXXXXXXXXXXXXXXXXXXXXXHXYCXPIXKXXXXXXALXXXXXXSGXXKXFXGTDSAPHXXXXKXXXXXXXXXXXXXXXXXXXXXXXXXXXXXXXXXAGXYXAXXXLXXXXXXXXXXXXXXXXFEXXXXLXXLXXFXSXXGXXFYXLXXXXXXXXXXXXIXLXKXXXXXXXXXXXXXXXXXXXXXXXXXXXXXXXXXXXVXPXXXGXXLXW

SEQ ID NO: 27879 - protein, 17 aa, Artificial sequence
  Variant (2)..(3): xaa in position 2 to 3 is any amino acid
  Variant (4)..(5): xaa in position 4 to 5 is any or no amino acid
  Variant (7)..(7): xaa in position 7 is any amino acid
  Variant (8)..(9): xaa in position 8 to 9 is any or no amino acid
  Variant (11)..(11): xaa in position 11 is any amino acid
  Variant (13)..(13): xaa in position 13 is any amino acid
  Variant (15)..(15): xaa in position 15 is Phe, Leu or Val
  Variant (17)..(17): xaa in position 17 is Asp, Glu or Gln
LXXXXPXXXDXHXHXRX

SEQ ID NO: 27880 - protein, 25 aa, Artificial sequence
  Variant (2)..(3): xaa in position 2 to 3 is any amino acid
  Variant (4)..(4): xaa in position 4 is any or no amino acid
  Variant (8)..(10): xaa in position 8 to 10 is any amino acid
  Variant (12)..(12): xaa in position 12 is Ala, Ile, Leu or Val
  Variant (13)..(20): xaa in position 13 to 20 is any amino acid
  Variant (22)..(24): xaa in position 22 to 24 is any amino acid
  Variant (25)..(25): xaa in position 25 is Ile or Leu
AXXXMPNXXXPXXXXXXXXXYXXXX

SEQ ID NO: 27881 - protein, 8 aa, Artificial sequence
  Variant (2)..(2): xaa in position 2 is any or no amino acid
  Variant (4)..(5): xaa in position 4 to 5 is any or no amino acid
LXLXXHGE

SEQ ID NO: 27882 - protein, 41 aa, Artificial sequence
  Variant (2)..(2): xaa in position 2 is any amino acid
  Variant (4)..(4): xaa in position 4 is Ile, Leu or Val
  Variant (5)..(5): xaa in position 5 is Ala, Leu, Pro or Val
  Variant (7)..(9): xaa in position 7 to 9 is any amino acid
  Variant (10)..(10): xaa in position 10 is Asp or His
  Variant (11)..(12): xaa in position 11 to 12 is any amino acid
  Variant (13)..(13): xaa in position 13 is Ala, Ser, Thr or Val
  Variant (15)..(17): xaa in position 15 to 17 is any amino acid
  Variant (18)..(18): xaa in position 18 is Ala, Ile or Val
  Variant (19)..(19): xaa in position 19 is any amino acid
  Variant (20)..(20): xaa in position 20 is Ala, Asp, Glu, Gly, Asn, Gln, Ser or Thr
  Variant (22)..(24): xaa in position 22 to 24 is any amino acid
  Variant (25)..(26): xaa in position 25 to 26 is any or no amino acid
  Variant (28)..(29): xaa in position 28 to 29 is any or no amino acid
  Variant (31)..(31): xaa in position 31 is Ser or Thr
  Variant (33)..(33): xaa in position 33 is Ser or Thr
  Variant (37)..(40): xaa in position 37 to 40 is any amino acid
CXPXXKXXXXXXXLXXXXXXGXXXXXFXXGXDXAPHXXXXK

SEQ ID NO: 27883 - DNA, 1251 bp, Escherichia coli
  CDS (1)..(1251)
atggaaagtaaagtagttgttccggcacaaggcaagaagatcaccctgcaaaacggcaaactcaacgttcctgaaaatccgattatcccttacattgaaggtgatggaatcggtgtagatgtaaccccagccatgctgaaagtggtcgacgctgcagtcgagaaagcctataaaggcgagcgtaaaatctcctggatggaaatttacaccggtgaaaaatccacacaggtttatggtcaggacgtctggctgcctgctgaaactcttgatctgattcgtgaatatcgcgttgccattaaaggtccgctgaccactccggttggtggcggtattcgctctctgaacgttgccctgcgccaggaactggatctctacatctgcctgcgtccggtacgttactatcagggcactccaagcccggttaaacaccctgaactgaccgatatggttatcttccgtgaaaactcggaagacatttatgcgggtatcgaatggaaagcagactctgccgacgccgagaaagtgattaaattcctgcgtgaagagatgggggtgaagaaaattcgcttcccggaacattgtggtatcggtattaagccgtgttcggaagaaggcaccaaacgtctggttcgtgcagcgatcgaatacgcaattgctaacgatcgtgactctgtgactctggtgcacaaaggcaacatcatgaagttcaccgaaggagcgtttaaagactggggctaccagctggcgcgtgaagagtttggcggtgaactgatcgacggtggcccgtggctgaaagttaaaaacccgaacactggcaaagagatcgtcattaaagacgtgattgctgatgcattcctgcaacagatcctgctgcgtccggctgaatatgatgttatcgcctgtatgaacctgaacggtgactacatttctgacgccctggcagcgcaggttggcggtatcggtatcgcccctggtgcaaacatcggtgacgaatgcgccctgtttgaagccacccacggtactgcgccgaaatatgccggtcaggacaaagtaaatcctggctctattattctctccgctgagatgatgctgcgccacatgggttggaccgaagcggctgacttaattgttaaaggtatggaaggcgcaatcaacgcgaaaaccgtaacctatgacttcgagcgtctgatggatggcgctaaactgctgaaatgttcagagtttggtgacgcgatcatcgaaaacatgtaa

SEQ ID NO: 27884 - protein, 416 aa, Escherichia coli
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLLKCSEFGDAIIENM

SEQ ID NO: 27885 - DNA, 1218 bp, Thermoplasma volcanium GSS1
  CDS (1)..(1218): transl_table=11
atggcatacatacaggtgagagaggatggaacacttctcgttcctgacaaagttacgataggctacattgagggggatggtataggccccgatatcacgaagaccacgataaatgtaataaatgctgcccttgaggtcgcctatggtggaaagagatcaatagaatggcacaaagtccttgcgggcgatgaagcatatgataagactggaaataggcttccagattcttcgctcgaagagcttaagaagtgcgttgtttcaataaagggcccgctcactactcctattggcgaagggtttaggagcctcaacgtcacgctcaggcagtaccttgatctgtatgctaacataaggcccgtccgttacttccctggagtcccatctcctgttctccatccggaatacatgaacatggttgtcttcagagaaaatactgaggatctttacgctggcattgagtggaggtatgattctgaggacgcggaaaaggttagggcttttctatcatctacattcaacataaatcttacgccagatacgggcataggcataaagcctataagcaagttcaagtcgacaaggttggtgcggaaggcgatacagtatgcaatagctaacggcaggaagagtgttacgctagtccacaaaggaaatataatgaagtacacagagggtgcattcagggactggggctatgaggtagccagaactgagtttggggattataccgtaacggaagccgaatacctgaaagaccctgagaaatacgcaaacaagatagtgataaaggacagaatcacggacaatatgttccagcaggtccttacaagaacccaggaatacgacgttattgctactccgaacttgaacggagactacctttccgatgccctcgctgcccaagttggtggaataggccttgccccaggagcaaacataggcgaccactatgctgtattcgaagcggttcacggtacagctccaaagtatgccggcctagacgttgcaaatccaacttccttgatactgtcagcggagatgatgctcgatcacataggctggaaggaagcatccaagatactcgatgatgctataatgcagacgtaccgcgaccaaaaattgacacaggatatagccaggctccttaatctaaaggccctaaaatgctctgagtttggcgaagaaataatcaacaggatgaagcctataaaaagctaa

SEQ ID NO: 27886 - protein, 405 aa, Thermoplasma volcanium GSS1
MAYIQVREDGTLLVPDKVTIGYIEGDGIGPDITKTTINVINAALEVAYGGKRSIEWHKVLAGDEAYDKTGNRLPDSSLEELKKCVVSIKGPLTTPIGEGFRSLNVTLRQYLDLYANIRPVRYFPGVPSPVLHPEYMNMVVFRENTEDLYAGIEWRYDSEDAEKVRAFLSSTFNINLTPDTGIGIKPISKFKSTRLVRKAIQYAIANGRKSVTLVHKGNIMKYTEGAFRDWGYEVARTEFGDYTVTEAEYLKDPEKYANKIVIKDRITDNMFQQVLTRTQEYDVIATPNLNGDYLSDALAAQVGGIGLAPGANIGDHYAVFEAVHGTAPKYAGLDVANPTSLILSAEMMLDHIGWKEASKILDDAIMQTYRDQKLTQDIARLLNLKALKCSEFGEEIINRMKPIKS

SEQ ID NO: 27887 - DNA, 1308 bp, Aeropyrum pernix K1
  CDS (1)..(1308): transl_table=11
gtgcaggttatggcttcccctccttgcactaccgaggagctctcgcctcccccagggggttctctagtcgagtatagcggcggcagccttagggtccccgataaccctgttgttgcgttcataaggggcgacggcgtgggccccgaggttgttgagagcgctctaaaggttgtggacgccgccgtgaagaaggtttacggggggtctaggaggatagtctggtgggagctcctggctggccatctcgcccgggagaagtgcggcgagctgcttcccaaggcgacgctggagggtataaggcttgccagggtcgcgctcaaggggcccttggagactcccgtgggcacgggctatagaagccttaacgtggctatacgccaggcgctagacctctacgctaacataaggcctgtgaggtactacggccagccagccccccacaagtatgcggatagggttgacatggtgatattcagggagaacacggaggacgtgtacgccggtatagagtggcctcatgacagccctgaggctgcgaggattaggaggttcctcgcagaggagttcgggatatcgataagggaggacgccggcataggggttaagccgataagcaggtttgcaactaggcgtcttatggagagggctctcgagtgggccctcaggaacggcaacacagtagtcactataatgcacaagggcaacataatgaagtacactgaaggggctttcatgaggtgggcctatgaggtggcgctggagaagtttagggagcatgtggttacggagcaggaggtccaggagaagtatgggggggttaggcccgagggcaagatacttgttaacgacaggatagccgacaacatgctgcagcagattataaccaggccctgggactaccaggtcatagtggcgccaaacctcaacggcgactacataagcgacgctgcgagcgccctcgtcggaggcataggcatggccgcggggatgaacatgggcgacggcatagctgtcgccgagccggttcacggcaccgcgccgaagtacgcgggcaaggacctgataaacccctccgcggagatactgagcgcctcactactgataggagagttcatgggctggagggaggtgaagagcatagtagagtatgccattaggaaggcggtgcagagcaagaaggtcacccaggacctggccaggcacatgcccggggtccagccgctgaggacaagcgagtacacggagacgctgatagcatacatagacgaggcggacctgaacgaggtcctcgccgggaagaggggctag

SEQ ID NO: 27888 - protein, 435 aa, Aeropyrum pernix K1
MQVMASPPCTTEELSPPPGGSLVEYSGGSLRVPDNPVVAFIRGDGVGPEVVESALKVVDAAVKKVYGGSRRIVWWELLAGHLAREKCGELLPKATLEGIRLARVALKGPLETPVGTGYRSLNVAIRQALDLYANIRPVRYYGQPAPHKYADRVDMVIFRENTEDVYAGIEWPHDSPEAARIRRFLAEEFGISIREDAGIGVKPISRFATRRLMERALEWALRNGNTVVTIMHKGNIMKYTEGAFMRWAYEVALEKFREHVVTEQEVQEKYGGVRPEGKILVNDRIADNMLQQIITRPWDYQVIVAPNLNGDYISDAASALVGGIGMAAGMNMGDGIAVAEPVHGTAPKYAGKDLINPSAEILSASLLIGEFMGWREVKSIVEYAIRKAVQSKKVTQDLARHMPGVQPLRTSEYTETLIAYIDEADLNEVLAGKRG

SEQ ID NO: 27889 - DNA, 1104 bp, Arabidopsis thaliana
  CDS (1)..(1104)
atgtctcgccaatcgttttctctactgaagaatcttcgtagcatcgcttccggttccaaaatccagacccgatccgtgacttacatgcccagacccggtgacggaaaaccaagaccagtgacgttaatccccggagacggagttggtccgttggtaacaaacgcggttcaacaagtgatggaagcgatgcacgctccggtttacttcgaaccgttcgaagttcatggagatatgaagagtttacctgaaggattgttggaatcgattaagaagaacaaagtttgtttgaaaggtggtcttaagactcccgtcggtggtggtgtgagctctctcaatgttaatctgagaaaggagcttgatctctttgcttctttggtcaactgtttcaatttgcctggtttagcttctcgtcatgagaatgttgatattgttgtgattagagagaacactgaaggtgaatatgcaggtcttgaacatgaagttgttcctggtgttgttgagagccttaaggtgattacaaagttctgttcagagcgtattgcaaagtatgcgtttgagtatgcctacttgaacaacaggaagaaagttacagcagtgcacaaggctaatatcatgaaattggctgatggtttgttcttggagtcttgtcaagaggttgctaagaagtatccaagcattgcttacaatgaaatcattgttgataattgttgtatgcaacttgtggctagaccagagcaattcgatgtcatggtgacgcctaatctctatggtaatctagtggcaaacactgctgctggtattgctggaggtactggagtcatgcctggaggaaatgttggggcggagtatgcggtctttgagcaaggtgcatcagcgggaaacgtggggaaggatacaacggaagagcaaaagaatgcaaaccctgtggctttgttgctgtcatcagccatgatgcttagacaccttcagttcccttcttttgctgacaggcttgaaaccgctgtgaagcgtgttatcgctgaagggaattgtcggactgaagatcttggtggaaacagtaccactcaagaggtcgttgacgctgtcattgcaaatttggattga

SEQ ID NO: 27890 - protein, 367 aa, Arabidopsis thaliana
MSRQSFSLLKNLRSIASGSKIQTRSVTYMPRPGDGKPRPVTLIPGDGVGPLVTNAVQQVMEAMHAPVYFEPFEVHGDMKSLPEGLLESIKKNKVCLKGGLKTPVGGGVSSLNVNLRKELDLFASLVNCFNLPGLASRHENVDIVVIRENTEGEYAGLEHEVVPGVVESLKVITKFCSERIAKYAFEYAYLNNRKKVTAVHKANIMKLADGLFLESCQEVAKKYPSIAYNEIIVDNCCMQLVARPEQFDVMVTPNLYGNLVANTAAGIAGGTGVMPGGNVGAEYAVFEQGASAGNVGKDTTEEQKNANPVALLLSSAMMLRHLQFPSFADRLETAVKRVIAEGNCRTEDLGGNSTTQEVVDAVIANLD

SEQ ID NO: 27891 - DNA, 1104 bp, Arabidopsis thaliana
  CDS (1)..(1104)
atgtctcgcagatcgctaactctcctcaagaatctagctagaaacgcgaatggatcaggtattcaaacccgatccgtgacttacatgcccagacccggtgacggagcaccacgcgcagtgacgctgatccccggagatggaatcggtcctctggtgacgaacgccgtggaacaggtgatggaagcgatgcacgctccgatcttcttcgagaagtacgatgttcacggagaaatgagccgtgtgccgccggaagtgatggagtcgataaggaagaataaggtttgtttgaaaggtgggcttaagactcctgttggtggtggtgttagttctcttaacgtccagcttaggaaagagcttgacctctttgcttctctggtcaactgttttaatttgcctggtttacctactcgccatgagaatgttgacatcgttgtcatcagagagaacactgaaggtgagtacgcggggcttgagcacgaggttgttcctggtgtcgttgagagtctgaaggtgatcacgaagttctgttcggagcgtattgcaaagtatgcttttgagtatgcctacctgaacaacaggaagaaagttacagcggtgcataaggctaacatcatgaaacttgcggatggtttgttcttggaatcttgtcgcgaggttgcgaaaaagtatcccagcatcacctacaatgaaatcattgttgataactgctgtatgcaacttgtagccaaaccagagcaattcgatgtcatggtaacgccgaatctctatgggaatttagttgcaaacactgctgctggtattgctggaggcacaggagtcatgcctggaggaaatgttggggctgaccatgcggtattcgagcaaggtgcatcagcaggaaatgttgggaaagacaagatagtattggaaaacaaagcaaacccagtggcattgcttctctcatcagcgatgatgcttagacaccttcagtttccttcatttgctgaccggctcgaaacagcagtgaagaaagtcatcgctgaaggaaagtgccggacgaaagatcttggtggaacaagcacgactcaagaggtcgttgatgcggtcattgcaaaactagactga

SEQ ID NO: 27892 - protein, 367 aa, Arabidopsis thaliana
MSRRSLTLLKNLARNANGSGIQTRSVTYMPRPGDGAPRAVTLIPGDGIGPLVTNAVEQVMEAMHAPIFFEKYDVHGEMSRVPPEVMESIRKNKVCLKGGLKTPVGGGVSSLNVQLRKELDLFASLVNCFNLPGLPTRHENVDIVVIRENTEGEYAGLEHEVVPGVVESLKVITKFCSERIAKYAFEYAYLNNRKKVTAVHKANIMKLADGLFLESCREVAKKYPSITYNEIIVDNCCMQLVAKPEQFDVMVTPNLYGNLVANTAAGIAGGTGVMPGGNVGADHAVFEQGASAGNVGKDKIVLENKANPVALLLSSAMMLRHLQFPSFADRLETAVKKVIAEGKCRTKDLGGTSTTQEVVDAVIAKLD

SEQ ID NO: 27893 - DNA, 1107 bp, Arabidopsis thaliana
  CDS (1)..(1107)
atggcgagaagatccgtttcgatatttaatcgccttctggcgaatcctccttctccattcacatcactgtcccgatccatcacctacatgcctagacccggagatggagctccacgaaccgtaaccctaattcccggcgacggaatcggacctttggtgaccggtgcggtggaacaggtcatggaagcgatgcacgcgccagtgcatttcgagagatacgaggttctaggaaacatgagaaaagtccctgaagaagtgatcgagtctgtgaagagaaacaaggtttgtctcaaaggtggattagcgactcctgttggtgggggtgtcagttctttgaatatgcaattgaggaaagaactcgatatcttcgcttctcttgtcaattgcatcaatgtccctggattagtgacgcgacacgaaaatgttgatatcgttgtgataagagagaacactgaaggagagtactcaggtctcgagcatgaggttgttcctggtgttgtcgagagccttaaggtgataacaaagttttgttctgagagaatagcgagatatgcatttgagtatgcgtatctaaacaataggaagaaagtgactgctgttcataaagctaacattatgaagcttgcggatgggctcttccttgaatcttgtagagaggttgctaaacattattcggggattacttacaatgaaataatcgtagacaattgctgtatgcagcttgtcgccaagcctgagcaatttgatgtcatggtgacacctaatttgtatggtaaccttatagcaaacacggcggctggaatagccggtggcactggagtgatgccaggagggaatgttggtgcagaacatgcgatattcgagcaaggtgcatcagcagggaatgtggggaatgataagatggtggaacagaagaaagcgaatccggtggctctacttctctcgtcggctatgatgctaagacatctccggtttcctacttttgctgatcggcttgaaacagcagtgaaacaagtgattaaagaaggaaaatatagaacaaaagatcttggaggagattgtaccacgcaggaagttgttgatgctgtcatagcagctcttgagtga

SEQ ID NO: 27894 - protein, 368 aa, Arabidopsis thaliana
MARRSVSIFNRLLANPPSPFTSLSRSITYMPRPGDGAPRTVTLIPGDGIGPLVTGAVEQVMEAMHAPVHFERYEVLGNMRKVPEEVIESVKRNKVCLKGGLATPVGGGVSSLNMQLRKELDIFASLVNCINVPGLVTRHENVDIVVIRENTEGEYSGLEHEVVPGVVESLKVITKFCSERIARYAFEYAYLNNRKKVTAVHKANIMKLADGLFLESCREVAKHYSGITYNEIIVDNCCMQLVAKPEQFDVMVTPNLYGNLIANTAAGIAGGTGVMPGGNVGAEHAIFEQGASAGNVGNDKMVEQKKANPVALLLSSAMMLRHLRFPTFADRLETAVKQVIKEGKYRTKDLGGDCTTQEVVDAVIAALE

SEQ ID NO: 27895 - DNA, 1269 bp, Bacillus halodurans C-125
  CDS (1)..(1269): transl_table=11
atggcaaacggagagaaaattaaagtaagtgcaggggtacttgaagtaccaaacaatccaattatcccatttatcgaaggggatggaacaggtcctgatatttgggcggctgcacatcgggtgatcgatgcggctgtggagaaagcgtacaacggagaaaagaaaattgtctggaaagaaattttggcaggtgagaaagcgttcaatcaaacaggccaatggcttccagatgagacgcttgaaacgattcgcgagtatacaatcgctattaaaggaccgcttacgactccagttggaggaggcattcgttctttaaacgtggcattacgtcaagaacttgacctttatgtttgcttgcgtccagttcgttattttaatggggttccatctccagtcaaacgtccggaagatacgaacatggttattttccgtgaaaactctgaagacatctacgcaggaattgagtatcaggctggaacggatgaagtgaagaaagtaatcaacttcttacgggaagaaatgggcgttaagaaaattcgcttccctgaaacttctggtattggcatcaaacctgtttctcaagagggaacagaccgactagttcgtgcagcgattcaatatgcgattacagaaggacgtaagagcgtcaccctcgttcataaaggtaacattatgaagtttacagaaggtgcgttcaaaaactgggggtacgaagtagctgagcgcgagttcggtgataaagtattcacgtgggcacagtacgacaaaattgttgaagaacaaggaaaggaagctgcggataaagcgcaagcagaggcggaagcagcaggcaaaattatcgtcaaagattcaattgccgatattttcctccaacaaatcttaacgcgtccgaaagagttcgatgttgtagcaacaatgaacttgaacggtgactatatttccgatgcactcgcggctcaagtaggcggtatcggaattgcgccgggagcgaacattaactatgatacaggtcacgccatttttgaggccactcacggaacggcgccgaaatatgcaggcctcgacaaagtgaatccatcttctgtacttttatctggtgagctcatgcttcgtcaccttggttggaatgaagctgctgacttaattatggcttccatggacaaaacgatcgaaagtaaagttgtcacatacgactttgctcgattaatggatggggctacagaagtcaaatgctcagagtttgcgaatgaattgatcaagaacctttaa

SEQ ID NO: 27896 - protein, 422 aa, Bacillus halodurans C-125
MANGEKIKVSAGVLEVPNNPIIPFIEGDGTGPDIWAAAHRVIDAAVEKAYNGEKKIVWKEILAGEKAFNQTGQWLPDETLETIREYTIAIKGPLTTPVGGGIRSLNVALRQELDLYVCLRPVRYFNGVPSPVKRPEDTNMVIFRENSEDIYAGIEYQAGTDEVKKVINFLREEMGVKKIRFPETSGIGIKPVSQEGTDRLVRAAIQYAITEGRKSVTLVHKGNIMKFTEGAFKNWGYEVAEREFGDKVFTWAQYDKIVEEQGKEAADKAQAEAEAAGKIIVKDSIADIFLQQILTRPKEFDVVATMNLNGDYISDALAAQVGGIGIAPGANINYDTGHAIFEATHGTAPKYAGLDKVNPSSVLLSGELMLRHLGWNEAADLIMASMDKTIESKVVTYDFARLMDGATEVKCSEFANELIKNL

SEQ ID NO: 27897 - DNA, 1248 bp, Pasteurella multocida subsp. multocida str. Pm70
  CDS (1)..(1248): transl_table=11
atgcaatcaaaagtcgttatcccacaaggtgaaaaaattcaactggatgccaaaggagcattaattgtacctgatcatccgattatcccctttattgaaggcgatggtattggtgtggacgttaccccagcgatgcgcacagtcattgatgcggcggtggaaaaagcctatggcggcaaacgtaaaatttcgtggatggaaatctatgctggtggtaaagcaaatgaggtctatggcgaaaatacttggttacccgatgaaaccatgacatttatccgtgattatcatgtggcgattaaaggaccgcttatgacgccagtcggtggtggcattcgttccttgaatgtggcgatgcgtcaaggcttagatttatataattgcttacgtccaattcgttattatgacggtaccccaagccctgttaaacaccctgaattagtggacatggtgattttccgtgaaaactccgaagatatttatgcgggtgtagaatgggtggcaggatctgccgaagcgaataaagtgattgcgtttttacaacaagaaatgggggtgaaaaaaatccgtttcactgaagattgtggcattggtatcaaaccagtttctaaacaaggtacccaacgtttagttcgtgcggcactacaatatgtgattgataatgatcgcaaatcgcttactctagtgcacaaagggaacatcatgaaatttaccgaaggcgcattcaaagagtggggttatcaagtggcgcaagagtttggtgccgaattgctagatggtggtccatggatgacattaaaaaatccaaaaacaggcagagaaatcatcattaaagacagcattgccgatgcgtttttacaagaaattctgcttcacccaacggagtacgatgtgattgcgactttaaacctaaacggggattacatttctgacgcgttagccgcgcaggtggggggtatcgggatttcaccgggggcgaatattggtgcagaagctgcgatttttgaagccacccacggtaccgcaccaaaaattgcaggacaagataaaggtaatccgggttctttgattttgagtggtgaaatgatgttacgtcacttaggttggttagaagcggcggatttagtggtcaaagcagtatcgaaaaccattgctgataaaaccgttacctttgattttgctgaaatgttagaaggcgctaaattacgttccacttcggaatttgctcaagatattgtagcgaatatgtaa

SEQ ID NO: 27898 - protein, 415 aa, Pasteurella multocida subsp. multocida str. Pm70
MQSKVVIPQGEKIQLDAKGALIVPDHPIIPFIEGDGIGVDVTPAMRTVIDAAVEKAYGGKRKISWMEIYAGGKANEVYGENTWLPDETMTFIRDYHVAIKGPLMTPVGGGIRSLNVAMRQGLDLYNCLRPIRYYDGTPSPVKHPELVDMVIFRENSEDIYAGVEWVAGSAEANKVIAFLQQEMGVKKIRFTEDCGIGIKPVSKQGTQRLVRAALQYVIDNDRKSLTLVHKGNIMKFTEGAFKEWGYQVAQEFGAELLDGGPWMTLKNPKTGREIIIKDSIADAFLQEILLHPTEYDVIATLNLNGDYISDALAAQVGGIGISPGANIGAEAAIFEATHGTAPKIAGQDKGNPGSLILSGEMMLRHLGWLEAADLVVKAVSKTIADKTVTFDFAEMLEGAKLRSTSEFAQDIVANM

SEQ ID NO: 27899 - DNA, 1257 bp, Pseudomonas aeruginosa PAO1
  CDS (1)..(1257): transl_table=11
atgggataccaaaagatccaggtgccggcgaccggtgacaaaatcactgtgaatgccgacatgtccttgagcgtaccgaagaacccgatcatcccgttcatcgagggtgatggcatcggcgtcgatatcagcccggtcatgatcaaggttgtcgacgctgcagtggaaaaagcatacaagggcgagcgcaagatcgcctggatggaagtctacgccggcgagaaggccacccaggtctatgaccaggacacctggctgccccaggaaaccctggacgccgtacgcgactacgtggtttccatcaagggcccgctgaccaccccggtcggtggcggcatccgctccctgaacgtggccctgcgccagcaactcgatctctacgtctgccagcgcccggtacgctggttcgaaggcgtgcccagcccggtgaagaagcccggcgacgtggacatggtgatcttccgcgagaactccgaggacatctatgccggcgtcgagtggaaggccggttcgccggaagcggagaaggtcatcaagttcctcaccgaggaaatgggcgtcaagaagatccgcttcaccgagaactgcggcatcggcatcaagccggtttcccaggaaggcaccaagcgcctggtgcgcaaggccctgcaatacgccgtcgacaacgaccgcagttcggtgaccctggtgcacaagggcaacatcatgaagttcaccgagggtgccttcaaggattggggctacgaagtcgcgcgcgatgaattcggcgccgagctgctggacggcggtccgtggatgcagttcaagaatccgaagaccggcaagaacgtcgtggtcaaggacgtgatcgccgacgccatgttgcagcagatcctgctgcgccccgccgagtacgacgtgatcgccaccctgaacctgaacggcgactatctctccgacgccctggcggccgaggtcggcggcatcggcatcgcgcccggcgccaacctgtccgattcggtggccatgttcgaggcgacccacggcaccgcgccgaagtacgccggccaggacaaggtcaacccgggttcgctgatcctctccgcggagatgatgctgcgccacatgggttggaccgaggcggccgacctgatcatcaagggcaccaacggggcgatcgccgccaagaccgtgacctatgacttcgaacgcctgatggacggcgcgaccctgctgtcctgctcggagttcggcgacgcgatgattgccaagatgtag

SEQ ID NO: 27900 - protein, 418 aa, Pseudomonas aeruginosa PAO1
MGYQKIQVPATGDKITVNADMSLSVPKNPIIPFIEGDGIGVDISPVMIKVVDAAVEKAYKGERKIAWMEVYAGEKATQVYDQDTWLPQETLDAVRDYVVSIKGPLTTPVGGGIRSLNVALRQQLDLYVCQRPVRWFEGVPSPVKKPGDVDMVIFRENSEDIYAGVEWKAGSPEAEKVIKFLTEEMGVKKIRFTENCGIGIKPVSQEGTKRLVRKALQYAVDNDRSSVTLVHKGNIMKFTEGAFKDWGYEVARDEFGAELLDGGPWMQFKNPKTGKNVVVKDVIADAMLQQILLRPAEYDVIATLNLNGDYLSDALAAEVGGIGIAPGANLSDSVAMFEATHGTAPKYAGQDKVNPGSLILSAEMMLRHMGWTEAADLIIKGTNGAIAAKTVTYDFERLMDGATLLSCSEFGDAMIAKM

SEQ ID NO: 27901 - DNA, 1239 bp, Lactococcus lactis subsp. lactis Il1403
  CDS (1)..(1239): transl_table=11
atgaaaattgagatgaaaaatggaaaattagttgtgccagattatccagcaattggttatattagaggagatggtgttggcgaagatatttttcctcaggcgcaaaaagtttttgatgctgcggttctaaaaatttatggtcaaaaaaagaaaatagaatggcaaaaattattggcaggaggagaagcatttgagacttgtggagaatatctgcccaaagaaactctcgctcatattaatgaaaatttaattgcgataaagggaccactaatgaccccggtcggtgaaagctttcgttcaattaatgttactttaagacaaaaaatggatttatatgcttgcgtaagaccagttgaatattttaaagggataaaatccccagttaaggcgccagaaaaagttgacatgacaatttttcgagaaaatacagaagatatttatgcaggtattgaatttgctagtgaaacaaatgagtctcacaacttattaaaatttttagaaaaagaattgaatgtccattctattcgctttccaaaaacttcagcactaggaataaaacctgttagtcctgaaggaagtaaacgactggttaatgcggcttttgagtacgctctgaaaatgaacaaaaaaagagtgacctttgttcataagggaaatattatgaaatttactgaaggaggatttagaaattgggcctatgaggttgctagggaatatccaacttttacaaaactagaatacgatgaaatcaaaaatgaaagaggaagtttacaagctgaaaatgagaaaaaagcagcattaaaatcaggaaaaatttatgtagatgatgtaattgctgacaacttcctccaacagattattttaaatcctgaaaattttgaagtaattgccactcttaatttaaatggtgattatatttcagatgcacttgccgcacaggttggaggaattggaattgcaccaggagcgaatattaattataaaagcggtcatgctatttttgaagcaactcatggaacagctccagatatcgctggaaaaaatatagcaaatccttctagtctaattttatctggagtgatgatgtttgagtatttaggctggcaagaggtagctgaattaatcaaaattgctctttcattttcattcaggaatggaaatttgacagctgatttaggtggaaaactttcaacttcaaaattttccgacgttttaattgattttataaaaacatattaa

SEQ ID NO: 27902 - protein, 412 aa, Lactococcus lactis subsp. lactis Il1403
MKIEMKNGKLVVPDYPAIGYIRGDGVGEDIFPQAQKVFDAAVLKIYGQKKKIEWQKLLAGGEAFETCGEYLPKETLAHINENLIAIKGPLMTPVGESFRSINVTLRQKMDLYACVRPVEYFKGIKSPVKAPEKVDMTIFRENTEDIYAGIEFASETNESHNLLKFLEKELNVHSIRFPKTSALGIKPVSPEGSKRLVNAAFEYALKMNKKRVTFVHKGNIMKFTEGGFRNWAYEVAREYPTFTKLEYDEIKNERGSLQAENEKKAALKSGKIYVDDVIADNFLQQIILNPENFEVIATLNLNGDYISDALAAQVGGIGIAPGANINYKSGHAIFEATHGTAPDIAGKNIANPSSLILSGVMMFEYLGWQEVAELIKIALSFSFRNGNLTADLGGKLSTSKFSDVLIDFIKTY

SEQ ID NO: 27903 - DNA, 996 bp, Methanothermobacter thermautotrophicus str. Delta H
  CDS (1)..(996): transl_table=11
atgtacaggataacggtcatacccggtgatgggatcggagtggaggtgatggaggcagcccttcacgtcctccaggcccttgaaattgaatttgaattcacacatgcagaggcaggtaatgagtgcttcaggcgctgcggcgacacactgccggaggaaaccctgaagcttgtcaggaaggctgatgcaacactcttcggtgctgtgacgactgtgccaggacagaagagtgccataatcacattgaggcgtgagctggatctttttgcgaatttgaggccagttaagtccctgccaggtgtcccctgcctctacccggaccttgactttgttattgtgcgggagaacaccgaggacctctatgtcggtgacgaggagtacacccctgagggcgccgttgcaaaaagaatcataacaagaaccgcctccaggagaatcagccaattcgccttccagtacgcccagaaagagggcatgcaaaaggtaacagcagtccacaaggccaacgtgctcaaaaaaaccgacggaatcttcagagacgaattctataaagtggcatcagaatacccccagatggaggccaatgactactacgttgacgccacagcaatgtacctcataacccagccccaggaattccagaccatcgtcacaaccaacctattcggagacatactatcagacgaagccgcaggactcatcggaggactcggactcgcaccatcagcaaacataggagaaaaaaacgcactattcgaaccagtacacggatcagcaccccaaatcgcaggaaaaaacatagccaaccccacagccatgatactaacaaccacactaatgctaaaacacctcaacaaaaaacaagaagcccaaaaaatagaaaaagcactccaaaaaaccctcatgaggggtatcatgacaccggaccttgggggtactgccagtaccatggagatggcagaggccataaaagaggaaatagtaaaaggggagtag

SEQ ID NO: 27904 - protein, 331 aa, Methanothermobacter thermautotrophicus str. Delta H
MYRITVIPGDGIGVEVMEAALHVLQALEIEFEFTHAEAGNECFRRCGDTLPEETLKLVRKADATLFGAVTTVPGQKSAIITLRRELDLFANLRPVKSLPGVPCLYPDLDFVIVRENTEDLYVGDEEYTPEGAVAKRIITRTASRRISQFAFQYAQKEGMQKVTAVHKANVLKKTDGIFRDEFYKVASEYPQMEANDYYVDATAMYLITQPQEFQTIVTTNLFGDILSDEAAGLIGGLGLAPSANIGEKNALFEPVHGSAPQIAGKNIANPTAMILTTTLMLKHLNKKQEAQKIEKALQKTLMRGIMTPDLGGTASTMEMAEAIKEEIVKGE

SEQ ID NO: 27905 - DNA, 1269 bp, Halobacterium sp. NRC-1
  CDS (1)..(1269): transl_table=11
atgagctacgacaagatcgaagtccccgagggcggggcgaaagtcagctacgacgaggccgccgacgaactcgacgtccccgacaccccgatcatccccatcattcacggggacggcatcggcaaggacgtcggtcccatcgcccaggacgtgctgagcgcggccgccgaggccaccggccacgacatcgagtggatggaagtgtacgccggcgagtccgcccgggagatgtacgacgagaacctccccgaggagaccgtcgaggccatccgcgagcaccgcgtcgcgatcaaggggccgctcacgacgccggtcggtgccgggttccgcagcctcaacgtggcgctgcgccagacgcttgacctctacgcgaacgtgcggccgacctactacctggacggcgtcccgtcacccatgaaggcccccgaggagatggacatggtgaccttccgggagaacaccgaggacgtctacgcgggcatcgagtgggaggccggcaccgacgaggcggagcaggtgcgttcgttcgtcgaggacgagatggacttcgacgacgtgatgcacgacggcgacatcgggatcggcctcaagcccatctcggagaagggctccaagcgcttggtacgggaggccatcgactacgccatcgagaacgaccgtgacacggtcacgctcgtccacaagggcaacatcatgaagttcaccgaggggcagttcggtgactgggggatggaggtcgccgaggaggagtaccccgacgacgaggtgttcgccgcgcccgattcgctgtgggaggaacaggacgaggtcgacatcccggaggacgccgtcatggtcgaggagcgcctcgcggacgccatgctgcagtggatgcagctgcgcaccgacgagttcgacgtgctcgcgatgccgaacctcaacggcgactacctcagcgacgccgcgggcgcgcagatcggcggcctcggcatcgcgccgggcgcgaacttcggggcggggcggtgtctcgcggagccggtccacgggtccgcgccgaagcgcgccggccaggacaaggcgaacccgaccgcgctcatcctctcgggccgcctgctgttcgagtacatcggctgggacgacgccagcacgctcgtgcgcgacgccgtcgaggacaccatcgagtcgggcacggtcacctacgacctcgcgcgccagcgcgacgacgccgaggaagtgtccagcacgacgtacgccgaggccgtcatcgaccgcatcgaggacctcgcgtaa

SEQ ID NO: 27906 - protein, 422 aa, Halobacterium sp. NRC-1
MSYDKIEVPEGGAKVSYDEAADELDVPDTPIIPIIHGDGIGKDVGPIAQDVLSAAAEATGHDIEWMEVYAGESAREMYDENLPEETVEAIREHRVAIKGPLTTPVGAGFRSLNVALRQTLDLYANVRPTYYLDGVPSPMKAPEEMDMVTFRENTEDVYAGIEWEAGTDEAEQVRSFVEDEMDFDDVMHDGDIGIGLKPISEKGSKRLVREAIDYAIENDRDTVTLVHKGNIMKFTEGQFGDWGMEVAEEEYPDDEVFAAPDSLWEEQDEVDIPEDAVMVEERLADAMLQWMQLRTDEFDVLAMPNLNGDYLSDAAGAQIGGLGIAPGANFGAGRCLAEPVHGSAPKRAGQDKANPTALILSGRLLFEYIGWDDASTLVRDAVEDTIESGTVTYDLARQRDDAEEVSSTTYAEAVIDRIEDLA

SEQ ID NO: 27907 - DNA, 1008 bp, Xylella fastidiosa 9a5c
  CDS (1)..(1008): transl_table=11
atgacgcaaacaattacggtgatccgcggtgatggtatcggcccggaaatcatggatgccaccctgttggtattaaacacgttacaagcgaatctgaattacgaattcgcagatgcaggcttgaacgcacttgaaaagcacggagacttgctaccagaggccaccctgaattcaatcagcaagaacaaagttgcgctgaaaagcccgctcacgaccccggtaggtgaaggcttcagctcgatcaatgtcgccctgcgacgtaaattcgacttatatgccaacgttcggcctgcaaaatccttcccaaataccaagtcacgctttagcgataacgtagacctgatcaccgtacgggaaaataccgagggcgcctacctgagcgaaggtcaaaccatctctcctgacggagaagttgccacttccagcgcacgagtgacccgtaaagggtcggaacgcatcgtccgttacgcgttcgacttggcccgaacaacgggccgcaaaaaggtcaccgcagtacacaaagccaacatcattaaatcaacctctgggctgtttctgaaaaccgcccgagacgtcgcaagccagtacccagaaatcgatttccaagaaatgatcgtcgacaacgcttgcatgcaacttgtgatgcgcccagaacaattcgacatcattgtcaccaccaacttgttcggtgacatcctctcagatttgtgcgcaggcttggtcggcggtttaggcttggctccgggcgccaacattggtaatgaacaagccatcttcgaagccgtacatggctcggctccagacatcgctggacaaggtaaagccaatccatgcgcgctgctgctaggtgctgtacaaatgctggatcatatcggtcaaccacaaaacgccgaacgcctacgcaacgcaatcgtggccacactgaatgccaaagactcgctgactcccgacctggggggtaacggcaacaccatggaattcgccaaggcaattgccagcagactctaa

SEQ ID NO: 27908 - protein, 335 aa, Xylella fastidiosa 9a5c
MTQTITVIRGDGIGPEIMDATLLVLNTLQANLNYEFADAGLNALEKHGDLLPEATLNSISKNKVALKSPLTTPVGEGFSSINVALRRKFDLYANVRPAKSFPNTKSRFSDNVDLITVRENTEGAYLSEGQTISPDGEVATSSARVTRKGSERIVRYAFDLARTTGRKKVTAVHKANIIKSTSGLFLKTARDVASQYPEIDFQEMIVDNACMQLVMRPEQFDIIVTTNLFGDILSDLCAGLVGGLGLAPGANIGNEQAIFEAVHGSAPDIAGQGKANPCALLLGAVQMLDHIGQPQNAERLRNAIVATLNAKDSLTPDLGGNGNTMEFAKAIASRL

SEQ ID NO: 27909 - DNA, 1242 bp, Sulfolobus solfataricus P2
  CDS (1)..(1242): transl_table=11
ttgatgcaaaagataccagaagatggagaagtaattaaatttgaaaatgggaaatggattgtaccaaaaaagccaataattctgtatgttgaaggggatggaatagggcatgaaataacacatgctgctatgaaggttataaacaaagcagtggaaaaagcttatggatctgatagagaaattaagtgggtagaagttctagcaggagataaggcagaaaagctaaccggaaatagatttcctaaagagtcagaggaattgatagagaagtatagagtcttattaaaaggtcccctagaaacaccaataggcaaaggctggaaatccatcaatgtagcaattagattaatgttggatctttatgcaaatataagaccagtaaaatacattccaggtatagaaagtccaattaagaacgcagataagattgaccttataatatttagggaaaatactgatgatttgtacagaggaatagagtatccttatgacagtgaacaagcaaagaaaattagagattttctaagaaaggagctaggagtggaagtggaagatgatactggaattggtataaaacttatcagtagatttaagacgcaaaggattgcgagaatggctataaaatacgctatagaccataaacgaaagaaagttacaataatgcataaaggtaatgtgatgaaatataccgaaggagcatttagagaatggtcatatgaagttgcaacaaaagaatttagagattatatagttactgaggaagaggtaacaaagaattataatggagtacctccttctgggaaggtcataataaatgataggatagctgataacatgttccaacagataattatcagaccagacgagtacgatataatattagcacctaacgtaaatggggattacatatcggatgctgcgggcgcactggtaggaaatattggtatgttaggcggtgcaaatataggagatactggaggtatgttcgaggcaatacatggtaccgcacctaagtatgctggtaagaatgttgcaaaccccactggaataataaaaggtggtgagttaatgttaagatttatgggatgggataaggctgctgagttaatagattctgcaatcatggaatctataagacagaagaaggttactcaggatttagctagatttatgggtgtaagagccttatcaactactgaatatactgacgagctaattgcgataatcgatacactatcataa

SEQ ID NO: 27910 - protein, 413 aa, Sulfolobus solfataricus P2; identical to SEQ ID NO: 5668

SEQ ID NO: 27911 - DNA, 1005 bp, Clostridium acetobutylicum ATCC 824
  CDS (1)..(1005): transl_table=11
atgaaaaaaaatcacacaataactcttattcctggagatggaataggaccagaagtaacgggggcagctaaaaaggtaatagaggcagcaggagttagtataacttgggatatagttgaagcgggagcaaaggttatggatgagtatggaacacctcttccagagtatgtgttagaaagcataaaaaagaataaaatagcactcaaaggacctataacaactcctgttggaagtggatttagaagtgtaaatgttgcattaagacaaacttttaatttatatgcaaatgtaagacctataaagacatatgaaggaatacctacaagatacaaagatgtagatctaattatagttcgtgaaaatacagaagatttatatgcaggaattgaacacaaaattggtgattatgcagctgaaagtattaagataataactagagaagcaagtgaaagaattgctgattttgctttcgatatggcagttaaacaaaatagaaaaaaggtaacagcagtacataaggctaatataatgaaattttctgatggactgtttttagattgtgcaagaaaagtagcagaaggttataaggaaaaagaatttgaagatatgattgttgatgctatgagtatgaaattagttcaaaatcctgaaaagtatgatgttcttgtaatgcctaatctttatggagatatactgtcagatatggctgcaggacttgttggaggacttggagtagcgccaggagcaaatataggaaaagaaatttcgatatttgaatcaattcatggttcagcacctgatatagcaggtaagaacatagcaaatccaacagctgctatactttctggagtaatgatgcttagatatataggggaacttgaagcagcagataagatagataatgcaattaaagtggttttaaaagagggaactaaggttacatctgatttaggtggaaatgctacaactgatgaatttgctaatgaagttataaagaatatataa

SEQ ID NO: 27912 - protein, 334 aa, Clostridium acetobutylicum ATCC 824
MKKNHTITLIPGDGIGPEVTGAAKKVIEAAGVSITWDIVEAGAKVMDEYGTPLPEYVLESIKKNKIALKGPITTPVGSGFRSVNVALRQTFNLYANVRPIKTYEGIPTRYKDVDLIIVRENTEDLYAGIEHKIGDYAAESIKIITREASERIADFAFDMAVKQNRKKVTAVHKANIMKFSDGLFLDCARKVAEGYKEKEFEDMIVDAMSMKLVQNPEKYDVLVMPNLYGDILSDMAAGLVGGLGVAPGANIGKEISIFESIHGSAPDIAGKNIANPTAAILSGVMMLRYIGELEAADKIDNAIKVVLKEGTKVTSDLGGNATTDEFANEVIKNI

SEQ ID NO: 27913 - DNA, 1230 bp, Sulfolobus tokodaii str. 7
  CDS (1)..(1230): transl_table=11
atgttatacaaagaacccgaggatggagaaaaaatcaaattcgataagggaaaatggatagtaccaaataaacccgtgattttatatatagaaggagatggaataggtccagagataactaacgctgcaataaaggtgattaataaagctgtagaaagagcttatggtagctctagagagataaaatggttagaagtttatgctggtgaaaaagctgaaaaattagttaatgatagatttccaaaagaaactcaagagatgttacttaaatatagagtagttcttaaaggtccattagaaactccaataggaaaaggatggaaatctgttaatgtagctattagattaatgcttgacttatacgcaaatataagaccagtaaaatatattgagggactagaaagccccctaaaacatcccgaaaaagtagatatgataatttttagagaaaatactgatgatctatatagaggaatagaatatccatttaatagtgaggaggctaaaaaaattagagactttctaagaaaagaactaaaagtagaaatagaagacgataccggaatagggataaaggtaatgagtaaatataaaactcaaagaattactaggttagcaatacagtatgcaatagaacataaaaggaaaaaggttactattatgcataaaggtaatgttatgaaatatacagaaggagcttttagagaatgggcatatgaagttgctctaaaagaatatcgtgattttatagttacggaagaagaaataaaccagggtaaaccagatcaaggtaaaataattctaaatgatagaattgctgataatatgttccaacaaataataataagaccagaagaatatgatataattttagcaccaaacgtaaacggtgactatatttctgatgcggccggtgcattaatcggcaatattggaatgctaggaggagctaatattggcgacgagggaggaatgtttgaagctattcatggtacagcaccaaagtatgctggcaaaaatgtagctaacccaacaggaattataaaagctggagaattgatgctaagatggatgggatggaatgaagctgctgacttaatagaaaaagctattaatatggcaataagagacaagaaagttacacaggatattgctaggtttatgggagtaaaagcattaggtaccaaagagtacgcagatgaactaataaagataatggacacaatttga

SEQ ID NO: 27914 - protein, 409 aa, Sulfolobus tokodaii str. 7
MLYKEPEDGEKIKFDKGKWIVPNKPVILYIEGDGIGPEITNAAIKVINKAVERAYGSSREIKWLEVYAGEKAEKLVNDRFPKETQEMLLKYRVVLKGPLETPIGKGWKSVNVAIRLMLDLYANIRPVKYIEGLESPLKHPEKVDMIIFRENTDDLYRGIEYPFNSEEAKKIRDFLRKELKVEIEDDTGIGIKVMSKYKTQRITRLAIQYAIEHKRKKVTIMHKGNVMKYTEGAFREWAYEVALKEYRDFIVTEEEINQGKPDQGKIILNDRIADNMFQQIIIRPEEYDIILAPNVNGDYISDAAGALIGNIGMLGGANIGDEGGMFEAIHGTAPKYAGKNVANPTGIIKAGELMLRWMGWNEAADLIEKAINMAIRDKKVTQDIARFMGVKALGTKEYADELIKIMDTI

SEQ ID NO: 27915 - DNA, 1218 bp, Thermoplasma acidophilum DSM 1728
  CDS (1)..(1218): transl_table=11
atggcatatattcaagtgaaggaggatggaacccttcaggttccagatagagtaactataggatatatagagggcgatggaataggacctgatatatcaaagacaacgataaacgtactcaacgcagctcttgacatcgcctatggtggaaagcgttcaatagaatggaagaagatacttgcaggagatgaggcctacgataagaccggtgacaggcttccccagtcatcgctagatgaactgaaaaagtgtgtagtttcgctgaagggacctctgacaaccccaataggagaaggcttcaggagccttaacgtcactttgaggcagtacctcgatctttatgcgaacatcaggcctgtaagatacttcccaggcgtgccttcccctgtagttcatccagaatatatgaacatggtcgtcttcagggagaacaccgaggacctgtatgccggcatagaatggaggtacgattcagatggagccaagaaggtcagggaattcttggcgtcaacattcaacataaacctaacaagcgataccggcatagggataaagcccataagcaagttcaagtccacgaggcttgtcaggaaggctatacagtatgctatagctaacaagaggaagagcgtaacgcttgtgcataagggaaacataatgaagtacactgagggggcattcaaggaatggggttatgaggttgctaagacggagttcggcaactacaccgtgacggaaacggaataccttcaggatcctgaaaaatactcgaacaagatcgtcataaaggatcgaataacggacaacatgttccagcaggtcctgaccaggacgcaggagtacgatgtcattgcgacgcccaatctgaatggcgactacctttcagatgccctggcggcccaggtcggcggcataggcctggcacctggagcgaatataggcgaccactatgccgtatttgaggccgtgcatggaacagcaccgaagtacgctggcatggatgttgcaaacccaacatcgctgatactctccggagagatgatgctgcaacacattggctggaacgaggctgcgaacatactcgatgaggcaataatgcagacgtacagggatcagaagctgacgcaggacattgcaaggcttcttaacgtaaaagcacttaaatgctctgaattcggtgaggagataatcaacaggatgaaaaaacctgttcactga

SEQ ID NO: 27916 - protein, 405 aa, Thermoplasma acidophilum DSM 1728
MAYIQVKEDGTLQVPDRVTIGYIEGDGIGPDISKTTINVLNAALDIAYGGKRSIEWKKILAGDEAYDKTGDRLPQSSLDELKKCVVSLKGPLTTPIGEGFRSLNVTLRQYLDLYANIRPVRYFPGVPSPVVHPEYMNMVVFRENTEDLYAGIEWRYDSDGAKKVREFLASTFNINLTSDTGIGIKPISKFKSTRLVRKAIQYAIANKRKSVTLVHKGNIMKYTEGAFKEWGYEVAKTEFGNYTVTETEYLQDPEKYSNKIVIKDRITDNMFQQVLTRTQEYDVIATPNLNGDYLSDALAAQVGGIGLAPGANIGDHYAVFEAVHGTAPKYAGMDVANPTSLILSGEMMLQHIGWNEAANILDEAIMQTYRDQKLTQDIARLLNVKALKCSEFGEEIINRMKKPVH

SEQ ID NO: 27917 - DNA, 1428 bp, Synechocystis sp. PCC 6803
  CDS (1)..(1428): transl_table=11
atgtacgaaaaacttcagccccccagcgttgggtcaaaaatcacctttgttgcaggtaagcccgtagtacccaacgatccgattattccctacatccggggggacggcaccggggttgatatttggcccgctacggaattagtcatcaatgcagcgatcgccaaggcctatggcggcgagaggaaaatcaactggttcaaagtctatgccggggacgaagcctgtgaattgtacggcacttatcagtatttaccggaagacactttaacagcgattaaggagtatggggtagccatcaaagggcctctcacaaccccggtgggcggtggtatccgttccctaaacgtggccctgagacaaatttttgacctctacacctgtgtgcggccctgtcgttactatcccggtactccgtctccccacaaaaccccggaaaaattagacattatcgtttatcgggaaaatacggaagatatttacctaggcattgaatgggcggaaggtacggaaggggcgaaaaagttaatcgcttaccttaacgatgaactgattcccacaactccagctttgggcaaaaaacaaattcgcctcgactctggcattggtattaaaccgattagtaagactggttcccaacggttggtgcggcgggctattctccatgcattgcgcttgccgaaagcaaaacagatggtgacgttggtccataagggcaacattatgaagttcaccgaaggggcgtttcgggattggggttacgagttggctacgacggaatttcgggcggaatgcgttacggaacgggaatcttggattttgggcaataaggaaagtaatccggacttaaccattgaggccaacgcccacatgattgaccccggttatgacactttgaccgaagaaaaacaagcggtcattaaacaagaagtggagcaggttttaaattccatttgggaatcccatggtaatggccagtggaaagaaaaagtcatggtcaatgaccgcattgccgatagtattttccaacagatccaaacccgccccgatgagtattccattctggcgaccatgaatttgaacggggattacctttccgatgccgccgccgctgtggtgggaggtttgggcatgggccccggagctaacattggggatagtgcagccatttttgaagccacccacggcactgcccccaaacatgctggtttagaccggatcaaccccggctctgtgatcctttccggcgtaatgatgctggaatttatgggctggcaggaggccgctgatctgattaaaaaaggtatcggagcggcgatcgccaatcgggaagttacctacgatttagcccggttaatggaaccgaaggtggataaacccctaaaatgctccgagtttgcccaggcgatcgtcagtcatttcgatgattaa

SEQ ID NO: 27918 - protein, 475 aa, Synechocystis sp. PCC 6803
MYEKLQPPSVGSKITFVAGKPVVPNDPIIPYIRGDGTGVDIWPATELVINAAIAKAYGGERKINWFKVYAGDEACELYGTYQYLPEDTLTAIKEYGVAIKGPLTTPVGGGIRSLNVALRQIFDLYTCVRPCRYYPGTPSPHKTPEKLDIIVYRENTEDIYLGIEWAEGTEGAKKLIAYLNDELIPTTPALGKKQIRLDSGIGIKPISKTGSQRLVRRAILHALRLPKAKQMVTLVHKGNIMKFTEGAFRDWGYELATTEFRAECVTERESWILGNKESNPDLTIEANAHMIDPGYDTLTEEKQAVIKQEVEQVLNSIWESHGNGQWKEKVMVNDRIADSIFQQIQTRPDEYSILATMNLNGDYLSDAAAAVVGGLGMGPGANIGDSAAIFEATHGTAPKHAGLDRINPGSVILSGVMMLEFMGWQEAADLIKKGIGAAIANREVTYDLARLMEPKVDKPLKCSEFAQAIVSHFDD

SEQ ID NO: 27919 - DNA, 1263 bp, Listeria monocytogenes EGD-e
  CDS (1)..(1263): transl_table=11
atgagtcaaaaaattcaagtagaaaacggtgtgctaaaaacaccaaacaatccagtcattccttttattgaaggggacggaactggtccagacatctgggcagctgcgaaacgcgttttagatgccgcagtaaaaaaagcttacaatggtgaaaaagaaattgcttggaaagaagtattagctggcgaaaaagcattcaagcaaacaggagaatggttaccacaggcgactttagatacaattgacgaatatttgattgctattaaaggaccacttactactccaatcgggggaggcattcgttcactaaacgttgccctgcgccaagagttagatttatatgtttgtttacgtccagttcgttatttcaaaggtgttccttcaccagtgaaacgtccagaagacacagatatggtcattttccgtgagaatacagaagatatttatgcagggattgaatttaaagaaggtagcatagaatcgaaaaaactaatcgacttcttaaaatctgaatttggtgttgataaaatccgtttcccggaaacttctggaattggtatcaagccgatttccaaagaaggaacggagcgtttagtgcgttcggcgattgaatatgcaattaaagaaggtcgtaaatcattaacgctcgtacacaaagggaatatcatgaagttcacagaaggagctttcaaaaattggggctatgacttatgtgaacgcgaatatggtgataaagtatttacttggaatgagtatgatcgaattaaagaagcagaaggaacagaagttgctgacgcgaaacaaaacgaagcgcttgctgctgggaaaattttagtcaaagattcgattgcggatattttcttgcaacaaatcttaactcgcccagctgaatttgatgtagttgctacaatgaacttgaatggagactacatttccgatgcgcttgctgctcaagtaggtggaatcggtattgctccaggagcaaacattaactacttaactggtcatgcgattttcgaagcgacgcatggtactgctccgaaatatgccggtcttgataaagtaaatccgtcatcggttattttatctgggacacttctgcttgaacacattggttggggtgaagcggctgccttaattaatcaatcaatggaaaaaaccattgctgcgaaaacggtaacctatgattttgctcgattaatggatggtgcgacagaagttaaatgttcggaatttgcggacgaattaataaaaaacttctaa

SEQ ID NO: 27920 - protein, 420 aa, Listeria monocytogenes EGD-e
MSQKIQVENGVLKTPNNPVIPFIEGDGTGPDIWAAAKRVLDAAVKKAYNGEKEIAWKEVLAGEKAFKQTGEWLPQATLDTIDEYLIAIKGPLTTPIGGGIRSLNVALRQELDLYVCLRPVRYFKGVPSPVKRPEDTDMVIFRENTEDIYAGIEFKEGSIESKKLIDFLKSEFGVDKIRFPETSGIGIKPISKEGTERLVRSAIEYAIKEGRKSLTLVHKGNIMKFTEGAFKNWGYDLCEREYGDKVFTWNEYDRIKEAEGTEVADAKQNEALAAGKILVKDSIADIFLQQILTRPAEFDVVATMNLNGDYISDALAAQVGGIGIAPGANINYLTGHAIFEATHGTAPKYAGLDKVNPSSVILSGTLLLEHIGWGEAAALINQSMEKTIAAKTVTYDFARLMDGATEVKCSEFADELIKNF

SEQ ID NO: 27921 - DNA, 1263 bp, Listeria innocua Clip11262
  CDS (1)..(1263): transl_table=11
atgagtcaaaaaattcaagtagaaaatggtgttttaaaaacaccgaacaacccagtcattccttttattgaaggagatggaacaggtccagacatctgggcagctgcaaaacgcgttttagatgcggcagtaaaaaaagcttacaatggcgaaaaagaaattgcttggaaagaagttctggctggcgaaaaagcatttaaacaaactggtgaatggcttccacaagagacactagatacaattgatgagtatttaattgctatcaaaggaccgcttacaacaccaattggtggcggtattcgctctctaaacgtcgctttacgccaagagttagatttatatgtatgtttacgtccagttcgttatttcaaaggtgttccttccccagtaaaacgtcctgaagatactgatatggtcattttccgtgaaaatacagaagatatttatgcgggaattgaatttaaagaaggtagcgcagaatcgaaaaaattaattgatttcttaaaatcggagtttggcgtggataaaattcgtttcccggaaacttctggtattgggattaaaccaatttcaaaagaaggaacagagcgtttagtccgttcagcgattgaatatgcgattaaagaaggacgtaaatctttaacacttgtacacaaaggaaatatcatgaaattcactgaaggagctttcaaaaactggggctatgatttatgtgaacgcgaatacggcgataaagtatttacttggaatgagtatgatcgtatcaaagaagcagaaggtacagaagctgctgatgcaaaacaaaaagaagagcttgctgctgggaaaatattagtaaaagattcgattgcagatattttcttacaacaaatcctcactcgcccagctgaatttgatgtagtagctacgatgaatttaaatggagattacatttctgatgcccttgctgctcaagtaggtggaattggaattgctcctggagcgaacattaattatttaactggtcatgcgatttttgaagcaacacatggtactgctccaaaatatgctggtcttgataaagtcaatccatcttctgttattttatctggaacattactacttgaacatattggctggggtgaagcagcagcactcattaaccactctatggaaaaaactatcgctgcaaaaaccgtaacatatgatttcgctagattaatggatggagctacagaagttaaatgttcggaatttgcggacgagttaatcaaaaacttctaa

SEQ ID NO: 27922 - protein, 420 aa, Listeria innocua Clip11262
MSQKIQVENGVLKTPNNPVIPFIEGDGTGPDIWAAAKRVLDAAVKKAYNGEKEIAWKEVLAGEKAFKQTGEWLPQETLDTIDEYLIAIKGPLTTPIGGGIRSLNVALRQELDLYVCLRPVRYFKGVPSPVKRPEDTDMVIFRENTEDIYAGIEFKEGSAESKKLIDFLKSEFGVDKIRFPETSGIGIKPISKEGTERLVRSAIEYAIKEGRKSLTLVHKGNIMKFTEGAFKNWGYDLCEREYGDKVFTWNEYDRIKEAEGTEAADAKQKEELAAGKILVKDSIADIFLQQILTRPAEFDVVATMNLNGDYISDALAAQVGGIGIAPGANINYLTGHAIFEATHGTAPKYAGLDKVNPSSVILSGTLLLEHIGWGEAAALINHSMEKTIAAKTVTYDFARLMDGATEVKCSEFADELIKNF

SEQ ID NO: 27923 - DNA, 1251 bp, Ralstonia solanacearum GMI1000
  CDS (1)..(1251): transl_table=11
atgtaccaacacatcaaggtcccggccggagagaagatcaccgtcaaccaagacttctccctgaacgtccccgataaccccatcattccttacatcgagggcgacggcaccggcttcgatatcacccccgtgatgatcaaggtggtggacgcggccgtggagaaggcctatgccggcaagcgcaagatttcctggatggaaatctacgccggcgagaagtcgaccaaggtgtacggcccggacgtgtggctgccggaagaaaccctgcaggtcctcaaggactacgtggtctcgatcaagggcccgctgacgacgccggtgggcggcggcatccgttcgctgaacgtggcgctgcgccaggagctggacctgtacgtctgcctgcgcccggtgcgctacttcaagggcgtgccctcgccggtcaaggagccggagaagaccgacatggtcatcttccgcgagaactcggaagacatctacgccggcatcgagttcgaagcccagagcgacaaggccaagaagctgatcaagatcctgcaggacgagttcggcgttaagaagatccgcttcccggagacctcgggcatcggcgtcaagccggtctcgaaggaaggcactgagcgcctggtgcgcaaggccatccagtacgcgatcgacaacgacaagccgtcggtcacgatcgtgcacaagggcaatatcatgaagttcacggaaggcggtttccgtgactgggcctacgcgctggcgcaaaaggaattcggcgccgagctgatcgatggcggtccgtggtgcaagttcaagaacccgaagacgggcaaggaaatcgtcgtcaaggacgcgattgccgacgccttcctgcagcagatcctgctgcgtccggccgagtactcggtggtggcgacgctgaacctgaacggcgactacatctccgacgcgctggccgcacaggtcggcggcatcggcatcgccccgggcgcgaacctgagcgactccgtcgcgatgttcgaggccacccacggcacggctccgaagtacgccggcaaggactacgtgaacccgggttcggaaatcctgtcggccgaaatgatgctgcgccacatgggctggacggaagccgctgacctgatcatctcgtcgatcgagaagtcgatcctgtcgaagaaggtcacgtatgacttcgcccgcctgctggaaggcgcgacgcaggtgtcgtgctcgggctttggtcaggtgatgatcgacaatatgtaa

SEQ ID NO: 27924 - protein, 416 aa, Ralstonia solanacearum GMI1000
MYQHIKVPAGEKITVNQDFSLNVPDNPIIPYIEGDGTGFDITPVMIKVVDAAVEKAYAGKRKISWMEIYAGEKSTKVYGPDVWLPEETLQVLKDYVVSIKGPLTTPVGGGIRSLNVALRQELDLYVCLRPVRYFKGVPSPVKEPEKTDMVIFRENSEDIYAGIEFEAQSDKAKKLIKILQDEFGVKKIRFPETSGIGVKPVSKEGTERLVRKAIQYAIDNDKPSVTIVHKGNIMKFTEGGFRDWAYALAQKEFGAELIDGGPWCKFKNPKTGKEIVVKDAIADAFLQQILLRPAEYSVVATLNLNGDYISDALAAQVGGIGIAPGANLSDSVAMFEATHGTAPKYAGKDYVNPGSEILSAEMMLRHMGWTEAADLIISSIEKSILSKKVTYDFARLLEGATQVSCSGFGQVMIDNM

SEQ ID NO: 27925 - DNA, 1320 bp, Pyrobaculum aerophilum str. IM2
  CDS (1)..(1320): transl_table=11
atggctgtagatatagagaaaatcaaacagggaatacccaacatagtcccctacgctgggaagtatgtagaccctccagagggggattacgtagagtacacgggcccgggccaattcaaagtccccgataaggtcgttatcgggtacatagagggagacgggatagggccagaggtggcttatgcggctattagagtggcaaacgccgcagttgaaaaggcatatgggaagtctagaaaagtaatctggtatgaggtagtggtcggcgaaaaggccgaaaaaatcttcggcaacagactgcctgaccagagcattaacgtcttgaagaaaatacgggtgtttcttaaagccccgcttgagactccagtgggaggagggtttagaagtataaacgtgacgttgcgccagctctttgatctctacgccaatattagacctgtgaagtacttcccgggcctcccctcgcctctgaaaaggccagaggttgtcgatttagtaatttttagagaaaacacagaggacgtctatgctggcattgagtggccttacaacagccctgaggcgtctaaaatccgggatttcctgcgtagggagttcggaattaatataagagacgacgccggcattggcataaagcccattagcaaattcggcacgcagagaattgcaaggctggccttgaaatttgcaattgaaaacaagaggcgtgtggtaacagttatgcataagggaaatatccagaaatacaccgaaggcgcatttaaagattgggcgtttgaagtggctaggaatgagtttagggaacacgtggtgtttgaagacgagctggcccagtacggcggccaggtgcccccgggcaaagtccttgttaacgacagaattgccgacaatatgttacaacagctactcacgagaacgggggaatacgacgtaattctagcccccaacttaaatggggattacgtctctgacgaggccgctggcctagtcggaggcctcggcgtcgcccccggcattgacgtgggagactggggaatgatggcggagccggtccacggcacagcgcctaaatatagaggtaaaaattacgtaaaccccactgccacaatactagcccttgaactactcttccgattcttggggtggagagaagccgcgaattatattatcaaaggagttgagactgcatatagggagggctatttcaccggagatctggcaaggcaaatggacgaggaggagaggaaacatcgggttaaggaggtgcttgggacgcaggaatttgccgataaagtagtagagataataaaaagattgtaa

SEQ ID NO: 27926 - protein, 439 aa, Pyrobaculum aerophilum str. IM2
MAVDIEKIKQGIPNIVPYAGKYVDPPEGDYVEYTGPGQFKVPDKVVIGYIEGDGIGPEVAYAAIRVANAAVEKAYGKSRKVIWYEVVVGEKAEKIFGNRLPDQSINVLKKIRVFLKAPLETPVGGGFRSINVTLRQLFDLYANIRPVKYFPGLPSPLKRPEVVDLVIFRENTEDVYAGIEWPYNSPEASKIRDFLRREFGINIRDDAGIGIKPISKFGTQRIARLALKFAIENKRRVVTVMHKGNIQKYTEGAFKDWAFEVARNEFREHVVFEDELAQYGGQVPPGKVLVNDRIADNMLQQLLTRTGEYDVILAPNLNGDYVSDEAAGLVGGLGVAPGIDVGDWGMMAEPVHGTAPKYRGKNYVNPTATILALELLFRFLGWREAANYIIKGVETAYREGYFTGDLARQMDEEERKHRVKEVLGTQEFADKVVEIIKRL

SEQ ID NO: 27927 - DNA, 1125 bp, Arabidopsis thaliana
  CDS (1)..(1125)
atgaccatggcagcaaatctagcgcgacggctgatcggaaaccgatcgactcagatccttggagccgtgaactctagctcaggtgcggctagttctgtcgctagggctttctgctcctccaccactccgatcaccgcaactctcttccctggcgatgggatcggtcccgagatcgccgaatctgtcaaaaaggtgtttacaacagctggtgtaccaattgagtgggaagaacactatgttgggactgagatagatccgagaacacagagtttcttgacatgggaaagtctcgaatctgtgcgtagaaacaaagttggtttgaaaggtccaatggctactccaattgggaaaggtcaccgttctttgaacctgactcttaggaaagagcttaatctatatgccaatgttagaccttgttacagtcttcctggttacaaaactcgttacgatgatgttgatctcattaccatcagagaaaacacggaaggagaatacagtggccttgaacatcaggttgttagaggtgtggtggaaagtcttaaaatcattacccgtcaggcgagtttgagagttgcagagtatgcttttctctatgccaagactcatggaagagagagagtttctgctatccacaaagccaacattatgcagaaaactgacggtctctttctcaagtgttgtcgtgaggttgctgagaagtatcctgagatcacttacgaggaggtcgttattgacaactgctgtatgatgcttgtgaaaaacccagcactttttgatgtcttggtgatgccaaacctgtacggtgacattattagcgatctgtgtgccggattggttggaggactaggattgactccaagttgtaatattggagaagatggtgtagcccttgctgaagcagttcacggttctgcacctgatatcgctggaaagaacttggcgaacccaaccgcgttgcttctgagtggagtgatgatgttgcgtcacctgaagttcaacgaacaagcagaacaaatccacagtgcaatcatcaacaccatagcagagggcaaatacagaaccgcggatcttggaggtagttcgaccaccacggaattcacaaaggcaatctgtgatcatctctga

SEQ ID NO: 27928 - protein, 374 aa, Arabidopsis thaliana
MTMAANLARRLIGNRSTQILGAVNSSSGAASSVARAFCSSTTPITATLFPGDGIGPEIAESVKKVFTTAGVPIEWEEHYVGTEIDPRTQSFLTWESLESVRRNKVGLKGPMATPIGKGHRSLNLTLRKELNLYANVRPCYSLPGYKTRYDDVDLITIRENTEGEYSGLEHQVVRGVVESLKIITRQASLRVAEYAFLYAKTHGRERVSAIHKANIMQKTDGLFLKCCREVAEKYPEITYEEVVIDNCCMMLVKNPALFDVLVMPNLYGDIISDLCAGLVGGLGLTPSCNIGEDGVALAEAVHGSAPDIAGKNLANPTALLLSGVMMLRHLKFNEQAEQIHSAIINTIAEGKYRTADLGGSSTTTEFTKAICDHL

SEQ ID NO: 27929 - DNA, 1065 bp, Drosophila melanogaster
  CDS (1)..(1065)
atggctgctagattcatacagaaaattgtcaacgcgactcccgccgccagccggtcctactcctccggcaccaagaaagtcaccctcatccctggcgatggcatcggacctgagatctctgcggccgtgcagaaaatcttcaccgccgccaatgtccccatcgagtgggaggccgtggacgtgacccccgtccggggacccgacggaaagttcggcatcccacaggccgccattgactcggtgaacacgaacaagatcggcctgaagggtcctctgatgacgcccgtcggcaagggccatcggtctctgaatctggccctgcgcaaggagttcaatctgtacgccaacgtgcgtccctgccgcagtctcgagggctacaagacgctgtacgacgatgtggacgtggtcaccatccgtgagaacaccgagggcgagtactccggcatcgagcacgagatcgtcgacggcgtcgttcagagcatcaagctgatcaccgaggaagcctccaagcgtgtggccgagtacgccttccagtacgccaagaacaacaaccgcaagaaggtcaccgtggtgcacaaggcgaacattatgcgcatgtccgatggtctcttcctgcgctgcgtccgcgacatggcccagaagttcccagaaatccagttcgaagagaagtatctggatacggtgtgcctgaacatggtccagaaccccggaaaatacgacgtgctggtcatgcccaatctgtacggtgatattctgtctgacatgtgcgccggtttggtgggcggcctcggcctgacgccctccggcaacatgggcctgaacggtgccctgttcgagtctgtgcacggaaccgcccccgatattgccggcaaggacctggccaatcccactgccctgttgctgtcggcggtcatgatgctgcgccacatggagctcaacacgtacgccgataaaatcgagcgtgccgccttcgagaccatcaaggagggcaaatacctcaccggcgatctgggcggccgtgccaagtgctccgagttcacgaacgagatctgtgccaagctgtag

SEQ ID NO: 27930 - protein, 354 aa, Drosophila melanogaster
MAARFIQKIVNATPAASRSYSSGTKKVTLIPGDGIGPEISAAVQKIFTAANVPIEWEAVDVTPVRGPDGKFGIPQAAIDSVNTNKIGLKGPLMTPVGKGHRSLNLALRKEFNLYANVRPCRSLEGYKTLYDDVDVVTIRENTEGEYSGIEHEIVDGVVQSIKLITEEASKRVAEYAFQYAKNNNRKKVTVVHKANIMRMSDGLFLRCVRDMAQKFPEIQFEEKYLDTVCLNMVQNPGKYDVLVMPNLYGDILSDMCAGLVGGLGLTPSGNMGLNGALFESVHGTAPDIAGKDLANPTALLLSAVMMLRHMELNTYADKIERAAFETIKEGKYLTGDLGGRAKCSEFTNEICAKL

SEQ ID NO: 27931 - DNA, 1203 bp, Pyrococcus furiosus DSM 3638
  CDS (1)..(1203): transl_table=11
atgagcattagacttccacaagaaggaaaagttattgaagttgtcaacggctctctaaagatccctaatgagcccatagttgcctatatagaaggtgatggaattgggagagaagttatcccagcagcgattaaagtagttgacaaggccgtcgaaactgcatacaaaggaaagagaagaattgtttggtggaagttacttgctggaaaagaagccctccagaaagttggaaaacttcttcctgaagaaacggtaaaagggatcgcggaggtaaaggtcgcactcaaaggacccatggagacaccaatagggacgggacataggagtataaacgtggcattaaggaagatgttcgatctttatgcaaacataagaccaatcaaatactatggagtcccaactgtctatccatatgccgacaaagtggacttaataatatttagggagaacacggaagatgtttatgctggaatagaatgggaggcttatagtagagaggctcaaaaactcagggagttcctaaaaaatgaatttggaatagagataagagaggactctggaattacactaaaaccaatttccaagtttgcaactcaaagaatagtgagaaaagcaataaaatgggccatagaaaagggaagaaagagagttacaataatgcataaaggaaatgtaatgaagtttacagaaggagcattcagaaactgggcatttgaagttgctgaaaaggagttttccgaatacgtaagcataggcaaaccagaagaaggcaaaattctagttgatgacaagatagcagataatatgctccaacagataattctcagaccctgggagtatgacattatagtgactccaaacttaaacggagattacctcagtgatgctgctgcggccttagttggaggagttggaatggcagctgggataaatgttggagattacatagcaatagcagaaccagtccacggcacggccccagacatcgctggaaaaggaatagcaaacccctcagcggccattttaagtgcagcacttcttctcgaatatctcggctgggtagaagcggctgagttaattagagcttctctaaggaaaacgatagagaagggtaaagtaactcccgacctagcgagaggagaaaaagctctttcaacggaagaattcattcaggaagtcataaaagaaattgagggggaataa

SEQ ID NO: 27932 - protein, 400 aa, Pyrococcus furiosus DSM 3638
MSIRLPQEGKVIEVVNGSLKIPNEPIVAYIEGDGIGREVIPAAIKVVDKAVETAYKGKRRIVWWKLLAGKEALQKVGKLLPEETVKGIAEVKVALKGPMETPIGTGHRSINVALRKMFDLYANIRPIKYYGVPTVYPYADKVDLIIFRENTEDVYAGIEWEAYSREAQKLREFLKNEFGIEIREDSGITLKPISKFATQRIVRKAIKWAIEKGRKRVTIMHKGNVMKFTEGAFRNWAFEVAEKEFSEYVSIGKPEEGKILVDDKIADNMLQQIILRPWEYDIIVTPNLNGDYLSDAAAALVGGVGMAAGINVGDYIAIAEPVHGTAPDIAGKGIANPSAAILSAALLLEYLGWVEAAELIRASLRKTIEKGKVTPDLARGEKALSTEEFIQEVIKEIEGE

SEQ ID NO: 27933 - DNA, 1068 bp, Pyrococcus furiosus DSM 3638
  CDS (1)..(1068): transl_table=11
atgataaagatagctgtgatcccaggtgatgggataggaaaggaggtagtggctgaggggctaaaggttcttcgcaaaatagaggagctgagcaacgttaagttcgactttcaagagtatccattcggagcagaacattacttgaaaactggagaaacccttccagactgggctcttgaggagtttagacactttgatgcaatttactttggagcaattggggatccaagggtaaagccgggaattctagaacacggaattctacttaagctcagattttccctagacctttacgtaaacttaagacctgtaaagttataccacccaaaactaactccgctaaagggaaaggaaaagattgacatggtgttcataagggaaaacactgagggcctatatgcaggagcgggtggttttcttaggaaggggacccctcatgaggtcgctattcaagaaatgataaatactaggtttggagtcgagagaaccattaggtttgcctttgaatatgcaaagactaaggggagaaaaaaggtaactctagtagataaggccaacgttcttacctatgctcacgatctctggcagagagtgtttaaggaagttgcttcggaataccaggaaatagagactgaccactactatgttgatgctatggcaatgaaaatgatccgttctccagagatcttcgaagtagttgtaactccaaacatgtttggagacattctcactgacttgggagcagagattgtgggaggattaggattagcagcttctggaaatatcaatccaaggggagtttccatgtttgagccagtccacggttctgccccagacattgcaggaaagggcattgcaaatccactagctgcgattttaacagcagctctaatgcttgagcacctgggattggacagggaagcctcacttgtggaaaaggccgttgcgaagacaatagaagaaaacaaagtaacaccagacttgggaggagagttgaagactagcgaagttggtaatgaagttgtgaaaaatttagaggtgttatgggatgagggagaggagagttga

SEQ ID NO: 27934 - protein, 355 aa, Pyrococcus furiosus DSM 3638
MIKIAVIPGDGIGKEVVAEGLKVLRKIEELSNVKFDFQEYPFGAEHYLKTGETLPDWALEEFRHFDAIYFGAIGDPRVKPGILEHGILLKLRFSLDLYVNLRPVKLYHPKLTPLKGKEKIDMVFIRENTEGLYAGAGGFLRKGTPHEVAIQEMINTRFGVERTIRFAFEYAKTKGRKKVTLVDKANVLTYAHDLWQRVFKEVASEYQEIETDHYYVDAMAMKMIRSPEIFEVVVTPNMFGDILTDLGAEIVGGLGLAASGNINPRGVSMFEPVHGSAPDIAGKGIANPLAAILTAALMLEHLGLDREASLVEKAVAKTIEENKVTPDLGGELKTSEVGNEVVKNLEVLWDEGEES

SEQ ID NO: 27935 - DNA, 1008 bp, Methanopyrus kandleri AV19
  CDS (1)..(1008): transl_table=11
gtgaacgcgtcgccgaccgtcgtggtaatccccggggacgggatcgggccggaagtcatcgacgcggccctgaaggtcgtgcgggcggttctgggtgacgaactcgagatcgtggaggaacaggccgggtactcgctgtggaagaagaggggagtcacgatcgaggacgagacgatcgagcgctgccgcgaggcggacgccatgctcttcggcgcgtgcacgactccggaggacccggaggccaagagtcccatcgtgacgctgcggaaagagctcggactctacgccaacgtccgtcccgctcgctcctggcccgtaccgcgacctgtcgacaccgagttcgacctggtgatcgtccgggagaacaccgagggtctctacaccggatgcgagtgcgagatccacgacggtgttaccgtcgccctgcgtaagatctccgaggagggtacgcgcagggtcgctgaggtcgcctgcgatctcgccgaggagcgctccggtcgcgtgacgatagtgcacaaggccaacgtgctgaagctcacgtgcggaacgttcaagcgcgtcgcggcggaaaccgtggagcgtcgcggtctggagtgggacgacgagtacgtggacgcggcggcgtacaagctggtgcgtgagccggacagcttcgacgtgatcctcacctccaacctgttcggggacatactctcggacctggcggcgggtctgatggggagcctcgggctcgcacccagcgcgaacctgggggacgacgccgccctattcgagcctgtacacgggtcggcacccgacatcgcgggtaaggggatcgcgaacccggtggcggcgatcctctcggccgccatgatgctggatcacctcgggtacggggaggaggctcggatcatcgagcgtgccgtcgaggaggtgctgcgcgagggcgtgaggactcccgacctcggcggttccgcgaccacggaggaggtggccgaggcgatcgcggagcgtgtggctaccgggtga

SEQ ID NO: 27936 - protein, 335 aa, Methanopyrus kandleri AV19
MNASPTVVVIPGDGIGPEVIDAALKVVRAVLGDELEIVEEQAGYSLWKKRGVTIEDETIERCREADAMLFGACTTPEDPEAKSPIVTLRKELGLYANVRPARSWPVPRPVDTEFDLVIVRENTEGLYTGCECEIHDGVTVALRKISEEGTRRVAEVACDLAEERSGRVTIVHKANVLKLTCGTFKRVAAETVERRGLEWDDEYVDAAAYKLVREPDSFDVILTSNLFGDILSDLAAGLMGSLGLAPSANLGDDAALFEPVHGSAPDIAGKGIANPVAAILSAAMMLDHLGYGEEARIIERAVEEVLREGVRTPDLGGSATTEEVAEAIAERVATG

SEQ ID NO: 27937 - DNA, 1128 bp, Methanosarcina acetivorans C2A
  CDS (1)..(1128): transl_table=11
atgacgcagtataaggttccggtccttcccggcgacgggataggcccagaaatcatcgccgaaggcaagaaagtaatagatgccgcaggcgaaagattcggttttgatgtagaatggattgaatacccgcatggagcagatcactacctgaaaacaggagaactgatctcggaagagaccttaaaggaattatccggctaccctgccatttaccttggctccatcggagaccccaggattgccccaggagttcttgaaaagggaatcttattaactgcacgcttttactttgaccagtacatcaacctgcgcccgataaaacttctcgaaggagtctggaccccgattaaagacaagacagcaaaagacatcgactttgtcgtggtcagggaaaacaccgaagacttctacataggagtcggcggcagagcaaagaaaggagagagcaaagacctccttgaagtcaaaaggacgctctactctgcaaaattcggcctggacatcgagactgacagcgaagaaataggctaccagataggccttatctccaaagaaggcacaaaaagagttatcgaatacgcctttgaccttgcagaaaacaggaagaaacacgtctcctcggttgataaagcaaacgtcctttccgacatttacggcttctggagagaagagttcaatgcagtcgccgcagcccacccggacattaccaccgacttcaacttcgttgacgccatcacaatgtggtttgtgaaaaaccccgaatggttcgatgtggtcgtaaccccgaacatgttcggagacatcatcaccgacctcggagccatgatccagggcggcctcggacttgcccccggcggaaacatcaacccgaagggcacaagcatgtttgagcccatccacggttcagccccgaaatacaagggccagaacaaagtcaacccgattgcaacaatctgggcaggcgccatgctcatagaacagctcggagaaaaggaagctgctgacaccatagttaatgcaatccagaaaaacatcctggaaggcaaagtcaaaacctacgacatgggaggcaaaaacaccacttcagatgtcggagacgacattgcaaggatagtaaagggagaataa

SEQ ID NO: 27938 - protein, 375 aa, Methanosarcina acetivorans C2A
MTQYKVPVLPGDGIGPEIIAEGKKVIDAAGERFGFDVEWIEYPHGADHYLKTGELISEETLKELSGYPAIYLGSIGDPRIAPGVLEKGILLTARFYFDQYINLRPIKLLEGVWTPIKDKTAKDIDFVVVRENTEDFYIGVGGRAKKGESKDLLEVKRTLYSAKFGLDIETDSEEIGYQIGLISKEGTKRVIEYAFDLAENRKKHVSSVDKANVLSDIYGFWREEFNAVAAAHPDITTDFNFVDAITMWFVKNPEWFDVVVTPNMFGDIITDLGAMIQGGLGLAPGGNINPKGTSMFEPIHGSAPKYKGQNKVNPIATIWAGAMLIEQLGEKEAADTIVNAIQKNILEGKVKTYDMGGKNTTSDVGDDIARIVKGE

SEQ ID NO: 27939 - DNA, 1029 bp, Methanosarcina acetivorans C2A
  CDS (1)..(1029): transl_table=11
atgactaaaaccgcagcagtaatcaaaggtgacggggttggccccgaacttgtggaagcaatgcttaaagttgcaaacgccgctggcactgatgttgaattcgtaatgtgtgaagcaggagccggctggtgggaagagcatggcggcaattcccttgtccctgatgagacctggcagatccttgacagctccgatgcctgtttcaaggggccgaccacaacccccggcgggataggctccccgagaagtgtggccgtatccatcaggagaaagtacgacctctatgcaaatgtcaggccgataaagaccttcccgaactcaaatgcacctctcggggatgtcgagatggtctgtgtgcgagaggggactgaaggactttacattggtgaggaaatccagctcacagacgatgtttccattgcaatccgaaaaattacccgtactgcatccggtaagattgcccgctatgcctttgaggaagccaaaaggagaggttacgacacggttgtgcccatccataaaagcaatatcctgaaactgacctgcggctctttcttagaagaagtcgaaaaggttgcacaggactaccctaacattgaggtctggccctatcacattgataacatcgcccagcagcttatcaaaaaccctcagatcttcaataaaaaggtcctcctttccaccaacctcttcatggatgtaatcagtgaagagtgttcagcccttgttggcagtatcgggctcatttactctgcaaatctcggggacaattttgcaatgttcgagccggctcacggctcagccccgaagtatgccgggctggataaagtaaaccctgttgcaaccgtgcttgcaggagcctggatgctggactacctgggtgagaaggaaaagtccgaagctatcttcaaagccacagagcgcgtaatctccgaaggcaagtatgtgacctacgacgttggaggcaacgcaaaactcagccagatggcagacgagatcgcaaaatacaccgccgaaatcctgaaataa

SEQ ID NO: 27940 - protein, 342 aa, Methanosarcina acetivorans C2A
MTKTAAVIKGDGVGPELVEAMLKVANAAGTDVEFVMCEAGAGWWEEHGGNSLVPDETWQILDSSDACFKGPTTTPGGIGSPRSVAVSIRRKYDLYANVRPIKTFPNSNAPLGDVEMVCVREGTEGLYIGEEIQLTDDVSIAIRKITRTASGKIARYAFEEAKRRGYDTVVPIHKSNILKLTCGSFLEEVEKVAQDYPNIEVWPYHIDNIAQQLIKNPQIFNKKVLLSTNLFMDVISEECSALVGSIGLIYSANLGDNFAMFEPAHGSAPKYAGLDKVNPVATVLAGAWMLDYLGEKEKSEAIFKATERVISEGKYVTYDVGGNAKLSQMADEIAKYTAEILK

SEQ ID NO: 27941 - DNA, 1029 bp, Methanosarcina mazei Go1
  CDS (1)..(1029): transl_table=11
atgaccaaaaccgcagcagtaatcaaaggtgacggggtaggccccgaactggtggatgcaatgcttaaagttgcagaagcctctggcactgatgtcgaattcgtaatgtgtgaagcaggagccggctggtgggaggagcatggaggtaattcccttattcctgaagagacctggcagatccttgacagttctgacgcatgtttcaagggtcctacaaccactcccggaggaatcggctccccgagaagtgtggctgtatccatcaggagaaagtacgacctttatgccaatgtcaggccaataaaaaccttcccgaattcaagtgcacctctcggagatgtcgaaatggtttgtgttcgtgaagggacagaaggtctctacataggagaagaaatccagctcacagacgatgtatccattgcaatcaggaaaattacccggacggcatccagcaagattgcccgctatgcttttgaagacgcaaaaaagagaggttacgacacagttgtgccaatccacaaaagtaacatcctgaaattgacctgcggctcattccttgaagaggtcgaaaaggttgctcacgacttcccggatatcgaggtctggccctaccatattgataatattgcccagcagcttatcaagaacccccagatctttaacaagaaagtcctcctttccaccaacctcttcatggacgtgatcagtgaggaatgctcagcccttgttggcagtatcgggcttatctattccgcaaatatcggggacaactttgcaatgtttgaacctgctcacggctcagccccgaagtatgcaggccttgacaaggtaaaccctgttgcaaccgttcttgcgggcgcctggatgctggactaccttggagaaaaggacaaatccgacgcgatctttaaagccactgagcgtgttatttccgaaggcaaatacgtgacttatgacctcggaggaagcgcaaagctcagccagatggcagatgagatcgcaaaatacacagaagaaatcctgaaataa

SEQ ID NO: 27942 - protein, 342 aa, Methanosarcina mazei Go1
MTKTAAVIKGDGVGPELVDAMLKVAEASGTDVEFVMCEAGAGWWEEHGGNSLIPEETWQILDSSDACFKGPTTTPGGIGSPRSVAVSIRRKYDLYANVRPIKTFPNSSAPLGDVEMVCVREGTEGLYIGEEIQLTDDVSIAIRKITRTASSKIARYAFEDAKKRGYDTVVPIHKSNILKLTCGSFLEEVEKVAHDFPDIEVWPYHIDNIAQQLIKNPQIFNKKVLLSTNLFMDVISEECSALVGSIGLIYSANIGDNFAMFEPAHGSAPKYAGLDKVNPVATVLAGAWMLDYLGEKDKSDAIFKATERVISEGKYVTYDLGGSAKLSQMADEIAKYTEEILK

SEQ ID NO: 27943 - DNA, 1128 bp, Methanosarcina mazei Go1
  CDS (1)..(1128): transl_table=11
atgacgcagtataaggttcccgtcctcccaggagatgggattggaccagaaatcatcgccgaaggcagaaaagtcatagatgctgcaggcgaaagatttggttttgatgtagaatggatagaatatcctcatggagcagaccactacctggaaacgggtgagctgatctcggaagagaccttaaaggaattatccggctaccctgcaatttatcttggctccataggagacccgaggattgccccaggtgtccttgaaaaggggatcttattaactgcacgcttttactttgaccagtacattaacctgcgcccgataaaactccttgagggtgtctggaccccgataaaggacaagacatcaaaagacattgactttgtcgtggtaagggaaaataccgaggacttctacataggcattggcggcagggcaaaaaaaggagcgagtaaagacctccttgaagtcaagaggacactttactccgcaaagttcggcctcgacatcgagaccgacagcgaagaaataggataccagataggccttatctccaaagagggcacaaagcgtgttattgagtacgcttttgaccttgcagaaaaccggaagaaacacgtctcatctgttgacaaggcaaacgtcctttccgacatctacgggttctggagagaagagttcaacgcagttgccgaaaagcatcctggttttaccacagacttcaacttcgttgacgctatcacaatgtggtttgtgaaaaaccctgaatggttcgatgtggtagtaaccccgaacatgttcggagacatcatcaccgacctcggagccatgatccagggcggcctcggactcgccccgggcgggaacattaacccgaacggcacaagcatgtttgagcccatccacggttcagcccctaagtacaagggccagaacaaggtaaacccgatcgcaacaatctgggcaggtgcaatgctcatagaacagctcggagaaaaggaagccgcagataccatagtcaatgcaatccagaaaaatatcctggacggcaaagtaaagacctacgatatgggcggcaaaaatactacctcagatgtcggagacgacattgcaaggataataaagggagaataa

SEQ ID NO: 27944 - protein, 375 aa, Methanosarcina mazei Go1
MTQYKVPVLPGDGIGPEIIAEGRKVIDAAGERFGFDVEWIEYPHGADHYLETGELISEETLKELSGYPAIYLGSIGDPRIAPGVLEKGILLTARFYFDQYINLRPIKLLEGVWTPIKDKTSKDIDFVVVRENTEDFYIGIGGRAKKGASKDLLEVKRTLYSAKFGLDIETDSEEIGYQIGLISKEGTKRVIEYAFDLAENRKKHVSSVDKANVLSDIYGFWREEFNAVAEKHPGFTTDFNFVDAITMWFVKNPEWFDVVVTPNMFGDIITDLGAMIQGGLGLAPGGNINPNGTSMFEPIHGSAPKYKGQNKVNPIATIWAGAMLIEQLGEKEAADTIVNAIQKNILDGKVKTYDMGGKNTTSDVGDDIARIIKGE

SEQ ID NO: 27945 - DNA, 1008 bp, Xanthomonas axonopodis pv. citri str. 306
  CDS (1)..(1008): transl_table=11
atgacgcagacaatcacggtcatccgcggcgacggcatcggcccggagatcatggatgccacgctgttcgtgctcgacgcgctgcaggctggcctgacctacgaatacgccgacgccggcctggttgcgctggaaaagcatggcgatctgctgcccgagtccactctggcgtcgatcaccaagaacaaggtggcgctgaaaagtccgctgaccacgccggtcggcgagggtttcagctcgatcaacgtcgccatgcgtcgcaagttcgacctgtacgccaacgtgcgtccggccaagtcgttcccgaacaccaagtcgcgttttgccgacggcgttgacctgatcacggtccgcgaaaacaccgaaggtgcgtatctgagcgaaggccagacggtgtccgaggatggcgagaccgcgttctccggcacccggatcacccgcaagggctccgagcgcatcgtgcgctacgccttcgagctggccaagagcaccggccgcaagaaggtcaccgccgtgcacaaggccaacatcatcaagtcgacctcgggcctgttcctgaaggtggcacgcgatgtggccgcgcagtatccggaaatcgaattccaggaaatgatcgtcgacaacacctgcatgcagctggtgatgcgtcccgagcaattcgacatcatcgtgaccaccaacctgttcggcgacatcatctccgacctgtgcgccggcctggtcggcggcctgggcctggcgccgggcgccaacatcggtctggacgcggcgatcttcgaagccgtgcacggctcggcgccggatatcgcagggcagggcaaggccaacccgtgcgcgctgctgcttggcgcggcgcagatgctcgaccacatcggtcagccgcagaatgccgagcgcctgcgcgaagccatcgtcgccaccctggaagccaaggattcgctgacccccgacctgggcggcaccggcaacaccatgggctttgccaaggccatcgccagccgcctctga

SEQ ID NO: 27946 - protein, 335 aa, Xanthomonas axonopodis pv. citri str. 306
MTQTITVIRGDGIGPEIMDATLFVLDALQAGLTYEYADAGLVALEKHGDLLPESTLASITKNKVALKSPLTTPVGEGFSSINVAMRRKFDLYANVRPAKSFPNTKSRFADGVDLITVRENTEGAYLSEGQTVSEDGETAFSGTRITRKGSERIVRYAFELAKSTGRKKVTAVHKANIIKSTSGLFLKVARDVAAQYPEIEFQEMIVDNTCMQLVMRPEQFDIIVTTNLFGDIISDLCAGLVGGLGLAPGANIGLDAAIFEAVHGSAPDIAGQGKANPCALLLGAAQMLDHIGQPQNAERLREAIVATLEAKDSLTPDLGGTGNTMGFAKAIASRL

SEQ ID NO: 27947 - DNA, 1305 bp, Yersinia pestis KIM
  CDS (1)..(1305): transl_table=11
ttgacacgaatcttacaaagcattaacaaaattgcgctgaaggagaggttgatggaaagcaaagtagttgttccggcagaaggtaagaaaattactgtcgatgctcagggtaaactggttgttccgcataatccgatcattccatttattgaaggtgacggtattggtgttgatgtaaccccggcgatgatcaacgtggtagatgctgcggttaagaaagcttataacggtgaacgtaaaatttcctggatggaaatttacactggtgagaaatcaacccatgtctatggtaaagatgtttggttgccagaagaaaccttagatctgatccgtgattatcgcgttgctatcaaaggcccgttgaccactcctgtcggtggcggcatccgttctttgaacgttgctctgcgtcaacaacttgacctgtatgtgtgtctgcgtccggtgcgttattatgaaggcaccccaagcccggtaaaacaccctgaactgaccaacatggtgattttccgtgaaaacgctgaagatatctatgcgggtatcgaatggaaagcgggttcacccgaagcagagaaagtgatcaagttcctgcgtgaagagatgggtgtgaagaaaatccgtttccctgaacaatgtggtatcggtgtgaaaccgtgttcagaagaagggactaagcgtttggtacgtgcagcgattgaatatgcaattaccaacgatcgtgaatcagttacgctggttcataaaggcaatattatgaaattcaccgaaggcgcgtttaaagactggggttatcagttagcgcgtgaggaatttggtggtgaactgatcgacggtggcccatgggttaaaatcaaaaacccaaataacggcaaagaaattatcgttaaagatgtgattgccgatgctttcctgcaacagatcctgctgcgtcctgcggaatatgatgttatcgcttgtatgaacctgaacggtgattacatctctgatgcattggcagctcaggttggcggtattggtattgctccgggggctaacattggtgatgactgcgcactgttcgaagccactcacggtactgcaccaaaatatgctggtcaggataaagtgaacccaggttctattattctttcagcagaaatgatgctgcgtcacatgggctggtttgaagccgctgacttaatcattaaaggcactgaaggcgcaattcaagccaagaccgtgacttatgatttcgaacgtctgatggaaggcgctaagttgttgaagtgtagtgagtttggcgacgccattattaagcacatgtag

SEQ ID NO: 27948 - protein, 434 aa, Yersinia pestis KIM
MTRILQSINKIALKERLMESKVVVPAEGKKITVDAQGKLVVPHNPIIPFIEGDGIGVDVTPAMINVVDAAVKKAYNGERKISWMEIYTGEKSTHVYGKDVWLPEETLDLIRDYRVAIKGPLTTPVGGGIRSLNVALRQQLDLYVCLRPVRYYEGTPSPVKHPELTNMVIFRENAEDIYAGIEWKAGSPEAEKVIKFLREEMGVKKIRFPEQCGIGVKPCSEEGTKRLVRAAIEYAITNDRESVTLVHKGNIMKFTEGAFKDWGYQLAREEFGGELIDGGPWVKIKNPNNGKEIIVKDVIADAFLQQILLRPAEYDVIACMNLNGDYISDALAAQVGGIGIAPGANIGDDCALFEATHGTAPKYAGQDKVNPGSIILSAEMMLRHMGWFEAADLIIKGTEGAIQAKTVTYDFERLMEGAKLLKCSEFGDAIIKHM

SEQ ID NO: 27949 - DNA, 1077 bp, Thermosynechococcus elongatus BP-1
  CDS (1)..(1077): transl_table=11
atgtcccacgctgtcaccttaattcgcggcgacggtattggtcctgaggttgccgcggcagctcgcaccgccattgatgccacaggcgtcaaaattgactgggtggtggtggatgccggcgtggccatgatggagcgctacggtacccccttgcccgaagaggttatcgatgccatcaaaagtacgaaaactgccatcaaaggcccaattaccacccccgtggggacaggctttcgttctgtcaatgtcgagatccgcaagcggctcaatctctatgcgaacctacggcctgctaaatccattgttggggtgaaaagctattttcaaaacattgacctcgtcattgttcgcgagaataccgaagacctctacgccgggattgagtttgcatacaccagtcccgaagcagctaaagctcgcgcctttttgagtgatctatcgggcaagccgattcgggaggatgcagccattggtgttaagcccatttctgtcctagggagcgatcgcatcctggagtttgccttcaaatatgccaaggctaacggccgcaaaaaagtgacagccgttcacaaggccaacatcatgaaatttaccgatggcctcttccttgaacgtgcccgcgaaattgccagccgttaccccgatattgtctttgaagatcgcattgtcgataacatgtgcatgcagttgatgcagaagcccgaactctacgatgtgatggtgatgccaaacctctacggcgatattctgtcagacctttgtgcagggatgattggtggtctaggggtggctcccggcgccaatattggcgatgaatgtgcggtttttgaggcgattcacggttcagcccccaaatatgcaggtcaaaacaaagccaatcccacggccttgattctctcaggggttttgatgctgcaacacctgggtgaaatggaggcggcacagcgtctgcaagcggctgtcgaaaaagtaattgctgaggggcgctttgtcacctacgatttggcggcgccgggcaaagaacccgtaggtacccaagagatggctgcggcgattgccgagtacgccgccccctaa

SEQ ID NO: 27950 - protein, 358 aa, Thermosynechococcus elongatus BP-1
MSHAVTLIRGDGIGPEVAAAARTAIDATGVKIDWVVVDAGVAMMERYGTPLPEEVIDAIKSTKTAIKGPITTPVGTGFRSVNVEIRKRLNLYANLRPAKSIVGVKSYFQNIDLVIVRENTEDLYAGIEFAYTSPEAAKARAFLSDLSGKPIREDAAIGVKPISVLGSDRILEFAFKYAKANGRKKVTAVHKANIMKFTDGLFLERAREIASRYPDIVFEDRIVDNMCMQLMQKPELYDVMVMPNLYGDILSDLCAGMIGGLGVAPGANIGDECAVFEAIHGSAPKYAGQNKANPTALILSGVLMLQHLGEMEAAQRLQAAVEKVIAEGRFVTYDLAAPGKEPVGTQEMAAAIAEYAAP

SEQ ID NO: 27951 - DNA, 1269 bp, Oceanobacillus iheyensis HTE831
  CDS (1)..(1269): transl_table=11
atgacacaagctgaaaaaatcgtagtagaaaacggaaaaatgaacgtacctgatacgccaatcattccatttattgaaggagacggaactggtccagatatttgggcttctgctcaaaaagttatagaagcagcggttgataaagcgtatgatggtaagaaaagtattgagtggatggaagtatatgctggtcaaaaggcatatgacaaaactggcgaatggttgccaaaagatacacttgataaaattaatgaatataaaattgctatcaaaggtcccttaactacaccgatcggtggaggtattcgttcccttaatgtagcattacgtcaagagttagatttatttacatgtttacgaccagtgcgttactttgaaggagtaccttcgccagttaaacgtccagaagaagtagatatggttattttccgtgaaaatacagaggatatttatgctggaatagaatggcaaaaaggttctgacgaagtgaaaaaagtaattaacttcctaaaagaagaaatgggagtaaaaaatattcgcttcccagaaacgtcaggaattggtgtaaaaccagtatctgaagaaggtacaaaacgattagtgcgttcagctattgactatgcacttaatgaaggtcgtaaaaatgttactttagtacataaaggtaacatcatgaaatttacagaaggtgcttttaaaaactggggttatgaagtagctgagcaagaatacggtgataaagtatttacttgggcagagtacgatcgtattgtagaagcagaaggtaaggatgcagctaataaagcacaagacgaagcacttgcttctggtaaaattcttgtgaaagatgcaattgctgacattttcttacaacaagttcttactcgtccgaaagagtttgatgttgtagctacgatgaatttaaatggtgactacatttctgatgcacttgcagcacaagtaggtggaattggaattgcacctggagcgaacatcaattatgatactggacatgcgatttttgaagcgacacatggtactgcacctaagtatgcgggattagataaagtaaatccatcttctgttattctatccgctgtacttatgttagaacacttaggttggagagaagctgcagacttaattacgaaatcaatggacaagacgattggttcaaaagtagttacgtatgactttgcacgcctaatggatggagcaaaagaggttaaatgctctgaatttggacaagaactaattaaaaatatgtaa

SEQ ID NO: 27952 - protein, 422 aa, Oceanobacillus iheyensis HTE831
MTQAEKIVVENGKMNVPDTPIIPFIEGDGTGPDIWASAQKVIEAAVDKAYDGKKSIEWMEVYAGQKAYDKTGEWLPKDTLDKINEYKIAIKGPLTTPIGGGIRSLNVALRQELDLFTCLRPVRYFEGVPSPVKRPEEVDMVIFRENTEDIYAGIEWQKGSDEVKKVINFLKEEMGVKNIRFPETSGIGVKPVSEEGTKRLVRSAIDYALNEGRKNVTLVHKGNIMKFTEGAFKNWGYEVAEQEYGDKVFTWAEYDRIVEAEGKDAANKAQDEALASGKILVKDAIADIFLQQVLTRPKEFDVVATMNLNGDYISDALAAQVGGIGIAPGANINYDTGHAIFEATHGTAPKYAGLDKVNPSSVILSAVLMLEHLGWREAADLITKSMDKTIGSKVVTYDFARLMDGAKEVKCSEFGQELIKNM

SEQ ID NO: 27953 - DNA, 1008 bp, Shewanella oneidensis MR-1
  CDS (1)..(1008): transl_table=11
atgtcaaaaagaacgataaccgtaattccaggtgatggaattggcccaagtattattgattcagccttaaaaattcttgataaagcaggttgtgattttgaatatgaatttgccgatgctggtttagcagcactcgaaaaacaaggcgagttacttccgcagcgtactttagaactgattgaaaaaaaccgcatcactctgaaaggcccgctgactacaccagtgggtgaaggctttacctctatcaacgtgacattacgtaaaaaattcggcctgtacgcgaacgtgcgcccagtgttgtctttcaaaggcacccaagcccgttatgaaaacattgatatcatcacagtgcgtgaaaacaccgaaggtatgtattcaggccacggtcaaaaagtgtcagaagacggtagcacagctgaagccaccagtattgtcactcgccaaggtgccgaacaaatcgcgacctttgcctacgaactggcccgtaaagaaagccgcaagaaagtcactatcgtgcacaaggcaaacatcatgaagtcaacttcaggtctgttcctgaaagtagctcgtgaagtaagcctacgctatccagatatcaaaaccgaagaaatgatcgtcgatgcgacttgcatgaagttagtaatgaacccagaaaactttgatgtgatcgtgaccactaacctgtttggtgacattctgtcggatctgtgtgcgggtttagtcggtggtttaggtatggcaccaggcgccaacattggccgtgatgcagcgattttcgaagcggttcacggcagcgcgccagatatcgcaggtaaaaacctcgcgaacccaacctcagtgatcttggcctctatccaaatgctggaatacttaggtatggccgataaagcggctccgatccgtaaagcggtatctgctgtgattgaagaaggcgaccgtacgactcgcgatttaggcggcacccacggcacaactgacttcacacaagcggtgcttgaccgtctgtga

SEQ ID NO: 27954 - protein, 335 aa, Shewanella oneidensis MR-1
MSKRTITVIPGDGIGPSIIDSALKILDKAGCDFEYEFADAGLAALEKQGELLPQRTLELIEKNRITLKGPLTTPVGEGFTSINVTLRKKFGLYANVRPVLSFKGTQARYENIDIITVRENTEGMYSGHGQKVSEDGSTAEATSIVTRQGAEQIATFAYELARKESRKKVTIVHKANIMKSTSGLFLKVAREVSLRYPDIKTEEMIVDATCMKLVMNPENFDVIVTTNLFGDILSDLCAGLVGGLGMAPGANIGRDAAIFEAVHGSAPDIAGKNLANPTSVILASIQMLEYLGMADKAAPIRKAVSAVIEEGDRTTRDLGGTHGTTDFTQAVLDRL

SEQ ID NO: 27955 - DNA, 2160 bp, Drosophila melanogaster
  CDS (1)..(2160)
atgtccggcaattggttcaaatggactgctcttcacgggcggccaagaactgtcggcttaaacactaatggaagaattctacggcttttggacgatgccgtagttcgatttcggcagccattctacgaatcttggcggcgtcgtaggcgccttgaagacattgaaaagagagaaatcccagtgcgacagcaagttccaaggatacggcacaatcgttgtccaggggcgaaggaaaatccttgccgcaaaatgcccagtgttcttcctgggaagggtgaagtgcttgttccctctcgcattcaaccgccacggaattcaatgggtttctcagttataagattatttggaagctccactaatgatgggggttccggtgaaccaccggaaaatcgcgaaggaaagctcattaagtttacagtgggttctcgcatagccaaacccaaaacgggcaagattgaaatatcaaaaaaaggaccattaggttttgagacaactaaactaccagttcaagaatcattaccgcagtctgattacttatcaggactatcgaaaaaaagtccagacaaggatacaactccagacaccagcaccacacaagcttcagatcgatcgggaaaagaagggaatgaggaaaaaattaaagatgatatacctagatcattctcagaatacatcatacattgggattccgaatccaaaaatccttcaggaattcagtcccagcaacccgaaagatgcgaaagtgctggaaatcctccatctggagggaaaccacccaccaaacctccaacaggacccagtactccgtcaggtcccagcaatccttcaagaccaccatcaagaaaggataataatccatttagcggaatgggatccgaaccgcctaagaagccacctttgggaagtaagcctcctagcaaattaccaccaagaagtacgtctcccaaaaaaccaccaacaggcagtacaccgccccaaaaaccaacaaaatctagtaagccgccaaataaaccaccagcgggaccagggaaaaagtcagccagtaaaccacccacagcaagtaagcctcctgttaaatctccagcaggaggacaaggtcagaaaggtggagctggaggtaagtctggaaaggcttcaggtgaaccgagggtcataaccctaatgccaggcgatggcatcgggccagagatatcgatggcagtgataaagatccttgaggccgcaaaaactcctttaatctttgagcctgttgacgtgacccccgtgttgaatagccaaggtatgacatcggtgcccgagcaggtgatcgagagtatgaaccgaacgaaagttggtctcaaaggtccactgatgacacccgtgggcactggcttccgctccctcaatcttaccctgcgccagctatttaacctatatgccaacattcgaccgtgcagatccctgccaggtgtggaaaccgtttacggcgatgtggacatagtgaccatacgcgagaacaccgagggtgagtactcgggcatcgagcacaccctggttaacggtgtggtgcagagcatcaagctgatcactcggaatgcctcgctccgggtggccgagtacaccttccagtacgccctggctatgaagcggaaaaaggttacggccgtggctgaatcgcaggttatgaggatgtcggacgggctatttctgcggtgtgtccgcgaaatggcagcaaagtataagagcaaaatggatcaggcaggcattaaatatgaagagtccaccatgactaccgtctgtctgaatattgtccaggatcccaagcgatacgatatgctggtgctgcccaatctgtacggggatatcatttcggacacctgcgccggattgattggtggattgggtctgacgccgtcgggaaatgtaggcaccaatggcgccattttcgagtccgttcacggaactgcgcctgatattgctggcaaggatttggccaacccgaccgccttactgctttcctccgtgatgatgctgcactacatcggattgcatgagcatgcggacaagatagagaaggcagtgctgaagactattagggatgataatattcgcaccatggatctgggcggcaaggccaaatgctccgagtacaccgatgccctgatcaaaaaccttaagtga

SEQ ID NO: 27956 - protein, 719 aa, Drosophila melanogaster
MSGNWFKWTALHGRPRTVGLNTNGRILRLLDDAVVRFRQPFYESWRRRRRLEDIEKREIPVRQQVPRIRHNRCPGAKENPCRKMPSVLPGKGEVLVPSRIQPPRNSMGFSVIRLFGSSTNDGGSGEPPENREGKLIKFTVGSRIAKPKTGKIEISKKGPLGFETTKLPVQESLPQSDYLSGLSKKSPDKDTTPDTSTTQASDRSGKEGNEEKIKDDIPRSFSEYIIHWDSESKNPSGIQSQQPERCESAGNPPSGGKPPTKPPTGPSTPSGPSNPSRPPSRKDNNPFSGMGSEPPKKPPLGSKPPSKLPPRSTSPKKPPTGSTPPQKPTKSSKPPNKPPAGPGKKSASKPPTASKPPVKSPAGGQGQKGGAGGKSGKASGEPRVITLMPGDGIGPEISMAVIKILEAAKTPLIFEPVDVTPVLNSQGMTSVPEQVIESMNRTKVGLKGPLMTPVGTGFRSLNLTLRQLFNLYANIRPCRSLPGVETVYGDVDIVTIRENTEGEYSGIEHTLVNGVVQSIKLITRNASLRVAEYTFQYALAMKRKKVTAVAESQVMRMSDGLFLRCVREMAAKYKSKMDQAGIKYEESTMTTVCLNIVQDPKRYDMLVLPNLYGDIISDTCAGLIGGLGLTPSGNVGTNGAIFESVHGTAPDIAGKDLANPTALLLSSVMMLHYIGLHEHADKIEKAVLKTIRDDNIRTMDLGGKAKCSEYTDALIKNLK

SEQ ID NO: 27957 - DNA, 1257 bp, Pseudomonas putida KT2440
  CDS (1)..(1257): transl_table=11
atgggataccagaaaatcaaggttccgaccgacggcaccaaaattaccgtcaatgcagaccattcgcttaacgtgcctgaccatccgatcattccttacatcgaaggcgacgggatcggcgtcgatgtttcgccggtaatgatcaaggtggtcgatgccgccgtgcagaaggcctacggcggcaagcgcaagattgcctggatggaggtgtacgctggcgagaaagccacccaggtgtatgaccaggatacctggctaccgcaggaaaccctcgatgccgtgcgtgattatgtggtatcgatcaagggcccgctgaccacgcccgtcggtggcggcatccgctccctcaacgtggccctgcgccagcaactggacctgtatgtatgcctgcggccggtgctgtggttccagggtgtgccaagcccggtgaaaaagccgggcgacgtcgacatggtgatcttccgcgagaactccgaagacatctatgccggcatcgagtggaaggccgggtcgcccgaggcgaacaaggtgatcaagtttctcaaggaggaaatgggggtcaccaagatccgcttcgaccaggactgcggtatcggcgtcaagccggtgtcgaaggagggtaccaagcgtctggtgcgcaaggccctgcaatacgtggtggataacgaccgcgaatcactgaccctggtgcacaagggcaacatcatgaagttcaccgagggtgccttcaaggactgggggtacgaggtggcgcgtgacgagttcggcgctgaactgcttgatggcggcccttggatgaagttcaagaaccccaagaccggtcgcgaggtcatcgtcaaggacgccatcgccgacgccatgctgcagcagatcctgctacgcccggccgagtacgacgtgatcgccaccctcaacctcaacggtgactacctgtccgatgccctggccgcagaagtgggcggtatcggcattgccccgggcgccaacctgtccgacaccgtggccatgttcgaggccactcacggcactgcgcccaagtatgccgggcaggacaaggtcaacccgggctcggtgatcctctcggcagagatgatgctgcgccacatggggtggaccgaggccgccgacctgatcatcaagggcaccaatggcgccattgcggccaagaccgtgacctacgatttcgagcgattgatggagggcgccaagctggtaagcagctcaggctttggcgatgaaatgatcaaacacatgtaa

SEQ ID NO: 27958 - protein, 418 aa, Pseudomonas putida KT2440
MGYQKIKVPTDGTKITVNADHSLNVPDHPIIPYIEGDGIGVDVSPVMIKVVDAAVQKAYGGKRKIAWMEVYAGEKATQVYDQDTWLPQETLDAVRDYVVSIKGPLTTPVGGGIRSLNVALRQQLDLYVCLRPVLWFQGVPSPVKKPGDVDMVIFRENSEDIYAGIEWKAGSPEANKVIKFLKEEMGVTKIRFDQDCGIGVKPVSKEGTKRLVRKALQYVVDNDRESLTLVHKGNIMKFTEGAFKDWGYEVARDEFGAELLDGGPWMKFKNPKTGREVIVKDAIADAMLQQILLRPAEYDVIATLNLNGDYLSDALAAEVGGIGIAPGANLSDTVAMFEATHGTAPKYAGQDKVNPGSVILSAEMMLRHMGWTEAADLIIKGTNGAIAAKTVTYDFERLMEGAKLVSSSGFGDEMIKHM

SEQ ID NO: 27959 - DNA, 1008 bp, Xylella fastidiosa Temecula1
  CDS (1)..(1008): transl_table=11
atgacgcaaacaattacggtgatccgcggtgatggtatcggcccggaaatcatggatgccaccctgtcggtattaaacgcgttacaagcgaatctgaattacgaattcgcagatgcaggcttgagcgcacttgaaaaacacggagacttgctaccggaatccaccctgaattcaatcagcaagaacaaaatcgcgctaaaaagcccgctcacaaccccggtaggtgaaggtttcagctcgatcaatgtcgccctgcgacgtaaattcgacttatacgccaacgttcgccccgcaaaatctttcccaaataccaagtcacgctttagcgataacgtagacctgatcaccgtacgggaaaataccgagggtgcctacctgagcgagggtcaaaccatctctcctgacggagaagttgccacttcaagcgcacgagtgacccgtaaagggtcggaacgtatcgtccgttacgcattcgacttagcccgaacaacgggccgcaaaaaggtcaccgcagtacacaaagccaacatcattaaatcaacctctggactatttctgaaaaccgcccgagacgtcgcaagccagtacccagaaatcgatttccaagaaatgatcgtcgacaacacttgcatgcaacttgtaatgcgcccagaacaattcgacatcattgtcaccacaaacttgttcggtgacatcctctcagatttgtgcgcaggcttggtcggcggtttaggcttggctccgggcgccaacattggtaatgaacaagccatcttcgaagccgtacatggctcggctccagacatcgctggacaaggtaaagccaatccatgcgcgctgctgctaggtgctgtacaaatgctggatcatatcggtcaaccacaaaacgccgaacgcctacgcaacgcaatcgtggccacactgaatgccaaagattcgctgactcccgatctggggggtaacggcaacaccatgggattcgccaaggcaattgcaagcagactctaa

SEQ ID NO: 27960 - protein, 335 aa, Xylella fastidiosa Temecula1
MTQTITVIRGDGIGPEIMDATLSVLNALQANLNYEFADAGLSALEKHGDLLPESTLNSISKNKIALKSPLTTPVGEGFSSINVALRRKFDLYANVRPAKSFPNTKSRFSDNVDLITVRENTEGAYLSEGQTISPDGEVATSSARVTRKGSERIVRYAFDLARTTGRKKVTAVHKANIIKSTSGLFLKTARDVASQYPEIDFQEMIVDNTCMQLVMRPEQFDIIVTTNLFGDILSDLCAGLVGGLGLAPGANIGNEQAIFEAVHGSAPDIAGQGKANPCALLLGAVQMLDHIGQPQNAERLRNAIVATLNAKDSLTPDLGGNGNTMGFAKAIASRL

SEQ ID NO: 27961 - DNA, 1191 bp, Bacteroides thetaiotaomicron VPI-5482
  CDS (1)..(1191): transl_table=11
atgaacaaaataaccatgcaaaaagatggtacgctatcggtgcccgatgtgcctgtcgtaccttatattaccggagacggagtaggagcggaagtgactccgtcgatgcagtccgttgtgaacgcggctgttcagaaagcatacggcggcaaacgtcggattgaatggaaagaagtgctggcgggcgaacgcgctttcaacgagacaggttcgtggttgccggatgaaacgatgaaggctttccaagaatatctgatcggcatcaaggggccgctgacgacccctgtcggcggtggaatccgttctttgaacgtggctttgcgccaaactctggatttgtatgtttgtctgcgtccggtccgttggtatcaaggcgttcattctccggtgaaagcaccggaaaaagtgaacatgtgcgtgttccgtgaaaatacggaggatatatatgcaggaatcgagtgggaggcaggtactcccgaagccgaaaagttctatcaattcctgaaaaacgagatgggagtgacgaaagtccgcttccccgagacctcttcttttggagtgaaacctgtttcccgtgagggcacggaacgtcttgtgcgggctgcctgccagtatgcgctcgaccatcatctgccttccgtgacactggtgcacaaaggaaacattatgaagttcaccgaaggaggcttcaagaaatggggctatgagctggcgcaacgtgagttcggcgacgccttggcagacggccggttggtgataaaggactgcatcgccgatgctttcctgcaaaatacattactgattcccgaagaatattccgtgattgccacgctgaacctgaacggagactacgtttccgaccagttggcggcaatggtaggcggcatcggcattgctccgggagcaaatattaactacaagacggggcacgccatttttgaagcgactcatggaaccgcccccaacattgccggaaaggatgtcgtgaatccttgttctatcattctttcggcggtgatgatgcttgaatatctgggatggaaagaagcggccgcgcttatcgaaaaggcgttggaacagagtttcctcgatgcccgtgccacgcacgatctggctcgctttatgccgggaggtacatccctgtctaccaccgctttcacacgcgaaattgtggaaagaatcgaaaagtaa

SEQ ID NO: 27962 - protein, 396 aa, Bacteroides thetaiotaomicron VPI-5482
MNKITMQKDGTLSVPDVPVVPYITGDGVGAEVTPSMQSVVNAAVQKAYGGKRRIEWKEVLAGERAFNETGSWLPDETMKAFQEYLIGIKGPLTTPVGGGIRSLNVALRQTLDLYVCLRPVRWYQGVHSPVKAPEKVNMCVFRENTEDIYAGIEWEAGTPEAEKFYQFLKNEMGVTKVRFPETSSFGVKPVSREGTERLVRAACQYALDHHLPSVTLVHKGNIMKFTEGGFKKWGYELAQREFGDALADGRLVIKDCIADAFLQNTLLIPEEYSVIATLNLNGDYVSDQLAAMVGGIGIAPGANINYKTGHAIFEATHGTAPNIAGKDVVNPCSIILSAVMMLEYLGWKEAAALIEKALEQSFLDARATHDLARFMPGGTSLSTTAFTREIVERIEK

SEQ ID NO: 27963 - DNA, 1284 bp, Coxiella burnetii RSA 493
  CDS (1)..(1284): transl_table=11
atgacggagttaaccggagtatccatcgtgacttaccaacacatcaaagttcccagccaaggtgaaaaaatcaccgttaataaagccgttttagaagttcctgaccgacccattattccctttatcgaaggagatgggattggcattgatatcgcgcccgtcatgaaaaacgtggtcgatgccgccgtggaaaaatcctacgctggaaagcgaaaaattgaatggatggagatctacgccggagaaaaggctacgaaagtgtatggcaaagacaattggctgcctgatgagacactcgaagccattaaagaataccaagtggccattaaaggtcccttaaccacgccggtggggggtggcatacgttcgctcaatgtcgcgctgcgccaacagttagacctgtatgtttgccttaggcccgtccgttattttacgggtgtgccaagcccggtcaaaacgcctgaaaaggtgaatatggtgattttccgcgaaaattctgaagatatttacgccggaattgaatggccggcgggaagcccggaagcggtgaaattaatcaacttccttcaaaacgaaatgggcgtaaagaaaatccgtttcccggaaacggcggggatagggattaaaccggtttctaaagaaggcacgagccgtttagtacgccgagcgattcaatatgccattgataatgaccgcgattccgtgacgctcgtccataaaggtaacatcatgaaattcacggagggggcttttaaagattggggctatgaagtcgctgtcaaagaatttggagcaaagcccttagatggcggaccctggcatgtctttgagaatccgaaaacaggccaaaagattacgattaaagacgttattgccgacgcctttttacaacaaattttattgcgtcccgccgagtacagcgtcatcgccaccttgaacctcaatggagattatatctccgacgcgttagcggccgaagtcggcggcattggcattgctccgggcgctaatttaagcgacaccgtcggtctttttgaagccactcatgggacagcgcctaaatatgcggggcaagataaagtcaatccaggctctctaattttatcagcagaaatgatgctccgttacctaggctggaaagaagccgccgaccttgtcgttcaaggtattgagggggcgattgaaagtaaaacagtaacttacgattttgcccgtttgatgaccggcgccaaagaagtaagtacctctcagttcggcaaagccataattaagcatattctgtag

SEQ ID NO: 27964 - protein, 427 aa, Coxiella burnetii RSA 493
MTELTGVSIVTYQHIKVPSQGEKITVNKAVLEVPDRPIIPFIEGDGIGIDIAPVMKNVVDAAVEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 27965 - DNA, 1248 bp, Nitrosomonas europaea ATCC 19718
  CDS (1)..(1248): transl_table=11
atgtatcagcatatcaaagtaccaaccactggcagcaaaattcgggtaaaggatgattcttccctggttgtgcccgacaacccgatcattccttttatcgaaggcgatggtatcggtgtggatatcacacctgtcatgatcagcgttgtcgatggtgcagtaaaaaaagcatacggcgactcccggaaaatttcctggatggaaatatatgccggtgagaaatctacccgggtctatggtcaggatatctggctgccagatgagactttgcaggcagccaaagaattcgtggtatccatcaaagggccgctgaccacaccggtaagtggaggtatccgctcgatcaacgtggcattgcgccagttactggatctgtatgtgtgcctgcgcccggtacgctatttccaaggggtacccagtccggtcaaacaaccggagaaagtggacatggtcatatttcgtgaaaactcggaagatatctatgcgggaatcgaatgggaagccggaacggaagctgttgaaaaagtgatcaatttcctgacggcagaaatgggaattaccaaaatccgattccctcgttcctctgcgatcgggatcaaaccggtttcaaaagaaggcagtgagcgtctgatcagaaaagccatccagtatgcaatcgaccataaacgtcgctctgtcacactggtgcacaaaggtaatatcatgaagttcactgaaggtgccttcaagaaatggggttatgaactggcagcgaaggaattcggtgcggagctactggatggcgggccatggatgatactgcggcacaacggtaatgaaatcatcatcaaagatgtcatcgccgacgcctttctccagcaaatcctgctgcgcccggatgaatatgatgtcatcgccacccttaatttgaacggtgactacatttccgatgctctggccgcacaggtaggcggcattggaatcgcgcccggtgcaaatatgagtgacagcatcgcaatattcgaagcgacacacggcactgcacccaaatatgctggtaaggatcaggtcaacccggggtcaattattctgtcagcagaaatgatgctcagacatatcggctggcatgaagcagccaatattgtcatcagctcaatggaaaaaacgattcaggatcgaatcatgacctacgatctggcaagacttacgccgaacgccaaacaggccacttcttcagaatttgggaatgccatggtagcgaggatgtaa

SEQ ID NO: 27966 - protein, 415 aa, Nitrosomonas europaea ATCC 19718
MYQHIKVPTTGSKIRVKDDSSLVVPDNPIIPFIEGDGIGVDITPVMISVVDGAVKKAYGDSRKISWMEIYAGEKSTRVYGQDIWLPDETLQAAKEFVVSIKGPLTTPVSGGIRSINVALRQLLDLYVCLRPVRYFQGVPSPVKQPEKVDMVIFRENSEDIYAGIEWEAGTEAVEKVINFLTAEMGITKIRFPRSSAIGIKPVSKEGSERLIRKAIQYAIDHKRRSVTLVHKGNIMKFTEGAFKKWGYELAAKEFGAELLDGGPWMILRHNGNEIIIKDVIADAFLQQILLRPDEYDVIATLNLNGDYISDALAAQVGGIGIAPGANMSDSIAIFEATHGTAPKYAGKDQVNPGSIILSAEMMLRHIGWHEAANIVISSMEKTIQDRIMTYDLARLTPNAKQATSSEFGNAMVARM

SEQ ID NO: 27967 - DNA, 1092 bp, Arabidopsis thaliana
  CDS (1)..(1092)
atgtctcgccaatcgttttctctactgaagaatcttcgtagcatcgcttccggttccaaaatccagacccgatccgtgacttacatgcccagacccggtgacggaaaaccaagaccagtgacgttaatccccggagacggagttggtccgttggtaacaaacgcggttcaacaagtgatggaagcgatgcacgctccggtttacttcgaaccgttcgaagttcatggagatatgaagagtttacctgaaggattgttggaatcgattaagaagaacaaagtttgtttgaaaggtggtcttaagactcccgtcggtggtggtgtgagctctctcaatgttaatctgagaaaggagcttgatctctttgcttctttggtcaactgtttcaatttgcctggtttagcttctcgtcatgagaatgttgatattgttgtgattagagagaacactgaaggtgaatatgcaggtcttgaacatgaagttgttcctggtgttgttgagagccttaagttctgttcagagcgtattgcaaagtatgcgtttgagtatgcctacttgaacaacaggaagaaagttacagcagtgcacaaggctaatatcatgaaattggctgatggtttgttcttggagtcttgtcaagaggttgctaagaagtatccaagcattgcttacaatgaaatcattgttgataattgttgtatgcaacttgtggctagaccagagcaattcgatgtcatggtgacgcctaatctctatggtaatctagtggcaaacactgctgctggtattgctggaggtactggagtcatgcctggaggaaatgttggggcggagtatgcggtctttgagcaaggtgcatcagcgggaaacgtggggaaggatacaacggaagagcaaaagaatgcaaaccctgtggctttgttgctgtcatcagccatgatgcttagacaccttcagttcccttcttttgctgacaggcttgaaaccgctgtgaagcgtgttatcgctgaagggaattgtcggactgaagatcttggtggaaacagtaccactcaagaggtcgttgacgctgtcattgcaaatttggattga

SEQ ID NO: 27968 - protein, 363 aa, Arabidopsis thaliana
MSRQSFSLLKNLRSIASGSKIQTRSVTYMPRPGDGKPRPVTLIPGDGVGPLVTNAVQQVMEAMHAPVYFEPFEVHGDMKSLPEGLLESIKKNKVCLKGGLKTPVGGGVSSLNVNLRKELDLFASLVNCFNLPGLASRHENVDIVVIRENTEGEYAGLEHEVVPGVVESLKFCSERIAKYAFEYAYLNNRKKVTAVHKANIMKLADGLFLESCQEVAKKYPSIAYNEIIVDNCCMQLVARPEQFDVMVTPNLYGNLVANTAAGIAGGTGVMPGGNVGAEYAVFEQGASAGNVGKDTTEEQKNANPVALLLSSAMMLRHLQFPSFADRLETAVKRVIAEGNCRTEDLGGNSTTQEVVDAVIANLD

SEQ ID NO: 27969 - DNA, 1125 bp, Arabidopsis thaliana
  CDS (1)..(1125)
atgaccatgacagcatttctcgcgagacggcttatcggtaacggatcgagccagattctcgggacttcgagttctagctccggtccgttcatttccgtttctagggctttcttctcctcctccactccgatcaaagctactctctttcccggtgatgggatcggtcccgaaatcgctgaatctgtcaagcaggtgtttactgccgctgatgtggttattgattgggacgaacagtttgttggtactgaagtagatcctagaaccaatagtttcttgacatgggataatcttcaatctgtgcttaaaaacaaggttggtttgaaaggaccaatggctactccaattggaaagggtcaccgttccttgaaccttactcttaggaaagagctgaatttgtatgccaatgttaggccttgttacagtcttcctggttacaaaacccgttatgatgatgttgatctcattaccattcgtgagaacactgaaggagagtacagtgggcttgaacaccaggtcgtcaagggtgtagtggaaagtcttaaaattattacccgtaaggcgagtatgagagttgccgagtatgcctttctttatgccaagactcacggaaggaagaaagtttctgcaattcacaaagccaacattatgcagaaaactgatggtcttttcctgcagtgttgtgatgaagttgctgcgaagtatcctgagatatattacgagaaggttgttattgacaattgctgtatgatgcttgtgaaaaacccagcactttttgatgtcttggtgatgccaaatctctatggagatattatcagcgatttgtgtgctggacttgttgggggactaggactgactcctagtatgaatattggggaggatggtattgcccttgctgaagctgttcacggctctgcacctgatattgctggaatgaacctggcgaacccaacagctttgctactgagtggagtgatgatgttgcggcacctgaagctcaacaaacaagcagagcaaatccacagtgccatcatcaacacaatagccgagggaaagtatagaactgctgatctcggaggttcctcaactacaacagatttcacaaaagccatctgtgatcatctctaa

SEQ ID NO: 27970 - protein, 374 aa, Arabidopsis thaliana
MTMTAFLARRLIGNGSSQILGTSSSSSGPFISVSRAFFSSSTPIKATLFPGDGIGPEIAESVKQVFTAADVVIDWDEQFVGTEVDPRTNSFLTWDNLQSVLKNKVGLKGPMATPIGKGHRSLNLTLRKELNLYANVRPCYSLPGYKTRYDDVDLITIRENTEGEYSGLEHQVVKGVVESLKIITRKASMRVAEYAFLYAKTHGRKKVSAIHKANIMQKTDGLFLQCCDEVAAKYPEIYYEKVVIDNCCMMLVKNPALFDVLVMPNLYGDIISDLCAGLVGGLGLTPSMNIGEDGIALAEAVHGSAPDIAGMNLANPTALLLSGVMMLRHLKLNKQAEQIHSAIINTIAEGKYRTADLGGSSTTTDFTKAICDHL

SEQ ID NO: 27971 - DNA, 1425 bp, Prochlorococcus marinus subsp. marinus str. CCMP1375
  CDS (1)..(1425): transl_table=11
atggttcattatgagaagctctctccaccaaccacaggagaaaaaattaaattcaataatggattgcctatagtgcccgcaaatcccatcattccttatataagaggagatggaacaggggtagacatctggcccgcaacacaaaaggtaattgatcaagccatagaaaaagcctatgggattgatagaaaaatagaatggttcaaaatatatgcaggcgatgaagcttgtgatttatatggcacttaccaatatctacctaaggacaccatagaggcaattcgagagtatggagtggcaattaaagggcccttaacaacaccaattgggggaggcattagatctttaaatgttgctcttaggcaaaaatttgatctatatagttgtgtacgaccatgccgttattatcaaggtacaccaagtcctcataaacatcctgaaaacctagatgtaattgtttatcgcgagaatactgaagatatatatattggtattgaatgggagtcaaatgatccaattggcataaagcttatagagcatctaaacaatgatgtaattcctgctagtccgtctcttaaaaatcgaattattcctcaaggatcaggtattggaatcaagcccgttagtaaagatggtagccaacgacatattcgaagagctatacaacatgctttgaaactgaatggcaataaacgtcatgtaacgctagtacataaaggaaatattatgaaatttactgaaggctcatttcgagattggggatatgaattagcaactaatgaatttcgtaatgaatgtataactgaaagggaaagctggatactttccaatctagagcaaaatcctagattaagtattgaaaataatgcaaagttgattgaccctggttatgaatcattaacaaaagaaaaaaaagatattatttgcaatgaggttcaacttgtaattaataatattcataaaacacatggaaataacaaatggaaaaaaatggttttagttgacgataggattgcagacagtatattccaacaaatacaaaccagacctcaagaatattccatattagcaacattaaatttgaatggggactacatatcagatgccgctgctgcaattgttggaggattaggaatggctcccggtgcaaatattggtgatcgagctgcgatttttgaagccacacatggcactgctccaaagcatgctggactcgatagaattaatccaggttcagtgattttaagcggcgtaatgatgctggaatatataggttggcaagaagctgctgacttaattacaaaaggtttgagtcaatcaatttacgataaacaagtcacttatgaccttgccaggttaatggaacctcctcaatctccattaagttgtagtgaatttgcaaatgcggtaattgaacgattctaa

SEQ ID NO: 27972 - protein, 474 aa, Prochlorococcus marinus subsp. marinus str. CCMP1375
MVHYEKLSPPTTGEKIKFNNGLPIVPANPIIPYIRGDGTGVDIWPATQKVIDQAIEKAYGIDRKIEWFKIYAGDEACDLYGTYQYLPKDTIEAIREYGVAIKGPLTTPIGGGIRSLNVALRQKFDLYSCVRPCRYYQGTPSPHKHPENLDVIVYRENTEDIYIGIEWESNDPIGIKLIEHLNNDVIPASPSLKNRIIPQGSGIGIKPVSKDGSQRHIRRAIQHALKLNGNKRHVTLVHKGNIMKFTEGSFRDWGYELATNEFRNECITERESWILSNLEQNPRLSIENNAKLIDPGYESLTKEKKDIICNEVQLVINNIHKTHGNNKWKKMVLVDDRIADSIFQQIQTRPQEYSILATLNLNGDYISDAAAAIVGGLGMAPGANIGDRAAIFEATHGTAPKHAGLDRINPGSVILSGVMMLEYIGWQEAADLITKGLSQSIYDKQVTYDLARLMEPPQSPLSCSEFANAVIERF

SEQ ID NO: 27973 - DNA, 1257 bp, Bordetella parapertussis 12822
  CDS (1)..(1257): transl_table=11
atgtcctatcaacatatcaaggttcccactgggggccaaaaaatcacggtcaacgccgattactcgctgaatgtgcccgatcaggtcatcattccggtcatcgagggtgacggtacgggcgccgacatcacgccggtgatgatcaaggtcgtcgacgcggccgtgcagaaggcctatgcgggcaagcgcaagatccactggatggaagtctacgccggcgagaaggccaccaaggtctacggcccggacgtctggctgcccgaggaaaccctcgacgccgtcaaggactacgtggtgtcgatcaagggtccgctgaccacgccggtcggcggcggcatccgttcgctgaacgtggcgctgcgccagcagctggacctgtatgtctgcctgcgcccggtgcgctatttcaagggcgtgccctcgccggtgcgcgagcccgagaagaccgacatggtcatcttccgcgagaactcggaagacatctacgcgggcatcgagtacatggccgagtccgagcaggccaaggacctgatccagtacctgcagaccaagctgggcgcgaccaagatccgcttcccgaacacctcgtcgatcggcatcaagccggtttcgcgcgaaggcaccgagcgcctggtgcgcaaggcgctgcagtacgccatcgacaatgaccgcgcctcggtgaccctggtccacaagggcaacatcatgaagttcacggaaggcggcttccgcgactggggctacgccctggcccagaacgagttcggcgcgcagccgatcgacggcggcccgtggtgcaagttcaagaatcccaagacgggtcgcgagatcatcgtcaaggattcgatcgccgacgccttcctgcagcagatcctgctgcgtccggccgaatacgacgtgatcgccacgctgaacctgaacggcgactacatctccgacgcgctggccgcgcaagtgggcggcatcggcattgccccgggcgccaacctgtcggactccgtggccatgttcgaagccacccacggcaccgcgccgaagtacgcgggcaaggactacgtgaaccccggttccgaaatcctgtcggccgaaatgatgctgcgccacatgggctggaccgaggccgccgacctgatcatcgccagcatggagaaatccatcctgtccaagaaggtcacctatgacttcgcccgtctgctcgaaggcgccacccaggtgtcgtgctcgggcttcggtcaggtcatgatcgacaatatgtaa

SEQ ID NO: 27974 - protein, 418 aa, Bordetella parapertussis 12822
MSYQHIKVPTGGQKITVNADYSLNVPDQVIIPVIEGDGTGADITPVMIKVVDAAVQKAYAGKRKIHWMEVYAGEKATKVYGPDVWLPEETLDAVKDYVVSIKGPLTTPVGGGIRSLNVALRQQLDLYVCLRPVRYFKGVPSPVREPEKTDMVIFRENSEDIYAGIEYMAESEQAKDLIQYLQTKLGATKIRFPNTSSIGIKPVSREGTERLVRKALQYAIDNDRASVTLVHKGNIMKFTEGGFRDWGYALAQNEFGAQPIDGGPWCKFKNPKTGREIIVKDSIADAFLQQILLRPAEYDVIATLNLNGDYISDALAAQVGGIGIAPGANLSDSVAMFEATHGTAPKYAGKDYVNPGSEILSAEMMLRHMGWTEAADLIIASMEKSILSKKVTYDFARLLEGATQVSCSGFGQVMIDNM

SEQ ID NO: 27975 - DNA, 1257 bp, Bordetella bronchiseptica RB50
  CDS (1)..(1257): transl_table=11
atgtcctatcaacatatcaaggttcccactgggggccaaaaaatcacggtcaacgccgattactcgctgaatgtgcccgatcaggtcatcattccggtcatcgagggtgacggtacgggcgccgacatcacgccggtgatgatcaaggtcgtcgacgcggctgtgcagaaggcctatgcgggcaagcgcaagatccactggatggaagtctacgccggcgagaaggccaccaaggtctacggcccggacgtctggctgcccgaggaaaccctcgacgccgtcaaggactacgtggtgtcgatcaagggtccgctgaccacgccggtcggcggcggcatccgttcgctgaacgtggcgctgcgccagcagctggacctgtatgtctgcctgcgcccggtgcgctacttcaagggcgtgccctcgccggtgcgcgagcccgagaagaccgacatggtcatcttccgcgagaactcggaagacatctacgcgggcatcgagtacatggccgagtccgagcaggccaaggacctgatccagtacctgcagaccaagctgggcgtgaccaagatccgcttcccgaacacctcgtcgatcggcatcaagccggtttcgcgcgaaggcaccgagcgcctggtgcgcaaggcgctgcagtacgccatcgacaatgaccgcgcctcggtgaccctggtccacaagggcaacatcatgaagttcacggaaggcggcttccgcgactggggctacgccctggcccagaacgagttcggcgcgcagccgatcgacggcggcccgtggtgcaagttcaagaatcccaagacgggtcgcgagatcatcgtcaaggattcgatcgccgacgccttcctgcagcagatcctgctgcgtccggccgaatacgacgtgatcgccacgctgaacctgaacggcgactacatctccgacgcgctggccgcgcaagtgggcggcatcggcattgccccgggcgccaacctgtcggattccgtggccatgttcgaagccacccacggcaccgcgccgaagtacgcgggcaaggactacgtgaaccccggttccgaaatcctgtcggccgaaatgatgctgcgccacatgggctggaccgaggccgccgacctgatcatcgccagcatggagaaatccatcctgtccaagaaggtcacctatgacttcgcccgtctgctcgaaggcgccacccaggtgtcgtgctcgggcttcggtcaggtcatgatcgacaatatgtaa

SEQ ID NO: 27976 - protein, 418 aa, Bordetella bronchiseptica RB50
MSYQHIKVPTGGQKITVNADYSLNVPDQVIIPVIEGDGTGADITPVMIKVVDAAVQKAYAGKRKIHWMEVYAGEKATKVYGPDVWLPEETLDAVKDYVVSIKGPLTTPVGGGIRSLNVALRQQLDLYVCLRPVRYFKGVPSPVREPEKTDMVIFRENSEDIYAGIEYMAESEQAKDLIQYLQTKLGVTKIRFPNTSSIGIKPVSREGTERLVRKALQYAIDNDRASVTLVHKGNIMKFTEGGFRDWGYALAQNEFGAQPIDGGPWCKFKNPKTGREIIVKDSIADAFLQQILLRPAEYDVIATLNLNGDYISDALAAQVGGIGIAPGANLSDSVAMFEATHGTAPKYAGKDYVNPGSEILSAEMMLRHMGWTEAADLIIASMEKSILSKKVTYDFARLLEGATQVSCSGFGQVMIDNM

SEQ ID NO: 27977 - DNA, 1425 bp, Prochlorococcus marinus subsp. pastoris str. CCMP1986
  CDS (1)..(1425): transl_table=11
atgcctaaatttgaaaaattaaatttaccaaaagaaggagagttaattacttttaatcaaggtaagcctaatgttcctaataatcctattgtcccttatataagaggtgacggtactggggtagatatttggccagctactcaacttgttcttgatgaagcaataaaaaaaagttatggagatgagagaaaaataaattggttcaaagtctatgctggtgacgaagcttgtgaaatatacggaacttacaactatttaccacaggatactattgaagcaataagacactttggagttgcaattaaaggcccattaacaactcctataggagggggaattagatctttaaatgtcgctttaagacaaatttttgacttatatagctgcgttagaccttgtaaatactattcagggactcctagccctcataaaaatccacaaaatttagacgtaattgtttatagagaaaatacagaagatatttatatgggtattgaatgggaagccgatgatcatacatgcattgatttaattaatcatctaaataatgttgtcattccaaatagcaaaaatttaaaaaatagatcaataccggacggttcaggtattgggataaaacccgtaagtaagttaggaagtcaaaggcatataagaaaggccatagaacatgcaaaaagattatcaggaaataaaaagcatgtaactcttgttcataaaggaaatatcatgaaatatacagaaggtgcatttagagattggggatatgaattagcagtaaatgaattcagagcagactgcattacggaaagagaaagctggattttagacaatattcacaaaaatccagaaattacaatcgaaaataatgccagaaagatagagccaggctatgacaagctaacaagtaataaaaaagcatttatttgcgaagaaataaaagaagtaatagcctcaatatcaaattctcatggaaataataaatgggaagaactcattatggttgatgatcgaattgctgacagtattttccaacaaattcaaacaaggcctcaagaatattctattcttgcgaccttgaacttaaacggagattatgtttctgatgctgctgctgcaattgtgggaggcctaggtatggctcccggagctaatattggagataattccgcaatttttgaagcaacgcatggaacagctccaaaacatgcaggattaaacaaaattaatccgggttcggtaattcttagtggagtaatgatgcttgaatattttggttggaatgaagcagcgaagctggtgacttctggaattagtaaagctattgaagaaaaaaaagtcacctatgatctagcacgcttaatggaaccaaaggtagcaccactatcctgtagtggttttgctgaagcaattatctcaaatttttaa

SEQ ID NO: 27978 - protein, 474 aa, Prochlorococcus marinus subsp. pastoris str. CCMP1986
MPKFEKLNLPKEGELITFNQGKPNVPNNPIVPYIRGDGTGVDIWPATQLVLDEAIKKSYGDERKINWFKVYAGDEACEIYGTYNYLPQDTIEAIRHFGVAIKGPLTTPIGGGIRSLNVALRQIFDLYSCVRPCKYYSGTPSPHKNPQNLDVIVYRENTEDIYMGIEWEADDHTCIDLINHLNNVVIPNSKNLKNRSIPDGSGIGIKPVSKLGSQRHIRKAIEHAKRLSGNKKHVTLVHKGNIMKYTEGAFRDWGYELAVNEFRADCITERESWILDNIHKNPEITIENNARKIEPGYDKLTSNKKAFICEEIKEVIASISNSHGNNKWEELIMVDDRIADSIFQQIQTRPQEYSILATLNLNGDYVSDAAAAIVGGLGMAPGANIGDNSAIFEATHGTAPKHAGLNKINPGSVILSGVMMLEYFGWNEAAKLVTSGISKAIEEKKVTYDLARLMEPKVAPLSCSGFAEAIISNF

SEQ ID NO: 27979 - DNA, 1425 bp, Prochlorococcus marinus str. MIT 9313
  CDS (1)..(1425): transl_table=11
atggctcagttcgagaaactctccccaccaagccagggcacggccatccgcttcgtgaacggtcagccagtcatacccaacgagccaatcattcccttcatccgcggtgatggcacaggtgtggacatctggccggcgacccaacgagtgctggatgcagctgtaacaaaggcctatcaaggcgtgcgtcgtatcgaatggttcaaggtctatgcaggcgacgaggcctgcgatctctacggcacctaccagtacctaccagaggacacccttgaagcgatccgaacctatggggtcgccatcaaaggtcccctcacgactccaattggtgggggcatccgttccctcaatgtggccctacgtcaaatcttcgatttgtattcctgcgtccgcccatgtcgctactacaagggcacacccagtccccacaaacggcctcaggatcttgatgtcatcgtctaccgagaaaacacggaagatatctacatgggggtggaatgggaagccgatgatccagtcggcaagacattgcgcgaacatctcaacactgtcgtcattcccgccaacggcaagctcggcaaacgccagattcctgaaggctcaggcatcggcatcaagccggtaagcaagcacggcagccagcgtcatatccgcaaagcgattcaacatgctcttcggctaaagggcgacaagcgccacgtcaccttggtgcacaaaggcaacatcatgaagttcactgaaggagccttccgtgactggggctatgaactcgccacaagtgagttccgcgacgtgtgcatcaccgaaagggagagctggattctcggcaatcttgaaaacgatccacaactaagcatccaagccaatgcccgcatgatcgagcctggctacgacagcctcacgcctgagagaaaggccagcatcgatgccgaagtgcacggcgtgctggatgccatcggcaccagtcatggcaacggccaatggaaagcgatggtgcttgtcgatgaccgcatcgccgacagcatcttccaacagatccaaacacggccgcaggaatactcaatcctggcaacactcaacctcaatggcgactacatctccgacgcagccgcggcgatggtgggcggattaggcatggccccgggagccaacatcggcgagaacgctgccatcttcgaggcgacccacggaacagcacccaagcatgccggccttgatcgcatcaaccctggatcggtgatcctcagcggcgtgatgatgctggagtttctgggctggcaagaagccgcagacttgatcacaaaagggctcagtgctgcgattgccaatcaacaggtcacctatgacctggctcgcctcatggacccacccgtagaccctgtgagctgcagtggcttctctgaggccgtcatcagccacttctaa

SEQ ID NO: 27980 - protein, 474 aa, Prochlorococcus marinus str. MIT 9313
MAQFEKLSPPSQGTAIRFVNGQPVIPNEPIIPFIRGDGTGVDIWPATQRVLDAAVTKAYQGVRRIEWFKVYAGDEACDLYGTYQYLPEDTLEAIRTYGVAIKGPLTTPIGGGIRSLNVALRQIFDLYSCVRPCRYYKGTPSPHKRPQDLDVIVYRENTEDIYMGVEWEADDPVGKTLREHLNTVVIPANGKLGKRQIPEGSGIGIKPVSKHGSQRHIRKAIQHALRLKGDKRHVTLVHKGNIMKFTEGAFRDWGYELATSEFRDVCITERESWILGNLENDPQLSIQANARMIEPGYDSLTPERKASIDAEVHGVLDAIGTSHGNGQWKAMVLVDDRIADSIFQQIQTRPQEYSILATLNLNGDYISDAAAAMVGGLGMAPGANIGENAAIFEATHGTAPKHAGLDRINPGSVILSGVMMLEFLGWQEAADLITKGLSAAIANQQVTYDLARLMDPPVDPVSCSGFSEAVISHF

SEQ ID NO: 27981 - DNA, 1425 bp, Synechococcus sp. WH 8102
  CDS (1)..(1425): transl_table=11
atggcccagtttgagaagctcaccgcccccagccagggcacaccgattcgcttcgagaacggccaacctgtcgtggccgacaatccgatcattcccttcatccgcggtgatgggaccggcgtagacatctggcctgccacccagaaggtattggatgccgccgtggcaaaggcctatggcggagttaaaaccatcgagtggttcaaggtgtatgccggcgatgaggcctgcgacctctacggcacctatcagtacctgcccgaagacaccctcgaagcgatccgcacctacggcgtggccatcaagggccccctcaccacccccgtgggtggcggcatccgttcgctgaacgtggccctgcgccagatcttcgatctttactcctgcgtgcgcccttgccgttattacgagggcacccccagtcctcacaagcgtccccaggatctggacgtgatcgtctaccgggagaacaccgaagacatctacatgggagttgagtgggaggccgatgacgcggttggtcaggagctgcgcaagcacctcaacgaggtggtgattcctgccaacggcaagctgggcaaacgacagatcccggaaggctccggcatcggcatcaaaccggtgagcaaacacggcagccagcgccacatccgcaaagcgatccagcacgccctacgcctggagggcaacaagcgccacgtgaccctggtgcacaagggcaacatcatgaaattcaccgaaggtgcgtttcgcgactggggctacgaactggccaccacggagttccgcgacgtgtgcatcaccgagcgggagagctggatcctcggcaacctcgagaaggattcaggactgagtgtgcaggccaacgcccggatgattgaaccgggctacgacagcctcacccccgagaagaaagcggacatcgatgctgaagtgcaggccgtgatcgatgccatcggcagcagccatgggggcggcaagtggaggtcgatggtgctggtggatgaccgcatcgccgacagcatcttccagcagatccagacccgccctcaggagtattcgatcctggccaccctcaacctcaatggcgactacatctccgatgcagccgcggccatggtgggcggtctgggcatggcccccggcgccaatatcggcgaaaccgccgccatcttcgaagccacccacggcaccgccccgaaacatgccggtctcgaccgcatcaaccccggttcagtgatcctcagcggcgtgatgatgctggaattcctgggttggcaggaggctgcagacctggtgaccaaaggcctgagtgccgccattaccgacaaacaaatcacctacgacctggccaggctgatggaaccgcaggtggaccctgtgagctgcagcggcttcgctgaagcgattatccagcgattctga

SEQ ID NO: 27982 - protein, 474 aa, Synechococcus sp. WH 8102
MAQFEKLTAPSQGTPIRFENGQPVVADNPIIPFIRGDGTGVDIWPATQKVLDAAVAKAYGGVKTIEWFKVYAGDEACDLYGTYQYLPEDTLEAIRTYGVAIKGPLTTPVGGGIRSLNVALRQIFDLYSCVRPCRYYEGTPSPHKRPQDLDVIVYRENTEDIYMGVEWEADDAVGQELRKHLNEVVIPANGKLGKRQIPEGSGIGIKPVSKHGSQRHIRKAIQHALRLEGNKRHVTLVHKGNIMKFTEGAFRDWGYELATTEFRDVCITERESWILGNLEKDSGLSVQANARMIEPGYDSLTPEKKADIDAEVQAVIDAIGSSHGGGKWRSMVLVDDRIADSIFQQIQTRPQEYSILATLNLNGDYISDAAAAMVGGLGMAPGANIGETAAIFEATHGTAPKHAGLDRINPGSVILSGVMMLEFLGWQEAADLVTKGLSAAITDKQITYDLARLMEPQVDPVSCSGFAEAIIQRF

SEQ ID NO: 27983 - DNA, 1293 bp, Wolinella succinogenes DSM 1740
  CDS (1)..(1293): transl_table=11
atggctaattttgaaggctacaatccccgatttctccccttgcccaccgaaggcgaggcaatcaccctcacccctgagggaatcctccaggtccctgatcaccccattatcccctacattgagggcgatggcattggcatggatatcacgccagcgatgaaaagtgttgtggacgctgcggtgaacaaggcctatggaggcaaaagaaaaatcgcatggtatgaggtctacacgggcgagaagtgctatgaaaagtttaaaaatgaaaagagcctctctccgatggatcagtggctcctccctgatacgattgatgcaatcaactacttcaaggtctccatcaaaggccctctaaccacgcccgtgggcgaaggatttcgcagcctgaatgttgccttgcgccagatgatggatctctatgtctgcctccgccctgtgcgctggtatggcagccccagccctgtcaaagagcctcacaaggtcgatatggtgatctatcgcgaaaatagtgaggatatctacgcgggaatcgagtttgccgccgagagcaaagaggccaacaaagtgatccaattcctccaaaacgaaatggaggtgaaaaagattcgattccccaaaacaagcgccatcggaatcaagcccgtgagcaaagaggggagtgagcgtctcatcagaaaagccatccaatacgctatcgacaacgaccgcgcctccctcacctttgttcacaaaggcaacatcatgaaattcaccgagggcggattcatgaagtggggttatgagctgctcaaacgagaatttggcgcgaccgagatcgatggaggtccttggtgctccatgaaaaacccaaaaacaggcaaagagatcatcatcaaagacgtcattgctgatgccttcttgcagcagattctcttgcgccctgctgaatatgatgtcattgccaccatgaatctcaatggcgactatatctctgacgcgctcgctgcgatggttggaggaatcgggatcgctcctggtgccaacctcaatgatagcgtggcgatgtttgaggcgactcatggaaccgcgcccaaatacgctggacttgacaaggtcaaccccggctctcttatcctaagtgcagagatgatgctgcgccacatgggctggatcgaggcggccgacctcgtcgtctcctccatgaaaaaggcgatcgaatccaaaaatgtcacttacgactttgcccgcttgatggagggcgccaaagaggtgaaatgctccgaatttgcccaagtcatgattgagcgaatgtaa

SEQ ID NO: 27984 - protein, 430 aa, Wolinella succinogenes DSM 1740
MANFEGYNPRFLPLPTEGEAITLTPEGILQVPDHPIIPYIEGDGIGMDITPAMKSVVDAAVNKAYGGKRKIAWYEVYTGEKCYEKFKNEKSLSPMDQWLLPDTIDAINYFKVSIKGPLTTPVGEGFRSLNVALRQMMDLYVCLRPVRWYGSPSPVKEPHKVDMVIYRENSEDIYAGIEFAAESKEANKVIQFLQNEMEVKKIRFPKTSAIGIKPVSKEGSERLIRKAIQYAIDNDRASLTFVHKGNIMKFTEGGFMKWGYELLKREFGATEIDGGPWCSMKNPKTGKEIIIKDVIADAFLQQILLRPAEYDVIATMNLNGDYISDALAAMVGGIGIAPGANLNDSVAMFEATHGTAPKYAGLDKVNPGSLILSAEMMLRHMGWIEAADLVVSSMKKAIESKNVTYDFARLMEGAKEVKCSEFAQVMIERM

SEQ ID NO: 27985 - DNA, 1089 bp, Oryza sativa (japonica cultivar-group)
  CDS (1)..(1089)
atggcgctacggaggctgctccaggggagcgtcctgccgcggatggcgggcagagccgccgcggcgccgttctcgacggcgtccggggagaccgtccgcgccacgctcttcccaggcgacggcatcgggccggagatcgccgagtcggtcaagcaggtattcaatgttgcaggggtaccaatagaatgggaagaacactatgttggtacagaagttgatcccagaacagagagttttctgacttgggaaagcttggagtcggtgcggagaaacaaagttggcttgaaaggtcctatggctacgcctattggaaaaggccaccgttcattgaatcttacactaaggaaagagcttggtctttatgcaaatgttagaccttgcaacagcctcccaggatacaagactcgatatgatgatgtgaaccttgtgactattcgtgaaaataccgagggagaatatagtggccttgagcatcaggttgtgaggggtgttgtggaaagcttaaaaattatcactcgccaagcaagtttaagagtggcagagtatgctttccactatgccaagaccaatggccgggagagggtctctgcgatacacaaggccaatatcatgaggaagaccgatggtcttttcctcaagtgctgtcgtgaagtggctgagaagtaccctgaaattgtatacgaggaggtcatcattgacaattgttgtatgacgcttgtgaagaatcctggtctttttgatgtactggtgatgccaaatctttatggtgatattattagtgatctttgtgctggtctgattggaggcttgggcttgacacccagctgcaacattggtgaaggtggcatttgtctggcagaagctgttcacggttctgctcctgatattgctggcaagaaccttgcaaacccgaccgctcttatgctgagtgctgttatgatgttgcgccacttgcaattcaataaccaagcagaccggatccacaacgccatcctccagaccatctccgaggggaaattcaggactgctgatctcggcggaaaggcgtcgacttcagacttcacgaaggcagtctgtgatcatatctga

SEQ ID NO: 27986 - protein, 362 aa, Oryza sativa (japonica cultivar-group)
MALRRLLQGSVLPRMAGRAAAAPFSTASGETVRATLFPGDGIGPEIAESVKQVFNVAGVPIEWEEHYVGTEVDPRTESFLTWESLESVRRNKVGLKGPMATPIGKGHRSLNLTLRKELGLYANVRPCNSLPGYKTRYDDVNLVTIRENTEGEYSGLEHQVVRGVVESLKIITRQASLRVAEYAFHYAKTNGRERVSAIHKANIMRKTDGLFLKCCREVAEKYPEIVYEEVIIDNCCMTLVKNPGLFDVLVMPNLYGDIISDLCAGLIGGLGLTPSCNIGEGGICLAEAVHGSAPDIAGKNLANPTALMLSAVMMLRHLQFNNQADRIHNAILQTISEGKFRTADLGGKASTSDFTKAVCDHI

SEQ ID NO: 27987 - DNA, 1080 bp, Gloeobacter violaceus PCC 7421
  CDS (1)..(1080): transl_table=11
gtgtccccatatcgtgtcacactgatccgcggcgatgggatcggcccggaagtgacgcaggcagcccggatcgtgctcgacgccaccgggatcgactttgagtgggtcgtggtcgatgccggcgccgaggtgatggagaagtccggcacaccccttccggccccagtgatcgaagcggtgcgcgcgagcgacgccgccatcaaaggcccgatcaccacccccgcaggttcgggcatccgttcggtcaacgtcgccttgcgtcgggccctcgacttgtacgccaacctgcgcccggcccgcaccctgcccggggtgcactcgcgctacgacaatatcgatctggtggtcgtgcgcgaaaataccgaggacctctacagcggcatcgagtttgaaaaaaattctccccaggctcttgaagtaatcgagatgctcatgcgcctgggcggcaaaaaaatctttccaagatccggccttgcggtcaaaccaatctccagcgaggcgagcgagcggatcgcccgcttcgccttcgagtacgcccgccgccacgcccgccgcaaagttaccgccgtccacaaggcgaatatcttgaagcacaccgacggtctgtttctggaggctgcccgccaggtggcttcggagtatccggatgtcgagtttgaagatcggatcgtggacaacctttgcatgcaactcgtccagaggccggaatcctacgacgtcctggtgctgcccaacctctatggcgatatcgtctcggatctgaccgccgggctggtgggcggtctcggggtggcgccgggggccaatatcggcgatcgcagcgccgtcttcgaagcgatccacggctcggcgccgcgctacgccggtcagaacaaggtcaatccctcggcactcatcctgagcggcgcgctgttgcttcggcacctgggcgagcaggaggccgccgtgcgcgtcgagcaggccgtggccgccgtgatcgccgaaggccgcagcgttacctacgacctggccccggcgggagcgacccccgccggtacccgccagatggccgaggcgattgcccagaaggtagcgggctga

SEQ ID NO: 27988 - protein, 359 aa, Gloeobacter violaceus PCC 7421
MSPYRVTLIRGDGIGPEVTQAARIVLDATGIDFEWVVVDAGAEVMEKSGTPLPAPVIEAVRASDAAIKGPITTPAGSGIRSVNVALRRALDLYANLRPARTLPGVHSRYDNIDLVVVRENTEDLYSGIEFEKNSPQALEVIEMLMRLGGKKIFPRSGLAVKPISSEASERIARFAFEYARRHARRKVTAVHKANILKHTDGLFLEAARQVASEYPDVEFEDRIVDNLCMQLVQRPESYDVLVLPNLYGDIVSDLTAGLVGGLGVAPGANIGDRSAVFEAIHGSAPRYAGQNKVNPSALILSGALLLRHLGEQEAAVRVEQAVAAVIAEGRSVTYDLAPAGATPAGTRQMAEAIAQKVAG

SEQ ID NO: 27989 - DNA, 1254 bp, Photorhabdus luminescens subsp. laumondii TTO1
  CDS (1)..(1254): transl_table=11
atggaaagcaaagtagttattccggcggaaggtaaaaaaataacagtcgacgctaaaggtaaactggttgttccgaataacccggtcatcccttatatcgaaggggatgggattggtgtcgatgttacccctgcaatgttgaaagttgtcgatgcagcggttcagaaagcctatcagggtgagcgtaaaatttcctggatggaaatctacaccggtgaaaaatcgactcatgtatacggtaaagatgtttggttgccggatgaaacgttggatctgatccgtgaatatcgcgtcgccattaaaggccctctgacgacgccagttggtggcggcattcgttctctgaacgtagcattgcgccagcaattagatctgtatgtttgcctgcgtcctgttcgttattatcagggaacgccaagcccggtcaaacaacctgaattgaccgatatggttattttccgtgaaaacgcggaagatatttacgccggtattgaatggaaagcggggtctgttgaagcggataaagtgatcaaattcctgcaagaagagatgggcgtgaataaaatccgtttcccacagcaatgtggtatcggtgtgaaaccctgttctgaagagggcactaaacgcttagttcgtgctgccatcgaatacgcaattgataatgaccgtgaatctgtcactctggttcacaaaggcaacattatgaagttcaccgaaggtgctttcaaagattggggttatcagcttgctcgtgaagagttcggcggtgaactgttggatggtggtccttgggtaaaaattaagaatccgaaaaacggtaaagagatcattgtcaaagatgtcatcgcagatgcgtttttacaacagattctgctgcgtcctgctgaatatgatgttattgcctgtatgaacctgaatggtgactatatttctgatgcactagctgctcaggttggtggtatcggtatcgctccgggagcaaatatcggtgatgaatgtgctctgtttgaagcgactcatggtacagcacctaaatatgccggtcaggataaggtgaatccaggttctgtgattctttccgctgagatgatgttacgccatatggggtggacagaagccgcagatctgattgttaaaggtatggaaggcgcgattgccgcgaagactgtgacttatgatttcgaacgtctgatggaaggggctaagctgctgaaatgcagtgaatttggtgacgcgattattcagcatatgtaa

SEQ ID NO: 27990 - protein, 417 aa, Photorhabdus luminescens subsp. laumondii TTO1
MESKVVIPAEGKKITVDAKGKLVVPNNPVIPYIEGDGIGVDVTPAMLKVVDAAVQKAYQGERKISWMEIYTGEKSTHVYGKDVWLPDETLDLIREYRVAIKGPLTTPVGGGIRSLNVALRQQLDLYVCLRPVRYYQGTPSPVKQPELTDMVIFRENAEDIYAGIEWKAGSVEADKVIKFLQEEMGVNKIRFPQQCGIGVKPCSEEGTKRLVRAAIEYAIDNDRESVTLVHKGNIMKFTEGAFKDWGYQLAREEFGGELLDGGPWVKIKNPKNGKEIIVKDVIADAFLQQILLRPAEYDVIACMNLNGDYISDALAAQVGGIGIAPGANIGDECALFEATHGTAPKYAGQDKVNPGSVILSAEMMLRHMGWTEAADLIVKGMEGAIAAKTVTYDFERLMEGAKLLKCSEFGDAIIQHM

SEQ ID NO: 27991 - DNA, 1098 bp, Danio rerio
  CDS (1)..(1098)
atggctaacgcatggaggtcagcggtttcctgtataatgggagctatcaagactcagactccacagcccagagtcttctccagagggattcaaactgtaacattaattcctggagatggaattggtccagagatctccactgcagtaatgaagatatttgaagcagcaaagaccccaattcaatgggaagagagaaatgtgactgctatcaagggacctggaggcaggtggatgatacctcctgaggcaaaagaatcgatggacaaaaacaaaattgggttaaaaggacccctgaaaacaccaattgctgctggccacccatccatgaacctgctgcttaggaagacctttgacctgtatgccaatgtgcgtccttgcgtgtccattgagggctataaaacaccttacactgatgtggatctagtcaccatcagagaaaacacagaaggagagtacagtgggattgaacatgtgatcgtggatggagttgttcagagtattaaactaatcacagaggaggccagcagacgcattgctgagtatgcatttgagtatgccaggaataaccaaagaaccagtgtcactgctgttcacaaagccaacatcatgcggatgtcagatggtctgtttttgcggaagtgcagagaggttgcagaaaattttaaggatgtgaaattcactgagatgtatctggatacagtgtgtctcaatatggtgcaagatccctctcagtttgatgtcctcgtaatgcctaacctttatggtgacatcttgagtgatctgtgtgctggattgattggcggtcttggagtcactcccagtgggaacattggagccaatggcgttgccatatttgaatctgtacatggaacggcgcctgatattgcaggcaaagacatggcaaaccccactgcccttttgcttagtgccgtcatgatgctgcgccacatgggactgcatggtcatgcaaaaaagattgagactgcttgctttgacaccatacgagataaaaaggttttgaccaaagatcttggtggaaactcgaagtgctcagagtttacagctgacatctgccgaagagtgcaggacatggaataa

SEQ ID NO: 27992 - protein, 365 aa, Danio rerio
MANAWRSAVSCIMGAIKTQTPQPRVFSRGIQTVTLIPGDGIGPEISTAVMKIFEAAKTPIQWEERNVTAIKGPGGRWMIPPEAKESMDKNKIGLKGPLKTPIAAGHPSMNLLLRKTFDLYANVRPCVSIEGYKTPYTDVDLVTIRENTEGEYSGIEHVIVDGVVQSIKLITEEASRRIAEYAFEYARNNQRTSVTAVHKANIMRMSDGLFLRKCREVAENFKDVKFTEMYLDTVCLNMVQDPSQFDVLVMPNLYGDILSDLCAGLIGGLGVTPSGNIGANGVAIFESVHGTAPDIAGKDMANPTALLLSAVMMLRHMGLHGHAKKIETACFDTIRDKKVLTKDLGGNSKCSEFTADICRRVQDME

SEQ ID NO: 27993 - DNA, 1419 bp, Wolbachia endosymbiont of Drosophila melanogaster
  CDS (1)..(1419): transl_table=11
atgtcaacactaatcacagttgcatatggcgacggtatcggaccagaaatcatggaagcggtgctgtcgatattgcgcgaagcagaagcggaaatctcaatagatattattgaaataggggagcgtgtttacagtaaagaatggtctcacggaatttctccaagtggttgggaatcaattgaaaggacaaaaatattattaaaatctccgacaacaactcctcaaggtaaagggaacaaaagcttaaacgttgcactcagaaaaaatctagggttgtatgcaaatatcagaccatgcatttcatatcatcatgttatagaaaataaattcgataagtttgatatcgtagtgatacgtgaaaatgaagaggacgtttacaccggaatagagcataggctcactggtgactcttaccaatgcactaaaattattactagatctggctcagagaagatatgcaggtacgcttttgaatatgcaaaaaaacacaacagaaaaaaagtaacttgcctgactaaagataacatcatgaaaatgactgacggaactttccatgccgcgtttgatcgcattgcaaaggaatacccagatataaaggcagaacattatatagttgatattggaatggcgcgtgttgcaacagaaccggagaattttgatgttatagtaaccgagaacttatatggcgacatattatcagatatagtcgcacaaacctctggatctgtggggcttgccggaagtagcaacatcgggaatgaatacgcaatgtttgaagcagtgcacggttctgcccctgatattgcaggaaaaaacatagccaatccttctggtcttttaaatgctgcagtgcatatgctaatttacataggtcaagtgggtactgcaaaactaatctacgatgcatggctcaagactttggaggatggaatacacactgccgatttatataaggagaaaagaagtaaacagaaagttggtacaaaagaatttgcagaagctgttatagacaatctaggaaaaaaaccgaaaacattatctgagcttataattggcagtgatccaaatagtaaagtggataaaatacaggataattatgaacaggattataagattaaaaaactagtgggtagcgatataacgcttgcctggagtaagccggctgactttgaccaaatagtgaagttgtttgaaacaagtaatccgcagattatagcaatatattcaaaaggccttgcgatttggccaggaagttcaaagtcttcaagtgaccaaataacctgcaggttcattgcaaataatgaaattacaaatagtgatgtgaataacttgctaatcaaatttgaggaacataattttgatgtggtgagaatggataagttgtatttgtatgatgggaaagagggtttcttctcttag

SEQ ID NO: 27994 - protein, 472 aa, Wolbachia endosymbiont of Drosophila melanogaster
MSTLITVAYGDGIGPEIMEAVLSILREAEAEISIDIIEIGERVYSKEWSHGISPSGWESIERTKILLKSPTTTPQGKGNKSLNVALRKNLGLYANIRPCISYHHVIENKFDKFDIVVIRENEEDVYTGIEHRLTGDSYQCTKIITRSGSEKICRYAFEYAKKHNRKKVTCLTKDNIMKMTDGTFHAAFDRIAKEYPDIKAEHYIVDIGMARVATEPENFDVIVTENLYGDILSDIVAQTSGSVGLAGSSNIGNEYAMFEAVHGSAPDIAGKNIANPSGLLNAAVHMLIYIGQVGTAKLIYDAWLKTLEDGIHTADLYKEKRSKQKVGTKEFAEAVIDNLGKKPKTLSELIIGSDPNSKVDKIQDNYEQDYKIKKLVGSDITLAWSKPADFDQIVKLFETSNPQIIAIYSKGLAIWPGSSKSSSDQITCRFIANNEITNSDVNNLLIKFEEHNFDVVRMDKLYLYDGKEGFFS

SEQ ID NO: 27995 - DNA, 1002 bp, Bdellovibrio bacteriovorus HD100
  CDS (1)..(1002): transl_table=11
atgatgaaactgacagtgattcccggtgatggtatcggccctgagattatggctcaggtcgttcgcgttcttaaacacgtccatgctccatttgaatatgaagagcaccaggccggcgaagtggctctgaattccctgggcgaattgctgcctcagaccaccattgattccatcaacaaaaccaagctggcaatcaaaggcccaacgaccactcccgtcggcggaggccacaagtccatcaacgtgaccatgagacaaaagttcgatctttatgccaacgtgcgcccggttcgttctttgcctggtgttcagtgcgtttgctcggatgtggacctgaccatcgtgcgtgaaaacaccgaagacctttacgcgggtattgagcgcatggtcgatgaagacactgcagaaagcatcaagcgcatcacacgcaaaggatctgagcgcattgcccgttatgcttatgatctggctcagaaaaccggcaaacctcgtatggctatcgtgcacaaagccaacatcatgaaactttctgacggtctgttccttaaagtggcgcaggaagtgggctggcagtatccggaaatcacaaccaaagatgtgatcgtggataacgcctgcatgcagctggtgaccaagcctcagcagtttgatgtgatcgtgactgaaaacctttacggcgacattctgtcggacctgtgcgcgggtctggtgggcggtctgggtgtggttcctggcgccaacattggtgccaatcacgcgatctttgaagcggttcacggttctgcaccggatatcgcgggccagaacaaagccaatccaacagcacttcttcaatctgcagtgatgatgcttcagcacgtgggcgaaaatgccaaagccgatgcaatcatgaaggctttgattgccgcactttctgacgtcaacgcaagaactggggatctgggtggtaaaggcacgacggtgtccttcaccgacgctatcatccagcgcctgggccactaa

SEQ ID NO: 27996 - protein, 333 aa, Bdellovibrio bacteriovorus HD100
MMKLTVIPGDGIGPEIMAQVVRVLKHVHAPFEYEEHQAGEVALNSLGELLPQTTIDSINKTKLAIKGPTTTPVGGGHKSINVTMRQKFDLYANVRPVRSLPGVQCVCSDVDLTIVRENTEDLYAGIERMVDEDTAESIKRITRKGSERIARYAYDLAQKTGKPRMAIVHKANIMKLSDGLFLKVAQEVGWQYPEITTKDVIVDNACMQLVTKPQQFDVIVTENLYGDILSDLCAGLVGGLGVVPGANIGANHAIFEAVHGSAPDIAGQNKANPTALLQSAVMMLQHVGENAKADAIMKALIAALSDVNARTGDLGGKGTTVSFTDAIIQRLGH

SEQ ID NO: 27997 - DNA, 1308 bp, Bacillus cereus ATCC 10987
  CDS (1)..(1308): transl_table=11
atgggggttatcacattgacgacaggtgaaaaaattactgtaactaatggtgttatgaatgtaccaaacaatccgattattccatttattgaaggagatggaattggtcctgatatttgggcagctgcatctcgtgtactagaagcagcagttgaaaaagcttatgatggtgagaagaaaatcgtttggaaagaagtgcttgcaggggaaaaagcattcaaccaaacaggcgagtggttaccagaagaaactttaaatttaattcgtgaatatttaatcgcgattaaaggtccacttacaactccagttggcggtggtattcgttctctaaacgtagcacttcgtcaagaattagatttatatgtatgtctacgtccagttcgttattttgaaggtgttccttcacctgtaaagcgtccggaagatactgatatggttattttccgtgaaaatacagaagacatttatgctggaattgaatatgcgcaaggatctccagaagcagaaaaagttcttactttcttaaaagaagcaatgggtgtgaataaaattcgcttcccagaaacatctggtattggtattaagccaatctcagaagaagggacaaagcgtcttgttcgtgctgcaattcaatatgcaattaacgaaaaacgctcttctgttacattagttcataaaggaaacattatgaaatttacagaaggtgctttcaaaaactggggttacgaagtagcggaacaagaattcggcgacaaagtatttacttgggctgaatatgatcgtatcgttgagaaagatggaaaagatgcagcgaataaagcgatggcagacgctgaagtggctggaaaaatcatcgtaaaagattctattgcagacatcttcttacaacaaattttaactcgtccacgtgagttcgatgttgttgcaacaatgaacttaaacggagactacatctctgatgcacttgctgcacaagtaggtggaattggtattgcacctggtgcaaacattaactatgtgactggacatgctatctttgaagctacacacggtacagctccaaaatatgcaggtttagataaagtaaacccatcttcagttcttctttctggtgtattattattagagcacttaggatggaacgaagctgcgaaattagtaactgcttcagttgagaaaacaattgcttcaaaagtagtgacttatgatttcgcacgcttaatggaaggtgcaacagaagtgaaatgttctgagttcgctaatgaacttattaaaaacatggatgtagcgataatcaaaaacgcataa

SEQ ID NO: 27998 - protein, 435 aa, Bacillus cereus ATCC 10987
MGVITLTTGEKITVTNGVMNVPNNPIIPFIEGDGIGPDIWAAASRVLEAAVEKAYDGEKKIVWKEVLAGEKAFNQTGEWLPEETLNLIREYLIAIKGPLTTPVGGGIRSLNVALRQELDLYVCLRPVRYFEGVPSPVKRPEDTDMVIFRENTEDIYAGIEYAQGSPEAEKVLTFLKEAMGVNKIRFPETSGIGIKPISEEGTKRLVRAAIQYAINEKRSSVTLVHKGNIMKFTEGAFKNWGYEVAEQEFGDKVFTWAEYDRIVEKDGKDAANKAMADAEVAGKIIVKDSIADIFLQQILTRPREFDVVATMNLNGDYISDALAAQVGGIGIAPGANINYVTGHAIFEATHGTAPKYAGLDKVNPSSVLLSGVLLLEHLGWNEAAKLVTASVEKTIASKVVTYDFARLMEGATEVKCSEFANELIKNMDVAIIKNA

SEQ ID NO: 27999 - DNA, 1104 bp, Eremothecium gossypii
  CDS (1)..(1104)
atgcacagaagcagtgcgacgtccctgatccataaagcaacgtatgccacctccaagacactcacaataggcttgattccaggcgacggaatcggcaaggaggtgatcccagccgggcagcgggttttggaggctatcggcaagaaacatgatataaggttcagctatgagcatctggatgctggctggcaaacgtttttagagacgggcaacgcccttccaggagcaacagtggaagctttgcgggaaagatgccagggtgcactgtttggcgcagtccagtcgccgaccacgaaggtggaagggtactcatcacccattgttgcgctacgcaggcagctggggctttacgccaacataaggcccgtcaagtctgtttctgggactgggcagccagtggatctcgtaatcgtgagagaaaataccgaagatctatatgttcaacaggaacggacttacgtggatgcggcgaccggcaagcgggtagcggaggccatcaagagaatctcggagccggcaaccgagcggatagctgaaatttcgttgcggcttgcactacagcgccagcggatgggagggcgcggagcgctaaccgtcactcataagtcgaacgtgttatcccagacagatgggctcttcaaagaggtatgcagggaggtatacgaggccaacaaaaaatcttatgggtcgatagagtacaacgagcagattgtggattcaatggtttatcggcttttcaaggaaccccattgtttcgacgtggtagttgcgcctaatctgtacggagacctgctatctgacggtgcagcagctttagtcggctcacttggactggttccgagcgttaatgttggcaacaacatcattatcggagaaccatgtcatggctctgcacctgatatcgctggaagggggattgcgaaccccatcgctacaatcagatcagtgtcactaatgcttcagttcctaggtttagaggaggctgcaagtgacatcgaccaggctgttacagggaacttgaaggatcgccaggttgtttcccccgaccttggcgggaagaacaccacacaggaggtgctggacgatattctggcaaggatttga

SEQ ID NO: 28000 - protein, 367 aa, Eremothecium gossypii
MHRSSATSLIHKATYATSKTLTIGLIPGDGIGKEVIPAGQRVLEAIGKKHDIRFSYEHLDAGWQTFLETGNALPGATVEALRERCQGALFGAVQSPTTKVEGYSSPIVALRRQLGLYANIRPVKSVSGTGQPVDLVIVRENTEDLYVQQERTYVDAATGKRVAEAIKRISEPATERIAEISLRLALQRQRMGGRGALTVTHKSNVLSQTDGLFKEVCREVYEANKKSYGSIEYNEQIVDSMVYRLFKEPHCFDVVVAPNLYGDLLSDGAAALVGSLGLVPSVNVGNNIIIGEPCHGSAPDIAGRGIANPIATIRSVSLMLQFLGLEEAASDIDQAVTGNLKDRQVVSPDLGGKNTTQEVLDDILARI

SEQ ID NO: 28001 - DNA, 1104 bp, Eremothecium gossypii
  CDS (1)..(1104)
atgctgagacagaagctatttcaaggaagccgcaggtggttagcgtctgtgcggcagcccagtatcgggcggtatgcgggtaagccgaacgcggcgggcaagtacacggtgtcgttcattgagggcgatggtgtgggccccgagatctcgcagtcggtcaaggacatcttctcggcggcgtctgtgccagtcgagtgggagtactgcgacgtgacgccccttctggtgaacgggctgacgacgatccccgagcctgcggtggcgtcgattaacaagaacctagtggcgctgaaggggccgctggcaacgcccatcggcaagggccaccggtcgctgaacttgacgctacgtaagaccttcgggctgtttgcgaacgtgcgcccggcgaagtcgatcgagggctacaagacgacatactcagacgtggacctggtgctgatccgggagaacacggaaggcgagtactccgggattgagcacgtggtatcgccgggcgtggtgcagtcgatcaagcttatcacgcgcgaggcgtccgagcgcgtgatccgctacgcgttcgagtacgcgaggaccgtggggcggcccaaggttgtggtggtgcacaagtccaccatccagcggctggccgatgggctgttcgtgaacgttgcgcaggagctgggccgcgaatacccggacattgagctgcagaccgagctgctcgacaacaccgtcctcaacgtggtcacgaagccagaggcgtacaaggacgtcgtcgccgtctgccccaacctgtacggcgacattctatctgacctgaacagtgggctttctgccggctcgcttggtctcaccccctccgccaatattgggcaccaggtctctatctttgaggccgtccacggttcggcgccggacatcgctggccagaaccgcgccaacccaaccgcgctattgctctcctccgttatgatgttgaatcacatgggcttgcacgagcacgccggccggatcgagaaggccgtgctttccaccattgcctctagccgtgagaaccgcactgcggaccttgctggtactgcctccacctcttcgttcacaaatgccgtcatcgaacggttgtaa

SEQ ID NO: 28002 - protein, 367 aa, Eremothecium gossypii
MLRQKLFQGSRRWLASVRQPSIGRYAGKPNAAGKYTVSFIEGDGVGPEISQSVKDIFSAASVPVEWEYCDVTPLLVNGLTTIPEPAVASINKNLVALKGPLATPIGKGHRSLNLTLRKTFGLFANVRPAKSIEGYKTTYSDVDLVLIRENTEGEYSGIEHVVSPGVVQSIKLITREASERVIRYAFEYARTVGRPKVVVVHKSTIQRLADGLFVNVAQELGREYPDIELQTELLDNTVLNVVTKPEAYKDVVAVCPNLYGDILSDLNSGLSAGSLGLTPSANIGHQVSIFEAVHGSAPDIAGQNRANPTALLLSSVMMLNHMGLHEHAGRIEKAVLSTIASSRENRTADLAGTASTSSFTNAVIERL

SEQ ID NO: 28003 - DNA, 993 bp, Methanococcus maripaludis S2
  CDS (1)..(993): transl_table=11
atgcataagatttgcgtaatcgaaggcgatgggattggaaaagaagtggttcctgctgccgtagaagttttaaaagctacgggtgtcgaatttgaatttaatcatgccttggcaggggacgaggtatttgaaaaaacaggtgtagcacttccagaagaaacaattgctgctgcaaaagctgctgatgcaatattattcggtgctgctggagagactgccgctgacgttattgtaaaattgagaaaaatattggatacttatgcaaatataaggccagtaaaatcatacaatggaataaactgcctaaaaacaggtatcgactacataatagtaagggaaaacacagaaggcctctataaaggtattgaagctgaaattgcagacggagttactgttgcaacaagggttattaccaaagatgcatctgaaagaatattcaaacacgcatttgaaatggcaaaagacaggaaaaaacaaggaactgccggaaaagtcacatgtgcacacaaagcaaacgttttaaaaataactgatgggttatttaagaaaacattctacgaagtttcaaatgattacaaagatatacaaactgaagacttttatgtcgatgcaatgaacatgtttataatttcaagacctgaaacatttgacatagttgttacatcgaatttatttggagacattttatcagacggggctgttggaatggttggcggacttggaatggcaccatcaggaaatgttggtgacaaatacggtctttttgaaccaatccacggttcagctccagatatcgctggaaaaggacttgcaaatccaactgcaacaatactgaccgcagtaatgatgttaagatacttaaaagaaaatgaagctgctgaaaaagtcgaaaaagcgcttgaagaagttttaagccttggattaacaacacctgatttaggtggtactctttcaacaagtgaaatgggtcaggaagttgcaaaaagagtataa

SEQ ID NO: 28004 - protein, 330 aa, Methanococcus maripaludis S2
MHKICVIEGDGIGKEVVPAAVEVLKATGVEFEFNHALAGDEVFEKTGVALPEETIAAAKAADAILFGAAGETAADVIVKLRKILDTYANIRPVKSYNGINCLKTGIDYIIVRENTEGLYKGIEAEIADGVTVATRVITKDASERIFKHAFEMAKDRKKQGTAGKVTCAHKANVLKITDGLFKKTFYEVSNDYKDIQTEDFYVDAMNMFIISRPETFDIVVTSNLFGDILSDGAVGMVGGLGMAPSGNVGDKYGLFEPIHGSAPDIAGKGLANPTATILTAVMMLRYLKENEAAEKVEKALEEVLSLGLTTPDLGGTLSTSEMGQEVAKRV

SEQ ID NO: 28005 - DNA, 1020 bp, Methanococcus maripaludis S2
  CDS (1)..(1020): transl_table=11
atgagaaacactcccaaaatttgtgttatcaatggtgacggtattggaaacgaagtagttcctgaaacggtgcgagttttaaatgaacttggtgacttcgaattcattcatgcccatgcaggttacgaatgttttaaaagatgtggcgatgcgataccagaaaacacaattgaaattgcaaaagaatctgattgtattttatttggatcagttaccactccaaaaccgactgaattaaaaaataaatcatatagaagtccaatattaactttaagaaaagaacttgacctttatgcaaatattaggccaacttataactttgataatcttgattttgttataattcgagaaaatactgaaggactctatgtaaaaaaagaatattacgacgaaaaaaacgaagttgcaattgctgagcgaataatttcaaaatttggaagttctagaattgtaaaatttgcttttgattatgcggttcaaaataacagaaaaaaagtatcctgcatacataaagcaaacgtattacgggttactgacggattatttttagaagttttcgaagaaatgtctaaacattacgaaaaattaggaataaagtctgatgactacctaattgacgcgacagcaatgtatttgattagaaacccgcaaatgtttgatgtattggttacaacaaatctttttggagatattttatctgatgaagctgcaggacttattggcggacttggaatgtctccttcagcaaacattggtgataaaaacggattatttgagccagttcatggatctgcaccagacattgctggaaaaggaatttcaaacccgattgcaacaatattgagtgctgcaatgatgcttgaccatttaaaaatgaataaagaagccgaatacattagaaaagcggttaaaaaaacggttgaatgtaaatatttaactcctgatcttgggggaaacttaaaaacttttgaagttacggaaaaaatcattgaatccataaggtctcagatgattcagtga

SEQ ID NO: 28006 - protein, 339 aa, Methanococcus maripaludis S2
MRNTPKICVINGDGIGNEVVPETVRVLNELGDFEFIHAHAGYECFKRCGDAIPENTIEIAKESDCILFGSVTTPKPTELKNKSYRSPILTLRKELDLYANIRPTYNFDNLDFVIIRENTEGLYVKKEYYDEKNEVAIAERIISKFGSSRIVKFAFDYAVQNNRKKVSCIHKANVLRVTDGLFLEVFEEMSKHYEKLGIKSDDYLIDATAMYLIRNPQMFDVLVTTNLFGDILSDEAAGLIGGLGMSPSANIGDKNGLFEPVHGSAPDIAGKGISNPIATILSAAMMLDHLKMNKEAEYIRKAVKKTVECKYLTPDLGGNLKTFEVTEKIIESIRSQMIQ

SEQ ID NO: 28007 - DNA, 1101 bp, Xenopus tropicalis
  CDS (1)..(1101)
atggctggcagcgcctggaggtcactgatctctcgtgtggcgggggcactcactgcaccagaatatggagccaggcagctttctaaccatgtgcagactgtcactcttataccaggggatggaattggcccagagatttcaacagctgtcatgaaaatttttgagactgccaaagcacctgtacagtgggaagagagaaatgtcacagcaattaaaggccctggtggaaagtggatgattcctcctgaagccaaagaatccatggataagaacaagatgggcttaaaaggacctttaaagacacccattgctgctgggcatccgtccatgaacttgctgctccgcaagacatttgatctctatgcaaatgtgcgaccctgtgtttctattgagggctacaggaccccatacacagatgtagacctggtcacaattcgtgagaacacagagggagaatatagtggtatcgagcatgtgattgtagatggtgtggtgcaaagcattaagctgattacggaggaagccagccatcgcattgcacagtttgcctttgagtatgcaaggaacaaccagagaagcacagtgactgcagtgcacaaagctaatattatgaggatgtctgatgggctgttcctaaaaaaatgtcgagaagttgcagaaaactttaaagacattaaatttaatgaaatgtatctggataccgtgtgtcttaatatggtccaggatcctacccagtttgatgtgttagtcatgccaaacctttatggtgacatcttgagtgacctttgtgcaggtttaattggaggcctgggagtgacgccaagtggaaatattggtgctaatggggtagcaatctttgaatcggttcatggcacagctccagatattgctggaaaagacttggctaatcccactgctcttcttctaagcgcagtcatgatgttgcggcacatgggtctccacgaacatgcacgcaaaatagaaaatgcttgctttgagacaatcaaatctgggaaggctctgactaaagacttgggtggtaactccaagtgctctgaatttaccaatgaaatctgtcgcagaatacaggacagtgattag

SEQ ID NO: 28008 - protein, 366 aa, Xenopus tropicalis
MAGSAWRSLISRVAGALTAPEYGARQLSNHVQTVTLIPGDGIGPEISTAVMKIFETAKAPVQWEERNVTAIKGPGGKWMIPPEAKESMDKNKMGLKGPLKTPIAAGHPSMNLLLRKTFDLYANVRPCVSIEGYRTPYTDVDLVTIRENTEGEYSGIEHVIVDGVVQSIKLITEEASHRIAQFAFEYARNNQRSTVTAVHKANIMRMSDGLFLKKCREVAENFKDIKFNEMYLDTVCLNMVQDPTQFDVLVMPNLYGDILSDLCAGLIGGLGVTPSGNIGANGVAIFESVHGTAPDIAGKDLANPTALLLSAVMMLRHMGLHEHARKIENACFETIKSGKALTKDLGGNSKCSEFTNEICRRIQDSD

SEQ ID NO: 28009 - DNA, 1161 bp, Ustilago maydis 521
  CDS (1)..(1161)
atgttcacggtccctgctttccgatcggccagctcgtcgctggccaagcgccccacgctcgcctcgtcggcgctcaagctcaacaggatgtcggtccgtggcctcgcgatgcctgtcaccaacgcccctacctcggcttacaacaagcaaaagggctccgatggcaagtacacggtcaccttgattcccggtgatggtattggtcccgaggtctcgaatgccgtcaaggagatctaccacgctgctaacgtacccatcaagtgggaggaggtctcggtcgctccgttcatcaaggatggcaagcagaccatccccgaagagtcaatcgtctcgatcaagaagaacacggttgcactcaagggtcccctcgctacgcccatcggcaagggtcacgtctcgctcaacttgacgctccgacgaaccttccatctctttgccaacgtccgaccgtgcaagtcgatcgagggcttcaagaccgcctacgacaacgtcgacactgtgctcatccgtgaaaacaccgagggtgagtactcgggtatcgagcacgaggtcgtcgacggcgtcgtccagtcgattaagctcatcacctacgaggcttcggagcgtgttgcccgctacgctttccaccacgccgaacagaacggccgtaacaaggtgactgctgttcacaaggctcccatcatgcgcatgtcggacggcatgttcctgcacgcctgccgacaggttgccaaggagtatccgcacatcgcctacgacgaggatctgctcgaccgagcctgcctccgtatcgtgcaggaccctgcaccttacgccgaccgcgtcatggtgatgcccaacttgtacggtgacattctctcggacatgtgcgccggtctcattggtggtctcggtctcacgccttccggtaacattggcaaggacgcttcgattttcgaggcagtccacggctctgcccccgacattgctggccaggacaaggcgaaccctactgcgctgttgctctcttcgatcatgatgctccgacacatgagcctgtttgacaaggctgaccagatcgagaatgccatcttcaagaccatcgctgccggcgagcgtaccggggatcttggcggcaagctcggcacccgcgctttcaccgacaagatcatctctcgcttgtaa

SEQ ID NO: 28010 - protein, 386 aa, Ustilago maydis 521
MFTVPAFRSASSSLAKRPTLASSALKLNRMSVRGLAMPVTNAPTSAYNKQKGSDGKYTVTLIPGDGIGPEVSNAVKEIYHAANVPIKWEEVSVAPFIKDGKQTIPEESIVSIKKNTVALKGPLATPIGKGHVSLNLTLRRTFHLFANVRPCKSIEGFKTAYDNVDTVLIRENTEGEYSGIEHEVVDGVVQSIKLITYEASERVARYAFHHAEQNGRNKVTAVHKAPIMRMSDGMFLHACRQVAKEYPHIAYDEDLLDRACLRIVQDPAPYADRVMVMPNLYGDILSDMCAGLIGGLGLTPSGNIGKDASIFEAVHGSAPDIAGQDKANPTALLLSSIMMLRHMSLFDKADQIENAIFKTIAAGERTGDLGGKLGTRAFTDKIISRL

SEQ ID NO: 28011 - DNA, 1467 bp, Leptospira interrogans serovar Copenhageni str. Fiocruz L1-130
  CDS (1)..(1467): transl_table=11
atgtccgaaaaaactaaaatcgcaattgcctacggtgatggaatcggtcctgagattatggatgcgactcttaaaattttaaatgctgccggagctaaaattgaaccgattgaaatcgaaatcggcgaaaaagtttataaggaaggacactcttccggaattaaaccggaagcctgggatattctgagacaaactaaagtatttctaaaagcacccattacaactcctcaaggaggcggttacaaaagtttaaacgttactgtcagaactaccctaggtctatttgcaaacgttagaccctgtttttcactgtatccatacgtagaaaccaaacacccttccctagatattgtaatcatccgtgaaaatgaagaagatctttatactggaatagaacacagacaaaccaatgacacggttcaatgccttaaattaatttcccacccaggatcagaaaagatcattcgttacgcattcgaatatgcaagagcttacggaagaaaaaaagtaaccgcgatggtaaaggacaatattatgaaacaaacagacggtttgtttcatgacattttcaaagaagtagccaaagaatatccagaattagaagtaaattctcaaatcatagatataggcgcagccaacctagcagacagacctcaaaattttgacgtagtagttactttaaatttatatggagatattatttctgatatagtcgctcagatcgcgggttcagtaggaatggcaggttcttccaacatcggagaaattgtttctatgttcgaagcaatccacggttctgctccggacatagcaggaaaaaatctggcaaatccatctggcttactcaacgccgcagtgatgatgctcgttcacattggacaaccggacatcgctgcaaaaattaataacgcgtggttattgaccatagaagaaggaattcataccggagatatttttaaaccgggagtaagcagaattaaagtgggaaccaaagaattttccgacgcggtaatcggaaatttaggtcatcttcctggaaaattcaaaccagtttcttttggaaaggctaagaaaattataattcctgaatataaaagaaacattcaaaagaaagatttagtaggagtggatatttttctggattgggtaggaaaggatccgaacgaactcggaaataaactcaaatctgtttccgacgaactgatgttaaaaatcatcaccaaccggggagtcaaagtttatcctgacggccaaccggaaacttttttgatcgatcattggagatgtagatttgtaagcaaaaatgcactgattaaacaagaggacccttcctaccatccaatttctcataaacaagtagcagaacttcttttaaagttagacttggccggttttgatacaatcaaaacggaaaatctttattactttaacggaaaaagagccttttctttagggcaaggagaatga

SEQ ID NO: 28012 - protein, 488 aa, Leptospira interrogans serovar Copenhageni str. Fiocruz L1-130
MSEKTKIAIAYGDGIGPEIMDATLKILNAAGAKIEPIEIEIGEKVYKEGHSSGIKPEAWDILRQTKVFLKAPITTPQGGGYKSLNVTVRTTLGLFANVRPCFSLYPYVETKHPSLDIVIIRENEEDLYTGIEHRQTNDTVQCLKLISHPGSEKIIRYAFEYARAYGRKKVTAMVKDNIMKQTDGLFHDIFKEVAKEYPELEVNSQIIDIGAANLADRPQNFDVVVTLNLYGDIISDIVAQIAGSVGMAGSSNIGEIVSMFEAIHGSAPDIAGKNLANPSGLLNAAVMMLVHIGQPDIAAKINNAWLLTIEEGIHTGDIFKPGVSRIKVGTKEFSDAVIGNLGHLPGKFKPVSFGKAKKIIIPEYKRNIQKKDLVGVDIFLDWVGKDPNELGNKLKSVSDELMLKIITNRGVKVYPDGQPETFLIDHWRCRFVSKNALIKQEDPSYHPISHKQVAELLLKLDLAGFDTIKTENLYYFNGKRAFSLGQGE

SEQ ID NO: 28013 - DNA, 1005 bp, Thermus thermophilus HB27
  CDS (1)..(1005): transl_table=11
atggcgtaccggatctgcttgattgagggcgacggcatcgggcacgaggtcatccccgcggcgcggagggtgctggaggccaccggcctccccctggagttcgtggaggcggaggcgggctgggagacctttgagagaagagggacctccgtccccgaggagacggtggagaagatcctgtcctgccacgccaccctcttcggggccgccaccagccccacccgtaaagtgccgggcttcttcggggcgatccgctacctcaggcgcaggctggacctctacgccaacgtccgccccgccaagagccgccccgtcccgggaagccgccccggcgtggacctggtcatcgtccgggagaacaccgaagggctttacgtggagcaggaaaggcgctacctggacgtggccatcgccgacgccgtcatctccaagaaggccagcgagcgcatcggccgggccgccttaaggatcgccgagggccggccccgcaaaacccttcacatcgcccacaaggccaacgtcctccccctcacccaggggctcttcctggacacggtcaaggaggtggccaaggacttccccctggtgaacgtgcaggacatcatcgtggacaactgcgccatgcagctcgtcatgcgtcccgagcgctttgacgtcatcgtcaccaccaacctcctgggggacatcctctccgacctcgccgcggggctcgtggggggcctgggcctcgccccctcgggcaacatcggggacaccaccgcggtctttgagcccgtccacggctccgcccccgacatcgccggcaagggcatcgccaaccccacggcggccatcctctccgcggccatgatgctggactacctgggggagaaggaggcggccaagcgggtggagaaggcggtggacctggtgctggagcgggggcccaggacccctgacctgggcggggacgccaccacggaagccttcaccgaggccgtggtggaggcgctcaagagcctgtag

SEQ ID NO: 28014 - protein, 334 aa, Thermus thermophilus HB27
MAYRICLIEGDGIGHEVIPAARRVLEATGLPLEFVEAEAGWETFERRGTSVPEETVEKILSCHATLFGAATSPTRKVPGFFGAIRYLRRRLDLYANVRPAKSRPVPGSRPGVDLVIVRENTEGLYVEQERRYLDVAIADAVISKKASERIGRAALRIAEGRPRKTLHIAHKANVLPLTQGLFLDTVKEVAKDFPLVNVQDIIVDNCAMQLVMRPERFDVIVTTNLLGDILSDLAAGLVGGLGLAPSGNIGDTTAVFEPVHGSAPDIAGKGIANPTAAILSAAMMLDYLGEKEAAKRVEKAVDLVLERGPRTPDLGGDATTEAFTEAVVEALKSL

SEQ ID NO: 28015 - DNA, 1491 bp, Thermus thermophilus HB27
  CDS (1)..(1491): transl_table=11
atgcccctgatcaccacggaaaccggcaagaagatgcacgttctcgaggacgggcgcaagctcatcaccgtcatccccggagacggcgtcgggcccgagtgcgtggaggctaccctcaaggtcctagaggcggccaaggcccccctggcctacgaggtgcgagaggcgggggcgagcgtcttccggcggggcatcgcctcgggcgttccccaggagaccattgagtccatccgcaagacccgggtggtcctgaagggtcccctggaaaccccggtgggctacggggagaagagcgccaacgtcaccctaaggaagctctttgagacctacgccaacgtccgccccgtgcgggagttccccaacgtccccaccccctatgcgggccggggcattgacctcgtggtggtgcgggagaacgtggaggacctctacgccgggattgagcacatgcagaccccgagcgtggcccagaccctcaagctcatctcctggaagggatcggagaagatcgtccgcttcgcctttgagctggcccgggccgaggggcggaagaaggtccactgcgccaccaagtccaacatcatgaagctcgccgaagggaccctgaagcgggcctttgagcaggtggcccaggagtaccccgacatagaagcggtccacatcatcgtggacaacgctgcccaccagctggtgaaaaggcccgagcagtttgaggtgatcgtcaccaccaacatgaacggagacatcctctccgacctcacctcggggctcatcgggggcctgggcttcgctccctcggccaacatcggcaacgaggtggccatctttgaggccgtccacggttccgcccccaagtacgccgggaagaacgtcatcaaccccaccgcggtcctcctctcggcggtgatgatgctccgctacctggaggagttcgccacggcggaccttatagagaacgccctcctctacaccctcgaggagggccgggtcctcacgggggacgtggtgggctacgaccggggggccaagaccacggagtacaccgaggccatcatccagaacctgggcaagaccccaaggaagacccaggtgcggggctacaagcccttccgcctgccccaggtggacggggccatcgcccccatcgtccctaggagccgccgggttgtgggggtggacgtcttcgtggaaaccaacctcctgcccgaggccctgggaaaggccctggaggaccttgccgcgggcacccccttccggctcaagatgatctccaaccggggcacccaggtctacccccccaccggcgggctcacggacctggtggaccactaccgctgccgcttcctctacacgggggagggggaggctaaggacccggagatcctggacctcgtaagccgggtggcaagccgcttccgctggatgcacctggagaagctccaggaatttgacggcgagcccggcttcaccaaggcccaaggggaagactaa

SEQ ID NO: 28016 - protein, 496 aa, Thermus thermophilus HB27
MPLITTETGKKMHVLEDGRKLITVIPGDGVGPECVEATLKVLEAAKAPLAYEVREAGASVFRRGIASGVPQETIESIRKTRVVLKGPLETPVGYGEKSANVTLRKLFETYANVRPVREFPNVPTPYAGRGIDLVVVRENVEDLYAGIEHMQTPSVAQTLKLISWKGSEKIVRFAFELARAEGRKKVHCATKSNIMKLAEGTLKRAFEQVAQEYPDIEAVHIIVDNAAHQLVKRPEQFEVIVTTNMNGDILSDLTSGLIGGLGFAPSANIGNEVAIFEAVHGSAPKYAGKNVINPTAVLLSAVMMLRYLEEFATADLIENALLYTLEEGRVLTGDVVGYDRGAKTTEYTEAIIQNLGKTPRKTQVRGYKPFRLPQVDGAIAPIVPRSRRVVGVDVFVETNLLPEALGKALEDLAAGTPFRLKMISNRGTQVYPPTGGLTDLVDHYRCRFLYTGEGEAKDPEILDLVSRVASRFRWMHLEKLQEFDGEPGFTKAQGED

SEQ ID NO: 28017 - DNA, 1452 bp, Parachlamydia sp. UWE25
  CDS (1)..(1452): transl_table=11
gtgatggcagcacaactgataccgattactgtggccgagggagatggaattgggccggaaattatggatgctacgctaagaattttaaaagcagctggagctcctttagatataaaaaatgttgaaattggagaaaaggtttatttaagtggacaaccaacaggaattgaaaattccacttgggatttaattagacaatccaaagctcttttaaaagccccaattaccactccccaaggtggtggctttaaaagtctaaacgtgaccattcgcaccactctaggattatatgctaatgtgcgcccttgtgtagcttattacccattcgttgaaaccaaatatccaggcatgaacgttgtgattgtcagagaaaacgaagaagacctttatactggaattgaatatcgacaaactcccgacgtctacgaagcacttaaactcattacaagacccggatgtgagaaaatcattcgttatgctttcgaatatgcgcaaatctatcaccgcaaaaaagtcacttgttttacaaaagataatattttgaagttaactgatgggcttttccataaaatttttgatgaaattggagccgaatatccacaaattgaaaaagagcattggattgttgatatcggagcagctaaactagctgatacaccaacagcttttgatgtaattgttatgcctaatttgtatggagacattttatcagatgttgctgctcaaattgctggatctgtcggtctagccggatctgcaaatattggtaattcgggagccatgtttgaagctattcatggatctgcgcctagacgggctggacaaaatctagccaatccttcaggtcttttactggctgccattcaaatgcttgttcatttagaacaatcgaatttagctgaactcattcataatgcctggctaaaaacgcttgaagaagggattcatacttatgatatttttaaagaaaaaacaagtaagcagaaagttggaacaaaggaatttgcgaatgccgtaactgcccgtttaggaaaaaaacccgaaacattacccgcagctcactatagcacatcttttcatatcaaacattccaacttttcatctcttaaaaatttcaaacaagaattatatgggatagacatttttattaaatggagcgaagatgtagaaacattagcgactcttcttcaatccacgtctaatcacgatttaaaattaaaaatgatcaataaccgaggtgtaaaagtatggccaaataaaatgcctgaaacagcttgcatagacaactggcgttgtagattcatatcttctacaaataaaatcgtatcccaagagcaaattctcaatttactaaacagacttgtacaaaaaaaacttacgctgacacaaactgcttatttatttgcttttgatggacaggcgggttatactttagctcaagatgaacaataa

SEQ ID NO: 28018 - protein, 483 aa, Parachlamydia sp. UWE25
MMAAQLIPITVAEGDGIGPEIMDATLRILKAAGAPLDIKNVEIGEKVYLSGQPTGIENSTWDLIRQSKALLKAPITTPQGGGFKSLNVTIRTTLGLYANVRPCVAYYPFVETKYPGMNVVIVRENEEDLYTGIEYRQTPDVYEALKLITRPGCEKIIRYAFEYAQIYHRKKVTCFTKDNILKLTDGLFHKIFDEIGAEYPQIEKEHWIVDIGAAKLADTPTAFDVIVMPNLYGDILSDVAAQIAGSVGLAGSANIGNSGAMFEAIHGSAPRRAGQNLANPSGLLLAAIQMLVHLEQSNLAELIHNAWLKTLEEGIHTYDIFKEKTSKQKVGTKEFANAVTARLGKKPETLPAAHYSTSFHIKHSNFSSLKNFKQELYGIDIFIKWSEDVETLATLLQSTSNHDLKLKMINNRGVKVWPNKMPETACIDNWRCRFISSTNKIVSQEQILNLLNRLVQKKLTLTQTAYLFAFDGQAGYTLAQDEQ

SEQ ID NO: 28019 - DNA, 1263 bp, Listeria monocytogenes str. 4b F2365
  CDS (1)..(1263): transl_table=11
atgagtcaaaaaattcaagtagaaaacggtgtgctcaaaacaccaaacaatccagtcattccttttattgaaggggacggaactggtccagacatctgggcagctgcaaaacgcgttttagatgccgcagtaaaaaaagcttacaatggcgaaaaagaaattgcttggaaagaagtactagctggtgaaaaagcatttaaacaaacaggagaatggttaccacaagcgactttagatacaattgatgaatatttgattgctattaaaggaccgcttactactccaatcggtggaggcattcgttcgttaaacgttgccctgcgccaagagttagatttatatgtttgtttacgtccagttcgttatttcaaaggcgttccttcaccggtgaaacgtccggaagacacagatatggtcattttccgtgagaatacagaagatatatatgcagggattgaatttaaagaaggcagcgaagaatcaaaaaaactaatcgacttcttaaaatctgagtttggcgttgacaaaattcgtttcccggaaacttctggtattggtattaagccaatttccaaagagggaacagagcgtttagtgcgttcggcgattgaatatgcaattaaagaaggtcgtaaatcattaacgcttgtacacaaagggaatatcatgaaattcacagaaggagctttcaaaaattggggctatgacttatgtgaacgcgaatatggcgataaagtatttacttggaatgagtatgatcgcattaaagaagcagaaggaacagaagttgctgatgcgaaacaaaaagaagcgcttgctgctgggaaaattttagtcaaagattcgattgcggatattttcttgcaacaaatcttaactcgcccggctgaatttgatgtagttgctacaatgaacttgaatggagattacatttctgatgcacttgctgctcaagtaggcggaatcggtattgctccaggagcaaacattaactacttaactggccatgcaattttcgaagcgacgcatggtactgcaccgaaatatgcaggtcttgataaagtgaatccttcatcagttattttatctgggacacttcttcttgaacatattggttggggtgaagcggctgcattaattaatcagtcaatggaaaaaacaatcgctgcgaaaaccgtaacttatgattttgctcgattaatggatggtgcgacagaagttaaatgttcggaatttgcagatgaattaataaaaaatttctaa

SEQ ID NO: 28020 - protein, 420 aa, Listeria monocytogenes str. 4b F2365
MSQKIQVENGVLKTPNNPVIPFIEGDGTGPDIWAAAKRVLDAAVKKAYNGEKEIAWKEVLAGEKAFKQTGEWLPQATLDTIDEYLIAIKGPLTTPIGGGIRSLNVALRQELDLYVCLRPVRYFKGVPSPVKRPEDTDMVIFRENTEDIYAGIEFKEGSEESKKLIDFLKSEFGVDKIRFPETSGIGIKPISKEGTERLVRSAIEYAIKEGRKSLTLVHKGNIMKFTEGAFKNWGYDLCEREYGDKVFTWNEYDRIKEAEGTEVADAKQKEALAAGKILVKDSIADIFLQQILTRPAEFDVVATMNLNGDYISDALAAQVGGIGIAPGANINYLTGHAIFEATHGTAPKYAGLDKVNPSSVILSGTLLLEHIGWGEAAALINQSMEKTIAAKTVTYDFARLMDGATEVKCSEFADELIKNF

SEQ ID NO: 28021 - DNA, 1179 bp, Picrophilus torridus DSM 9790
  CDS (1)..(1179): transl_table=11
atggacagaataatgtttgaaaatggaagctggatagtaccagaaaagcctgtaattttgtatgcaaatggagacggcataggtcctgagataatggatgcaaccaggaaggttgtggatgctgccacggccatggagaaaaaatccatagcatggaaggagatcctccttggagatagggccgaggaattaaagggcgatagatttccggaggaatcaataaaggcaataaatgattacagggttcttttaaaggcgcctttgaatacacctgttggcaagggctttaaatcgataaatgttagaataaggatgttgcttgatctgtacgcaaacataaggcctgtaaagttcatgccgggtcttgaaagcccattaaaaaatccagaaaaggttaatttaacgatctttagagaaaacactgacgatctttaccttggctatgaatggagctacgacacggatgaggcaaaaaggataagaaaattcctcaaagatgagtttaacatagatataagcgacgactctggtataggcataaagccaatgagcaggtataaaacacagagaataacaaggcttgcggtaaaatatgccatggataacaatcttaaaaagataacaataatgcacaagggaaacgtcatgaagtacacagaaggtgcattcagggagtgggcatatgaaacagcactgaatgaattttctgattacgtatcaagagacgatgataaaaagataataataaacgatataatcgcggataacatgttccagcagataataaccaggccagatgagtatcaattaattcttgcgccaaatgttgacggtgattacatctcggatgcggccggtgccttaataggcaatataggcacgcttggcggtgcaaacatcggcgacaacggtgcaatgttcgaggctgttcatggtacagcgccaaagtacgccggaaagaacgttgcagatccgcttgggctgatacgcggtgcgcagttaatgcttagatacatgggctggaaccgtgcagctgatgcaatagaaaaggcaatacaggcatcaataaacgaaaagaaggttacaaacgatcttgcaaggttctttaacgttgagcctcttggcaccagggaatatggtgattaccttgtagataaaataaaggtattagtttcttaa

SEQ ID NO: 28022 - protein, 392 aa, Picrophilus torridus DSM 9790
MDRIMFENGSWIVPEKPVILYANGDGIGPEIMDATRKVVDAATAMEKKSIAWKEILLGDRAEELKGDRFPEESIKAINDYRVLLKAPLNTPVGKGFKSINVRIRMLLDLYANIRPVKFMPGLESPLKNPEKVNLTIFRENTDDLYLGYEWSYDTDEAKRIRKFLKDEFNIDISDDSGIGIKPMSRYKTQRITRLAVKYAMDNNLKKITIMHKGNVMKYTEGAFREWAYETALNEFSDYVSRDDDKKIIINDIIADNMFQQIITRPDEYQLILAPNVDGDYISDAAGALIGNIGTLGGANIGDNGAMFEAVHGTAPKYAGKNVADPLGLIRGAQLMLRYMGWNRAADAIEKAIQASINEKKVTNDLARFFNVEPLGTREYGDYLVDKIKVLVS

SEQ ID NO: 28023 - DNA, 1308 bp, Bacillus anthracis str. Sterne
  CDS (1)..(1308): transl_table=11
atgggggttatcacattgacgacaggtgaaaaaattactgtaactaatggtgttatgaatgtaccaaacaatccgattattccatttatcgaaggagatggaattggtcctgatatttgggcagctgcatctcgtgtactagaagcagcagttgaaaaagcttatgatggtgagaagaaaatcgtttggaaagaagtgcttgcaggggaaaaagcattcaaccaaacaggcgagtggttaccagaagaaactttaaatttaattcgtgaatatttaatcgcgattaaaggtccacttacaactccagttggcggtggtattcgttctctaaacgtagcacttcgtcaagaattagatttatatgtatgtctacgtccagttcgttattttgaaggtgttccttcacctgtaaaacgtccggaagatactgatatggttattttccgtgaaaatacagaagacatttatgctggaattgaatatgcgcaaggatctccagaagcagaaaaagttcttgctttcttaaaagaagcaatgggtgttaataaaatccgcttcccagaaacatctggtattggtattaaaccaatctcagaagaagggacaaagcgtcttgttcgtgctgcaattcaatatgcaattaacgaaaaacgctcttctgttacattagttcataaaggaaacattatgaaattcacagaaggtgctttcaaaaactggggttacgaagtagcggaacaagaattcggcgacaaagtatttacttgggctgaatatgatcgtatcgttgagaaagatggtaaagatgcagcgaataaagcgatggcagacgctgaagtggctggaaaaatcatcgtaaaagattctattgcagacatcttcttacaacaaattttaactcgtccacgtgagttcgatgttgttgcaacaatgaacttaaacggagactacatctctgatgcacttgctgcacaagtaggtggaattggtattgcacctggtgcaaacattaactatgtgactggacatgctatctttgaagctacgcacggtacagctccaaaatatgcaggtttagataaagtaaacccatcttcagttcttctttctggtgtattattattagagcacttaggatggaacgaagctgcgaaattagtaactgcttcagttgagaaaacaattgcttcaaaagtagtaacttatgatttcgcacgcttaatggaaggtgcaacagaagtgaaatgttctgagttcgctaatgaacttattaaaaacatggatgtagcgataatcaaaaacgcataa

SEQ ID NO: 28024 - protein, 435 aa, Bacillus anthracis str. Sterne
MGVITLTTGEKITVTNGVMNVPNNPIIPFIEGDGIGPDIWAAASRVLEAAVEKAYDGEKKIVWKEVLAGEKAFNQTGEWLPEETLNLIREYLIAIKGPLTTPVGGGIRSLNVALRQELDLYVCLRPVRYFEGVPSPVKRPEDTDMVIFRENTEDIYAGIEYAQGSPEAEKVLAFLKEAMGVNKIRFPETSGIGIKPISEEGTKRLVRAAIQYAINEKRSSVTLVHKGNIMKFTEGAFKNWGYEVAEQEFGDKVFTWAEYDRIVEKDGKDAANKAMADAEVAGKIIVKDSIADIFLQQILTRPREFDVVATMNLNGDYISDALAAQVGGIGIAPGANINYVTGHAIFEATHGTAPKYAGLDKVNPSSVLLSGVLLLEHLGWNEAAKLVTASVEKTIASKVVTYDFARLMEGATEVKCSEFANELIKNMDVAIIKNA

SEQ ID NO: 28025 - DNA, 1311 bp, Acinetobacter sp. ADP1
  CDS (1)..(1311): transl_table=11
atgtcctttgtggcatacatttattcgccagttacaaaagggagtacctgtacaatgggttatcagaagatcgtggtgcctgtcgatggtgacagaataaaagtcaatgcagacctgtcacttaacgttccaaaccatccgatcattcctttcattgagggtgacggtattggtgtggatattacaccagctatgaaggcagtggtagatgctgcgattgtcaaagcttatggcggcaaacgttcgatcgaatggatggaagtatactgcggtgaaaaagcaaatactatctatggcagctatatgcctgaagaaacttttgaagcattacgtgaatttgtcatttcaattaaagggccgcttaccacgccagtgggtggaggtattcgttcactcaacgtggctttacgtcaagaactagatttatatgtttgtgtcagacctgtacgctggtttgaaggtgtaccaagtcctgtacaacaccctgaactcaccgatatggtgatttttcgtgaaaattcagaagatatttatgctggcattgagtggaaagcagattctccagaggcaaaaaaagtcattcagtttttacaagaagaaatgggtgttcaaaaaatccgttttcccgaacactgtgggattggaattaaaccggtctctaaagaaggaacccagcgtctggtacgaaaagcgattcagttcgccatcgataatgataagccaagtgttactttggtacacaaaggcaatattatgaaatataccgaaggtgctttcaaagaatggggttatgagcttgcaatcgagcgttttggaggagagttgatcgatggtgggccatgggttcaaattaaaaaccccaaaacaggcaaggatattgtgattaaagatgtcattgcagacgctttcttgcagcaaattttaatgcgtccagccgattattcagtcattgcaaccctcaatctaaatggtgattatatttcagatgcacttgctgctgaggtgggtggaattgggattgcaccaggtgccaatattggtggtgcaattgctgtttatgaagcaacccatggaacagcaccgaaatatgctgggcaagataaagtaaatccaggctctattattttatcggcagaaatgatgctacgcgatatgggatggacagaagcagctgatctgatcatcaaaggtatatctggtgcgattgaagccaaaacagtgacttacgattttgagcgtttaatgccaggcgcaactctattaacctgttcagagtttgggcaagccatcattaagcatatggatgattaa

SEQ ID NO: 28026 - protein, 436 aa, Acinetobacter sp. ADP1
MSFVAYIYSPVTKGSTCTMGYQKIVVPVDGDRIKVNADLSLNVPNHPIIPFIEGDGIGVDITPAMKAVVDAAIVKAYGGKRSIEWMEVYCGEKANTIYGSYMPEETFEALREFVISIKGPLTTPVGGGIRSLNVALRQELDLYVCVRPVRWFEGVPSPVQHPELTDMVIFRENSEDIYAGIEWKADSPEAKKVIQFLQEEMGVQKIRFPEHCGIGIKPVSKEGTQRLVRKAIQFAIDNDKPSVTLVHKGNIMKYTEGAFKEWGYELAIERFGGELIDGGPWVQIKNPKTGKDIVIKDVIADAFLQQILMRPADYSVIATLNLNGDYISDALAAEVGGIGIAPGANIGGAIAVYEATHGTAPKYAGQDKVNPGSIILSAEMMLRDMGWTEAADLIIKGISGAIEAKTVTYDFERLMPGATLLTCSEFGQAIIKHMDD

SEQ ID NO: 28027 - DNA, 1254 bp, Erwinia carotovora subsp. atroseptica SCRI1043
  CDS (1)..(1254): transl_table=11
atggaaagcaaagtagtggtaccgacagaaggtcagaaaatcacggttgatgctcaaggtaaactggttgttccaaacaatccggttatcccgtttatcgaaggtgatggcattggtatcgatgtaacgccagccatgatcaacgtagtggacgccgccgtgaagaaagcctatcagggcaagcgcgcgatctcctggatggagatctacaccggtgagaaatccacgcaagtttacggtaaagatgtctggctgccagacgaaacgctggatctgatccgtgaatatcgtgtggcgattaagggcccgctgacaacgccagtcggtggtggtattcgttctctgaacgttgcactgcgccaacagttggacctgtatgtttgcctgcgtccggtacgctactacgaaggtacacctagcccggttaaacaacctgaactgaccgacatggtgatcttccgcgaaaacgccgaagacatctatgcaggtattgagtggaaagcgggttctgttgaagcagacaaagtgatcaaattcctgcgtgaagaaatgggtgttagcaaaatccgtttccctgagcagtgtggtatcggcgtgaagccgtgttccgaagaaggtaccaaacgtctggttcgcgctgcgatcgaatacgcgattaccaacgaccgtgattccctcacgttggtacacaaaggcaatatcatgaaattcaccgaaggcgcgtttaaagactggggctaccagttggcgcgtgaagaattcggcggtgagctgatcgatggcggcccgtgggtgaaaatcaagaacccgaacacaggcaaagagatcgttgtaaaagacgtcatcgccgatgcattcctgcaacaaatcctgctgcgtcctgctgaatatgacgtaatcgcctgtatgaacctgaacggtgactacatttctgatgcgctggcagcacaggttggcggtatcggtattgctccgggtgcgaacatcggtgacgaatgtgcactgtttgaagctacgcacggtacggcaccaaaatatgctggtcaggataaagtgaatccaggttccgttattctgtctgctgaaatgatgttacgtcacctgcaatggttcgaagcggctgacctgattgttaaaggcgttgaaggcgcgatcaagaacaagaccgtgacttacgatttcgaacgtctgatggaaggcgctaagctacggaaatgtagtgagtttgcgcaagacatcatcgataacatgtaa

SEQ ID NO: 28028 - protein, 417 aa, Erwinia carotovora subsp. atroseptica SCRI1043
MESKVVVPTEGQKITVDAQGKLVVPNNPVIPFIEGDGIGIDVTPAMINVVDAAVKKAYQGKRAISWMEIYTGEKSTQVYGKDVWLPDETLDLIREYRVAIKGPLTTPVGGGIRSLNVALRQQLDLYVCLRPVRYYEGTPSPVKQPELTDMVIFRENAEDIYAGIEWKAGSVEADKVIKFLREEMGVSKIRFPEQCGIGVKPCSEEGTKRLVRAAIEYAITNDRDSLTLVHKGNIMKFTEGAFKDWGYQLAREEFGGELIDGGPWVKIKNPNTGKEIVVKDVIADAFLQQILLRPAEYDVIACMNLNGDYISDALAAQVGGIGIAPGANIGDECALFEATHGTAPKYAGQDKVNPGSVILSAEMMLRHLQWFEAADLIVKGVEGAIKNKTVTYDFERLMEGAKLRKCSEFAQDIIDNM

SEQ ID NO: 28029 - DNA, 1254 bp, Yersinia pseudotuberculosis IP 32953
  CDS (1)..(1254): transl_table=11
atggaaagcaaagtagttgttccggcagaaggtaagaaaattactgtcgatgctcagggtaaactggttgttccgcataatccgatcattccatttattgaaggtgacggtattggtgttgatgtaaccccggcgatgatcaacgtggtagatgctgcggttaagaaagcttataacggtgaacgtaaaatttcctggatggaaatttacactggtgagaaatcaacccatgtctatggtaaagatgtttggttgccagaagaaaccttagatctgatccgtgattatcgcgttgctatcaaaggcccgttgaccactcctgtcggtggcggcatccgttctttgaacgttgctctgcgtcaacaacttgacctgtatgtgtgtctgcgtccggtgcgttattatgaaggcaccccaagcccggtaaaacaccctgaactgaccaacatggtgattttccgtgaaaacgctgaagatatctatgcgggtatcgaatggaaagcgggttcacccgaagcagagaaagtgatcaagttcctgcgtgaagagatgggtgtgaagaaaatccgtttccctgaacaatgtggtatcggtgtgaaaccgtgttcagaagaagggactaagcgtttggtacgtgcagcgattgaatatgcaattaccaacgatcgtgaatcagttacgctggttcataaaggcaacattatgaaattcaccgaaggcgcgtttaaagactggggttatcagttagcgcgtgaggaatttggtggtgaactgatcgacggtggcccatgggttaaaatcaaaaacccaaataacggcaaagaaattatcgttaaagatgtgattgccgatgctttcctgcaacagatcctgctgcgtcctgcggaatatgatgttatcgcttgtatgaacctgaacggtgattacatctctgatgcattggcagctcaggttggcggtattggtattgctccgggggctaacattggtgatgactgcgcactgttcgaagccactcacggtactgcaccaaaatatgctggtcaggataaagtgaacccaggttctattattctttcagcagaaatgatgctgcgtcacatgggctggttcgaagccgctgacttaatcattaaaggcactgaaggcgcaattcaagccaagaccgtgacttatgatttcgaacgtctgatggaaggcgctaagttgttgaagtgtagtgagtttggcgacgccattattaagcacatgtaa

SEQ ID NO: 28030 - protein, 417 aa, Yersinia pseudotuberculosis IP 32953
MESKVVVPAEGKKITVDAQGKLVVPHNPIIPFIEGDGIGVDVTPAMINVVDAAVKKAYNGERKISWMEIYTGEKSTHVYGKDVWLPEETLDLIRDYRVAIKGPLTTPVGGGIRSLNVALRQQLDLYVCLRPVRYYEGTPSPVKHPELTNMVIFRENAEDIYAGIEWKAGSPEAEKVIKFLREEMGVKKIRFPEQCGIGVKPCSEEGTKRLVRAAIEYAITNDRESVTLVHKGNIMKFTEGAFKDWGYQLAREEFGGELIDGGPWVKIKNPNNGKEIIVKDVIADAFLQQILLRPAEYDVIACMNLNGDYISDALAAQVGGIGIAPGANIGDDCALFEATHGTAPKYAGQDKVNPGSIILSAEMMLRHMGWFEAADLIIKGTEGAIQAKTVTYDFERLMEGAKLLKCSEFGDAIIKHM

SEQ ID NO: 28031 - DNA, 1266 bp, Symbiobacterium thermophilum IAM 14863
  CDS (1)..(1266): transl_table=11
gtggcgaagtttaccaagctgaccccgcccgaaggccagaagatcaccatggagaacggccggttggtggtaccggacaaccccatcatcccgtttatcgagggcgacggcacgggccccgacatctgggcggccgcgcagcccgtgatcgacgccgccgtggagaaggcctacggcggcaggcggaagatcgcctggttcgaggtctacgccggcgagaagtgcctgaacaagttcggcgagtggctgatcgacgacacggtggaggccatccgcgagtaccgggtcgcgatcaaggggcccctcaccacgccggtgggcggcggcatccggtcgctgaacgtcaccctgcggcaggtgctggacctgtacgcctgcgtccggcccgtgcgctggttccccggcgtgcccagcccggtgaaggagccgcacaagaccgacgtggtgatcttccgggagaacaccgaggacatctacgccggcatcgagtggaaggccggcaccccggaggcccgcaaggtccaggccctgctggccgaggagatgggcgtcaagttccccaacagcgacaagagcgacatgatcggcgtgggcatcaagccggtctcggagttcggctccaagcggctggtccgcgcggccatccagtacgccatcgacaacaagcgcaagtccgtcacgctggtccacaagggcaacatccagaagttcaccgagggcgccttccgcgactggggctaccaggtcgcgctggaggagttccgcccgtacgtcatcaccgaggaagagctctggtccgatgagtacaagggcaagatgcccgagggcaagatcctgatccgcgaccgcatcgccgacatcaccttccagcagctgctgctccggcccgaggagtgggacgtgatcgccaccctcaacctgaacggcgactacctctctgaccacgtcgcggctatcgtgggcggcatcggcatcgcccccggcgccaacatctcgtacagcggcggctacggcctgttcgaggccacccacggcaccgcgcccaagtacgccgggctcgacaaggtcaaccccggttcggtcatcctctcgggcgagatgatgctccgctacatgggctggcacgaggcggcggacctgatcatcaagggcctttccgccaccatcgcccagaagacggtcacctacgacttcgcccggctcaccgagggcgcgaccgaggtgaagtgctccgagttcggccggctcatcatcgcgaacatgtag

SEQ ID NO: 28032 - protein, 421 aa, Symbiobacterium thermophilum IAM 14863
MAKFTKLTPPEGQKITMENGRLVVPDNPIIPFIEGDGTGPDIWAAAQPVIDAAVEKAYGGRRKIAWFEVYAGEKCLNKFGEWLIDDTVEAIREYRVAIKGPLTTPVGGGIRSLNVTLRQVLDLYACVRPVRWFPGVPSPVKEPHKTDVVIFRENTEDIYAGIEWKAGTPEARKVQALLAEEMGVKFPNSDKSDMIGVGIKPVSEFGSKRLVRAAIQYAIDNKRKSVTLVHKGNIQKFTEGAFRDWGYQVALEEFRPYVITEEELWSDEYKGKMPEGKILIRDRIADITFQQLLLRPEEWDVIATLNLNGDYLSDHVAAIVGGIGIAPGANISYSGGYGLFEATHGTAPKYAGLDKVNPGSVILSGEMMLRYMGWHEAADLIIKGLSATIAQKTVTYDFARLTEGATEVKCSEFGRLIIANM

SEQ ID NO: 28033 - DNA, 1317 bp, Bacillus licheniformis ATCC 14580
  CDS (1)..(1317): transl_table=11
atgtttttctatattgaagaattacatattatgggaggttttattgtggcacaaggcgaaaaaattacagtctccggcggagtattaaacgttccaaacaacccggtcatcccgtttattgaaggggacggaacaggtcctgatatttggagagcggcttccagggttcttgaagcggctgtggagaaagcgtataacggcgaaaagaaaatcacttggaaagaagtctacgccggggaaaaagcgtacaacaaaaccggcgaatggcttccggaagaaacgcttgatacgatccgcgaatacctgatcgcgattaaaggtcctttaacaactcctgtaggcgggggaatccgctcattaaacgtagcgctcagacaagagcttgacttgtttacatgcctgcgtcctgtccgctatttcacaggcgttccttcaccggttaagcgccctgaagatacggacatggtcatcttccgtgagaatactgaagatatctacgccggcatcgagtacgcgaaaggctctgaagaagtgcaaaagctgatttcattcctgaaaaacgagcttggcgttaacaaaatccgcttccctgaaacatcgggcatcggcatcaagccggtttctgaagaaggaacatcaaggcttgtcagagctgcgatcgagtatgcgatcgagcacggccgcaaatctgtgacgctcgtccataaaggaaacatcatgaaattcacggaaggcgcctttaaaaactggggctatgaagtggctgaaaaagaattcggcgataaagtattcacttgggccgaatacgaccgcatcgctgaaaaagacggcaaagacgctgcaaacaaagcgcaaagcgaagctgaagctgccggcaaaatcatcatcaaagacagcatcgccgacatcttcctgcagcagattctgacacgtcctgccgagtttgacgttgtggcgacaatgaacctgaacggggactacatttcagatgcgctggctgcccaagtcggcggaatcggcatcgcacctggagcaaacatcaactatgagacaggacatgccatctttgaggcgacacatggtacagcgcctaaatacgccggcctcgacaaagtaaacccgtcttcagtcatcctatccggcgtgctgcttcttgagcatttgggctggaatgaggcggccgaccttgtcattaaatcaatggagaaaacaatcgcatccaaagtcgtcacatacgatttcgctcgtttgatggacggcgcgactgaagtcaaatgctctgaattcggtgatgagcttatcaaaaacatgtcttaa

SEQ ID NO: 28034 - protein, 438 aa, Bacillus licheniformis ATCC 14580
MFFYIEELHIMGGFIVAQGEKITVSGGVLNVPNNPVIPFIEGDGTGPDIWRAASRVLEAAVEKAYNGEKKITWKEVYAGEKAYNKTGEWLPEETLDTIREYLIAIKGPLTTPVGGGIRSLNVALRQELDLFTCLRPVRYFTGVPSPVKRPEDTDMVIFRENTEDIYAGIEYAKGSEEVQKLISFLKNELGVNKIRFPETSGIGIKPVSEEGTSRLVRAAIEYAIEHGRKSVTLVHKGNIMKFTEGAFKNWGYEVAEKEFGDKVFTWAEYDRIAEKDGKDAANKAQSEAEAAGKIIIKDSIADIFLQQILTRPAEFDVVATMNLNGDYISDALAAQVGGIGIAPGANINYETGHAIFEATHGTAPKYAGLDKVNPSSVILSGVLLLEHLGWNEAADLVIKSMEKTIASKVVTYDFARLMDGATEVKCSEFGDELIKNMS

SEQ ID NO: 28035 - DNA, 1248 bp, Mannheimia succiniciproducens MBEL55E
  CDS (1)..(1248): transl_table=11
atgcaatcaaaagttaaaattccacaaggtgataaaattcaactcgccgataacggcgcacttatcgtccctcataatcctattattccttttattgaaggcgacggtattggcgttgatgtgacgccggcgatgaaagcggtgattgatgcggcggtggaaaaagcatacggaggtacgcgtaaaatatcatggatggaaatctatgccggcggtaaagcaaatcaggtttatggcgaaaatacctggctgcctgcagaaacgctggagttgatccgtcaatatcatgtggcgattaaaggtccgttaatgacaccggtaggcggcggcattcgttctttaaacgtggcgatgcgccaaggtttggatttgtataactgcttacgtccgattcgttattatgaaggtacgccaagtccggttaaacacccggaatttgtcaatatggttattttccgtgaaaactccgaagatatttatgcgggcgttgaatgggtagccggctccccgggggcggataaactgattaacttcctgcaacgggaaatgggggtgactaaaatccgctttaccgaagattgcggaatcggcattaaaccggtttccaagcagggatcgcaacgtttggtgcgggctgctttacaatatgtaatagataatgaccgcagttcgcttaccttagtacataaaggcaatatcatgaaatttaccgaaggcgctttcaaagaatggggctatcaggttgcaaaagaattcggtgcggaacttattgatcaaggtccgtggatgaaattgaaaaatcctaatacgggcaccgaaattatcattaaagattgcattgccgacgcctttttacaagaagtgttattgcatcctaaagattacgatgtgattgccaccttaaaccttaacggcgattacatttccgacgcattagccgcgcaggttggcggtatcggtatttcaccgggcgccaatatcggtgacgatgcggcaatttttgaggctactcacggcacggcaccgaaaattgccggccaaaataaaggcaacccgggttcattaattcttagcggagaaatgatgctgcgccatttaggctggttggaagccgccgatttagtagtaaacgccgttgccaaaactattgcggacaaaaccgtaacatttgattttgccgaaatgctcgaaggagcgaccttgcgctcaacttccgagtttgccgaagacattattgccaatatgtag

SEQ ID NO: 28036 - protein, 415 aa, Mannheimia succiniciproducens MBEL55E
MQSKVKIPQGDKIQLADNGALIVPHNPIIPFIEGDGIGVDVTPAMKAVIDAAVEKAYGGTRKISWMEIYAGGKANQVYGENTWLPAETLELIRQYHVAIKGPLMTPVGGGIRSLNVAMRQGLDLYNCLRPIRYYEGTPSPVKHPEFVNMVIFRENSEDIYAGVEWVAGSPGADKLINFLQREMGVTKIRFTEDCGIGIKPVSKQGSQRLVRAALQYVIDNDRSSLTLVHKGNIMKFTEGAFKEWGYQVAKEFGAELIDQGPWMKLKNPNTGTEIIIKDCIADAFLQEVLLHPKDYDVIATLNLNGDYISDALAAQVGGIGISPGANIGDDAAIFEATHGTAPKIAGQNKGNPGSLILSGEMMLRHLGWLEAADLVVNAVAKTIADKTVTFDFAEMLEGATLRSTSEFAEDIIANM

SEQ ID NO: 28037 - DNA, 1191 bp, Bacteroides fragilis YCH46
  CDS (1)..(1191): transl_table=11
atgagtaaaattaccaaacagcaaaatggagtattgtcagtgccggatgtaccgacaataccttttataacgggtgatggagtaggagcggaaataactccggccatgcaggcgatagtagatgcggcggtagacatgtcgtatggtggtgtccggcgcatcgaatggaaagaagtactggccggtgaacgtgctttccgggctaccggttcgtggttgccggacgaaacgatggaggttttcaaggagtatctgataggcatcaaaggaccgttgactactccggtaggaggaggaatacgttcgttaaacgtggctttgcgccagacactcgatttatatgtctgcctgcgtccggtacgttggttccgcggagtggtgtctccggtcaaagagcccgaaaaggtgaatatgtacatctttcgtgagaatacggaagatatctatgccggtatcgaatgggaagcaggcactccggaagctaagaagttctaccggttcttgcacgaagagatgggagtcagtaaagtacgtttccccgaaacctcttcttttggtgtgaaaccggtttcgcgtgaggggacggagcgtctggtacgcgctgcctgccgttatgcgttgcagcatgaattgccctcggtcaccttggtgcacaaaggtaatatcatgaaattcacagaaggaggttttaagaagtgggggtacgaattggctgagcgggagtttgcagaggctcttgcctcaggtaaactggtgatcaaagactgtatagccgatgcctttttgcagaacactcttttgattcctgaagaatattcggtcattgccactctgaatctgaacggagactatatttccgaccaactggctgcgatggtaggtggcattggtattgcaccgggagccaatatcaattatgattccggacacgccatctttgaggccactcatgggacagcccccaatattgccggaaagaatgtggtgaatccctgttcactgatactttcggccgttatgatgcttgaatatataggctggcaagaacccgccgatcttatcgtcgaggcgcttgaagccagttttgccgaggggaaagccactaatgacctggcacgtttcatgcacaaaggccagccgctctctacttcggaatttacccgggaaatcattaaccgaattaaaaattaa

SEQ ID NO: 28038 - protein, 396 aa, Bacteroides fragilis YCH46
MSKITKQQNGVLSVPDVPTIPFITGDGVGAEITPAMQAIVDAAVDMSYGGVRRIEWKEVLAGERAFRATGSWLPDETMEVFKEYLIGIKGPLTTPVGGGIRSLNVALRQTLDLYVCLRPVRWFRGVVSPVKEPEKVNMYIFRENTEDIYAGIEWEAGTPEAKKFYRFLHEEMGVSKVRFPETSSFGVKPVSREGTERLVRAACRYALQHELPSVTLVHKGNIMKFTEGGFKKWGYELAEREFAEALASGKLVIKDCIADAFLQNTLLIPEEYSVIATLNLNGDYISDQLAAMVGGIGIAPGANINYDSGHAIFEATHGTAPNIAGKNVVNPCSLILSAVMMLEYIGWQEPADLIVEALEASFAEGKATNDLARFMHKGQPLSTSEFTREIINRIKN

SEQ ID NO: 28039 - DNA, 1023 bp, Methylococcus capsulatus str. Bath
  CDS (1)..(1023): transl_table=11
atgcacaagatcaccctcatccccggcgacggtatcggcccctccatcgtcgacgccgccgtcaaggtcatcgaggccaccggcgtccaggtccaatgggacacccaatccgccggcatggcggcggtcgagaaattcggtaccccgttgccggacgccacgctggattccatccgcgccaaccgcatctgcttcaagggaccgctcaccactcccgtcggcggaggttaccgcagcgtcaacgtcaccctgcgccaagccttcaacctctatgccaacgtccgtccggccatctccttcgagggcaccgacaccgccttcagcgacgtcaacctcgtcaccgtccgcgagaacaccgaaggcttgtacgccggcatcgagcatttcatcaaggtcgacgaggaaaagatcgcggcggaaagcatcgcggtcgtcacccgcaagggctctgagcgcatcatccgctatgccttcgactatgcccgccgcgcccggcgcaagaaggtcaccctggtgcacaaggccaacatcctcaagtgcacctccggcctgttcctggaaatcggtcgcgaaatcgccaaggaatatccggacatcgaattcgacgaccgtatcgtcgatgcctgctcaatgcagatggtcatgcagcctcagcgcttcgacgtgctggtcaccaccaatctgttcggcgatatcctgtcggacctggcggccggcctgatcggcggcctcgggctcacggcgggcgccaacatcggcaccgacgcggcgctgttcgaagccgtgcacggcagcgcgccggacatcgccgacaaaggcatcgccaatcccaccgccatgatcatggccggcgccatgatgctcgaacacatcggcgaaccggacgccgcgcgcaggatcgaacgcgcggtgcgcgaggtgatcgaggacggccgctcggtcacgccggacctggccaaggactccccctgcggcaccgcacagatggccgaagccatcgtcgagcgggtgcgtcaggcgtag

SEQ ID NO: 28040 - protein, 340 aa, Methylococcus capsulatus str. Bath
MHKITLIPGDGIGPSIVDAAVKVIEATGVQVQWDTQSAGMAAVEKFGTPLPDATLDSIRANRICFKGPLTTPVGGGYRSVNVTLRQAFNLYANVRPAISFEGTDTAFSDVNLVTVRENTEGLYAGIEHFIKVDEEKIAAESIAVVTRKGSERIIRYAFDYARRARRKKVTLVHKANILKCTSGLFLEIGREIAKEYPDIEFDDRIVDACSMQMVMQPQRFDVLVTTNLFGDILSDLAAGLIGGLGLTAGANIGTDAALFEAVHGSAPDIADKGIANPTAMIMAGAMMLEHIGEPDAARRIERAVREVIEDGRSVTPDLAKDSPCGTAQMAEAIVERVRQA

SEQ ID NO: 28041 - DNA, 1257 bp, Legionella pneumophila str. Lens
  CDS (1)..(1257): transl_table=11
atgacatacgataaaatcaaagtgcctgcccaaggcgaagctattactgttgctgctgaccattcacttcatgttcctgataatccaattattccttttattgagggtgatggtatcggtgttgatgtaacacctccgatgatccgtgttgttgatgctgcagttcaaaaagcatatggcaacaagaggaaaatttcctggatggaggtttatgccggggaaaaggctactaaggtttatggtggcgatcaatggcttcccaaagagactctggatgccatgaaaaaatatgtggtttcaattaaaggtcctttaactacccctgttggtggcggtatacgttcattgaatgtcgctattcgccaagacatggatctctatgtttgtttacgtccaattcgctattttaatggtgttccaagcccagttcgggaaccatggaaaaccgatatggttattttcagggaaaattctgaagatatttatgccggtattgaatggcaggcagataccccggaagctaaaaaagtgattcaatttttaactcaggaaatgggtgttaagaagattcgttttcctgagcattgtggtatcggtgtaaagcctgtttccagagaaggtaccactcgacttgtcaaagcggcaattcagtatgcaattgataatgaccgcagtacagtgactctggtacataaaggcaatatcatgaagtttactgaaggggcttttaaagattggggatatcaggttgcgcgcgattcttttggagcaaaagaatatcaaggtgggccatggatggaatttaaaaatcctaaaaccggtaagcagattatcattaatgatgtgatcgctgatgcctttttgcaacaaatcctgttaagacccgaagactatagtgtcattgctacattaaatttgaatggtgattatatttctgatgctttggctgctcaggttggcggaataggtatagctcccggagcgaacattagtgatcaaatggctgtgtttgaagcaactcatggaacagcgcctaaatacgctggccagaataaagtaaaccccggttctattattctttctgccgaaatgatgttacgtcatatggggtggtatgaagcggctgatttgattatcagaggtatggaaggcgcgatagaagccaaaaccgtaacttatgattttgaacgtggtatgcaaggagcaacgttagtcagcagctctggttttgcagatgccatgattaagcatatgtaa

SEQ ID NO: 28042 - protein, 418 aa, Legionella pneumophila str. Lens
MTYDKIKVPAQGEAITVAADHSLHVPDNPIIPFIEGDGIGVDVTPPMIRVVDAAVQKAYGNKRKISWMEVYAGEKATKVYGGDQWLPKETLDAMKKYVVSIKGPLTTPVGGGIRSLNVAIRQDMDLYVCLRPIRYFNGVPSPVREPWKTDMVIFRENSEDIYAGIEWQADTPEAKKVIQFLTQEMGVKKIRFPEHCGIGVKPVSREGTTRLVKAAIQYAIDNDRSTVTLVHKGNIMKFTEGAFKDWGYQVARDSFGAKEYQGGPWMEFKNPKTGKQIIINDVIADAFLQQILLRPEDYSVIATLNLNGDYISDALAAQVGGIGIAPGANISDQMAVFEATHGTAPKYAGQNKVNPGSIILSAEMMLRHMGWYEAADLIIRGMEGAIEAKTVTYDFERGMQGATLVSSSGFADAMIKHM

SEQ ID NO: 28043 - DNA, 1254 bp, Photobacterium profundum SS9
  CDS (1)..(1254): transl_table=11
atggatagtaaagtagttgtaccagtagacggtcagaaaatcacattggattctgaaggtaaactggtcgttcctaacaacccggtaatcccatacattgaaggtgatggtatcggtgttgatgtaagccctgcaatgatcaaagttgtcgatgcggcagtaaataaagcgtatgcaggtgatcgcaagattgagtggatggaaatctacactggtgagaaatcaactcaagtttacggcgaagatgcatggctaccgcaagaaactttagaattcattcgtgaatacaaagtcgcaatcaaaggtccactaacaactccagttggtggcggcattcgttctttaaacgttgctttacgtcaagaacttgatttatacatttgtgtacgtcctgttcgttattttgatggcgtacctagcccagttaaacgtccagatttaacagacatggtaatttaccgtgagaactctgaagatatctatgctggcgttgaataccaagctggcactgcagaagcagataaagtcattaaatttctacaagatgaaatgggcgcaactaaaatccgtttcacacagcaatgtggtatcggtattaagccgatttcagaggaaggcactaagcgtttaattcgcgcagcacttcagtacacaattgataacgaccgtgactcgctaacgcttgtacacaaaggcaatatcatgaagtttactgaaggtgcctttaaagattggggttacgaagttgctctacaagagtttggcgctgagttattggacggtggtccatggatgacgcttaaaaatccaaatactggcaaagagatcgttatcaaagactgtatcgctgatgcattcttacaacagatcctacttcgccctgctgagtacgatgtaattgcaaccatgaatcttaacggtgactacgtttctgatgcactagctgcacaggttggtggtatcggtatcgcacctggtgcaaacatcggtgatggtgttgcattgtttgaagcaactcacggtactgcacctaagtatgctggacaagataaagtaaaccctggttcactcattctttctgctgaaatgatgcttcgtcatatgggctggcttgaagctgctgatctgatcatcagctcaatggaagctgcaatcaataacaaaactgtgacttatgacttcgaacgccaaatggaaggtgctaccttacgtaagtgttcagagtttgcagatgacatgattgaacacatgtaa

SEQ ID NO: 28044 - protein, 417 aa, Photobacterium profundum SS9
MDSKVVVPVDGQKITLDSEGKLVVPNNPVIPYIEGDGIGVDVSPAMIKVVDAAVNKAYAGDRKIEWMEIYTGEKSTQVYGEDAWLPQETLEFIREYKVAIKGPLTTPVGGGIRSLNVALRQELDLYICVRPVRYFDGVPSPVKRPDLTDMVIYRENSEDIYAGVEYQAGTAEADKVIKFLQDEMGATKIRFTQQCGIGIKPISEEGTKRLIRAALQYTIDNDRDSLTLVHKGNIMKFTEGAFKDWGYEVALQEFGAELLDGGPWMTLKNPNTGKEIVIKDCIADAFLQQILLRPAEYDVIATMNLNGDYVSDALAAQVGGIGIAPGANIGDGVALFEATHGTAPKYAGQDKVNPGSLILSAEMMLRHMGWLEAADLIISSMEAAINNKTVTYDFERQMEGATLRKCSEFADDMIEHM

SEQ ID NO: 28045 - DNA, 984 bp, Haloarcula marismortui ATCC 43049
  CDS (1)..(984): transl_table=11
atgacacacgagatagccgttattccgggcgatggaatcggacaggaggtcacacccgccgcggtcgaagtgctggaggccatcgacggcgtcgacttcgacttcgtcgagggtgaagccggcgacgcagtgaaggaagaaaccggcgacgcgctcccggaggagacgcgcgaactggcggccgacgccgacgcgacgctgttcggcgcggctggcgagacagcggccgatgtcatcttgccgctccggcaggtcgtcggttccttcgcaaacgtccgcccggcccgctcgtatccgggactcgatgccgtccagcccgacaccgatatcgtattcattcgggagaacaccgagggtgtctacaagggcatcgagagcgagatttcggaaggcgtcactacctgtacgcgggtcatcaccgaagacgcctctgagaaaatcgccgaatacgggttcagctacgcgaagcagaacagctacgacgatgtgacgattgcccacaaagccaacgtcatgcgcactacagacgggctgttcctcgatgcggcctcggcagtcggcgaggaccgggacgcgtcctacgatacggcgctcatggacgcgcttgcgatgcatctggtcatgaacccacaggattacggcgtcgtcatctgtccgaacctcgccggcgatatgctatcggacctcgccgcgggcctcgtcggcggcctcggcctgctgccgtcggccaacatcggcgaggagaacgcgctgttcgagccggtccacggctccgccccggacatcgctggcgaaggcatcgccaacccttcagcgatgattctctccgcagcgatgttgctcgaccacctcggctacgacgagcagggcgatgcagttcggacggctgtcgagtccgtgctcgattcggggcctcgaacgccggatctgggcggcgacgcatccactgaggacgtgaccgccgcggttatcgacgaactgtaa

SEQ ID NO: 28046 - protein, 327 aa, Haloarcula marismortui ATCC 43049
MTHEIAVIPGDGIGQEVTPAAVEVLEAIDGVDFDFVEGEAGDAVKEETGDALPEETRELAADADATLFGAAGETAADVILPLRQVVGSFANVRPARSYPGLDAVQPDTDIVFIRENTEGVYKGIESEISEGVTTCTRVITEDASEKIAEYGFSYAKQNSYDDVTIAHKANVMRTTDGLFLDAASAVGEDRDASYDTALMDALAMHLVMNPQDYGVVICPNLAGDMLSDLAAGLVGGLGLLPSANIGEENALFEPVHGSAPDIAGEGIANPSAMILSAAMLLDHLGYDEQGDAVRTAVESVLDSGPRTPDLGGDASTEDVTAAVIDEL

SEQ ID NO: 28047 - DNA, 1263 bp, Haloarcula marismortui ATCC 43049
  CDS (1)..(1263): transl_table=11
atgggctacgattacgacaaagtggaggttcccgacgagggacagcagattcaggtcacggaggacgacgaactcgacgttccggaaaacccgattatccctatcatccacggggacggtatcgggaccgacgtgggtccggccgcacagaaagtgctcgaagccgccgcgaacgcaaccggtcgtgacatctcttggatgcgcatctacgccggccagtccgcccgagacaagtacgacgagaacctccctgatgacaccgtcgaagccatcaaagagttcaacgtcgctatcaagggcccgctaacgacaccggtcggcgctggcttccgctcgctgaacgtcgcacttcgcaagacgctcgacctctacgcgaacgttcgcccgacctatcacatcgagggcgtcccgtcaccggtcaaagaccccgaggagatggacatggtcaccttccgggagaacaccgaggacgtctacgccggcatcgagtgggaggccggcaccgacgaagtcgaggaggtcaaggagttcgtcgaggacgagatgaacttcgacgagaccatccacgacggcccggtcggcatcggcgtcaagccgatcaccgagttcgggaccaagcgcctcgtccgtgaggccatcgactacgccctcgaagaggaccgcgacagcgtcacgctggtccacaagggcaatatcatgaagttcactgagggagccttccgtgactggggctacgaggtcgccgaagaggagtacggcgagcacgtcatcaccgaggacgagctgtgggacgagtacgacggcgaggcgcccgaggactcactggtcgttaacgaccgcatcgccgacaacatgctccagcagctcctgacccgtaccgacgagtacgacgtcatcgcgacgatgaacctcaacggggactacatgtccgacgctgccggcgcacagatcggcggcctcggcatcgcccccggtgcgaacttcggttcggcccgctgtctcgcagagccggtccacggctccgcgccgaagtacgccggcgaggacaaggtcaacccgaccgcaatgatcctctccggccgcctcatgctcgaatacatgggctggaaggacgccggccagctcgttcgtgacgccgtcgaggagaccatctcctctggcaacgtcacctacgacctcgaacgccagatcgaaggcggtacgaagctcgccaccagcgagttcgccgagaaggtcgtcgaaaacatcgagaaacttgcataa

SEQ ID NO: 28048 - protein, 420 aa, Haloarcula marismortui ATCC 43049
MGYDYDKVEVPDEGQQIQVTEDDELDVPENPIIPIIHGDGIGTDVGPAAQKVLEAAANATGRDISWMRIYAGQSARDKYDENLPDDTVEAIKEFNVAIKGPLTTPVGAGFRSLNVALRKTLDLYANVRPTYHIEGVPSPVKDPEEMDMVTFRENTEDVYAGIEWEAGTDEVEEVKEFVEDEMNFDETIHDGPVGIGVKPITEFGTKRLVREAIDYALEEDRDSVTLVHKGNIMKFTEGAFRDWGYEVAEEEYGEHVITEDELWDEYDGEAPEDSLVVNDRIADNMLQQLLTRTDEYDVIATMNLNGDYMSDAAGAQIGGLGIAPGANFGSARCLAEPVHGSAPKYAGEDKVNPTAMILSGRLMLEYMGWKDAGQLVRDAVEETISSGNVTYDLERQIEGGTKLATSEFAEKVVENIEKLA

SEQ ID NO: 28049 - DNA, 1176 bp, Streptococcus thermophilus LMG 18311
  CDS (1)..(1176): transl_table=11
atggcagaaagaatccttatgactaatggcaatctcaaagttactgataatccgattattcctttcattgaaggagatggtgttggacgtgatatttggaagaatgctcaagcaatttttgataaagcggtagaagtggcctatggaggacagcgtcgtattgagtggcaagagtttttggcaggtaaaaaggcttttgataaaacaggtgagtggttgccgcaagaaactttagaggctattcgagaaagcctggtagctattaaggggccacttgaaacacctgtcggaggaggaattcgttctttaaatgtagctttacgtcaagaacttgatctctacgcttgtgttcgaccggttcggtatttcgaaggagtagcaagtccgcttaaggaaccagaaaaaacagacattactatttttcgtgagaatactgaggatatttatgcaggaattgaatgggaagcaggaacggtagatgtagagcgcgttattgctttttttcaaacagaaatgaatgtcgataaaattcgctttcccaagtcaagtagtattggaattaagcctatttcaatagaaggaagtaaacgattgattcgttcagctattgactatgctcttaagaacaatctaaagaaagtgacattggtgcataaagggaatattcaaaaattcacagaaggtggctttcgtaaatggggctatgaagtggctgaggaagaatataaggaagaaatgcttgctggccgtctagaagttaatgatataatcgctgataattttctacaacagattcttttgaatcccgaaaaatttgatgttgttgcattaaccaacttgaatggcgattatgcaagtgatgctctagctgcccaggttggtggtatcggaatctcccctggagctaatattaactatcaaacaggccatgctatctttgaagctactcatggaacggctccagatattgcggatcaagatagggctaatccttgctctattctcttatctggctgtatgcttttagaatatatcggttggtctgaagcagctgaactcattataagtgctattgaaaaaaactttaaatcagggatttttacagctgacctagcctttggaaaacgagcctattcaaccagtggtttcagcaatcaaattctctcaattatatga

SEQ ID NO: 28050 - protein, 391 aa, Streptococcus thermophilus LMG 18311
MAERILMTNGNLKVTDNPIIPFIEGDGVGRDIWKNAQAIFDKAVEVAYGGQRRIEWQEFLAGKKAFDKTGEWLPQETLEAIRESLVAIKGPLETPVGGGIRSLNVALRQELDLYACVRPVRYFEGVASPLKEPEKTDITIFRENTEDIYAGIEWEAGTVDVERVIAFFQTEMNVDKIRFPKSSSIGIKPISIEGSKRLIRSAIDYALKNNLKKVTLVHKGNIQKFTEGGFRKWGYEVAEEEYKEEMLAGRLEVNDIIADNFLQQILLNPEKFDVVALTNLNGDYASDALAAQVGGIGISPGANINYQTGHAIFEATHGTAPDIADQDRANPCSILLSGCMLLEYIGWSEAAELIISAIEKNFKSGIFTADLAFGKRAYSTSGFSNQILSII

SEQ ID NO: 28051 - DNA, 1272 bp, Geobacillus kaustophilus HTA426
  CDS (1)..(1272): transl_table=11
gtgacgcaaggagaaaaaattacagtccaaaatggtgtgctcaacgttccgaacaacccgatcattccgttcatcgagggggatggaaccggcccggacatttgggcggccgcttcgcgcgtgctcgaagcagcggtggaaaaagcgtacaaaggtgagaaaaaaatcgtctggaaggaagtgctcgctggtgaaaaagcgtacaagctgacgggcagctggcttccggatgaaacgcttgagacgatccgcgaatacataatcgccattaaagggccgttgacgacgccggtcggcggcggcatccgctcgctgaacgtagcgctccgccaagagctcgacctgtttgtctgcttgcgcccggttcgctacttcccaggcgttccgtcgccggtgaaacgcccggaagacaccgatatggtcattttccgggaaaacacggaagacatctacgctggcattgaatatgccaaaggcacgccggaagtgaaaaaagtcatcgactttttgcaaaacgaaatgggcgtgcgcaaaatccgcttcccggaaacgtccggcatcggcattaaaccgatttccgaacaagggacgaaacggcttgtgcgcgcggcgatcaactacgcgatcgaacacggccgcaagtcggtgacgctcgttcataaaggaaacattatgaaattcaccgaaggcgcgtttaaaaactggggttatgaattggcggaggaagaattcgccgacaaagtgttcacgtgggcgcaatacgaccgaatcgttgaaacggaaggcaaggaagcggcgaacaaagcgcttgctgatgcggaagcgtccggcaaaatcattatcaaagatgtcatcgccgacatcttcctgcaacaaattttgacgcgtccgcgcgaatttgacgtcatcgcgacgatgaacttaaacggcgactacatttccgacgcgctggccgctcaagtcggcggcatcggcatcgcgccgggggccaacatcaactacgaaaccggccacgcgattttcgaagcgacgcacggcacggcgccgaaatacgcagggcttgacaaagtcaacccgtcgtccgtcattctctcgggcgtcatgatgtttgagcatcttggttggaacgaagcagcgaaattgatcatcaaagcgatggagaaaaccatcgccgcgaaaatcgtcacgtatgacttcgcccgcctgatggaaggggcgacggaagtgaaatgctccgaatttgctgatgcgctcatccgcaatatggactaa

SEQ ID NO: 28052 - protein, 423 aa, Geobacillus kaustophilus HTA426
MTQGEKITVQNGVLNVPNNPIIPFIEGDGTGPDIWAAASRVLEAAVEKAYKGEKKIVWKEVLAGEKAYKLTGSWLPDETLETIREYIIAIKGPLTTPVGGGIRSLNVALRQELDLFVCLRPVRYFPGVPSPVKRPEDTDMVIFRENTEDIYAGIEYAKGTPEVKKVIDFLQNEMGVRKIRFPETSGIGIKPISEQGTKRLVRAAINYAIEHGRKSVTLVHKGNIMKFTEGAFKNWGYELAEEEFADKVFTWAQYDRIVETEGKEAANKALADAEASGKIIIKDVIADIFLQQILTRPREFDVIATMNLNGDYISDALAAQVGGIGIAPGANINYETGHAIFEATHGTAPKYAGLDKVNPSSVILSGVMMFEHLGWNEAAKLIIKAMEKTIAAKIVTYDFARLMEGATEVKCSEFADALIRNMD

SEQ ID NO: 28053 - DNA, 1467 bp, Anaplasma marginale str. St. Maries
  CDS (1)..(1467): transl_table=11
ttgtgttgggagtctatgtcagtacctataaccgtagcgtatggagatggagtagggccggaaattatggaggccgtgctgttcatcttgaaggaggccagagcagatgtttctatagaaaccgtggatataggccacaaccagtataaaaaggagtggacttctggcatcgctccctctgcgtgggagtcaatcagcaggactaggctgctgcttaaggcccctactatgaccccacagggtagtgggcataagagtttgaatgtcgccctcaggcagaggctggggctttatgtaaacgtgcggccctgcgtttcttattttcccgttgtaggcactaagcatccagatttggatgtggtaatcatcagagagaatgaggaagacacctacagcggtgttgagcacaaactatctgaagacacccatgagtgcgtgaagatttcaaccaggtccgcctcggaaaaaatctgtgcgtatgcgtttaactacgccagggctcacaatagaaagaaggttacgtgtttcgtgaaagataacatcatgaaaatgactgacggaatactgcacgcttctttcgacaaggtcgccaagggctatccagatattgaagcaaactactacatagttgatgtgggcatggctaagatcgccagcaacccggaggattttgatgttgtggtaaccacaaatctgtatggagacattgtatcagacatagtgtcgctctcttctgggtctatagggctgactggcagtgcgaacataggtgattattacgccatgttcgaggcagtacacggctcagcacccgatatagcaggcaagaatgtggccaatccctcagggctgctcaacgcggctgtgcaaatgttagtgcacatcgggcagctggacaaggccggggtgatccgtaacgcatttttgaagaccttagaagatggcgtgcatactgccgatatatatagcgagaaaaccagcttgcgtagggcatccaccatggagttcgcgcaggcaatagtgggaaacttaggaacaacacctcagcggcttaagggcctctctctcggcaaggaaacaccaagtaccgggagttcgggctacgtgcgcagcaatcccaaaagggtgttggtgggcgttgatgtcacggtacattgggacaagggcactgacatcaaggagttagttgggtccctttcagggctcagttcggaactgaagttgcagctggtgtacgccaaaggactggagttgtggcctaaagctccatattcttacacgtacgtcgatcttgtgtcttgcaggttttacgcggaagggaaggaagaggatggcgttgacggccgggaggttggaaatctgctgctcaaaatggaagacgctggcatagacacggtgaagatggtgaagttgtacctgtacgatgggggccagggttttttactccgtagcagctttggatcctga

SEQ ID NO: 28054 - protein, 488 aa, Anaplasma marginale str. St. Maries
MCWESMSVPITVAYGDGVGPEIMEAVLFILKEARADVSIETVDIGHNQYKKEWTSGIAPSAWESISRTRLLLKAPTMTPQGSGHKSLNVALRQRLGLYVNVRPCVSYFPVVGTKHPDLDVVIIRENEEDTYSGVEHKLSEDTHECVKISTRSASEKICAYAFNYARAHNRKKVTCFVKDNIMKMTDGILHASFDKVAKGYPDIEANYYIVDVGMAKIASNPEDFDVVVTTNLYGDIVSDIVSLSSGSIGLTGSANIGDYYAMFEAVHGSAPDIAGKNVANPSGLLNAAVQMLVHIGQLDKAGVIRNAFLKTLEDGVHTADIYSEKTSLRRASTMEFAQAIVGNLGTTPQRLKGLSLGKETPSTGSSGYVRSNPKRVLVGVDVTVHWDKGTDIKELVGSLSGLSSELKLQLVYAKGLELWPKAPYSYTYVDLVSCRFYAEGKEEDGVDGREVGNLLLKMEDAGIDTVKMVKLYLYDGGQGFLLRSSFGS

SEQ ID NO: 28055 - DNA, 1005 bp, Idiomarina loihiensis L2TR
  CDS (1)..(1005): transl_table=11
atgagtagaactatcacagttattccaggtgacggcatcggcccggatattgtcgagtctgcaacagccattcttgataaagcaggttgtgactttgaatatgaatacgtcgacgctggtctgactgctttggaaaaaaccggagagttattacctcaaaatactcttgatgcgattgaacgtaacggtgttacattaaaaggtccactgactactccggttggcgaaggcttcacctctattaatgtcagcctgcgtaaacacttttcgctatatgctaacgtacgccctgttttgtcttttaccggcacccaagcgcgctacgaaaacattgatattattaccattcgtgaaaataccgaaggtatgtattccggcttaggccaaaaagtgtctgaagacggtaatgaagcagaagcagtcagcaaaattacccgtgaaggcgctgagcggattgtccgtttcgcctatgaaaccgcacgccgcgaaggccgtaagaaagtcaccgcagtgcataaagccaatattctgaagtccacttctggtctattcttaaaagtagcgcgtgaaattgcggaagagtatccggacattgaatcaacagaaatgattgttgatgcggcctgcatgcgcttagttatgaaccctgaagagtttgacgttattgttaccaccaacctgtttggcgatatcctgtcagacctgtgcgcaggtttggtcggcggcttaggtatggcacccggcgctaacattggtaaagactgcgccattttcgaagctgtacacggctcagccccggatattgccggtaaaaacctggcaaacccaacctcagttatcttagcgtcaattcagatgctggaatacttgggcatgcaagagcaagccgaaaaaatcaccaaagcactagaagacgtgatttccagtggtgaccgtaccactcgtgatttaggcggttcgcacggtaccactgattttactcaggcagttattgagcgtctttaa

SEQ ID NO: 28056 - protein, 334 aa, Idiomarina loihiensis L2TR
MSRTITVIPGDGIGPDIVESATAILDKAGCDFEYEYVDAGLTALEKTGELLPQNTLDAIERNGVTLKGPLTTPVGEGFTSINVSLRKHFSLYANVRPVLSFTGTQARYENIDIITIRENTEGMYSGLGQKVSEDGNEAEAVSKITREGAERIVRFAYETARREGRKKVTAVHKANILKSTSGLFLKVAREIAEEYPDIESTEMIVDAACMRLVMNPEEFDVIVTTNLFGDILSDLCAGLVGGLGMAPGANIGKDCAIFEAVHGSAPDIAGKNLANPTSVILASIQMLEYLGMQEQAEKITKALEDVISSGDRTTRDLGGSHGTTDFTQAVIERL

SEQ ID NO: 28057 - DNA, 1263 bp, Zymomonas mobilis subsp. mobilis ZM4
  CDS (1)..(1263): transl_table=11
atgagtgaaaaaataacgtttaccgaaggtaaattacaggttcccgattatcccgttattccctttattgaaggcgatggtgtcggacccgaaatctggcaatctgctcagacgattttcgataaagccatagaaaaggcttatggcgacaaacgccgcgttgaatggaaacaggttttagctggcggcaaggcttttgatcaaacaggctcatggatgcctgatgaaacgatgactgccttcaaagactatcttgtcggtattaaaggccctctgacaacgcctatcggcggcggtattcgttctttaaatgtagctttgcggcaggaactggatctctttgtttgtttgcgcccagttcgctggtttaaaggtgtcgaaacaccggtcaaacaccctgaaaaagtcaatatgactatttttcgggaaaataccgaagacatttatgcgggtattgaatggctggaaggcacggatgatgccaaaaagctttataaattcttgcatgaagaaatgggcgttaccaaggttcgtttccctgaaacatcttctttcggcatcaaacccgtttctattgacggctctgaacggcttgttcgtgcggctatcgaatatgctattgcccagaaagcaccatcgattaccttggtgcataaaggcaatatcatgaaattcacagaaggcggctttaaacaatggggctatgccttagctgaacgtgaatttggcgataaactctttacgatgaaccaatatgatcagctgaaaaaggcacaaggtgctgaagccgctgacaaggctttgcaagcggccaaggctgctggaaaaattattgttaaagatgtgattaccgatgccttcttgcagaatactcttctgaaacctgaagattattcggttattgcaaccatgaatttgaacggcgattatatctccgatcagttggccgccatggttggcggtattggtatcgcaccgggtgctaatatcaactatgccaccggacatgcgatctttgaagcgacccatggcacggcaccggatatcgctggggaagataaggctaacccgtcttcgctgttactgtcaggtgccatgatgtttgactatcttggatggttcgaagtcggcaagctgattagtcaggctatggaaaaactgttccagaagagacatgctacggttgatttggcgcgattcatgccagaaggcgttgcgctgcctaccagccaatttacagaagagatggtagcccatctataa

SEQ ID NO: 28058 - protein, 420 aa, Zymomonas mobilis subsp. mobilis ZM4
MSEKITFTEGKLQVPDYPVIPFIEGDGVGPEIWQSAQTIFDKAIEKAYGDKRRVEWKQVLAGGKAFDQTGSWMPDETMTAFKDYLVGIKGPLTTPIGGGIRSLNVALRQELDLFVCLRPVRWFKGVETPVKHPEKVNMTIFRENTEDIYAGIEWLEGTDDAKKLYKFLHEEMGVTKVRFPETSSFGIKPVSIDGSERLVRAAIEYAIAQKAPSITLVHKGNIMKFTEGGFKQWGYALAEREFGDKLFTMNQYDQLKKAQGAEAADKALQAAKAAGKIIVKDVITDAFLQNTLLKPEDYSVIATMNLNGDYISDQLAAMVGGIGIAPGANINYATGHAIFEATHGTAPDIAGEDKANPSSLLLSGAMMFDYLGWFEVGKLISQAMEKLFQKRHATVDLARFMPEGVALPTSQFTEEMVAHL

SEQ ID NO: 28059 - DNA, 1428 bp, Synechococcus elongatus PCC 6301
  CDS (1)..(1428): transl_table=11
atgtacgagaagattcaaccccctagcgaaggcagcaaaattcgctttgaagccggcaagccgatcgttcccgacaacccgatcattcccttcattcgtggtgacggcgctggcgttgatatctggcccgcaactgagcgcgttctcgatgccgctgtcgctaaagcctatggcggtcagcgcaaaatcacttggttcaaagtctacgcgggtgatgaagcctgcgacctctacggcacctaccaatatctgcctgaagatacgctgacagcgatccgcgagtacggcgtggcaatcaaaggcccgctgacgacgccgatcggtggtggcattcgatcgctgaacgtggcgctacggcaaatcttcgatctctatgcctgcgtccgcccctgtcgctactacaccggcacaccctcgccccaccgcacgcccgaacaactcgatgtggtggtctaccgcgaaaacaccgaggatatctacctcggcatcgaatggaagcaaggtgatcccaccggcgatcgcctgatcaagctgctgaacgaggacttcattcccaacagccccagcttgggtaaaaagcaaatccgtttggattccggcattggtattaagccgatcagtaaaacgggtagccagcgtctgattcgtcgtgcgatcgagcatgccctacgcctcgaaggccgcaagcgacatgtcacccttgtccacaagggcaacatcatgaagttcacggaaggtgctttccgggactggggctatgaactggccacgactgagttccgaaccgactgtgtgactgaacgggagagctggattcttgccaaccaagaaagcaagccggatctcagcttggaagacaatgcgcggctcatcgaacctggctacgacgcgatgacgcccgaaaagcaggcagcagtggtggctgaagtgaaagctgtgctcgacagcatcggcgccacccacggcaacggtcagtggaagtctaaggtgctggttgacgatcgcattgctgacagcatcttccagcagattcaaacccgcccgggtgaatactcggtgctggcgacgatgaacctcaatggcgactacatctctgatgcagcggcggcggtggtcggtggcctgggcatggcccccggtgccaacattggcgacgaagcggcgatctttgaagcgacccacggcgcagcgcccaagcacgctggcctcgatcgcattaaccccggctcggtcatcctctccggcgtgatgatgctggagtacctaggctggcaagaggctgctgacttgatcaccaagggcatcagccaagcgatcgctaaccgtgaggtcacctacgatctggctcggttgatggaaccggcggttgatcaaccactcaagtgctcggaatttgccgaagccatcgtcaagcatttcgacgattag

SEQ ID NO: 28060 - protein, 475 aa, Synechococcus elongatus PCC 6301
MYEKIQPPSEGSKIRFEAGKPIVPDNPIIPFIRGDGAGVDIWPATERVLDAAVAKAYGGQRKITWFKVYAGDEACDLYGTYQYLPEDTLTAIREYGVAIKGPLTTPIGGGIRSLNVALRQIFDLYACVRPCRYYTGTPSPHRTPEQLDVVVYRENTEDIYLGIEWKQGDPTGDRLIKLLNEDFIPNSPSLGKKQIRLDSGIGIKPISKTGSQRLIRRAIEHALRLEGRKRHVTLVHKGNIMKFTEGAFRDWGYELATTEFRTDCVTERESWILANQESKPDLSLEDNARLIEPGYDAMTPEKQAAVVAEVKAVLDSIGATHGNGQWKSKVLVDDRIADSIFQQIQTRPGEYSVLATMNLNGDYISDAAAAVVGGLGMAPGANIGDEAAIFEATHGAAPKHAGLDRINPGSVILSGVMMLEYLGWQEAADLITKGISQAIANREVTYDLARLMEPAVDQPLKCSEFAEAIVKHFDD

SEQ ID NO: 28061 - DNA, 1266 bp, Bacillus clausii KSM-K16
  CDS (1)..(1266): transl_table=11
atggcagcagaaaaaattcaaactcaaaacggtgttttaaacgttccaaacgagccaatcgttccattcattgaaggcgacggtacaggcccagacatttgggcagcagcttctcgtgttcttgatgctgcagttgagaaagcatacaacggcgagcgcaaaatccactggaaagaaattcttgccggtgaaaaagcgtacaacgaaacaggagaatggcttccagcagaaacgcttgacgctgtccgcgaatatttaattgcgattaaaggacctttaacgacgccaattggcggcggcatccgctcattaaacgtagcgctccgccaagagcttgatttgttcacgtgtctccgtccagtccgttattttacaggagtgccatctccagtgaaacgtcctgaagatacggacatggtcatcttccgggaaaatacagaagacatttatgcagggattgaatttaaagaaggctctgacgaagtgaaaaagctaattgcctttttgcaagatgagcttggtgcaacgaatatccgcttccctgaaacttctggtatcggcgtaaaacctgtatcgaaggaaggaacagagcgcctcgtccgttctgccattcaatatgcgcttgatgaaggccgcaagagcgtgacgcttgtccataaaggcaacatcatgaaatttacagaaggcgcgtttaaaaactggggttacgaattggctgagcgtgagtttggcgataaagtatttacatgggctgagtacgataaaattgtggaagaaagtggccgcgaagctgccgataaagcgcaaagcgaagcagaagctgctggcaaaatcattgtgaaagatgccattgccgacattttcttgcagcaaattttgactcgcccgaaagagtttgatgtggttgcgacgatgaacttaaacggcgattacatttccgatgctcttgctgctcaagtaggcggaatcggcattgctccaggagcaaacatcaactatgatacaggtcatgccatttttgaagcgacacatggcacggcgccaaaatatgcgggactcgacaaagtcaacccttcctcagtcctgttgtcaggagaactgcttttgcgtcaccttggctggacagaagcagcagatttaattatggcgtcaatggacaaaacgattgccagcaaagttgttacttatgattttgcccgcttgatggatggcgcaacagaagtgtcttgctcaggatttgcagatgaattgatcaaaaatctataa

SEQ ID NO: 28062 - protein, 421 aa, Bacillus clausii KSM-K16
MAAEKIQTQNGVLNVPNEPIVPFIEGDGTGPDIWAAASRVLDAAVEKAYNGERKIHWKEILAGEKAYNETGEWLPAETLDAVREYLIAIKGPLTTPIGGGIRSLNVALRQELDLFTCLRPVRYFTGVPSPVKRPEDTDMVIFRENTEDIYAGIEFKEGSDEVKKLIAFLQDELGATNIRFPETSGIGVKPVSKEGTERLVRSAIQYALDEGRKSVTLVHKGNIMKFTEGAFKNWGYELAEREFGDKVFTWAEYDKIVEESGREAADKAQSEAEAAGKIIVKDAIADIFLQQILTRPKEFDVVATMNLNGDYISDALAAQVGGIGIAPGANINYDTGHAIFEATHGTAPKYAGLDKVNPSSVLLSGELLLRHLGWTEAADLIMASMDKTIASKVVTYDFARLMDGATEVSCSGFADELIKNL

SEQ ID NO: 28063 - DNA, 1080 bp, Dehalococcoides ethenogenes 195
  CDS (1)..(1080): transl_table=11
atgtctcataacgtaacccttatacccggtgacgggattggccctgaaatatctgaggcaacccgccgggtactggaagctaccggtgtaaagtttaactgggagatagtaaatgccggtgcggatgtggtagccgaatatggcacgcctctaccggatatggtgcttgaatccattcgtaaaaacaaggttgccatcaaagggccggtgactaccccggtcggctcagggtttagaagtgtaaatgtgggtatgcgcaaggctcttaatctttatacctgcctgcgcccctgcaagacctatcccggtgttccctcccgctatgacaatgtggatattgttatcgtgcgggaaaacatggaagacctgtatgccggtattgagtttgaaaagggcagccccgaagccctaaggcttatagagtttatcaaagagaataaaaaggttgaaatacgggcggattcgggtatcagcataaagcctatcagcgtgttcggcaccgaacgcatattccgctgggcttttaaatatgcccgggacaacaaacgcaaaagggttacggctgtccacaaagctaatatcatgaaatattctgacgggcttttcctggctataggccgcaaagtggccgaggaatacccggagatagagtttgaagaccgtattgtagacaatatgactatgcagctggtcaaaaacccctcccagtttgatattctggtctgcccaaatctgtacggggacattctgtctgatttgtgtgccgggttggtgggcggcctgggggttgcaccgggtgctaatatcggtgatgagtatgccctgtttgagcctacccatggctctgcccccaagtacaaggggatgaataaggtaaaccccatggccatgatgctttccggggtgctgatgcttcgctacctgaaagaggaaaaggccgctgataagctggaaaatgctattgcagctgttattgccgaaggcaagagtgttacctatgatatgctttcacctgacaaacaggcggcggcggtaggcacttcgcaggtggcagacgccataatagccaaaatgaaataa

SEQ ID NO: 28064 - protein, 359 aa, Dehalococcoides ethenogenes 195
MSHNVTLIPGDGIGPEISEATRRVLEATGVKFNWEIVNAGADVVAEYGTPLPDMVLESIRKNKVAIKGPVTTPVGSGFRSVNVGMRKALNLYTCLRPCKTYPGVPSRYDNVDIVIVRENMEDLYAGIEFEKGSPEALRLIEFIKENKKVEIRADSGISIKPISVFGTERIFRWAFKYARDNKRKRVTAVHKANIMKYSDGLFLAIGRKVAEEYPEIEFEDRIVDNMTMQLVKNPSQFDILVCPNLYGDILSDLCAGLVGGLGVAPGANIGDEYALFEPTHGSAPKYKGMNKVNPMAMMLSGVLMLRYLKEEKAADKLENAIAAVIAEGKSVTYDMLSPDKQAAAVGTSQVADAIIAKMK

SEQ ID NO: 28065 - DNA, 1023 bp, Gluconobacter oxydans 621H
  CDS (1)..(1023): transl_table=11
atgaccaagaccattcccgccacgctcatcgccggtgacggaattggcccggaaatcatgcaatcggtcacgaccgtcatggatgccctcggcgcccccttcctctgggatcaccagagcgcaggcgtaggcgcattcgaccagcacggtacggccctgcccgaggccacgctcgacagcatccgccgcaccggcctcgtgctgaaagggccgctgaccacgcctgtgggcaagggcttccgctccatcaacgtcacgctgcgtcaggccttcgacctgtacgccaatgtccgcccgacccagacgatcgtccccggcggacgctacgagaacgtcgatctggtcgtgatccgcgagaacatcgaaggcctgtatgccgcgatggagtattacatggccgtggatggcgacccggaagccgtggcatacggcgccgggttcaatacccgcaccgaatgcaaccggatcgtccgcttcgccttcgaatacgccgtgaaaaacaaccgcaagaaggtgacgcttgtccacaaggcgaacatcctcaaaatcctgagcggcctgttcctgcatgaaggccgcaaggtcgccgcggaatatgaaggccgcgtggcactggaagagcgcatcgttgacgcctgcgcgatggaacttgtgatccgcccggagaactacgacgtcatcgtcacgaccaatctgttcggcgatatcctgtctgatctgacagccggtctcgtgggcggcctgggtatggcgccaggtgcgaatatcggcgagaaaatgggcatcttcgaggctgtgcacggctcagcacccgacatcgccggacagggaatcgccaatccgctggcgctgatgatggcgggtagcatgatgctggcccatgtcgggcggcaggacctgtcccagcgtctggacggtgcgatgaagcagatccttcaggtcgaaggccttcgcacgcgcgatctgggcggtaaggccaccacgcaggacgtcacgcaggcccttctgcgcgccatccagtaa

SEQ ID NO: 28066 - protein, 340 aa, Gluconobacter oxydans 621H
MTKTIPATLIAGDGIGPEIMQSVTTVMDALGAPFLWDHQSAGVGAFDQHGTALPEATLDSIRRTGLVLKGPLTTPVGKGFRSINVTLRQAFDLYANVRPTQTIVPGGRYENVDLVVIRENIEGLYAAMEYYMAVDGDPEAVAYGAGFNTRTECNRIVRFAFEYAVKNNRKKVTLVHKANILKILSGLFLHEGRKVAAEYEGRVALEERIVDACAMELVIRPENYDVIVTTNLFGDILSDLTAGLVGGLGMAPGANIGEKMGIFEAVHGSAPDIAGQGIANPLALMMAGSMMLAHVGRQDLSQRLDGAMKQILQVEGLRTRDLGGKATTQDVTQALLRAIQ

SEQ ID NO: 28067 - DNA, 1452 bp, Ehrlichia ruminantium str. Gardel
  CDS (1)..(1452): transl_table=11
atgtcaattccagtaacagttgcttatggagatggtattggtccagaaattatggaagctgtacttttaatcttaagtgaagctaaatcaggtttggttatagagactatagagctggggcacaatttatataaaaaagaatggtcttgtggtattgctccttcttcttgggattctatccatagaactaaggtattactaaaatctcctacaatgaccccacagggacaaggacataaaagcttaaatgttacattgagaaagaagttgggactatatgcaaatgttagaccatgtatttcttatcatcctgtaataaaaacaaaatatcctaatttgaatgtagtaataattagagaaaacgaggaagatacttatactggtatagaacatagattaactagtgatacatatcaatgtttaaaagtaataacaagatcaggttcagaaaggatatgtaattatgcttttcaatatgcgataactcataataggaaaaaagttacatgtttggtaaaagataatattatgaagatgacagatggcatatttcataagtctttttcaaaaattgcagagggttatcctagtattatatctgatcattatattgttgacattggtatggcaagagtagccactaatccagaaaattttgatgttatagtaactactaatttatatggtgatataatttctgatatagttgctgaactatctggatcaattggtcttgcaggaagtgccaatataggggacaattatgcaatgtttgaggctgtacatggatcagccccagatatagctggtaaaaatatagctaatccttctggtttattgagtgctgcaatacagatgctagtttatttgaagaagtttaatgaagcagaattaattcataatgcatttcttaaaactttagaagatggaattcacacagcagatatttaccaagataatattagtaaagaaaaagtttctactatggattttgctaaagctgtggttgagaattttgggcaatctccttgtaacatacaaaaacctgtattaagtattatgaatagtacaagtggtacaacaagtgtgccatatgtatatcagccatcttataccgataaaattttggttggtgtggatgttactattggttgtgatgttatagatctgaatcttaatcaattgattgttgatttacgaaatataaaacatgatcagttagaacttgtattagttcatagtaaaggattggaaatttggccagatgaatcttctactgtaaatctttcttatgttgatcaaatatgttgtagattttatatgaaatgtaaaagtgaaatcattcatgaccatgtgaatcaattgcttttggaattagataaaaagaaaataaatgtagtgaaaatggaaaagctctatctgtatgatgatcaacctggattttttacgtag

SEQ ID NO: 28068 - protein, 483 aa, Ehrlichia ruminantium str. Gardel
MSIPVTVAYGDGIGPEIMEAVLLILSEAKSGLVIETIELGHNLYKKEWSCGIAPSSWDSIHRTKVLLKSPTMTPQGQGHKSLNVTLRKKLGLYANVRPCISYHPVIKTKYPNLNVVIIRENEEDTYTGIEHRLTSDTYQCLKVITRSGSERICNYAFQYAITHNRKKVTCLVKDNIMKMTDGIFHKSFSKIAEGYPSIISDHYIVDIGMARVATNPENFDVIVTTNLYGDIISDIVAELSGSIGLAGSANIGDNYAMFEAVHGSAPDIAGKNIANPSGLLSAAIQMLVYLKKFNEAELIHNAFLKTLEDGIHTADIYQDNISKEKVSTMDFAKAVVENFGQSPCNIQKPVLSIMNSTSGTTSVPYVYQPSYTDKILVGVDVTIGCDVIDLNLNQLIVDLRNIKHDQLELVLVHSKGLEIWPDESSTVNLSYVDQICCRFYMKCKSEIIHDHVNQLLLELDKKKINVVKMEKLYLYDDQPGFFT

SEQ ID NO: 28069 - DNA, 1428 bp, Wolbachia endosymbiont strain TRS of Brugia malayi
  CDS (1)..(1428): transl_table=11
atgtcaacaccaatcacagttgcatatggtgacggtatcgggccagaaattatggaagcggtgctgtcgatgctgcgcgaagcagaggcaaagatttcaatagatgttattgaaataggagagcgtgtttataataaggaatggtcttacggaatttctccaagtggttgggagtctattgaaagaacaaaggtattgctcaagtctccgacaacaacttcacaaggtaaagggcacaaaagcttaaatgttgcactcagaaaaagtctagggttatatgcaaacatcaggccatgcacttcatatcatcctgttatagaaaataaattcgataggtttgatattgtagtgatacgcgaaaatgaagaggacgtttatacaggaatagagcataggcttactggtaattcctaccagtgcactaaaattattactagatctggctcagagaaaatatgcagatacgcttttaattatgcaaaaagacacaataggaagaaagtaacttgcctaactaaagataacataatgaaaatgactgatggcattttccatacagcatttgattctattgcaaaagaatatccagatataaaggcagaacattatatagttgacattggaatggcacgtgttgccacagaacctgaaaatttcgatgttatagtaactgagaacctatatggcgatatattgtcagacatagtagcacaaacctcaggttctgtagggcttgctggaagtagtaatataggtagtgaatatgcaatgtttgaagcagttcatggttctgctcctaatattgcaggaaaaaacatagctaatccttctggccttttaaatgccgcggtgcatatgttgatctatataggtcaggcagatgttgcaaaattagttcacgatgcatggctaaagactttggaggatgggatacacactgctgatttgtataaagagaagaagagtaaacagaaagttggtacgaaagagtttgcagaggctgttatagataatataggaaagaaacctggaatattgcctgagcttataattagcaatggtgtaagtagtaaaattagtaaaatacaaggtaactgtgaacaagactataaagttaggaaactggttggtagcgacataacgctcgcttgggacaaatccagcaattttaatcaaatagtgaaattatttgagtcaagtaatccaaaggttatagcaatatactcaaaagggctggcgatctggcctggagactcaaaatctttgagtgaccaagtaacttgcaggtttattgcaaataacgaaaagaaaactatcacaaacattgatgtaaacaacctgctaatcaaacttgaaagaaatagctttgatgtggtgagaatggataagttgtatttgtatgatgagaaagaagggttcttttcttaa

SEQ ID NO: 28070 - protein, 475 aa, Wolbachia endosymbiont strain TRS of Brugia malayi
MSTPITVAYGDGIGPEIMEAVLSMLREAEAKISIDVIEIGERVYNKEWSYGISPSGWESIERTKVLLKSPTTTSQGKGHKSLNVALRKSLGLYANIRPCTSYHPVIENKFDRFDIVVIRENEEDVYTGIEHRLTGNSYQCTKIITRSGSEKICRYAFNYAKRHNRKKVTCLTKDNIMKMTDGIFHTAFDSIAKEYPDIKAEHYIVDIGMARVATEPENFDVIVTENLYGDILSDIVAQTSGSVGLAGSSNIGSEYAMFEAVHGSAPNIAGKNIANPSGLLNAAVHMLIYIGQADVAKLVHDAWLKTLEDGIHTADLYKEKKSKQKVGTKEFAEAVIDNIGKKPGILPELIISNGVSSKISKIQGNCEQDYKVRKLVGSDITLAWDKSSNFNQIVKLFESSNPKVIAIYSKGLAIWPGDSKSLSDQVTCRFIANNEKKTITNIDVNNLLIKLERNSFDVVRMDKLYLYDEKEGFFS

SEQ ID NO: 28071 - DNA, 1209 bp, Xanthomonas oryzae pv. oryzae KACC10331
  CDS (1)..(1209): transl_table=11
gtgctgaaagatcgtgctaatcaggtaccttcttgcagttcatccacctggcgttcctggcactgctgctcaggagatcgtgaacaggttcttaggtgttcagtcccggcatcgggcataattgccggtgagacctcattgcgccgatctgccgggtttgacggctggcgctccccccttcaagttcggaaacccaacgttatgacgcagacaatcacggtcatccgcggcgacggtatcggcccggagatcatggatgccacgctgttcgtgctcgacgcgctgcaagctggcctgacctacgaatacgcagacgccggcctggtcgcgctggaaaagcacggcgatctgctgcccgagtcgaccctggcctcgatcagcaagaacaaggtggcgctgaaaagcccgttgaccacgccggtcggcgagggcttcagctcgatcaacgtcgccatgcgtcgcaagttcgacctgtacgcgaacgtgcgtccggccaagtcgttcccgaacaccaagtcgcgtttcgccgatggcgtggacctgatcacggtgcgcgaaaacaccgaaggtgcctacctgagcgaaggccagaccgtgtccgaggatggcgagaccgcgttctccggcatcctgatcactcgcaagggctccgagcgcatcgtgcgctacgccttcgacctggcgcgcgccaccggccgcaagaaggtcaccgcggtgcacaaggccaacatcatcaagtcgacctcgggcctgttcctgaaggtcgcccgcgatgtggccgcgcagtacccggaaatcgaattccaggaaatgatcgtcgacaacacctgcatgcagctggtgatgcgtccggagcagttcgacatcatcgtcaccaccaacctgttcggcgacatcctctccgacctgtgcgccggtctggtcggcggcctgggcctggccccgggcgccaacatcggtctggacgcggcgatcttcgaagccgtgcacggctcggcgccggatatcgcagggcagggcaaggccaatccgtgcgcgctgctgctgggcgccgcgcagatgctggaccacatcggccagccgcagaacgccgagcgcctgcgcgaagccatcgtcgccacgctggaagccaaggattccttgaccccggacctgggcggcagcggcaacaccatgggcttcgccaaggccatcgccagccgcctctga

SEQ ID NO: 28072 - protein, 402 aa, Xanthomonas oryzae pv. oryzae KACC10331
MLKDRANQVPSCSSSTWRSWHCCSGDREQVLRCSVPASGIIAGETSLRRSAGFDGWRSPLQVRKPNVMTQTITVIRGDGIGPEIMDATLFVLDALQAGLTYEYADAGLVALEKHGDLLPESTLASISKNKVALKSPLTTPVGEGFSSINVAMRRKFDLYANVRPAKSFPNTKSRFADGVDLITVRENTEGAYLSEGQTVSEDGETAFSGILITRKGSERIVRYAFDLARATGRKKVTAVHKANIIKSTSGLFLKVARDVAAQYPEIEFQEMIVDNTCMQLVMRPEQFDIIVTTNLFGDILSDLCAGLVGGLGLAPGANIGLDAAIFEAVHGSAPDIAGQGKANPCALLLGAAQMLDHIGQPQNAERLREAIVATLEAKDSLTPDLGGSGNTMGFAKAIASRL

SEQ ID NO: 28073 - DNA, 1191 bp, Bacteroides fragilis NCTC 9343
  CDS (1)..(1191): transl_table=11
atgagtaaaattaccaaacagcaaaatggagtattgtcagtgccggatgtaccgacaataccttttataacgggtgatggagtaggagcggaaataactccggccatgcaggcgatagtagatgcggcggtagacatgtcgtatggtggtgtccggcgcatcgaatggaaagaagtactggccggtgaacgtgctttccgggctaccggttcgtggttgccggacgaaacgatggaggttttcaaggagtatctgataggcatcaaaggaccgttgactactccggtaggaggaggaatacgttcgttaaacgtggctttgcgccagacactcgatttatatgtctgcctgcgtccggtacgttggttccgcggagtggtgtctccggtcaaagagcccgaaaaggtgaaaatgtacatctttcgtgagaacacggaagatatctatgccggtatcgaatgggaagcaggcactccggaagctaagaagttctaccggttcttgcacgaagagatgggagtcagtaaagtacgtttccccgaaacctcttcttttggtgtgaaaccggtttcgcgtgaggggacggagcgtctggtacgcgctgcctgccgttatgcgttgcagcatgaattgccctcggtcaccttggtgcacaaaggtaatatcatgaaattcacagaaggaggttttaagaagtgggggtacgaattggctgagcgggagtttgcagatgctcttgcctcaggtaaactggtgatcaaagactgtatagccgatgcctttttgcagaacactcttttgattcctgaagaatattcggtcattgccactctgaatctgaacggagactatatttccgaccaactggctgcgatggtaggtggcattggtattgcaccgggagccaatatcaattatgattccggacacgccatctttgaggccactcatgggacagcccccaatattgccggaaagaatgtggtgaatccctgttcactgatactttcggccgttatgatgcttgaatatataggctggcaagaacccgccgatcttatcgtcgaggcgcttgaagccagttttgccgaggggaaagccactaatgacctggcacgtttcatgcacaaaggccagccgctctctacttcggaatttacccgggaaatcattaaccgaattaaaaattaa

SEQ ID NO: 28074 - protein, 396 aa, Bacteroides fragilis NCTC 9343
MSKITKQQNGVLSVPDVPTIPFITGDGVGAEITPAMQAIVDAAVDMSYGGVRRIEWKEVLAGERAFRATGSWLPDETMEVFKEYLIGIKGPLTTPVGGGIRSLNVALRQTLDLYVCLRPVRWFRGVVSPVKEPEKVKMYIFRENTEDIYAGIEWEAGTPEAKKFYRFLHEEMGVSKVRFPETSSFGVKPVSREGTERLVRAACRYALQHELPSVTLVHKGNIMKFTEGGFKKWGYELAEREFADALASGKLVIKDCIADAFLQNTLLIPEEYSVIATLNLNGDYISDQLAAMVGGIGIAPGANINYDSGHAIFEATHGTAPNIAGKNVVNPCSLILSAVMMLEYIGWQEPADLIVEALEASFAEGKATNDLARFMHKGQPLSTSEFTREIINRIKN

SEQ ID NO: 28075 - DNA, 1008 bp, Xanthomonas campestris pv. campestris str. 8004
  CDS (1)..(1008): transl_table=11
atgacgcagacaatcacggtcatccgcggcgacggtattggcccggagatcatggatgccacgctgttcgtgctcgacgcgctgcaggctggcctgacctacgagtacgccgatgccggcctggtcgcgctggaaaagcacggcgatctgctgcctgagtccaccctggcctcgatcaccaagaacaaggtggcgctgaagagcccgctgaccacgccggtcggtgagggtttcagctcgatcaacgtcgccatgcgtcgcaagttcgacctgtacgccaacgtgcgtccggccaagtcgttccccaacaccaagtcgcgtttcgccgatggcgtggacctgatcacggtgcgtgagaacaccgaaggcgcctacctgagcgaaggccaggaagtctcggccgacggcgaagtggccgtttccggcgcccgcgtcacccgcaagggctccgagcgcatcgtgcgctacgccttcgacctggcgcgcgccaccggccgcaagaaggtcaccgcggtgcacaaggccaacatcatcaagtcgacctcgggcctgttcctgaaagtcgcccgcgatgtcgccacgcagtacccggaaatcgaattccaggaaatgatcgtcgacaacacctgcatgcagctggtgatgcgtccggagcagttcgacatcatcgtgaccaccaacctgttcggcgacatcatctccgacctgtgtgccggtctggtcggcggcctgggcctggctccgggcgccaacatcggtgtggacgcggcgatcttcgaggccgtgcacggctcggcgccggatatcgcagggcagggcaaggccaacccgtgcgcgctgctgctgggcgcggcacagatgctggaccacatcggccagccgcagaacgccgaacgcctgcgcgaagcgatcgtcgccacgctggaagccaaggactcgctgacccccgacctgggtggcaccggcaacaccatgggctttgccaaggccatcgccagccgcctctga

SEQ ID NO: 28076 - protein, 335 aa, Xanthomonas campestris pv. campestris str. 8004
MTQTITVIRGDGIGPEIMDATLFVLDALQAGLTYEYADAGLVALEKHGDLLPESTLASITKNKVALKSPLTTPVGEGFSSINVAMRRKFDLYANVRPAKSFPNTKSRFADGVDLITVRENTEGAYLSEGQEVSADGEVAVSGARVTRKGSERIVRYAFDLARATGRKKVTAVHKANIIKSTSGLFLKVARDVATQYPEIEFQEMIVDNTCMQLVMRPEQFDIIVTTNLFGDIISDLCAGLVGGLGLAPGANIGVDAAIFEAVHGSAPDIAGQGKANPCALLLGAAQMLDHIGQPQNAERLREAIVATLEAKDSLTPDLGGTGNTMGFAKAIASRL

SEQ ID NO: 28077 - DNA, 1476 bp, Rickettsia felis URRWXCal2
  CDS (1)..(1476): transl_table=11
atgtacttaacaagagagtattatatggcagaatttacaccgattacaattgcatacggggacggtataggtcctgaaataatggaggcagtgctttatatattacgtaaagccgaggctcgtattcgcttagaaaccattgaagtaggtgaaaagctttacaagaagcattatacttcaggcataagtgaagaaagttgggaatcaatacaacgtaccggtattatacttaaagccccgattactactccgcaaggtggaggatataaaagtttaaacgtcacgattcgtaaaacattacagctttttgctaatattcgtccttctgtttcgtttcatccttttactatgacattacatccgcatctgaacctcactatcatacgtgagaatgaggaagatttatacgcaggtatagaataccgacaaacgcataatatgtatgaatcaataaagttgataagtcatacgggttgtgaaaaaattattagatatgcttttgaatatgcggtaaaaaataaccgcaaaaaagtcacgtgcttaagcaaagataatattatgaaattttccgatggggtttttcataaaatatttaatgagattgcaaaagaatatccgcaaattaataatgagcattatattatcgatatcgggactgcaaggcttgcaaccaaacctgaaatatttgacgttatcgtaacttctaatttatacggtgatatcatatccgatgtagctgccgagatttcagggtcggtaggactcgccggttctgcaaatatcggacaacattatgctatgtttgaagcggtacatggaagtgctcccgatattgccggcaaagatatcgcaaatccgtcagggcttctaaatgctgctataatgatgcttgtacatatagggcaaggtgatattgctagtttaatcgaaaatgcttggaaaaaaactatagaggatggagttcatacagccgatatatataatgagcagaattctagtaaaaaagttggtacaaaagaatttgctgaagaagtaacgaaaagattaggacagataccgacaaagctacctaaagcagattatccgttgattgccgagaaacaagaaagtaatatagattataaaattgatactaacgaagttaagaaattggtaggtacggatatatttgtgaatatgaatatatcttccgctcacgatatagctgataaaattaataagcttgatcttggtaatattgagctaaaaacaatctcgtccaaagggctaaaattatggcctcgtgatacaaggtttgaaactatttccgatcattggtgttgtcgttttatgaataaagacggcacggaaataaagcatttagatataacaaggttgcttgaagctttaagcaaagcaaatattgattttatcaaagtagagaatttatttgagtttgatggtgtggcagggtatagcttggctcaaggcgagtaa

SEQ ID NO: 28078 - protein, 491 aa, Rickettsia felis URRWXCal2
MYLTREYYMAEFTPITIAYGDGIGPEIMEAVLYILRKAEARIRLETIEVGEKLYKKHYTSGISEESWESIQRTGIILKAPITTPQGGGYKSLNVTIRKTLQLFANIRPSVSFHPFTMTLHPHLNLTIIRENEEDLYAGIEYRQTHNMYESIKLISHTGCEKIIRYAFEYAVKNNRKKVTCLSKDNIMKFSDGVFHKIFNEIAKEYPQINNEHYIIDIGTARLATKPEIFDVIVTSNLYGDIISDVAAEISGSVGLAGSANIGQHYAMFEAVHGSAPDIAGKDIANPSGLLNAAIMMLVHIGQGDIASLIENAWKKTIEDGVHTADIYNEQNSSKKVGTKEFAEEVTKRLGQIPTKLPKADYPLIAEKQESNIDYKIDTNEVKKLVGTDIFVNMNISSAHDIADKINKLDLGNIELKTISSKGLKLWPRDTRFETISDHWCCRFMNKDGTEIKHLDITRLLEALSKANIDFIKVENLFEFDGVAGYSLAQGE

SEQ ID NO: 28079 - DNA, 1269 bp, Staphylococcus haemolyticus JCSC1435
  CDS (1)..(1269): transl_table=11
atgtcagctgaaaaaattactagaattaacgatggattaaatgtacctaatgaaccaattattccttttattattggtgatggtattggaccagatatttggaaagcagcgagtcgcgttattgatgcagctgttgaaaaagcatataacggcgaaaaacgtattgaatggaaagaagtactagcaggtcaaaaagcttttgatgaaacaggtgaatggttacctcaagaaacgcttgacacgattaaagaatatttaatcgctattaagggaccattaactacaccaattggtggtggtattcgttcattaaatgttgcattacgtcaagaattagacctatttacatgtttacgtccagttcgttggttcaaaggtgtcccttcaccagttaaacgtccacaagatgttgatatggtcatcttccgtgaaaatactgaagatatttatgcaggtatcgaatttaaagaaggtactgatgaagttaaaaaaattattgatttcttacaaaatgaaatgggtgctactaacattcgcttcccagaaacttcaggtattggtgtgaaaccagtttctaaagaaggtactgaacgtttagttagagctgcaattcagtatgcaatcgataataaccgtaaaactgttacgcttgttcacaaaggtaatattatgaaattcaccgaaggcgcatttaagcaatggggctatgatgtagctcataatgaatttgctgataaggtatttacttggcaacaatatgatgaaattgttgaaaaagatggtaaagatgcagcaaatcaagctcaagaaaaagctgaacaagatggaaaaatcattattaaagattctatcgctgacattttcttacaacaaattttaactcgtccagcagaacatgatgtagttgctacaatgaatctaaatggtgactatatttcagatgctttagcagctcaagtgggcggaattggaattgcacctggtgcaaacattaactatgagtcaggacacgctattttcgaagcaacacatggtactgcacctaaatatgctggtttaaacaaagttaacccatcttctgaattattaagttcagttctaatgttagaacatttaggttggcaagaagccgctgataagattactgatgcaattgaagctactattgcttctaaagttgtaacttatgattttgctcgtttaatggatgatgctactgaagtatcaacttcagaattcgctgatgagttaattaaaaacttaaagtaa

SEQ ID NO: 28080 - protein, 422 aa, Staphylococcus haemolyticus JCSC1435
MSAEKITRINDGLNVPNEPIIPFIIGDGIGPDIWKAASRVIDAAVEKAYNGEKRIEWKEVLAGQKAFDETGEWLPQETLDTIKEYLIAIKGPLTTPIGGGIRSLNVALRQELDLFTCLRPVRWFKGVPSPVKRPQDVDMVIFRENTEDIYAGIEFKEGTDEVKKIIDFLQNEMGATNIRFPETSGIGVKPVSKEGTERLVRAAIQYAIDNNRKTVTLVHKGNIMKFTEGAFKQWGYDVAHNEFADKVFTWQQYDEIVEKDGKDAANQAQEKAEQDGKIIIKDSIADIFLQQILTRPAEHDVVATMNLNGDYISDALAAQVGGIGIAPGANINYESGHAIFEATHGTAPKYAGLNKVNPSSELLSSVLMLEHLGWQEAADKITDAIEATIASKVVTYDFARLMDDATEVSTSEFADELIKNLK

SEQ ID NO: 28081 - DNA, 1236 bp, Sulfolobus acidocaldarius DSM 639
  CDS (1)..(1236): transl_table=11
ttggtcatgttgtacaaagaacctcaagatggggagccaataaagtttgaaaagggaaaatgggtagtaccaaataaaccaataattctatatatagagggagacggaataggacctgaaattactaattcagctatcagagtagtgaataaggctgtagagaaagcttataaaagttctagagagatcaaatggttagaagtgtatgcaggagagaaagcaaacaagattacgggagatagattcccgaaagagacacaggacatgctattaaagtacagggttgtattaaagggacctttagaaactcccataggaaaaggatggaaatccataaatgttgcaataagattgatgcttgacctctacgcaaacataagaccagttaagtatattgaagggcttgaaagcccacttaaacatccagaaaaagtggatatgattatatttagggaaaatacagacgacctttacaggggcatagaatttccctatgatagcgaagaggcaaagaaaataagaaaattccttagagaggaattaaaggtcgatattgaagatgatacaggaataggactaaaggttatgagtaagtttaaaacccagagaattaccaggcttgcattaaactacgctcttcagaactcgagaaagaaagtcactgtaatgcataaaggaaatgtaatgaaatataccgaaggatccttcagggaatgggcatatgaagtagcactaaatgaatacagagataagattgtgactgaggaggaaattaaccggggggttaattcggaaggaaaggttatacttaatgataggatagcggataacatgcttcaacaaataatcattagacctgatgagtacgatataatacttgcccctaacgtaaatggtgattacatatcagatgctgctggagcattaatcggaaacataggaatgctaggaggtgccaacattggagatacaggaggaatgtttgaagctatacatggtacagcgccaaaatatgcaggcaagaatgtggcaaatcctacaggaataataaaatcatgtgaattaatgttatactttatgggatggagtgaagcagctagactaatagagaaagctattaatgaatccattaaacaaaagaaagtcacccaggatatagcgagatacctaggtatcacacctctaggaacaaaggaatatactgacacacttgtgcaaataatggactccttctga

SEQ ID NO: 28082 - protein, 411 aa, Sulfolobus acidocaldarius DSM 639
MVMLYKEPQDGEPIKFEKGKWVVPNKPIILYIEGDGIGPEITNSAIRVVNKAVEKAYKSSREIKWLEVYAGEKANKITGDRFPKETQDMLLKYRVVLKGPLETPIGKGWKSINVAIRLMLDLYANIRPVKYIEGLESPLKHPEKVDMIIFRENTDDLYRGIEFPYDSEEAKKIRKFLREELKVDIEDDTGIGLKVMSKFKTQRITRLALNYALQNSRKKVTVMHKGNVMKYTEGSFREWAYEVALNEYRDKIVTEEEINRGVNSEGKVILNDRIADNMLQQIIIRPDEYDIILAPNVNGDYISDAAGALIGNIGMLGGANIGDTGGMFEAIHGTAPKYAGKNVANPTGIIKSCELMLYFMGWSEAARLIEKAINESIKQKKVTQDIARYLGITPLGTKEYTDTLVQIMDSF

SEQ ID NO: 28083 - DNA, 1257 bp, Pseudomonas fluorescens Pf-5
  CDS (1)..(1257): transl_table=11
atgggatacaagaagattcaggttccagcagtcggcgacaaaatcaccgtcaacgcagaccattctctcaatgttcctaacaacccgattattcctttcatcgaaggcgacggtattggtgttgatatcagcccggtcatgatcaaggttgtcgatgctgcggttaagaaggcttacggcggcgaacgcaagatttcctggatggaagtgtatgccggggaaaaagcgactcaagtgtacgaccaggacacctggcttcctcaggaaaccctggacgcagtgaaggattacgtggtttccatcaagggcccgctgaccactccggtcggtggtggcatccgttccctgaacgtggccctgcgtcagcaactcgatctttatgtatgcctgcgccctgtgcgctggttcgaaggcgtgcccagcccggtgaaaaagccgggtgacgtggacatgaccatcttccgtgaaaactccgaagacatttacgccggcatcgagtggaaagccggctcggcagaagccaccaaggtcatcaagttcctcaaggaggaaatgggtgtcaccaagatccgtttcgacgaaaactgcggcatcggcgtcaagccggtttccctgcagggcaccaagcgtctggcgcgcaaggcgctgcaatatgtagtggataacgaccgcgactcgctgaccatcgtgcacaaaggcaacatcatgaagttcaccgaaggtgccttcaaggaatgggcctacgaagtggcggccgaagagttcggcgcgaccctgctggacggcggtccctggatgcagttcaagaacccgaaaaccggcaagaacgtcatcgtcaaggatgccatcgccgacgccatgctccagcagatcctgctgcgcccggccgaatacgatgtgatcgcgaccctcaacctcaacggtgactacctgtccgacgccctggcggcggaagtgggcggcatcggcattgcgccaggcgccaacctgtccgataccgtggccatgttcgaagccacccacggtaccgcgcccaagtatgccggcaaggaccaggtcaacccgggttcgctgatcctctccgcagagatgatgctgcgccacatgggctggaccgaagcggccgacctgatcatcaagggtaccaatggcgcaatctcggccaagaccgtgacctatgacttcgaacgcctgatggacggtgcaaccctgctgtcttcctcggccttcggcgatgcgctgatctcgcacatgtaa

SEQ ID NO: 28084 - protein, 418 aa, Pseudomonas fluorescens Pf-5
MGYKKIQVPAVGDKITVNADHSLNVPNNPIIPFIEGDGIGVDISPVMIKVVDAAVKKAYGGERKISWMEVYAGEKATQVYDQDTWLPQETLDAVKDYVVSIKGPLTTPVGGGIRSLNVALRQQLDLYVCLRPVRWFEGVPSPVKKPGDVDMTIFRENSEDIYAGIEWKAGSAEATKVIKFLKEEMGVTKIRFDENCGIGVKPVSLQGTKRLARKALQYVVDNDRDSLTIVHKGNIMKFTEGAFKEWAYEVAAEEFGATLLDGGPWMQFKNPKTGKNVIVKDAIADAMLQQILLRPAEYDVIATLNLNGDYLSDALAAEVGGIGIAPGANLSDTVAMFEATHGTAPKYAGKDQVNPGSLILSAEMMLRHMGWTEAADLIIKGTNGAISAKTVTYDFERLMDGATLLSSSAFGDALISHM

SEQ ID NO: 28085 - DNA, 1251 bp, Colwellia psychrerythraea 34H
  CDS (1)..(1251): transl_table=11
atgactaatcaaatcatcatccccactaccggagataaaattacctttgttgatggtaagttatcagtaccaaataatccgataatcccttttattgaaggtgatggcattggtgttgatgtaacacccccaatgctaaaagttgtgaatgcagcagttgctaaagcgtatgccggcgaaagagaaattgcgtggatggaagtctatgcgggtgaaaaagcgactaaaatgtatgatagtgaaacgtggcttcctgaagaaacacttgccatattacaagaatataaagtttctattaaaggacctctaactacacccgtaggtggtggcatgagttctttaaatgttgcaataagacaaatgcttgatctttacgtctgtcaacgtcctgttcaatggtttactggtgttccaagtccagtaaaaagaccttctgaagttgatatggtcatctttcgtgaaaataccgaagatatctatgctggcatagaatataaagcgggtagtgataaagcgaaagcggtgattgaattcttaactgaagaaatgggtgctagtaatatccgttttactgataactgtggtatcggtataaagccagtatcaaaagaaggaagtcaacgtttagtaagacaagcgattcaatacgcaattgataatgataaagactcggtaactctggttcataaaggtaatattatgaaattcacagagggcgcttttaaagattggggttatgagcttgctcgtgatgaatttggcgcaagtttgattgatggcggaccttggagtacgcttacaaacccaaatacaggtaatgagattatcatcaaggatgttattgctgatgccatgttacagcaaatcttgttacgtcctgctgaatatagtgttatcgccactttaaacttaaatggtgattacctatctgatgctcttgctgctcaagttggtggtattggtattgctcctggagctaatttaggcgacgaagttgctgtatttgaagcaactcatggaacagctcctaaatatgccggtaaaaataaagtaaatcctggttctgtaattctttctgcagaaatgatgttaagacatatgggctggcttgaagcggctgatttattgcttaaagggatgtcaggagcaatcaaagcgaaaacagtaacctatgattttgagcgccttatggatgatgcgacgttagtctcttgttcagcgtttggagattgtattattgatcatatgtaa

SEQ ID NO: 28086 - protein, 416 aa, Colwellia psychrerythraea 34H
MTNQIIIPTTGDKITFVDGKLSVPNNPIIPFIEGDGIGVDVTPPMLKVVNAAVAKAYAGEREIAWMEVYAGEKATKMYDSETWLPEETLAILQEYKVSIKGPLTTPVGGGMSSLNVAIRQMLDLYVCQRPVQWFTGVPSPVKRPSEVDMVIFRENTEDIYAGIEYKAGSDKAKAVIEFLTEEMGASNIRFTDNCGIGIKPVSKEGSQRLVRQAIQYAIDNDKDSVTLVHKGNIMKFTEGAFKDWGYELARDEFGASLIDGGPWSTLTNPNTGNEIIIKDVIADAMLQQILLRPAEYSVIATLNLNGDYLSDALAAQVGGIGIAPGANLGDEVAVFEATHGTAPKYAGKNKVNPGSVILSAEMMLRHMGWLEAADLLLKGMSGAIKAKTVTYDFERLMDDATLVSCSAFGDCIIDHM

SEQ ID NO: 28087 - DNA, 1008 bp, Colwellia psychrerythraea 34H
  CDS (1)..(1008): transl_table=11
atgactaaacaaaccatcacggtaattcctggcgacggtatcggtccgagcattatagatgctacgattaaaatattagataaagcaggctgtggttttgattatgaatttgcagatgcaggtttaaccgccttagaaaagcatggtgaattagtaccagaagaaacgatcaaccttatcgaaaaaaacaagatcactttaaaggggccattaacgactcctgtaggtgaaggttttacttcaatcaacgtaaccttacgtaagcagtttaaattatacgcaaaccttcgtcctgtattatcatttaagggcacaaaagcacgttatgaaaacattgatattctaacggttcgtgaaaatactcaaggcatgtattctggtgctggccaagttacttctgaggacggtactgaagctcaagcaatgagtattgttactcgtgaaggcgctgaaaaaatattaacatttgcttacgagactgcaattaaagaaggtcgtaaaaaaataacagctgttcataaagctaatatcctaaaatcgacttcaggtttatttttaaaagttgctcgtgaagttgcccagcgttacccacaaattgaatcaacagaaatgattgttgataactgttgtatgcaactggttatgaaccctgaacagtttgatgttatcgtaacaacgaatctatttggtgatattttatcagacttatgtgctggtttagttggcggccttggtatggcgccaggtgctaatattggtgaagattgtgcgatttttgaagcggtacacggtagtgcaccagatattgctggtaaaaacttagcaaacccaacgtctgtgatattagcagcaattcaaatgctggaatacttagacatgggtgataaagcagaaaagatcagagctgctattacagatgttattgcatcaggtgatagaactaccggtgatttaggtggtactcatggtactacggactttactgaagcagtacttgagagactataa

SEQ ID NO: 28088 - protein, 335 aa, Colwellia psychrerythraea 34H
MTKQTITVIPGDGIGPSIIDATIKILDKAGCGFDYEFADAGLTALEKHGELVPEETINLIEKNKITLKGPLTTPVGEGFTSINVTLRKQFKLYANLRPVLSFKGTKARYENIDILTVRENTQGMYSGAGQVTSEDGTEAQAMSIVTREGAEKILTFAYETAIKEGRKKITAVHKANILKSTSGLFLKVAREVAQRYPQIESTEMIVDNCCMQLVMNPEQFDVIVTTNLFGDILSDLCAGLVGGLGMAPGANIGEDCAIFEAVHGSAPDIAGKNLANPTSVILAAIQMLEYLDMGDKAEKIRAAITDVIASGDRTTGDLGGTHGTTDFTEAVLERL

SEQ ID NO: 28089 - DNA, 1242 bp, Dechloromonas aromatica RCB
  CDS (1)..(1242): transl_table=11
atgacttctcacatcaaggttccgcaaggtggttcgaaaatcgttccgggtcaggcgattccggataacccgatcatcccgttcatcgaaggcgatggcatcggcatcgacatcacgccggtcatgatcaaggtcatcgatgcggcagttgagaaggcctatggcggcaagaagaaaatccactggatggaagtctatgccggcgaaaagtctacccgcctgtacggttcggacgaatggctgcccaaggaaaccttcgatgccctgaaggaatactccgtctccatcaaggggccgatgacgacgccggttggtggcggcatccgttccctgaacgtggcgctgcgccaggaactggatctctaccagtgcgtccggccggtgcggtatttcaagggcgtgccatccccgctgaagcacccggaactgaccaatatggtcatcttccgcgagaataccgaagacatctacgctggtatcgaatgggcctgtggctctgaaggcgtcaagaaagtcgtcaagttcctgcaggaggaaatgggcgtcaagaaaatccggtttccggagacttccggtattggcatcaagccgatttccatcgaaggaacgtcgcgcctggtccgtgctgcgatcaaatacgccatcgacaatgatcgcaagtcggtgaccatcgtgcacaagggcaatatcatgaagttcacggaagggctgttccgtgatgcctgctacaagctggctcaggatgaattcggggccgaactgatcgacggtggcccgtggtgcaggatcaagaacccgaagaacggtcgtgagatcatcatcaaggattccattgccgatgccttcctgcaacagatcctgctgcgtccggccgagtacgacgtgatcgctactaccaacctgaacggcgactacatctccgatgcgctggcggcccaggtcggtggcatcggtatcgcgccaggggccaacatctccgaccggtacgcctgcttcgaggccacccacggcacggcgccgaagtacgccggcctggacaaggtcaatccgggttccttgatcctctcggccgaaatgatgctgcgccacctcggctggggcgacgccgccaatctggtgctcaaggccatggaagcggcgattggcgacaagcaggtgacctacgacttcgcccgccagatggaaggcgccaacgagttgtcctgctccgaattcggcgatgcgatgattgcccgcatgtaa

SEQ ID NO: 28090 - protein, 413 aa, Dechloromonas aromatica RCB
MTSHIKVPQGGSKIVPGQAIPDNPIIPFIEGDGIGIDITPVMIKVIDAAVEKAYGGKKKIHWMEVYAGEKSTRLYGSDEWLPKETFDALKEYSVSIKGPMTTPVGGGIRSLNVALRQELDLYQCVRPVRYFKGVPSPLKHPELTNMVIFRENTEDIYAGIEWACGSEGVKKVVKFLQEEMGVKKIRFPETSGIGIKPISIEGTSRLVRAAIKYAIDNDRKSVTIVHKGNIMKFTEGLFRDACYKLAQDEFGAELIDGGPWCRIKNPKNGREIIIKDSIADAFLQQILLRPAEYDVIATTNLNGDYISDALAAQVGGIGIAPGANISDRYACFEATHGTAPKYAGLDKVNPGSLILSAEMMLRHLGWGDAANLVLKAMEAAIGDKQVTYDFARQMEGANELSCSEFGDAMIARM

SEQ ID NO: 28091 - DNA, 1425 bp, Prochlorococcus marinus str. NATL2A
  CDS (1)..(1425): transl_table=11
atggcaaattttgaaaagcttactgccccatcagaaggccaaagaattactttttctgatggaaacccagtagtcccagaccatccaattattccatttatcagaggtgatggaacagggattgatatttggccagctacacaattagtcatcgataaagctattgaaaaagcttatggaaaaaatcgatccattgaatggttcaaaatctatgcaggtgatgaagcttgcgagttatacggaacttatcaatatttaccaaacgataccctcgaagcgatccgaacttacgggatagctatcaaaggacctttaacaactcctgtaggtggtgggattagatctttaaacgtatctctaagacagatttttgatctatattcatgtgttaggccttgcaaatattacgaagggactccaagccctcataaaaagcctcaggatttagatgtaattgtttatagagaaaatactgaagatatttatatgggtattgaatgggaatctgatgatcctgaatgcatcaaattgattgaccaaatcaataatgaaataattccagccagccaaaaactaaaaaacaggaaaattccaagcggatcaggaataggcattaaaccagttagtaaaattggtagtcaaagacatatcagacgtgcaattaaacatgcactcaccctggaagggagcaaaagacatgtgaccttggttcacaagggaaacatcatgaaattcactgaaggagctttcagagattggggatacgaattagcaaccacagaatttaggaatgaatgcgttaccgagagagaaagttggattttaggtaatgtagaaaaaaatcctcacatctcctatgaggagaatgctgagttaattgatccaggttattcgtctttaacagaagagaaaaagaaagctatttgtgatgaggtttgttccgttctttcaatcattggcagtagtcatggcagtggtaaatggaaagatatggtgatggttgatgaccgaatagcagatagtatttttcaacaaattcaaactcgtcctcaagagtattccatacttgcaactctcaatcttaatggtgactacatatcggatgcggccgctgcaattgttggtggactggggatggcaccaggtgcaaacattggagataaagcggctattttcgaagctacccatggaacagctcctaaacatgcaggtttggacagaataaatccaggttcagtaatactaagtggagtaatgatgctggaatatttgggttggaatgaggcagcaaaattaattacaaatggattgagcaaatctatttcagacaaacaagttacttacgatctagcacgattaatggaaccacgcgtagagcctcttagttgtagtgattttgcgaactcaattgttgaaagattttaa

SEQ ID NO: 28092 - protein, 474 aa, Prochlorococcus marinus str. NATL2A
MANFEKLTAPSEGQRITFSDGNPVVPDHPIIPFIRGDGTGIDIWPATQLVIDKAIEKAYGKNRSIEWFKIYAGDEACELYGTYQYLPNDTLEAIRTYGIAIKGPLTTPVGGGIRSLNVSLRQIFDLYSCVRPCKYYEGTPSPHKKPQDLDVIVYRENTEDIYMGIEWESDDPECIKLIDQINNEIIPASQKLKNRKIPSGSGIGIKPVSKIGSQRHIRRAIKHALTLEGSKRHVTLVHKGNIMKFTEGAFRDWGYELATTEFRNECVTERESWILGNVEKNPHISYEENAELIDPGYSSLTEEKKKAICDEVCSVLSIIGSSHGSGKWKDMVMVDDRIADSIFQQIQTRPQEYSILATLNLNGDYISDAAAAIVGGLGMAPGANIGDKAAIFEATHGTAPKHAGLDRINPGSVILSGVMMLEYLGWNEAAKLITNGLSKSISDKQVTYDLARLMEPRVEPLSCSDFANSIVERF

SEQ ID NO: 28093 - DNA, 1251 bp, Ralstonia eutropha JMP134
  CDS (1)..(1251): transl_table=11
atgtaccaacacatcaaggtcccggccggcgagaagatcacggtcaaccaggatttctcgctgaatgtcccggacactccgatcattccttacattgaaggcgatggtacgggcctcgacatcacgcctgtgatgatcaaggtggtggatgccgcggtggaaaaggcctacgccggcaagcgcaagatctcgtggatggaaatctacgccggcgagaagtccaccaaggtctatggcccggacgtgtggctgcctgacgaaaccctggacgtgctcaaggaatacgtcgtctcgatcaagggcccgctgaccacgccggtcggcggcggcatccgctcgctgaacgtggcgctgcgccagcagctcgacctgtacgtgtgcctgcgcccggtgcgctacttcaagggcgtgccttcgccggtgcgcgagccggaaaagaccgacatggtcattttccgcgagaactcggaagacatctacgccgggatcgaatgggaggccgaaagcccgcaggcccagaagctgattgccttcctgcagaacgaaatgggtgtgaagaagatccgcttcccggaaacgtcgggcattggcgtcaagcctgtgtcgaagcagggcacccagcgcctggtgcgcaaggctatccagtacgccatcgataacgacaagccgtcggtcacgctggtgcacaagggcaacatcatgaagttcacggaaggcggtttccgtgactggggctatgagctggcccagaaggaattcggcgccgagctggtcgatggaggcccgtggtgcaagttcaagaactcgaagacgggccgcgacatcgtcatcaaggacgccattgccgacgccttcctgcagcagatcctgctgcgcccggctgagtattcagtgatcgcgacgctgaacctgaacggcgactatatctcggacgcactggcagcacaggtcggtggtatcggcattgcccccggtgcgaacctgtccgactccgtggccatgttcgaagccacgcacggcacggcgccgaagtacgctggcaaggactacgtgaacccgggttcggaaatcctgtcggcagaaatgatgctgcgccacatgggctggaccgaagcggccgacctgatcatcgcctcgatggaaaagtcgatcctgtcgaagaaggtcacttatgacttcgcccgcctgctggaaggtgcgacccaggtgtcgtgctcgggttttggtcaggtgatgatcgaaaacatgtga

SEQ ID NO: 28094 - protein, 416 aa, Ralstonia eutropha JMP134
MYQHIKVPAGEKITVNQDFSLNVPDTPIIPYIEGDGTGLDITPVMIKVVDAAVEKAYAGKRKISWMEIYAGEKSTKVYGPDVWLPDETLDVLKEYVVSIKGPLTTPVGGGIRSLNVALRQQLDLYVCLRPVRYFKGVPSPVREPEKTDMVIFRENSEDIYAGIEWEAESPQAQKLIAFLQNEMGVKKIRFPETSGIGVKPVSKQGTQRLVRKAIQYAIDNDKPSVTLVHKGNIMKFTEGGFRDWGYELAQKEFGAELVDGGPWCKFKNSKTGRDIVIKDAIADAFLQQILLRPAEYSVIATLNLNGDYISDALAAQVGGIGIAPGANLSDSVAMFEATHGTAPKYAGKDYVNPGSEILSAEMMLRHMGWTEAADLIIASMEKSILSKKVTYDFARLLEGATQVSCSGFGQVMIENM

SEQ ID NO: 28095 - DNA, 1266 bp, Staphylococcus saprophyticus subsp. saprophyticus ATCC 15305
  CDS (1)..(1266): transl_table=11
atggcaggcgaaaaagtagcaaaaacaaatgaaggtttaacagtaccaaataatccaatcattccatttattattggtgatggtattggaccagatatttggaaagcagcaagcagagtaatcgatgctgcagtagagcaagcttataatggtgaaaagaaaattgaatggaaagaagtattggcaggccaaaaagcctatgatgaaacaggtgaatggttaccacaagcaacgcttgatacaattgaagaatatttaattgctatcaaagggcctttaactacaccaattggtggcggtattcgttcacttaacgttgcgttacgacaagaattagatttattcacatgcttacgtccagtacgttggttccaaggtgttccatcaccagttaaacgtccagaagatacagacatggttatcttccgtgaaaacactgaagacatttatgctggtattgaatttaaagaaggcacaccagaagttaaaaaactaatcgactttttacaagatgaaatgggcgctaaaaatattagattccctgaaacatcaggtattggtgttaaaccagtatcaaaagaaggtacagagcgtttagttcgtgcagcgattcaatacgcggtagacaataaccgtaaatcattaacattagtccacaaaggtaatatcatgaaatttactgagggcgcatttaaacaatggggttatgatgtagcgcataacgaatttggtgacaaagtatttacatggcaacaatatgatgaaatcgttgaaaaagaaggtaaagacaaagcgaatgcggctcaagaacaagctgaaaaagatggtaaaattatagtgaaggattcaattgctgatatcttcctacaacaaatcttaacacgtccgtcagatcacgatgttgttgctactatgaatttaaatggtgactatgtatcagatgcattagcagcacaagttggtggtatcggtatagctccaggagcaaatataaattatgaaactggacatgctatttttgaagcaacacatggtactgcgcctaaatatgctgacttaaataaagtgaatccatcatcagaaattttaagtgccgtattaatgttagaacatttaggatggcaagaagctgcagataaaattactgcatctatcgaaaaaacaatcgcgtctaaagtagttacttatgactttgctcgtttaatggatggtgcgaaggaagtttctacatctgactttgctgatgaattaattaaaaatctataa

SEQ ID NO: 28096 - protein, 421 aa, Staphylococcus saprophyticus subsp. saprophyticus ATCC 15305
MAGEKVAKTNEGLTVPNNPIIPFIIGDGIGPDIWKAASRVIDAAVEQAYNGEKKIEWKEVLAGQKAYDETGEWLPQATLDTIEEYLIAIKGPLTTPIGGGIRSLNVALRQELDLFTCLRPVRWFQGVPSPVKRPEDTDMVIFRENTEDIYAGIEFKEGTPEVKKLIDFLQDEMGAKNIRFPETSGIGVKPVSKEGTERLVRAAIQYAVDNNRKSLTLVHKGNIMKFTEGAFKQWGYDVAHNEFGDKVFTWQQYDEIVEKEGKDKANAAQEQAEKDGKIIVKDSIADIFLQQILTRPSDHDVVATMNLNGDYVSDALAAQVGGIGIAPGANINYETGHAIFEATHGTAPKYADLNKVNPSSEILSAVLMLEHLGWQEAADKITASIEKTIASKVVTYDFARLMDGAKEVSTSDFADELIKNL

SEQ ID NO: 28097 - DNA, 1449 bp, Ehrlichia canis str. Jake
  CDS (1)..(1449): transl_table=11
atgtcaatcccaatcacggttgcttatggagatggtattggcccagaaattatggaagctgtactattaatcttgagtgaagcagagtcaggtttagttatagaaactatagaagtaggacataatttatataaaaaggaatggtcttctggtattgctccttcatcttgggattctatttttaggacaaaagtactacttaagtctcctactatgactccacaaggacaaggtcataagagtcttaatgtaacattgaggaagaaattaggactgtatgcaaatattaggccatgtatttcttatcatcctgtaataaagacaaaatatcctaatcttaatatagtaataattagggaaaatgaagaagatacttatactggcatagaacataggttaacaagtgatacgtatcaatgttcaaaagtaattacaagatcagggtcagaaaggatatgtaattatgcatttcactatgctactgttcataatagaaaaaaggttacttgtttgataaaagataatattatgaaaatgacagatggaatttttcataaatctttttcaaaaattgcggaaaattatcctagtatcacatcagatcattatattgttgatattggtatggcaaaagtagctgctaacccagaaaattttgatgttatagttactactaatctttatggtgatattgtatctgatatagttgctgagttatcaggttctatcggtcttgctggtagtgctaatataggtgataattatgcaatgtttgaagccgtgcatgggtcagcaccagatatagctgggaaaaacatagctaatccttctggcttactaaatgcagctatacaaatgttaatttatttaaagaagtttgataaggcagagttgatatataatgcattacttaaaactttagaagatggtatgcatactgcagatatttaccaaagtcaggtcagtaagggaaaagtttctactatgggttttgccaaggcgattattgataattttgggcaatcccctactcaatttccaaagtctatatttcaaaatagcgcaggtgaatcaggtatatcttatacatataagccatcttatgctactaaagttcttgttggagtagatctgagtattagttgtgatagtgcagatttaaatttaaagcagttaattagtaatattcaaggtgttacgcatgataaattagaacttgtgctgattcatagtaaaggattggaaatttggcctgacgaatcttctaatgcaaacctttcttatatggaccaaatatgttgtaggttttatatgaagggtcaaagtgataagattgttaatgagcatgttaatcaattactttttgacatgagtaaaaagaaaatagatgttgtaaaaatggaaaaattgtatttgtacgacaatcaacctggatttttcactatgtaa

SEQ ID NO: 28098 - protein, 482 aa, Ehrlichia canis str. Jake
MSIPITVAYGDGIGPEIMEAVLLILSEAESGLVIETIEVGHNLYKKEWSSGIAPSSWDSIFRTKVLLKSPTMTPQGQGHKSLNVTLRKKLGLYANIRPCISYHPVIKTKYPNLNIVIIRENEEDTYTGIEHRLTSDTYQCSKVITRSGSERICNYAFHYATVHNRKKVTCLIKDNIMKMTDGIFHKSFSKIAENYPSITSDHYIVDIGMAKVAANPENFDVIVTTNLYGDIVSDIVAELSGSIGLAGSANIGDNYAMFEAVHGSAPDIAGKNIANPSGLLNAAIQMLIYLKKFDKAELIYNALLKTLEDGMHTADIYQSQVSKGKVSTMGFAKAIIDNFGQSPTQFPKSIFQNSAGESGISYTYKPSYATKVLVGVDLSISCDSADLNLKQLISNIQGVTHDKLELVLIHSKGLEIWPDESSNANLSYMDQICCRFYMKGQSDKIVNEHVNQLLFDMSKKKIDVVKMEKLYLYDNQPGFFTM

SEQ ID NO: 28099 - DNA, 1080 bp, Dehalococcoides sp. CBDB1
  CDS (1)..(1080): transl_table=11
atgtatcataatgtaacccttatacccggtgacgggattggtcctgaaatatctgaagctacccgtcgggtgctggaagctactggtgttaagtttaactgggaagtggtaaatgccggtgcggacgtggtggctgaatatggcacacccttgccggatatggtgcttgaatccatcaggaaaaataaggttgccataaaagggccggtaaccaccccggttggctcaggcttcagaagcgtaaatgtgggtatgcgtaaagcccttaatctgtatacctgccttcgcccctgtaagacctatcccggtgttccctcccgttatgacaatgtggatatagtcatagtgcgggaaaacatggaagacctgtatgccggtattgagtttgaaaagggcagtgccgaagccctaaggcttattgagtttattaaagaaaataaaaaggtggaaatacggactgattcgggtatcagcataaaaccaatcagtgtgtttggtaccgaacgcatattccgctgggcttttaaatatgccaaagataacaaccgcaaaaaggtaactgctgtccacaaggccaatattatgaaatattcagacgggctgtttctggctgtaggccgcaaagtggcggaggaataccctgaaatagagtttgaagaccggattgtagacaatatgactatgcagctggttaaaacccccacccagtttgatatactggtctgccccaacctgtacggagacatcttatctgatttgtgtgccggactggtgggtggtttgggggttgcaccgggtgccaatatcggtgatgaatacgccctgtttgagcctacccatggttctgcccccaagtacaaggggttgaacaaggtaaatcccatggctatgatgctttcaggtgtgcttatgctccgctatcttaaagaagaaaaggctgctgacaagctggaaaatgctattgcggcggttattgccgaaggcaagagtgttacttacgatatgctttctcctgacaaacaggcagtggcagtgggtacttcgcaggtggcagatgccataatagccaaaatgaaataa

SEQ ID NO: 28100 - protein, 359 aa, Dehalococcoides sp. CBDB1
MYHNVTLIPGDGIGPEISEATRRVLEATGVKFNWEVVNAGADVVAEYGTPLPDMVLESIRKNKVAIKGPVTTPVGSGFRSVNVGMRKALNLYTCLRPCKTYPGVPSRYDNVDIVIVRENMEDLYAGIEFEKGSAEALRLIEFIKENKKVEIRTDSGISIKPISVFGTERIFRWAFKYAKDNNRKKVTAVHKANIMKYSDGLFLAVGRKVAEEYPEIEFEDRIVDNMTMQLVKTPTQFDILVCPNLYGDILSDLCAGLVGGLGVAPGANIGDEYALFEPTHGSAPKYKGLNKVNPMAMMLSGVLMLRYLKEEKAADKLENAIAAVIAEGKSVTYDMLSPDKQAVAVGTSQVADAIIAKMK

SEQ ID NO: 28101 - DNA, 1242 bp, Thiobacillus denitrificans ATCC 25259
  CDS (1)..(1242): transl_table=11
atgacttatcagcacatccagatccccgctgccggccagaagatcacggtcaacgccgacaacaccctcaacgtgcccgacacgccgatcattcccttcatcgaaggcgacggcacgggcgtcgacatcacgcctgcgatgaagaaggtcgtcgacgcggcggtcgccaaggcctacggcggccggcgccagatcgcctggatggaggtctttgccggcgagaaagccgtcaaggtctacggcggcgaccagtggttgcccgaagaaaccgtttccgccgtcagggactacgtgatttcgatcaagggcccgctgacgacgccgacgtcgggcggcatccgttcgctcaacgtcgcgttgcgccagatcctcgatctctacgtctgcctgcgcccagtgcgctacttcgcgggcgtgcccagcccggtgaaggcgcccgagaaggtcgacatggttatcttccgcgagaacaccgaagacatttacgccggcgtcgaatgggaagccaactccgacgaggcgaagcgcgtcatcaagtacctgcagcggcagatgggcgtgaagaagatccgcttccccgccacctcggcgatcggcatcaagcccgtctcgatcgagggttcggaacggctgatcagaaaagcgatccagtacgcgatcgacaacaagcgccgctcggtgaccctcgtgcacaagggcaacatcatgaagttcaccgaaggcggtttcaagaagtggggctacgaactcgccgcgcgtgagttcggcgccaagctgatcggcgaaggcccgtggatggaattgccgaacggaatcgtgatcaaggacgtgattgccgacgccttcctgcaacagatcctgctgcgccccgacgagtacgacgtgatcgcgacgctgaacctcaacggcgactacatctccgacgcgctggcggcggaagtcggcggcatcggcatcgcgccgggcgcgaacctctcggacaccgtcgcgatgttcgaagccacgcacggcaccgcgccgaagtacgccggcaaggactacgtcaaccccggttcgctgatcctgtcggccgagatgatgctgcgccacctcggctggatcgaagccgccgacctcatcgtcgcgagcatggaaaaggcgatcgcggcgaaggccgtcacctacgacttcgcgcgactcatggaaggcgcgaccgaagtcaagtgctcgcagttcgccgaggcgatggtcgcgaagatgtga

SEQ ID NO: 28102 - protein, 413 aa, Thiobacillus denitrificans ATCC 25259
MTYQHIQIPAAGQKITVNADNTLNVPDTPIIPFIEGDGTGVDITPAMKKVVDAAVAKAYGGRRQIAWMEVFAGEKAVKVYGGDQWLPEETVSAVRDYVISIKGPLTTPTSGGIRSLNVALRQILDLYVCLRPVRYFAGVPSPVKAPEKVDMVIFRENTEDIYAGVEWEANSDEAKRVIKYLQRQMGVKKIRFPATSAIGIKPVSIEGSERLIRKAIQYAIDNKRRSVTLVHKGNIMKFTEGGFKKWGYELAAREFGAKLIGEGPWMELPNGIVIKDVIADAFLQQILLRPDEYDVIATLNLNGDYISDALAAEVGGIGIAPGANLSDTVAMFEATHGTAPKYAGKDYVNPGSLILSAEMMLRHLGWIEAADLIVASMEKAIAAKAVTYDFARLMEGATEVKCSQFAEAMVAKM

SEQ ID NO: 28103 - DNA, 1149 bp, Desulfovibrio desulfuricans G20
  CDS (1)..(1149)
atgcgcaagactgtgtatttcatcgaaggtgacggcatcggaccggaggtctggaacgccgcccgtcctgtcatcgacaaggccgtggaactggcatacggcaacgggcgttctctggaatggaaggaactgcttgccggcgaaaaagcctatgccgaaacaggcacctatctgcctcaggaaacgctcgacacgctggccggtgccgaactggccatcaaggggccgctgggcacccccgtgggcaaggggttccgcagtctcaacgtgaccatgcgccagactctcgacctgtatgcctgcatccggcccatacggtatttcgaaggcatcgaatcaccggtgaagcatccggagcgggtcaatatggttgtcttccgcgaaaacaccgaagacgtgtacgccggtatagaatacaaggctgacaccgacgaagccagaaagctgattgcctttctgcgcgacgaactgggcgccaatgtggacgagcgctgcgccgtgggcataaagcccatgagtgaaaaaggctccaagcgtctggtgcgccgcgccatggactttgctctggcgcaggggctgcccagcgtcacgctggtgcacaaaggcaatatcatgaaatttaccgaaggcggattccgccagtggggctacgaactggcgcatgacgaatacgccggacgcgcggtgaccgaagcacaggcagccgccggcgaaaccggtctggtggtcaaggaccgtatagccgacgccatgttccaggaagtgctcatccgtccggaacagtacagcgtggttgccaccagcaacctgaacggcgattatatttcggatgcgcttgctgcgcaggtgggcggtctgggactggctccgggcgtgaacatgtccgatacgctggccttctttgaagccacccacggcacggcacccaccattgccggaaaagatatggccaacccgggcagtcttattctgtgcgggggcatgctgctggaacatcttggctggcatgaggctgcaacccgtatccataccgccatgaacaccgtcataggcaaccgcacggtcaccgtggatctggccagccagatgcagggtgcctccactgtgggctgccggcagttcggcgaattgctgggcgcggcattgtag

SEQ ID NO: 28104 - protein, 382 aa, Desulfovibrio desulfuricans G20
MRKTVYFIEGDGIGPEVWNAARPVIDKAVELAYGNGRSLEWKELLAGEKAYAETGTYLPQETLDTLAGAELAIKGPLGTPVGKGFRSLNVTMRQTLDLYACIRPIRYFEGIESPVKHPERVNMVVFRENTEDVYAGIEYKADTDEARKLIAFLRDELGANVDERCAVGIKPMSEKGSKRLVRRAMDFALAQGLPSVTLVHKGNIMKFTEGGFRQWGYELAHDEYAGRAVTEAQAAAGETGLVVKDRIADAMFQEVLIRPEQYSVVATSNLNGDYISDALAAQVGGLGLAPGVNMSDTLAFFEATHGTAPTIAGKDMANPGSLILCGGMLLEHLGWHEAATRIHTAMNTVIGNRTVTVDLASQMQGASTVGCRQFGELLGAAL

SEQ ID NO: 28105 - DNA, 1257 bp, Burkholderia cepacia R18194
  CDS (1)..(1257)
atgccgtatcagcacatcaaggttccggaaggcggtgacaagatcaccgtcaacaaggacttctcgctcaacgtttccgatcagccgatcattccctatatcgaaggcgacggtacgggcttcgatatcacgccggtcatgatcaaggtcgtcgacgcggcggtcgcgcatgcctacaagggcaagcgcaagatccactggatggagattttcgcgggcgagaaggcgacgaaggtgtacggtccggacgtgtggctcccggacgaaacgctgcaggtgctgaaggaatacgtggtgtcgatcaaggggccgctcacgaccccggtcggcggcggcatccgttcgctgaacgtcgcgctgcgccaggaactcgacctgtacgtgtgcctgcgcccggtccagtacttcaagggcgtgccgtcgccggtgcgcgagccgcaaaagatcgacatggtgatcttccgcgagaactcggaagacatctacgcgggcatcgaatgggccgcgggctccgagcaggcgaagaaggtgatcaagttcctgcaggacgagatgggcgtgaagaagatccgcttcccggaaacctcggggatcggcgtcaagcccgtgtcgaccgaaggcaccgagcgtctcgtgcgcaaggcgatccagtacgcgatcgacaacgatcgcaagtcggtcacgctggtgcacaagggcaacatcatgaagttcacggaaggcctgttccgtgacgccggctacgcgcttgcacagaaggaattcggcggcgagctgatcgacggcggcccgtggatgcgcgtgaagaacccgaagacgggcaacgagatcgtgatcaaggattcgatcgccgatgcgttcctgcagcagatcctgctgcgcccggccgaatacgacgtgatcgccacgctgaacctgaacggcgactacatctccgacgcgctggccgcgcaggtcggcggcatcgggatcgcgccgggcgcgaacctgtcggattcggtcgcgatgttcgaagcgacgcacggcaccgcaccgaagtacgcaggcaaggattacgtgaaccccggttccgagatcctgtcggcggaaatgatgctgcgccacctcggctggacggaagcggccgacacgatcatcgccgcgatggagaagtcgatcctgcagaagcgcgtcacgtacgatttcgcgcgcttgatggaaggtgcgacgcaggtgtcgtgctcgggcttcggtgaagtgctgatcgagaacatgtaa

SEQ ID NO: 28106 - protein, 418 aa, Burkholderia cepacia R18194
MPYQHIKVPEGGDKITVNKDFSLNVSDQPIIPYIEGDGTGFDITPVMIKVVDAAVAHAYKGKRKIHWMEIFAGEKATKVYGPDVWLPDETLQVLKEYVVSIKGPLTTPVGGGIRSLNVALRQELDLYVCLRPVQYFKGVPSPVREPQKIDMVIFRENSEDIYAGIEWAAGSEQAKKVIKFLQDEMGVKKIRFPETSGIGVKPVSTEGTERLVRKAIQYAIDNDRKSVTLVHKGNIMKFTEGLFRDAGYALAQKEFGGELIDGGPWMRVKNPKTGNEIVIKDSIADAFLQQILLRPAEYDVIATLNLNGDYISDALAAQVGGIGIAPGANLSDSVAMFEATHGTAPKYAGKDYVNPGSEILSAEMMLRHLGWTEAADTIIAAMEKSILQKRVTYDFARLMEGATQVSCSGFGEVLIENM

SEQ ID NO: 28107 - DNA, 1269 bp, Pseudomonas fluorescens PfO-1
  CDS (1)..(1269)
atggagttcagcatgggttacaagaagattcaggttccagccgtcggcgacaaaatcaccgtcaacgcagaccattctctcaatgtccctgataacccgatcattcccttcatcgaaggtgacggcattggcgtcgacgtcagccctgtgatgatcaaagtggttgatgctgccgtagagaaagcctacgggggtaagcgcaagatttcctggatggaggtttatgctggcgaaaaagcaactcaggtctatgaccaggacacctggctgccccaggaaaccctggacgcggtcaaggattacgtggtctccatcaaaggcccgctgaccactccggtcggtggcggcatccgttccctcaacgtcgccctgcgccaacagctcgatctctatgtctgccttcgccctgtggtgtggttcgaaggtgtgccgagcccggtgaaaaagcctggcgacgtcgacatggtgatcttccgcgagaactccgaagacatttatgccggtatcgaatggaaagccggctcccctgaggccaccaaggtcatcaaattcctgaaagaagaaatgggcgtcaccaagatccgtttcgaccaggattgcggcatcggcatcaagccggtttccaaagaaggcaccaagcgtctggtgcgcaaggcgctgcaatacgtggtggacaacgaccgcaagtcgctgaccatcgtgcacaagggcaacatcatgaaattcaccgaaggtgccttcaaggactggggctacgaggtggcgaaggaagaattcggcgccgagctgctcgatggcggcccatggatgaaattcaagaacccgaaaaccggccgcgaagtcgtcgtcaaggacgccatcgccgacgccatgctccagcagatcctgctgcgtccggccgaatacgatgtgatcgccaccctcaacctcaacggtgactacctgtccgacgccctggcggcggaagtgggcggtatcggtatcgcgccgggtgccaacctgtccgacaccgtagccatgttcgaggcgacccacggtactgcgccgaaatatgccggcaaggaccaggtcaacccgggttcggtgattttgtcggcggaaatgatgctgcgccacctgggctggaccgaggcggccgacctgatcatcaagggcaccaatggcgccatcaaggccaagaccgtgacctacgacttcgaacgtctgatggaaggcgccacactggtgtcttcttcgggcttcggtgaagcgctgatcaagcacatgtaa

SEQ ID NO: 28108 - protein, 422 aa, Pseudomonas fluorescens PfO-1
MEFSMGYKKIQVPAVGDKITVNADHSLNVPDNPIIPFIEGDGIGVDVSPVMIKVVDAAVEKAYGGKRKISWMEVYAGEKATQVYDQDTWLPQETLDAVKDYVVSIKGPLTTPVGGGIRSLNVALRQQLDLYVCLRPVVWFEGVPSPVKKPGDVDMVIFRENSEDIYAGIEWKAGSPEATKVIKFLKEEMGVTKIRFDQDCGIGIKPVSKEGTKRLVRKALQYVVDNDRKSLTIVHKGNIMKFTEGAFKDWGYEVAKEEFGAELLDGGPWMKFKNPKTGREVVVKDAIADAMLQQILLRPAEYDVIATLNLNGDYLSDALAAEVGGIGIAPGANLSDTVAMFEATHGTAPKYAGKDQVNPGSVILSAEMMLRHLGWTEAADLIIKGTNGAIKAKTVTYDFERLMEGATLVSSSGFGEALIKHM

SEQ ID NO: 28109 - DNA, 1257 bp, Burkholderia fungorum LB400
  CDS (1)..(1257)
atgccgtatcagcacatcaaggttccgaccggtggtgacaagatcaccgtcaatcccgatttctcgctcaacgtgtcggaccagccgatcattccgtacatcgaaggcgacggcaccggcatcgacatcacgccggtcatgatcaaggtcgtggatgccgctgtggaaaaagcgtatgcaggcaagcgaaaaatccactggatggaaatctacgccggcgagaaatccaccaaggtgtacggcccggatgtgtggctgcccgaagagacgctgcaggtgctcaaggaatatgtcgtctcgatcaagggcccgctcaccacgccggtgggcggcggcatccgttcgctgaacgtcgcgttgcgccaggaactggatctgtatgtgtgcttgcggccggtgcagtatttcaagggcgtgccttcgccggtgcgcgagccggagaaaaccaacatggtgatcttccgcgagaactcggaagacatctacgcgggtatcgagtggccggccgaatcggagcaggcgaaaaaaatcatcaggttcctgcgcgaagaaatgggcgtgaagaagatccgtttcccggaaacgtcggggatcggcatcaagccggtgtcgcgtgaaggaacggagcgtctggtgcgcaaggcgatccagtacgcgatcgaccacgatcgccgttcggtcacgctggtgcacaagggcaacatcatgaagttcaccgaaggcgcgttccgcgactacggttacgcgctggcgcaaaaggaattcgccgcggaactgatcgacggcggcccgtggatgaagatcaagaatccgaaaacgggcggcgacgtcgtcctcaaggacgtgatcgccgacgcgttcctgcagcagatcctgctgcgtccggctgaatacgacgtgatcgccacgctgaacctgaatggcgactacgtatcggatgcgttggccgcgcaggtcggcggtattggtatcgcaccgggcgcgaatatgtcggattcagtcgcgatgttcgaagccacgcacggcaccgcgccgaaatacgccggcaaggactacgtgaatccgggctcggaaattctctcggcagaaatgatgctgcgccatctcggctggaccgaggcggcggatctgatcatcaagtcgatggaaaaatcgattctgcaaaaacgcgtcacatacgatttcgcgcgcttgatggaaggcgcgactcaggtgtcgtgttccggatttggtcaggtgctgatcgaaaatctgtaa

SEQ ID NO: 28110 - protein, 418 aa, Burkholderia fungorum LB400
MPYQHIKVPTGGDKITVNPDFSLNVSDQPIIPYIEGDGTGIDITPVMIKVVDAAVEKAYAGKRKIHWMEIYAGEKSTKVYGPDVWLPEETLQVLKEYVVSIKGPLTTPVGGGIRSLNVALRQELDLYVCLRPVQYFKGVPSPVREPEKTNMVIFRENSEDIYAGIEWPAESEQAKKIIRFLREEMGVKKIRFPETSGIGIKPVSREGTERLVRKAIQYAIDHDRRSVTLVHKGNIMKFTEGAFRDYGYALAQKEFAAELIDGGPWMKIKNPKTGGDVVLKDVIADAFLQQILLRPAEYDVIATLNLNGDYVSDALAAQVGGIGIAPGANMSDSVAMFEATHGTAPKYAGKDYVNPGSEILSAEMMLRHLGWTEAADLIIKSMEKSILQKRVTYDFARLMEGATQVSCSGFGQVLIENL

SEQ ID NO: 28111 - DNA, 1239 bp, Lactococcus lactis subsp. cremoris SK11
  CDS (1)..(1239)
atgaaaattgaaatgaagaatgggaaattaattgtaccagattatccaacaattggttacataagaggagatggtgttggtgaggacatttttccacaagcaaagcgtgtttttgatgctgctgttctaaaaatctttggcgaaaaaaagaaaatagattggcaaaaattattggcaggcggagaagctttcgcaagtaggggtgaatatcttcctgatgaaacacttgagcagattaaagaaaatatgatcgcaattaagggaccgttaatgactccagttggtgagagttttcgttctattaatgtcactttgagacaaaagctagatttgtatgcttgcgtaagacctgtagaatactttacagggataaaatctcctataagagcaccagagaaagtcaatatgacaatttttagggaaaatacagaggatatttatgcaggaattgaattttcttcttcgtcaaaagaatctaaaaagttaataaattttttggaaagagagctgtctgtccattcgattcgctttgcagaaacttctgcgattggaatcaaacccgttagccctgatggaagcaaacgtctggttagcgcagcctttgattatgctataaagatgaataagaagcgcgtgacatttgttcataagggaaatatcatgaaatttacagaaggaggatttagaaaatggggctatgaggtagctaaaaattatccaacttttacaaaactagaacacgataagataaaagaagaaaaaggcactgaacaggctgaaaaagagaaaaatattgcactaaaatcaggtaaaatttatgttgatgatgtgattgctgataattttcttcaacagattatccttaatcctgataattttgaggttgttgccactcttaatttaaatggggattatatttctgatgcccttgctgcccaagttggaggtattggaatcgcacctggagcaaatattaactatgaaagtggccatgctatttttgaagcaactcatggaacagctccggatatcgctggtttgaatcttgccaatccctctagccttttattatcaggagtcatgatgtttgaatatattggatggcaagatgtggcatatattattagaagagctttagtttctacttttaaactaaaaaaatacacttctgatttaggtgggaatctttcaacatcttcttttggagatcttcttatagcttatattgagaatgattaa

SEQ ID NO: 28112 - protein, 412 aa, Lactococcus lactis subsp. cremoris SK11
MKIEMKNGKLIVPDYPTIGYIRGDGVGEDIFPQAKRVFDAAVLKIFGEKKKIDWQKLLAGGEAFASRGEYLPDETLEQIKENMIAIKGPLMTPVGESFRSINVTLRQKLDLYACVRPVEYFTGIKSPIRAPEKVNMTIFRENTEDIYAGIEFSSSSKESKKLINFLERELSVHSIRFAETSAIGIKPVSPDGSKRLVSAAFDYAIKMNKKRVTFVHKGNIMKFTEGGFRKWGYEVAKNYPTFTKLEHDKIKEEKGTEQAEKEKNIALKSGKIYVDDVIADNFLQQIILNPDNFEVVATLNLNGDYISDALAAQVGGIGIAPGANINYESGHAIFEATHGTAPDIAGLNLANPSSLLLSGVMMFEYIGWQDVAYIIRRALVSTFKLKKYTSDLGGNLSTSSFGDLLIAYIEND

SEQ ID NO: 28113 - DNA, 1176 bp, Streptococcus thermophilus LMD-9
  CDS (1)..(1176)
atggcagaaagaatccttatgactaatggcaagctcaaagttactgataatccgattattccttttattgaaggagatggtgttggacgtgatatttggaagaatgctcaagcaatttttgataaagcggtagaagtagcctatggaggacagcgtcgtattgagtggcaagagtttttggcaggtaaaaaggcttttgataaaacaggtgagtggctgccgcaagaaactttagaggctattcgagaaagcctggtagctattaaggggccacttgaaacacctgtcggaggaggaattcgctctttaaatgtagctttacgtcaagaacttgatctctacgcttgtgttcgaccagttcggtatttcgaaggagtagcaagtccacttaaggaaccagaaaaaacagacattactattttccgtgagaatactgaggatatttatgcaggaattgaatgggaagcaggaacggtcgatgtagagcgcgttattactttttttcaaacagaaatgaatgtcgataaaattcgctttcccaagtcaagtagtattggaattaagcctatttcaatagaaggaagtaaacgattgattcgttcagctattgactatgctcttaagaacaatctaaagaaagtgacattggtgcataaagggaatattcaaaaatttacagaaggtggctttcgtaaatggggctatgaagtggctgaggaagaatataaggaagaaatgcttgctggccgtctagaagttaatgatataatcgctgataattttctacaacagattcttttgaatcccgaaaaatttgatgttgttgcattaaccaacttgaatggcgattatgcaagtgatgctctagctgcccaggttggtggtatcggaatctcccctggagctaatattaactatcaaacaggccatgctatctttgaagctactcatggaacggctccagatattgcggatcaagatagggctaatccttgctctattctcttatctggctgtatgcttttagaatatatcggttggtctgaagcagctgaactcattataagtgctattgaaaaaaactttaaatcagggatttttacagctgacctagcctttggaaaacgagcctattcaaccagtggtttcagcaatcaaattatctcaattatatga

SEQ ID NO: 28114 - protein, 391 aa, Streptococcus thermophilus LMD-9
MAERILMTNGKLKVTDNPIIPFIEGDGVGRDIWKNAQAIFDKAVEVAYGGQRRIEWQEFLAGKKAFDKTGEWLPQETLEAIRESLVAIKGPLETPVGGGIRSLNVALRQELDLYACVRPVRYFEGVASPLKEPEKTDITIFRENTEDIYAGIEWEAGTVDVERVITFFQTEMNVDKIRFPKSSSIGIKPISIEGSKRLIRSAIDYALKNNLKKVTLVHKGNIQKFTEGGFRKWGYEVAEEEYKEEMLAGRLEVNDIIADNFLQQILLNPEKFDVVALTNLNGDYASDALAAQVGGIGISPGANINYQTGHAIFEATHGTAPDIADQDRANPCSILLSGCMLLEYIGWSEAAELIISAIEKNFKSGIFTADLAFGKRAYSTSGFSNQIISII

SEQ ID NO: 28115 - DNA, 1257 bp, Burkholderia vietnamiensis G4
  CDS (1)..(1257): transl_table=11
atgccgtatcagcacatcaaggttccggaaggcggtgacaagatcaccgtcaacaaggacttctcgctcaacgtttccgatcagccgatcatcccttacatcgaaggcgacggtaccggcttcgacatcacgccggtgatgatcaaggtcgtcgatgcggcggtcgcgcatacgtacaagggcaagcgcaagatccactggatggagatcttcgccggcgagaaggcgacgaaggtgtacggcccggacgtatggctgcccgacgaaacgctgcaggtgctgaaggaatacgtcgtttcgatcaaggggccgctcacgacgccggtcggcggcggcatccgctcgctgaacgtcgcgctgcgccaggagctcgacctctacgtgtgcctgcgcccgatccagtatttcaagggcgtgccgtcgccggtgcgcgagccgcagaagatcgacatggtgatcttccgcgagaactcggaagacatctacgcgggcatcgagtgggcggccggctccgagcaggcgaagaaggtcatcaagttcctgcaggacgagatgggcgtgaagaagatccgcttcccggaaacctcggggatcggcatcaagcccgtgtcgaccgaaggcaccgagcgtctcgtgcgcaaggcgatccagtatgcgatcgacaacgatcgcaagtcggtcacgctggtgcacaagggcaacatcatgaagttcacggaaggcctgttccgtgacgccggttatgcgctcgcgcagaaggaattcggcggcgagctgatcgacggtggcccgtggatgcgcgtgaagaacccgaagacgggcgccgagatcgtcatcaaggattcgatcgccgacgcgttcctgcagcagatcctgctgcgtccggccgaatacgacgtgatcgccacgctgaacctgaacggcgactacgtctccgacgcactggccgcgcaggtcggcgggatcgggatcgcgccgggtgcgaacctgtcggactcggtcgcgatgttcgaggcgacccacggcacggcgccgaagtacgcgggcaaggactacgtgaaccccggttccgagatcctgtcggccgaaatgatgctgcgccacctcggctggacggaagcggccgacacgatcatcgccgcgatggagaagtcgatcctgcagaagcgcgtcacgtacgacttcgcgcgcctgatggaaggtgcgacgcaggtgtcgtgctcgggcttcggcgacgtgctgatcgagaacatgtaa

SEQ ID NO: 28116 - protein, 418 aa, Burkholderia vietnamiensis G4
MPYQHIKVPEGGDKITVNKDFSLNVSDQPIIPYIEGDGTGFDITPVMIKVVDAAVAHTYKGKRKIHWMEIFAGEKATKVYGPDVWLPDETLQVLKEYVVSIKGPLTTPVGGGIRSLNVALRQELDLYVCLRPIQYFKGVPSPVREPQKIDMVIFRENSEDIYAGIEWAAGSEQAKKVIKFLQDEMGVKKIRFPETSGIGIKPVSTEGTERLVRKAIQYAIDNDRKSVTLVHKGNIMKFTEGLFRDAGYALAQKEFGGELIDGGPWMRVKNPKTGAEIVIKDSIADAFLQQILLRPAEYDVIATLNLNGDYVSDALAAQVGGIGIAPGANLSDSVAMFEATHGTAPKYAGKDYVNPGSEILSAEMMLRHLGWTEAADTIIAAMEKSILQKRVTYDFARLMEGATQVSCSGFGDVLIENM

SEQ ID NO: 28117 - DNA, 1260 bp, Burkholderia pseudomallei 668
  CDS (1)..(1260)
atgccgtatcagcacatcaaggttccggaaggcggtgacaagatcaccgtcaacaaggatttctcgctcaacgtttccgatcagccgatcatcccttacatcgagggcgacggcacgggcttcgacatcacgccggtgatgatcaaggtcgtcgacgcggcggtcgagaaggcgtacggcggcaagaagaagattcactggatggagatctacgccggcgagaaggcgacgaaggtctacggcccggacgtgtggctgccggaagagacgctgcaggtgctgaaggaatacgtcgtgtcgatcaaggggccgctcacgaccccggtcggcggcggcatccgctcgctgaacgtcgcgctgcgccaggaactcgacctgtacgtctgcctgcgcccgatccagtacttcaagggcgtgccttcgcccgtgcgcgagccggagaagaccaacatggtcatcttccgcgagaactcggaagacatctacgccggcatcgaatgggcggccgaatccgagcaggcgaagaaggtcatcaagttcctgcaggaagagatgggcgtgaagaagatccgcttcccgcagacctcgggcatcggcatcaagcccgtgtcgaaggaaggcaccgagcgcctcgtgcgcaaggcgatccagtacgcgatcgacaacgaccgcaagtcggtcacgctcgtccacaagggcaacatcatgaagttcacggaaggtgcgttccgtgacgccggctatgcgctcgcgcagaaggaattcggcgccgagctgatcgacggcggcccgtggatgaagttcaagaacccgaagacgggcaacgagatcgtggtcaaggattcgatcgccgacgcgttcctgcagcagatcctgctgcgcccggccgaatacgacgtgatcgcgacgctgaacctgaacggcgactacatctcggacgcgctcgccgcgcaagtcggcggcatcggcatcgcgccgggcgcgaacctgtcggattcggtcgcgatgttcgaagcgacgcacggcacggcgccgaagtacgcgggcaaggattacgtgaacccgggttcggaaatcctgtcggccgaaatgatgctgcgccacctcggctggaccgaagcggccgatgtgatcatttccgcgatggagaagtcgatcaagcagaagcgcgtcacgtacgacttcgcgcgcctgatggaaggcgcgacgcaagtgtcgtgctcgggcttcggtcaggtgctgatcgaaaacatgcagtaa

SEQ ID NO: 28118 - protein, 419 aa, Burkholderia pseudomallei 668
MPYQHIKVPEGGDKITVNKDFSLNVSDQPIIPYIEGDGTGFDITPVMIKVVDAAVEKAYGGKKKIHWMEIYAGEKATKVYGPDVWLPEETLQVLKEYVVSIKGPLTTPVGGGIRSLNVALRQELDLYVCLRPIQYFKGVPSPVREPEKTNMVIFRENSEDIYAGIEWAAESEQAKKVIKFLQEEMGVKKIRFPQTSGIGIKPVSKEGTERLVRKAIQYAIDNDRKSVTLVHKGNIMKFTEGAFRDAGYALAQKEFGAELIDGGPWMKFKNPKTGNEIVVKDSIADAFLQQILLRPAEYDVIATLNLNGDYISDALAAQVGGIGIAPGANLSDSVAMFEATHGTAPKYAGKDYVNPGSEILSAEMMLRHLGWTEAADVIISAMEKSIKQKRVTYDFARLMEGATQVSCSGFGQVLIENMQ

SEQ ID NO: 28119 - DNA, 1491 bp, Crocosphaera watsonii WH 8501
  CDS (1)..(1491): transl_table=11
atgaggagtttaacctattttgggagtttaataaaagagcaacccttgattaatgatcattgtatgtacgaaaaactgacagcacccaccacaggttctaaaattacctttgaagacggtaaccccattgttcctaatgatcccattattcccttcattcgtggggacggaacaggaatcgatatttggcctgctacggagaaagtgatcgacgctgcggtaaaaactgcctacggagacagcaaaaaaattaactggtttaaggtgtatgcaggggatgaagcttgtgatcagtatggaacttatcaatatttgcccgaagataccttaaccgctatcaaagagtatggtatcgccatcaaaggacccctgacaaccccagtcggtgggggtattaggtctcttaacgtcgctttacgacaaatttttgaattatacgcttgtgtgcgtccctgtcgctattatcctgggactccttccccccataagtctcctgaaaaattaaatgtgatcgtctatcgggaaaataccgaggatatctacttaggaattgagtggacagaaggcacagaaattgctcaaaagttaatcaactatttgaacaatgaactgatacctgcaacggcagaacatgggaaaaaacagattcgtatagactcaggaattggggttaaacccattagtaaaactggttctcaacggttggttcgtcgggcaattgaacacgccttacgtttgccaaaagctaaacaaatggttactttagtgcataaaggtaacattatgaaatacactgaaggagcctttagagattggggatatgagttagcaacctcagaatttagagatgtttgtgttaccgaaagagaatcgtggattttgagtaacaaagaaggtaaggctgatatttctatcgaagataatgccagaaaagttgaacccggttatgatagtttgacccctgaaaagaaacaagaaatttgtgacgaggttaaaggagttattgacgctatttgggacagtcatggggatggtaaatggaaagaaaagatcatggtaaatgatcgcattgcggatagtattttccaacaaattcaaacccgtcccgatgaatattcgatcctggcaaccatgaacttaaatggggattatttatccgacgctgcggccgctgttgtggggggtttaggtatgggccctggggcaaatattggcgatacttgcgctatttttgaggcaactcatggcaccgcacctaaacacgcaggactggatagaattaatcctggatctgttattctttctggggtgatgatgttagaatatatgggctggcaagaagccgcagacctcattaaaaaaggtattgggaatgcgatcgcaaatcgtcaggtaacctatgatctcgctcgtttgatggaacctaaagttgatcctccactgaaatgttcagaatttgctcaggcaataattgattattttaatgattaa

SEQ ID NO: 28120 - protein, 496 aa, Crocosphaera watsonii WH 8501
MRSLTYFGSLIKEQPLINDHCMYEKLTAPTTGSKITFEDGNPIVPNDPIIPFIRGDGTGIDIWPATEKVIDAAVKTAYGDSKKINWFKVYAGDEACDQYGTYQYLPEDTLTAIKEYGIAIKGPLTTPVGGGIRSLNVALRQIFELYACVRPCRYYPGTPSPHKSPEKLNVIVYRENTEDIYLGIEWTEGTEIAQKLINYLNNELIPATAEHGKKQIRIDSGIGVKPISKTGSQRLVRRAIEHALRLPKAKQMVTLVHKGNIMKYTEGAFRDWGYELATSEFRDVCVTERESWILSNKEGKADISIEDNARKVEPGYDSLTPEKKQEICDEVKGVIDAIWDSHGDGKWKEKIMVNDRIADSIFQQIQTRPDEYSILATMNLNGDYLSDAAAAVVGGLGMGPGANIGDTCAIFEATHGTAPKHAGLDRINPGSVILSGVMMLEYMGWQEAADLIKKGIGNAIANRQVTYDLARLMEPKVDPPLKCSEFAQAIIDYFND

SEQ ID NO: 28121 - DNA, 1242 bp, Methylobacillus flagellatus KT
  CDS (1)..(1242): transl_table=11
atgtctacaaaaatcaaagtacccactactggcgagaaaatcagcgttaatgcggacaactcgctcaatgtgcccgatcacccgattatcccatttatcgaaggcgacggtatcggcgtcgatatcaccccacccatgcgccatgtcgtcgacagcgccgtcgccaaggcctatggcggcaaacgcgccattgcctggatggaggtatatgccggcgaaaaagccgtgaagacctatggtgacaacacctggctacccgatgaaacactcaaggccgtcaaagattatgtcatttccatcaagggaccgctgaccactcccgtaggcggtggcatccgctcgctcaacgtgaccttgcgccaggaactcgacctgtatgtctgcctgcgtccgatccagtattttcaaggcgtgcccagcccggtcaagcatcctgaaaaaaccaacatggtgattttccgcgagaataccgaggacatctatgccggtatcgaatgggctgccggtaccgacgaggtgaaaaaggtggtggacttcctcagtgacatgggtgtgcgcaagaagatacgcttcccagaagcttccgccatcggcatcaagccggtgtcaatcgacggcagcaagcgcctggtgcgcaaggcgatccagtacgccatcgacaacaaccgcaagtccgtaaccattgcccacaagggcaacatcatgaagttcaccgaaggcggatttaagacttggggttacgaagtcgccaaggaagagttcggtgcagtggaaattgacggcgggccgtggtgcaagctgcccaatggcatcatcatcaaggactgcatcgccgatgccttcctgcaggaaatcctgctgcaccctgcagactacgacgtagtggccaccctaaacctgaacggcgactatatctcagatgcgctcgcagcccaggtaggtggtatcggcattgcgcccggtgccaatatctcggataccgtggccatgttcgaggccacccacggtacggctcccaagatcgcgggcaaggatatcgccaatccaagttcgctgatcctgtcagccgagatgatgttgcgccacctgggatggactgaggccgccgacctggtcattaacggtgtggccaaggcgatccaggcaaagcgtgttacccatgacttctcatcacaaatggaaggcgccacgcaagtcggcagtgcagaattcggtgcggagatcgtcaagcacatgtcatga

SEQ ID NO: 28122 - protein, 413 aa, Methylobacillus flagellatus KT
MSTKIKVPTTGEKISVNADNSLNVPDHPIIPFIEGDGIGVDITPPMRHVVDSAVAKAYGGKRAIAWMEVYAGEKAVKTYGDNTWLPDETLKAVKDYVISIKGPLTTPVGGGIRSLNVTLRQELDLYVCLRPIQYFQGVPSPVKHPEKTNMVIFRENTEDIYAGIEWAAGTDEVKKVVDFLSDMGVRKKIRFPEASAIGIKPVSIDGSKRLVRKAIQYAIDNNRKSVTIAHKGNIMKFTEGGFKTWGYEVAKEEFGAVEIDGGPWCKLPNGIIIKDCIADAFLQEILLHPADYDVVATLNLNGDYISDALAAQVGGIGIAPGANISDTVAMFEATHGTAPKIAGKDIANPSSLILSAEMMLRHLGWTEAADLVINGVAKAIQAKRVTHDFSSQMEGATQVGSAEFGAEIVKHMS

SEQ ID NO: 28123 - DNA, 1011 bp, Moorella thermoacetica ATCC 39073
  CDS (1)..(1011): transl_table=11
ttgttgaaacatgtagttactctgattcccggggatggtaccggcccggagttaatcgccgccgccaggcgggtcctggaagccagcggtgcggaactggaatgggaggttatggcagccggggagggcgcccaggagaaatacggcagcgtgttgccagaagagaccctggcttcaatccgtaaaaatggcgtcgcccttaaaggccctatcaccaccccggtgggcaccggcttccggagcgtcaatgtggccctgcggaaagagctggatctctatgccaatgtccggcccttccgcaacttgcccaatgtcccctcacgctatcagggtgttgacctggtgatctaccgggagaacaccgaggacctctatgccggggttgaacatatggtgggtgaagatgcggctgaaagcattaagattattaccaggaagggctccgaacgtatcgcccgggcagcctttgaatacgcccggcgccagggccggaaacgggtgacagccggccacaaggccaatattatgaagttcagcgacggtcttttcctgcggaccttctacgacgtagccagggattatccggaaataacggctgatgaccgtattgtggacaacctgagcatgcagctggtccagaagccggagcaatatgatgtcctggtactgcccaacctttacggcgatatcctctccgacctctgcgccggcctggtgggcggcctgggagtggcccctggagccaatatcggggagaaggcagccgtctttgaaccaatccacggcagcgcacccaagtatgccggccagaataaggtaaatcccctggccactatcctctccggggttatgatgctggaacacctgggcgagaaggaagcagcagccaggatccagcgcgctatcctggcggtcctggcagaaggcaagtacttgacctacgatctgggcggcagtgccggtacgagcgatatggccgacgccatcgtcaggcgactggaagtagaataa

SEQ ID NO: 28124 - protein, 336 aa, Moorella thermoacetica ATCC 39073
MLKHVVTLIPGDGTGPELIAAARRVLEASGAELEWEVMAAGEGAQEKYGSVLPEETLASIRKNGVALKGPITTPVGTGFRSVNVALRKELDLYANVRPFRNLPNVPSRYQGVDLVIYRENTEDLYAGVEHMVGEDAAESIKIITRKGSERIARAAFEYARRQGRKRVTAGHKANIMKFSDGLFLRTFYDVARDYPEITADDRIVDNLSMQLVQKPEQYDVLVLPNLYGDILSDLCAGLVGGLGVAPGANIGEKAAVFEPIHGSAPKYAGQNKVNPLATILSGVMMLEHLGEKEAAARIQRAILAVLAEGKYLTYDLGGSAGTSDMADAIVRRLEVE

SEQ ID NO: 28125 - DNA, 1251 bp, Ralstonia metallidurans CH34
  CDS (1)..(1251): transl_table=11
atgtatcagcacatcaaggtgccggcaggcgagaagatcaaggtcaacgccgatctttcgctgaacgtgccggataatccgatcattccctacatcgaaggtgacggcacgggtgtcgatatcaccccggtgatgctgaaagtggtggatgccgccgtggccaaggcgtatggcggcaagcgcaagatctcgtggatggagatctacgcgggcgagaagtcgaccaaggtctatggcccggatgtgtggctgccggaagagaccatggaagtggtcaaggaatacgtggtgtcgatcaagggcccgctgaccacgccggtcggtggtggcatccgctcgctgaacgtggcactgcgtcagcagctcgatctctatgtctgcttgcgcccggtgcgttatttcaaaggcgtgccgtccccggtgcgcgagcccgagaagaccgacatggtgatcttccgcgagaactcggaagacatctatgccggcatcgagtgggaagccgaaagcgaaggcgcgaagaagctgatcgccttcctgcagaacgaaatgggcgtgaagaagatccgcttcccggaaacgtccggcatcggcatcaagcccgtctcgaaggaaggcacgcagcgcctggtgcgcaaggcgctccagtacgcgatcgacaacgacaagccgtcggtgacgctcgtgcacaagggcaacatcatgaagttcaccgaaggcggcttccgcgactggggctatgaactcgcgcagcaggaatttggcgcggaactggtcgatggcggcccgtggtgcaagttcaagaatccgaagactggccgcgatatcgtcgtcaaggacgctatcgccgacgcattcctgcagcagattctgctgcgtccagctgaatattcggtgatcgccacgctgaacctgaacggtgactacatctccgacgccctggccgcccaggtgggtggcatcggcatcgcaccgggcgcgaacatgtccgattcggtcgccatgttcgaagccacgcacggcaccgcgccgaagtatgcaggcaaggactacgtgaatccaggttcggaaatcctctccgcggaaatgatgctgcgccacatgggctggaccgaagcggccgacctgatcatccgctcgatggagaagtcgatccagtcgaagaaggtcacgtacgacttcgcccggctgctagaaggtgcgacgcaggtgtcgtgctcggggtttggtcaggtgatgatcgacaatatgtaa

SEQ ID NO: 28126 - protein, 416 aa, Ralstonia metallidurans CH34
MYQHIKVPAGEKIKVNADLSLNVPDNPIIPYIEGDGTGVDITPVMLKVVDAAVAKAYGGKRKISWMEIYAGEKSTKVYGPDVWLPEETMEVVKEYVVSIKGPLTTPVGGGIRSLNVALRQQLDLYVCLRPVRYFKGVPSPVREPEKTDMVIFRENSEDIYAGIEWEAESEGAKKLIAFLQNEMGVKKIRFPETSGIGIKPVSKEGTQRLVRKALQYAIDNDKPSVTLVHKGNIMKFTEGGFRDWGYELAQQEFGAELVDGGPWCKFKNPKTGRDIVVKDAIADAFLQQILLRPAEYSVIATLNLNGDYISDALAAQVGGIGIAPGANMSDSVAMFEATHGTAPKYAGKDYVNPGSEILSAEMMLRHMGWTEAADLIIRSMEKSIQSKKVTYDFARLLEGATQVSCSGFGQVMIDNM

SEQ ID NO: 28127 - DNA, 1173 bp, Rubrobacter xylanophilus DSM 9941
  CDS (1)..(1173): transl_table=11
atggtagaggccatccggctgtctcttcccccactacttcccgcagggtcttcagagaactattctacagcacccacgggcgtgccggagctcgttagtcctccgcggcgccgctcgctatacttgggcgtgccctttggtcgagagaggagacagcatcccgtggcaaggaccgttaccctcatacccggagacggaatagggccggaggtcactggctcggcgaaggaggtcatcggcgcgctcggcgtggacatcgagtgggagatagccgaggccggcgagacggtgatggagagggaggggacgcccctccccgagtacgtgctggagtccatccggcgcaacaaggtggccctgaagggcccgctgaccacccccgtgggcaccggcttccgctcggtgaacgtggccctgcgcaaggagctcgacctctacgccaacatccgcccggcgctcagcctcccggggctcgacctgccgtacagggacatagacatcctgcttttccgggagaacaccgaggatctgtacgcgggcgtcgagcacatggtcggcaagcacgccgccgagtccatcaagatcatcacccgcgagggcaccgagcgcatctgccgcatggccttcgagtactcgcgggaccagggccgcaggcacgtcacggtggtgcacaaggccaacatcatgaagtacaccgacggcctcttccgggaggtcttctacgaggtcgccagagactacgaggacgacttcgaggagatcgacgagcgcatcgtggacaacatggcgatgcagctggtgatgaagccgaacctctacgacgttctggtctgccccaacctctacggggacatcctctcggacctgtgcgccgggctgaccggcgggctcggggtcgccccgggggcgaacatcggggaggacatcgcgctgttcgagccggtgcacggctcggcccccaagtacgccgggcagaaccgggccaaccccttggcgaccctgctgtcggcgaagaacatgctctactacctggggtacggcgaggccgccgaccgcatgcagggggccatcaacgccgccctgaagaaccccgaaacccggacgaaggacctcggcggcagcgccgggacgcgggagttcacccgggcggtgatctccaacctgacgggctag

SEQ ID NO: 28128 - protein, 390 aa, Rubrobacter xylanophilus DSM 9941
MVEAIRLSLPPLLPAGSSENYSTAPTGVPELVSPPRRRSLYLGVPFGRERRQHPVARTVTLIPGDGIGPEVTGSAKEVIGALGVDIEWEIAEAGETVMEREGTPLPEYVLESIRRNKVALKGPLTTPVGTGFRSVNVALRKELDLYANIRPALSLPGLDLPYRDIDILLFRENTEDLYAGVEHMVGKHAAESIKIITREGTERICRMAFEYSRDQGRRHVTVVHKANIMKYTDGLFREVFYEVARDYEDDFEEIDERIVDNMAMQLVMKPNLYDVLVCPNLYGDILSDLCAGLTGGLGVAPGANIGEDIALFEPVHGSAPKYAGQNRANPLATLLSAKNMLYYLGYGEAADRMQGAINAALKNPETRTKDLGGSAGTREFTRAVISNLTG

SEQ ID NO: 28129 - DNA, 1179 bp, Ferroplasma acidarmanus Fer1
  CDS (1)..(1179): transl_table=11
atggcaaaaataacatttgaaaatggaaagtggaaagtgcccgataatccgacaattctgtacacagacggtgatggcataggcccagaaatcatggatgtaacgaggaaagttgtggatgctgcagttaaaaaggcatacaaaaataaaaaaatagagtggaaagaaattcttgtaggggacaaagcactgaaagagaaaaatgatcgtttcccggaagaatcacaggaggcaataaaacaataccgtgtactgttaaaatcgccgcttggaacacctataggtactggttttaagtcaatcaatgtaaggataagagttatgctcgacctttattcaaatataaggcctgttagttttatgaaaggtttagaaagcccactcaaacacccggaaaatgtaaatttaaccatattcagggaaaatactgatgatctttacaccggaattgagtataagtatgacagcaaagaggctgccgaaattagaaaatttttcaaagacaaattacatgttgaaataagcgacgattctggaattggaataaagccaatgagcaaatataaaacccagagaatcacaagagcggctgcaaaatttgcaattgaaaacaacaaaaagaagatcactataatgcataagggaaatgtaatgaaatacacggaaggcgctttcagggaatgggcatatgaaacacttaaaaacgaattcggtaattatacatcaaccgatgattcaagtaaaatacttgtaaacgacatgatagccgataatatgttccagcagataataacaaggcctgaaaactatgaagtgatattagctccaaatatagatggggattatatttctgatgcagcaggtgcattaataggaaatatcgggactctaggcggcgcaaatgttggagacgatgcaggaatgtttgaagcagtgcatggaaccgcaccgaaatatgcagggcagaatgtagcagacccgctgggattgataagaggagcgcagcttatgattaaatacctgaactggcacgaagcatttgatgtgatagaaaaagctataggggaagctatagagacaaagaaagtcacaaaggaccttgctaaattctttgatgttccggcaatggggacaaaggaatttggtgactcgcttgtgaaaattatagatgggctataa

SEQ ID NO: 28130 - protein, 392 aa, Ferroplasma acidarmanus Fer1
MAKITFENGKWKVPDNPTILYTDGDGIGPEIMDVTRKVVDAAVKKAYKNKKIEWKEILVGDKALKEKNDRFPEESQEAIKQYRVLLKSPLGTPIGTGFKSINVRIRVMLDLYSNIRPVSFMKGLESPLKHPENVNLTIFRENTDDLYTGIEYKYDSKEAAEIRKFFKDKLHVEISDDSGIGIKPMSKYKTQRITRAAAKFAIENNKKKITIMHKGNVMKYTEGAFREWAYETLKNEFGNYTSTDDSSKILVNDMIADNMFQQIITRPENYEVILAPNIDGDYISDAAGALIGNIGTLGGANVGDDAGMFEAVHGTAPKYAGQNVADPLGLIRGAQLMIKYLNWHEAFDVIEKAIGEAIETKKVTKDLAKFFDVPAMGTKEFGDSLVKIIDGL

SEQ ID NO: 28131 - DNA, 1260 bp, Psychrobacter cryohalolentis K5
  CDS (1)..(1260): transl_table=11
atgtcatataacaaggttatcgtaccaataaacggcgaaaaaataaccgtaaatgctgatttatccttcaatattccaaatcatccgatcattccctttatcgaaggcgatggcatcggcgttgatatcacacctgtcatgattgaagtgattgatgcggcagttgaaaaagcttataaaggcaaaaagtccatcgtttggatggagacctattgcggtgaaaaagcctctaaaatttatgacggcgaatttatgccagaagagacgcttgatgtgttgtgtgattatgtcatcagtataaaaggtccgctgaccacgccagttggcggtggtatgcgctcgctgaacgtggcaatgcgacaagagcttgatttgtacgtttgtcagcgtcctgtacgttggttcgaaggcgttccaagtcctgtccaacatcctgagttgactgatatgattattttccgcgaaaactcagaagatatctatgccggtatcgagtggaaagcaggcagtgaggatgccaaaaaagtcattaagtttttaaaagaagagatgggcgtgacacagattcgcttttcagaagattgtggcattggtatcaagccagtatcaaaagagggctcacagcgtttgatttgtaaagcgattcagcacgccatcgacaatgacttgcccaatgtgacgcttgtgcataaaggcaatattatgaagttcactgaaggcgcttttaaagagtggggatatgaagttgctactgagtgctttggtgctcaattactagatggtggcccttggatgacgataacaaatcctaagacgggtcataagattgtgattaaagatgtgattgcggatgcgtttttgcagcaaatcctgatgcgtccagctgactactcagtgattgcgacattaaacctaaacggcgactacatctctgacgcgttagccgcgcaagtcggtggtatcggtattgctccgggtgctaataaaggagttgctattgccgtatatgaggcaacccatggtacagctccaaagtacgccggacaaaacaaagtcaatccgggttcgcttattttgtcagctgagatgatgttacgtgatatgggctggacaaaggccgctgacttggtcatcgaaggtatccaaggtgctatcaaaaataagaccgtgacctacgattttgaacgcttgatgccggatgccaccttactgagtacctctgagtttggtaaagcaatcatcaaacatatgaatgcgtaa

SEQ ID NO: 28132 - protein, 419 aa, Psychrobacter cryohalolentis K5
MSYNKVIVPINGEKITVNADLSFNIPNHPIIPFIEGDGIGVDITPVMIEVIDAAVEKAYKGKKSIVWMETYCGEKASKIYDGEFMPEETLDVLCDYVISIKGPLTTPVGGGMRSLNVAMRQELDLYVCQRPVRWFEGVPSPVQHPELTDMIIFRENSEDIYAGIEWKAGSEDAKKVIKFLKEEMGVTQIRFSEDCGIGIKPVSKEGSQRLICKAIQHAIDNDLPNVTLVHKGNIMKFTEGAFKEWGYEVATECFGAQLLDGGPWMTITNPKTGHKIVIKDVIADAFLQQILMRPADYSVIATLNLNGDYISDALAAQVGGIGIAPGANKGVAIAVYEATHGTAPKYAGQNKVNPGSLILSAEMMLRDMGWTKAADLVIEGIQGAIKNKTVTYDFERLMPDATLLSTSEFGKAIIKHMNA

SEQ ID NO: 28133 - DNA, 1236 bp, Syntrophobacter fumaroxidans MPOB
  CDS (1)..(1236): transl_table=11
atgacggatcacaggggaaatgggacgtggatcgatttggaccgggatcgtaacctggtggtgccgcccgacccgatcatcgggttcatcgagggcgacggcatcggacccgatatctgggccgccacccgactggtgctggagtccgcggtccggagggcctacggcgggtcgaaacggatccgctggcatgagcttgcagccggcgagaaggccctcgcggccgtcggcgagcccctcccccaaatcacgttcgacgaaatccgcaagtgcgtggtggccatcaaggggccgctcaccactccggtcggcaagggatttcgcagcctcaacgtcacattgaggcaggtgttgaacctctacgcctgcgttcggccagtgcggtatttcccgggattgccctccccggtcaagcaccccgaaaaggtgaacatgatcgtgttccgcgaaaacaccgaagacgtttacgccggaatcgaatgggcgtcgggatcgaaggaggcccgccgcctggaagccatcctgaaggaggagttcaaggtttcgctgcccccggattcgggcatcggcatcaagcccatcagccgcgcgggaacccagcgtttggtacggcgggcgatccggtacgccatcgaaaacgggttgccttcggtcacgctggtccacaagggcaatatcatgaagtacaccgaaggggcgttcaggaactggggctacgagctggccgccacggaattcgccgatctcgcggtgaccgagaccgacctggagcagaagcacggcgggcacgtcccggagggcaaggtggtcatcaaggaccgcatggccgattccatgttccagcaggtgctcctgcgccccgaggaatacagtgtcatcgcgactccgaaccttgacggcgattacctttcggacgctctggccgcgcaggtcggagggctcggcatggcccccggcgcaaacatcggcgacgaatgcgcggtcttcgaagccacgcacgggagcgctcccaagtacgcgggtctggacaaggtcaaccccggttcactcatcctttcgggcgtcatgatgctcgagcacatcggctggcgggaagcggggaagctgatcgaggatgcgcttacgcgcaccatccaggcgggtgtggtgacctacgacctcgcccgacagatggacggggccagggaagtcaggtgctcggagttcgcccgggccgtcgtggagcgcatggattag

SEQ ID NO: 28134 - protein, 411 aa, Syntrophobacter fumaroxidans MPOB
MTDHRGNGTWIDLDRDRNLVVPPDPIIGFIEGDGIGPDIWAATRLVLESAVRRAYGGSKRIRWHELAAGEKALAAVGEPLPQITFDEIRKCVVAIKGPLTTPVGKGFRSLNVTLRQVLNLYACVRPVRYFPGLPSPVKHPEKVNMIVFRENTEDVYAGIEWASGSKEARRLEAILKEEFKVSLPPDSGIGIKPISRAGTQRLVRRAIRYAIENGLPSVTLVHKGNIMKYTEGAFRNWGYELAATEFADLAVTETDLEQKHGGHVPEGKVVIKDRMADSMFQQVLLRPEEYSVIATPNLDGDYLSDALAAQVGGLGMAPGANIGDECAVFEATHGSAPKYAGLDKVNPGSLILSGVMMLEHIGWREAGKLIEDALTRTIQAGVVTYDLARQMDGAREVRCSEFARAVVERMD

SEQ ID NO: 28135 - DNA, 1248 bp, Nitrosomonas eutropha C71
  CDS (1)..(1248): transl_table=11
atgtatcaacatatcaaggtaccggccatcggcagcaaaattcaggtaaaaaatgactctaccctgatcgtaccagataacccgatcatcccttttattgagggagatggtacaggtatagatatcacacccgtcatgatcaaagtgatcgatggcgcagtaaaaaaagcatatggtgattcccggaaaatttcctggatggaaatttacgcgggtgagaaatcgactcgcgtctatggacaggatgtctggctgccagacgaaaccttgcaagcagcaaaggaatttgtggtatccatcaaggggccattgaccacaccagtaagcggtggcattcggtcaatcaatgtagcattacgccaactgctggatctgtatgtttgtctgcgcccggtacggtatttccaaggggttcccagcccggtcaaacaaccggagaaagtagatatgatcatatttcgcgaaaactcggaagatatctatgcgggcatcgaatgggaagctggaacagcagctgttggaaaagtaattaatttcctgacaacagaaatggaaatcaccaagatccgatttcctcaatcttctgcgatcgggataaaaccggtttcaaaagaaggcagcgaacgtttgatcaggaaagccattcagtatgcgattgaccataaacggcgctctgtcaccttggtgcacaaaggaaatattatgaaattcacagaaggggctttcaagaaatggggttacgaactagcagcaaaagaatttggcgcagaattactggatggcggtccgtggatgaaactgcggtatgatggtaatgaaattaccatcaaggatgttattgctgatgccttcctccagcaaatcttgctgcgtccggatgaatacgatgttatcgccacacttaatttaaatggtgactatatttctgacgctctggctgcacaggtgggtggtatcggaatcgctcccggagcaaatttgagcgacagcatagcgatatttgaggcgacacacggcacagcaccaaagtacgctggcaaggatcaagtcaatccaggatcaatcatcctgtcagcagaaatgatgctcagatacattaactggcacgaagcagccgatatcattatcagctcaatggagaaaacgatacaagacaaaatcatgacctatgatctggcaagacttacaccgaatgccaggcaggccacttcttcagaatttgggagtgcaatgatacaaagaatgtaa

SEQ ID NO: 28136 - protein, 415 aa, Nitrosomonas eutropha C71
MYQHIKVPAIGSKIQVKNDSTLIVPDNPIIPFIEGDGTGIDITPVMIKVIDGAVKKAYGDSRKISWMEIYAGEKSTRVYGQDVWLPDETLQAAKEFVVSIKGPLTTPVSGGIRSINVALRQLLDLYVCLRPVRYFQGVPSPVKQPEKVDMIIFRENSEDIYAGIEWEAGTAAVGKVINFLTTEMEITKIRFPQSSAIGIKPVSKEGSERLIRKAIQYAIDHKRRSVTLVHKGNIMKFTEGAFKKWGYELAAKEFGAELLDGGPWMKLRYDGNEITIKDVIADAFLQQILLRPDEYDVIATLNLNGDYISDALAAQVGGIGIAPGANLSDSIAIFEATHGTAPKYAGKDQVNPGSIILSAEMMLRYINWHEAADIIISSMEKTIQDKIMTYDLARLTPNARQATSSEFGSAMIQRM

SEQ ID NO: 28137 - DNA, 1419 bp, Trichodesmium erythraeum IMS101
  CDS (1)..(1419): transl_table=11
atgtacgaaaaaataacccccccaaccacagggtctaaagtcactttcagtaacggccaacccatcgttcccgacgaccctattatcccatttattaggggcgatggtactggattagatttgtggccagcatctcaaaaagtctttgacgcagcgatcgctactgcctatggagacaaacgcaaaattaattggtttaaaatctacgctggtgatgaagcgtgtgacaaatatggcactttccaatatttgccggaagatactctaaatgccataaaagaatatggtattgccattaaaggtcctttaacaacacccataggtggaggtattcgttccctaaatgtcgcattgcgtcaaattaatgatttatatgcttgtgttcgtccttgtagatattacacgggtacaccttctcctcacaaaacaccggaaaaattagatgtcatcatttaccgggaaaatacagaagatatttatctgggaatagaatggcgcgagggaactgatattgctagcaaattgattgacattttaaataaagacttaattcctgctactctcgaacacggcaaaaagcaaattcgcttcgactctggtattggtattaaacctgtaagtaaaactggttcccaacgtttggttaaacgtgctattcaaaatgctttgcgtttacctaagtccaaacaaatggtaactttggtacataaaggtaatattatgaagtacaccgaaggcgcatttcgtgactggggttatgagttagcaactacagaatttcgtcaagaatgtgtcactgaaagagaatcttggattctttctaataaagaggaaaaccttaatattagtagtgaggaaaattctcgaaaaattgaccctggttatgatgctttaacaccagaaaaacaagcagaaatttgccaagaagttgaggatgtattggcagctatttgggatagtcatgggcatggaaaatggaaagagaaaatcatggtaaatgaccgaattgctgatagtattttccaacaaattcaaactcgaccagaggagtattctattctggcaactatgaatttgaatggggattatttatccgacgcagcagcagctattgttggtggtttaggtatgggtccaggtgctaatattggtgataaatgtgctatttttgaagccactcatggtactgctccaaaacacgcaggtttagatagagtaaaccctggttctttaattctttctggtgtaatgatgttagaatatataggctggcaagaagctgcagatttgattaaaaaaggtattgagatttctatttctaatggtgaggtaacttatgatttagcaagattaatggaaccatctgtgccggctttgaaatgttctgagtttgctgatgcaattatcaagcatttttaa

SEQ ID NO: 28138 - protein, 472 aa, Trichodesmium erythraeum IMS101
MYEKITPPTTGSKVTFSNGQPIVPDDPIIPFIRGDGTGLDLWPASQKVFDAAIATAYGDKRKINWFKIYAGDEACDKYGTFQYLPEDTLNAIKEYGIAIKGPLTTPIGGGIRSLNVALRQINDLYACVRPCRYYTGTPSPHKTPEKLDVIIYRENTEDIYLGIEWREGTDIASKLIDILNKDLIPATLEHGKKQIRFDSGIGIKPVSKTGSQRLVKRAIQNALRLPKSKQMVTLVHKGNIMKYTEGAFRDWGYELATTEFRQECVTERESWILSNKEENLNISSEENSRKIDPGYDALTPEKQAEICQEVEDVLAAIWDSHGHGKWKEKIMVNDRIADSIFQQIQTRPEEYSILATMNLNGDYLSDAAAAIVGGLGMGPGANIGDKCAIFEATHGTAPKHAGLDRVNPGSLILSGVMMLEYIGWQEAADLIKKGIEISISNGEVTYDLARLMEPSVPALKCSEFADAIIKHF

SEQ ID NO: 28139 - DNA, 1254 bp, Rhodoferax ferrireducens DSM 15236
  CDS (1)..(1254): transl_table=11
atgtaccagcacatcaaggttccctcagaaggccaaaagatcactgtcaatgccgatatgtcgttaaacgttcccgatcagccgatcattccttttattgaaggtgacggcaccgggttggacatcacaccggtgatgattaaagtggtggatgcggcggtgaccagggcgtacggtagcaagaagaagattcactggatggaagtttatgctggtgaaaaggcaaccaaggtctatggtcccgatgtctggttcccaactgaaacgctggacgctttgcgtgactatgtggtgtccatcaaaggcccactgacaaccccaatcggtggcggtattcgctcgctcaatgtctttatgcgtcaggagcttgacctgtttgtctgcctgcgtccgattcagtattttgaaggcgtacccagccccgtcaaagagccggaaaaaaccaatatggtgatcttccgtgaaaacaccgaagacatctactgcggcatcgaatttgaagccgaatcgcccaaggcaaaaaaactcatcaagttcctgcaggatgagctgggtgtcaccaaaatccgctttcccaatacgtcgggcatcggcatcaaaccggtatcacgtgagggtaccgagcgcttggtgcgtaaggcgatccggtacgccattgacaatgacaaacctaatgtcacgctggtgcataagggcaacatcatgaaatttaccgaaggtgctttccgtgactggggttatgccttggcgcagaatgagtttggtgccgaacttattgacggcggaccctggtgcaaattcaagagccccaaaacgggcaaagagatcatcgtgaaagactgcattgcggatgccttcctgcaacaaattctgttgcgcccggctgaatacagtgtgatagcgaccttgaacctgaatggggactacatttctgacgcattggcggctcaagtgggcggcatcggcattgcggccggggccaacctgtcagactcggtcgcttgctttgaagccacccatggcacagcccccaaatatgctggaaaagattatgtgaatccaggctctgaaattctgtcggctgaaatgatgctacgccacatgggctggtttgaagctgccgatgccgtcatcaagtcgatggaacgctctatcaagagcaagaaagtcacgtacgatttcgctcgtctgatggacggtgcgacccaggtcagttgctctggatttggtcaggtgatgatcgacaatatgtag

SEQ ID NO: 28140 - protein, 417 aa, Rhodoferax ferrireducens DSM 15236
MYQHIKVPSEGQKITVNADMSLNVPDQPIIPFIEGDGTGLDITPVMIKVVDAAVTRAYGSKKKIHWMEVYAGEKATKVYGPDVWFPTETLDALRDYVVSIKGPLTTPIGGGIRSLNVFMRQELDLFVCLRPIQYFEGVPSPVKEPEKTNMVIFRENTEDIYCGIEFEAESPKAKKLIKFLQDELGVTKIRFPNTSGIGIKPVSREGTERLVRKAIRYAIDNDKPNVTLVHKGNIMKFTEGAFRDWGYALAQNEFGAELIDGGPWCKFKSPKTGKEIIVKDCIADAFLQQILLRPAEYSVIATLNLNGDYISDALAAQVGGIGIAAGANLSDSVACFEATHGTAPKYAGKDYVNPGSEILSAEMMLRHMGWFEAADAVIKSMERSIKSKKVTYDFARLMDGATQVSCSGFGQVMIDNM

SEQ ID NO: 28141 - DNA, 1278 bp, Bacillus israeli
  CDS (1)..(1278): transl_table=11
atgattgtggcagaaggtcaaaaaattacaatgacaaatggtactttaaacgttccaaatgatcctataattccgtttattgaaggagacggcactggtcctgatatttggagagctgcgtcaaaagtgctggaagcagctgtagaaaaagcatacaatggcgaaaagaaaatcgtttggaaagaagtgcttgctggtgaaaaagcttttaaagagactggggaatggcttcctcaagaaacgcttgatgtgatacgcgagtatatgattgcgatcaaaggtccgttaacaactcctgtaggtggaggaatccgttctttaaacgttgctcttcgccaagagctggatttatttgtgtgcttaagacctgtccgttatttcaatggagttccttcccctgtaaaacgtcctcaagatacagacatggtaattttccgtgaaaataccgaagacatctatgccggcatagagtatgcaaaagggacagaagaagtaaaaaaagtcattgaatttttacaaaaagagctgggagtaaacaaaatccgtttccctgaaacgtccggaatcggcattaagcctatttctgaagaaggaacgaaacggcttgtccgtgcggccattaactatgcaattgaacacggaagaaaatctgtcacccttgttcataaagggaacattatgaaatttacagaaggcgcgtttaaaaattggggatatgaattggctgagcaagagtttggcgataaagtattcacatgggctgagtatgaccgcattgttgaaaaagaaggaaaagaagcggctaacaaagcgcaagaagaagcagaaaaagctggaaaaattattattaaagatgcaattgcagatattttcctacagcaaattcttactcgtccgcgcgagtttgatgtagtagcaacgatgaatttaaatggagactacatttcggatgctttggctgcacaagtaggcggaatcggtattgctccaggagcaaacattaactacgagacagggcatgcgatttttgaagcaacacacggtacagcaccaaaatacgccggacttgataaagtgaatccatcttccgtaattctttctggagtgcttatgctcgaacatttaggctggaaagaagcagctgatttaatcattcaagcaatggaaaaaacgatcgcttcaaaagttgtcacctatgactttgcacgcctcatggacggagctacggaagtaaaatgctctgaattcggcaatgaattgattaaaaacatgggttaa

SEQ ID NO: 28142 - protein, 425 aa, Bacillus israeli
MIVAEGQKITMTNGTLNVPNDPIIPFIEGDGTGPDIWRAASKVLEAAVEKAYNGEKKIVWKEVLAGEKAFKETGEWLPQETLDVIREYMIAIKGPLTTPVGGGIRSLNVALRQELDLFVCLRPVRYFNGVPSPVKRPQDTDMVIFRENTEDIYAGIEYAKGTEEVKKVIEFLQKELGVNKIRFPETSGIGIKPISEEGTKRLVRAAINYAIEHGRKSVTLVHKGNIMKFTEGAFKNWGYELAEQEFGDKVFTWAEYDRIVEKEGKEAANKAQEEAEKAGKIIIKDAIADIFLQQILTRPREFDVVATMNLNGDYISDALAAQVGGIGIAPGANINYETGHAIFEATHGTAPKYAGLDKVNPSSVILSGVLMLEHLGWKEAADLIIQAMEKTIASKVVTYDFARLMDGATEVKCSEFGNELIKNMG

SEQ ID NO: 28143 - DNA, 1170 bp, Salmonella enterica I
  CDS (1)..(1170): transl_table=11
atgcaaaacggcaaactcaacgttcctgagaatccgattatcccgtttattgaaggcgatggtatcggtgttgatgtcactccagccatgcttaaagtggtcgatgccgccgtcgagaaagcctataaaggcgagcgtaaaatttcctggatggaaatttacaccggagaaaaatccacacaggtttacggccaggatgtctggcttcccgctgaaacccttgatttaattcgtgactaccgcgtagcgattaaaggtccattgaccacgccggttggcggcggtatccgctctctgaacgttgccctgcgtcaggagcttgacctgtacgtttgtctgcgtcccgttcgttactatcagggcacgccaagtccggtgaaacatccggagctgaccgatatggtcatcttccgtgaaaactctgaagacatctacgccggaattgaatggaaagctgactctgcagacgctgagaaagtgatcaagttcctgcgcgaagagatgggcgtgaagaaaattcgcttcccggagcactgcggtatcggtatcaaaccgtgttctgaagaaggcactaaacgtctggttcgcgcggcgattgaatacgctattaccaacgatcgcgattccgtcacgctggtacataaaggcaatatcatgaagttcaccgaaggcgcgtttaaagactggggctaccagttggcgcgcgacgagttcggcggtgagcttattgacggcggtccgtggctgaaaattaagaacccgaacacgggtaaagagatcgtggttaaagacgttatcgccgatgcgttcctgcaacaaatcctgttgcgtccggcggaatacgacgttatcgcctgtatgaacctgaacggtgactatatttccgatgccctggcggctcaggttggcggtatcggtattgcaccgggtgcgaatatcggcgacgaatgcgcgttgtttgaagcgactcacgggactgcgccgaaatatgcgggccaggataaagtcaacccaggctccattattctgtctgcggagatgatgctgcgccacatgcagtggttcgaagcggcggatctgattgttaaaggtatggaaggcgcgattgccgcgaagaccgtgacctatgactttgaacgcctgatggacggcgctaagctgctgaaatag

SEQ ID NO: 28144 - protein, 389 aa, Salmonella enterica I
MQNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNDRDSVTLVHKGNIMKFTEGAFKDWGYQLARDEFGGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMDGAKLLK

SEQ ID NO: 28145 - DNA, 1170 bp, Salmonella enterica subsp
  CDS (1)..(1170): transl_table=11
atgcaaaacggcaaactcaacgttcctgagaatccgattatcccgtttattgaaggcgatggtatcggtgttgatgtcactccagccatgcttaaagtggtcgatgccgccgtcgagaaagcctataaaggcgagcgtaaaatttcctggatggaaatttacaccggagaaaaatccacacaggtttacggccaggatgtctggcttcccgctgaaacccttgatttaattcgtgattaccgcgtagcgattaaaggtccgttgaccacgccggttggcggcggtattcgctctctgaacgttgccctgcgtcaggagcttgacctgtacgtttgtctgcgtcccgttcgttactatcagggcacgccaagtccggtgaaacatccggaactgaccgatatggtcattttccgtgaaaactctgaagatatctacgccggaattgaatggaaagctgactctgcagacgctgagaaagtgatcaagttcctgcgcgaagagatgggcgtgaagaaaattcgcttcccggagcactgcggtatcggtatcaaaccgtgttctgaagaaggcaccaagcgtctggttcgcgcggcgattgaatacgctattaccaacgctcgcgattccgtcacgctggtgcataaaggcaatatcatgaagttcaccgaaggcgcgtttaaagactggggctaccagttggcgcgcgacgagttcggcggtgagcttatcgatggcggtccgtggctgaaaattaagaacccgaacacgggtaaagagatcgtggttaaagacgttatcgccgatgcgttcctgcaacaaatcctgttgcgtccggcggaatacgacgttatcgcctgtatgaacctgaacggtgactatatttccgatgccttggcggctcaggtaggcgggatcggcattgcaccgggtgcgaatatcggcgacgaatgcgcgttgtttgaagcgactcacgggacggcgccgaagtatgcgggccaggataaagtcaaccctggctccattattctctctgcggagatgatgctgcgccatatgcagtggttcgaagcggcggatctgattgttaaaggtatggaaggcgcgattgccgcgaagaccgtgacctatgactttgaacgcctgatggaaggcgctaagctgctgaaatag

SEQ ID NO: 28146 - protein, 389 aa, Salmonella enterica subsp
MQNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNARDSVTLVHKGNIMKFTEGAFKDWGYQLARDEFGGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLK

SEQ ID NO: 28147 - DNA, 1170 bp, Salmonella enterica subsp
  CDS (1)..(1170): transl_table=11
atgcaaaacggcaaactcaacgttcctgagaatccgattatcccgtttattgaaggcgatggtatcggtgttgatgtcactccagccatgcttaaagtggtcgatgccgccgtcgagaaagcctataaaggcgagcgtaaaatttcctggatggaaatttacaccggagaaaaatccacacaggtttacggccaggatgtctggcttcctgctgaaactcttgatttaattcgtgattatcgcgtagcgattaaaggcccgttaaccacgccggttggcggcggtattcgctctctcaacgttgccctgcgtcaggagcttgacctgtacgtttgtctgcgtcccgttcgttactatcagggcacgccgagtccggtgaaacatccggaactgaccgatatggtcattttccgtgaaaactctgaagatatttacgccggaattgaatggaaagctgattctgcagacgctgagaaggtgatcaagttcctgcgcgaagagatgggtgtgaagaagattcgcttcccggagcactgcggtatcggtatcaaaccgtgttctgaagaaggcaccaggcgtctggttcgcgcggcgcttgaatacgctattaccaacgatcgcgattccgtcacgctggtgcataaaggcaatatcatgaagttcaccgaaggcgcgtttaaagactggggctaccagttggcgcgcgacgagttcggcggtgagcttattgacggtggtccgtggctgaaaattaagaacccgaacacgggtaaagagattgtggttaaagacgttatcgctgatgcgttcctgcaacaaattctgttgcgtccagcagaatacgatgttatcgcttgtatgaacctgaacggggactatatttccgatgccctggcggctcaggttggcggtatcggtattgcaccgggtgcgaatatcggcgacgaatgcgcgctgtttgaagcgactcacgggacagcgccgaaatacgcgggccaggataaagtcaaccctggctccattattctgtctgcggagatgatgctgcgccacatgcagtggttcgaagccgcagacctgattgttaaaggtatggaaggcgcgattgccgcgaagaccgtgacctatgactttgaacgcctgatggaaggcgctaagctgctgaaatag

SEQ ID NO: 28148 - protein, 389 aa, Salmonella enterica subsp
MQNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTRRLVRAALEYAITNDRDSVTLVHKGNIMKFTEGAFKDWGYQLARDEFGGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLK

SEQ ID NO: 28149 - DNA, 1170 bp, Salmonella bongori
  CDS (1)..(1170): transl_table=11
atgcaaaacggcaaactcaacgttcctgagaatccgattatcccgtttattgaaggcgacggtatcggtgttgatgtaacccctgccatgctcaaagtggtcgatgccgcagtcgaaaaagcctataaaggtgagcgtaaaatttcctggatggaaatttacaccggtgagaaatccacccaggtttacggccaggacgtctggctacctgctgaaacccttgatctgattcgtgaataccgtgtggctatcaaaggcccgttgaccacgccggtcggtggcggtattcgttctctgaacgtggcgctgcgtcaggaactcgacctgtacgtttgtctgcgcccggtccgttactatcagggcaccccgagcccggtaaagcatcctgaactgaccgatatggtcatcttccgtgaaaactccgaagatatctacgcgggtattgagtggaaagccgattccgccgacgctgagaaagtgatcaaattcctgcgcgaagagatgggcgtgaagaaaattcgcttccctgaacattgcggtattggtatcaaaccgtgttctgaagaaggcaccaaacgtctggtccgtgcggcaattgagtacgccatcactaacgatcgtgactccgtgacactggtccataaaggcaacatcatgaagttcaccgaaggcgcgtttaaagactggggttaccagttggcgcgtgacgagttcggtggcgaactgatcgacggcggcccgtggatgaaaatcaagaacccgaacaccggcaaagagatcgtggtgaaagacgttatcgccgatgccttcctgcagcagatcctgctgcgtccggcggaatatgacgttatcgcctgcatgaacctgaacggtgactatatctccgatgcgctggcagcgcaggttggcggtattggtattgcgcctggggcaaacattggtgatgaatgtgcgctgttcgaagcaacccacggtactgcgccgaaatatgcaggccaggacaaagtaaacccaggctctatcattctgtccgctgagatgatgctgcgtcacatgcagtggttcgaagcggcggatctgattgttaaaggtatggaaggcgcgattgccgcgaagaccgtgacctatgactttgaacgcctgatggaaggcgctaagctgctgaaatag

SEQ ID NO: 28150 - protein, 389 aa, Salmonella bongori
MQNGKLNVPENPIIPFIEGDGIGVDVTPAMLKVVDAAVEKAYKGERKISWMEIYTGEKSTQVYGQDVWLPAETLDLIREYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNDRDSVTLVHKGNIMKFTEGAFKDWGYQLARDEFGGELIDGGPWMKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLK

SEQ ID NO: 28151 - DNA, 1095 bp, Nicotiana tabacum
  CDS (1)..(1095)
atggcttttcagattgcgagaagactcctacgtagccgcgctagttcgtcgattaggtatttggatcggagcttcagttcggagtccaattcgaatttgatccgcgctactcttttccccggcgatggtattggccctgagatcgccgactccgtcagacagattttcaagactgctgaggtaccaattgaatgggaagaacactatgtagggaaggagatagaccctagaaccaatagttttctgacatgggagagtcttgaatcagtgagaagaaataaggttggtttgaaagggccaatggctacacctatcgggaaaggtcatcgttccttgaaccttacattgaggaaagagttaaatctatatgccaatgttagaccttgctacagcctacctggatacaagactcgctacgatgatgtcaatctcattactatcagggaaaacactgaaggagagtacagtggtgtggaacatcaagtcgtaaggggtgtggttgaaagtctcaagatcatcactcgtcaagcaagcttaagggttgcggagtacgcgtttcactatgccaaggctcatggaagagagagagtgtctgcaattcacaaagctaacatcatgcaaaagactgatggtcttttccttaagtgttgccgagaggtagcagagaagtaccctgagataaagtatgaggaagttgtcattgacaattgttgtatgatgcttgtgaaaaatccagcactttttgatattttggtgatgcctaacctttatggtgacattatcagtgacctttgtgctggtgtgattggtggtttgggcctaactccaagttgcaatattggtgagggaggtattgctcttgctgaggctgtgcatggttcagcacctgatattgctggaaagaacttggcaaatccaactgctttgcttttgagtgctgtaaccatgctacggcatttggagcttcatgataaagctgatcgtatccaaggtgctgtcctaaacacaattgcggaggggaagtaccgaacaggtgatcttggtggtacttcatcaactactgacttcacaaatgctatctgtgaccatctttaa

SEQ ID NO: 28152 - protein, 364 aa, Nicotiana tabacum
MAFQIARRLLRSRASSSIRYLDRSFSSESNSNLIRATLFPGDGIGPEIADSVRQIFKTAEVPIEWEEHYVGKEIDPRTNSFLTWESLESVRRNKVGLKGPMATPIGKGHRSLNLTLRKELNLYANVRPCYSLPGYKTRYDDVNLITIRENTEGEYSGVEHQVVRGVVESLKIITRQASLRVAEYAFHYAKAHGRERVSAIHKANIMQKTDGLFLKCCREVAEKYPEIKYEEVVIDNCCMMLVKNPALFDILVMPNLYGDIISDLCAGVIGGLGLTPSCNIGEGGIALAEAVHGSAPDIAGKNLANPTALLLSAVTMLRHLELHDKADRIQGAVLNTIAEGKYRTGDLGGTSSTTDFTNAICDHL

SEQ ID NO: 28153 - DNA, 1104 bp, Arabidopsis thaliana
  CDS (1)..(1104)
atgtctcgccaatcgtcttctctactgaagaatcttcgtagcatcgcttcccgttccaaaatccagacccgatccgtgacttacatgcccagacccggtgacggaaaaccaagaccagtgacgttaatccccggagacggagttggtccgttggtaacaaacgcggttcaacaagtgatggaagcgatgcacgctccggtttacttcgaaccgttcgaagttcatggagatatgaagagtttacctgaaggattgttggaatcgattaagaagaacaaagtttgtttgaaaggtggtcttaagactcccgtcggtggtggtgtgagctctctcaatgttaatctgagaaaggagcttgatctctttgcttctctcgtcaactgtttcaatttgcctggtttagcttctcgtcatgagaatgttgatattgttgtgattagagagaacactgaaggtgaatatgcaggtcttgaacatgaagttgttcctggtgttgttgagagccttaaggtgattacaaagttctgttcagagcgtatcgcaaagtatgcgtttgagtatgcctacttgaacaacaggaagaaagttacagcagtgcacaaggctaatatcatgaaattggctgatggtttgttcttggagtcttgtcaagaggttgctaagaagtatccaagcattgcttacaatgaaatcattgttgataattgttgtatgcaacttgtggctagaccagagcaattcgatgtcatggtgacgcctaatctctatggtaatctagtggcaaacactgctgctggtattgctggaggctctggagtcatgcctggaggaaatgttggggcggagtatgcggtctttgagcaaggtgcatcagcgggaaacgtggggaaggatacaacggaagagcaaaagaacgcaaaccctgtggctttgttgctgtcatcagccatgatgcttagacaccttcagttcccttcttttgctgacaggcttgaaaccgctgtgaagcgtgttatcgctgaagggaattgtcggactgaagatcttggtggaaacagtaccactcaagaggtcgttgacgctgtcattgcaaatttggattga

SEQ ID NO: 28154 - protein, 367 aa, Arabidopsis thaliana
MSRQSSSLLKNLRSIASRSKIQTRSVTYMPRPGDGKPRPVTLIPGDGVGPLVTNAVQQVMEAMHAPVYFEPFEVHGDMKSLPEGLLESIKKNKVCLKGGLKTPVGGGVSSLNVNLRKELDLFASLVNCFNLPGLASRHENVDIVVIRENTEGEYAGLEHEVVPGVVESLKVITKFCSERIAKYAFEYAYLNNRKKVTAVHKANIMKLADGLFLESCQEVAKKYPSIAYNEIIVDNCCMQLVARPEQFDVMVTPNLYGNLVANTAAGIAGGSGVMPGGNVGAEYAVFEQGASAGNVGKDTTEEQKNANPVALLLSSAMMLRHLQFPSFADRLETAVKRVIAEGNCRTEDLGGNSTTQEVVDAVIANLD

SEQ ID NO: 28155 - DNA, 1104 bp, Arabidopsis thaliana
  CDS (1)..(1104)
atgtctcgcagatcgctaactctcctcaagaatctagctagaaacgcgaatggatcaggtattcaaacccgatccgtgacttacatgcccagacccggtgacggagcaccacgcgcagtgacgctgatccccggagatggaatcggtcctctggtgacgaacgccgtggaacaggtgatggaagcgatgcacgctccgatcttcttcgagaagtacgatgttcacggagaaatgagccgtgtgccgccggaagtgatggagtcgataaggaagaataaggtttgtttgaaaggtgggcttaagactcctgttggtggtggtgttagttctcttaacgtccagcttaggaaagagcttgacctctttgcttctctggtcaactgttttaatttgcctggtttacctactcgccatgagaatgttgacatcgttgtcatcagagagaacactgaaggtgagtacgcggggcttgagcacgaggttgttcctggtgtcgttgagagtctgaaggtgatcacgaagttctgttcggagcgtattgcaaagtatgcttttgagtatgcctacctgaacaacaggaagaaagttacagcggtgcataaggctaacatcatgaaacttgcggatggtttgttcttggaatcttgtcgcgaggttgcgaaaaagtatcccagcatcacctacaatgaaatcattgttgataactgctgtatgcaacttgtagccaaaccagagcaattcgatgtcatggtaacgccgaatctctatgggaatttagttgcaaacactgctgctggtattgctggaggcacaggagtcatgcctggaggaaatgttggggctgaccatgcggtattcgagcaaggtgcatcagcaggaaatgttgggaaagacaagatagtattggaaaacaaagcaaacccagtggcattgcttctctcatcagcgatgatgcttagacaccttcagtttccttcatttgctgaccggcccgaaacagcagtgaagaaagtcaccgctgaaggaaagtgccggacgaaagatcttggtggaacaagcacgacccaagaggtcgttgatgcgggcattgcaaaactagactga

SEQ ID NO: 28156 - protein, 367 aa, Arabidopsis thaliana
MSRRSLTLLKNLARNANGSGIQTRSVTYMPRPGDGAPRAVTLIPGDGIGPLVTNAVEQVMEAMHAPIFFEKYDVHGEMSRVPPEVMESIRKNKVCLKGGLKTPVGGGVSSLNVQLRKELDLFASLVNCFNLPGLPTRHENVDIVVIRENTEGEYAGLEHEVVPGVVESLKVITKFCSERIAKYAFEYAYLNNRKKVTAVHKANIMKLADGLFLESCREVAKKYPSITYNEIIVDNCCMQLVAKPEQFDVMVTPNLYGNLVANTAAGIAGGTGVMPGGNVGADHAVFEQGASAGNVGKDKIVLENKANPVALLLSSAMMLRHLQFPSFADRPETAVKKVTAEGKCRTKDLGGTSTTQEVVDAGIAKLD

SEQ ID NO: 28157 - DNA, 1281 bp, Thermus aquaticus
  CDS (1)..(1281): transl_table=11
atggcctaccagcgcatccagattccccaggagggcgaaaagatcaccatccaagagggcgtcctgaaggtgccggaccagcccatcatcggcttcattgagggggatgggaccggccctgacatctggagagcggcccaacccgtcctagacgccgccgtggccaaagcctacggcgggcaacggcgcatcgtctgggtggagctttacgccggggaaaaggccaaccaggtctacggggagcccatctggctccccgaggagaccctggagttcatccgggagtacctggtggccatcaagggccccctgaccacgccggtgggcggcggcatccggagcatcaacgtggccctcaggcaggagctggacctctacgcctgcgtgcgccccgtgcgctggttccagggggtgcccagtccggtgaagcacccggagctggtcaacatggtcatcttccgggagaacaccgaggacatctacgccgggattgagtggccggcggggagcgaggaggtaaagaaggtcctagacttcttgaagcgggagttccccaaggcctacgccaagatccgcttccccgagacctcgggcctgggcctgaagcccatctccaaggagggcacggagcgcctggtggaggcggccattgagtacgccatcaaggaggacctccccagcgtgaccctggtccacaaaggcaacatcatgaagttcaccgaaggggccttccgggagtggggctacgccctggcccgggaaaagtacggggccacgcccctggacggcgggccctggcacgtcctcaaaaacccccgcaccggcagggagatcgttatcaaggacatgatcgccgacaacttcctgcagcagatcctcctccgccccgacgaatactcggtgatcgccaccatgaacctgaacggggactacatctccgatgccctggccgcccaggtggggggcatcggcatcgcccccggggccaacatcaactacaagacgggccacgccgtctttgaggccacccacggcaccgcccccaagtacgctggccaggacaaggtgaaccccagcagcgtcatcctctccggggagatgatgcttcgctacctgggctggaacgaggcggcggacctcatcatcagggccatggagaggaccatcagcaagggcctggtcacctacgacttccaccgcctcctggtggccgagggcaagcccgccacgcttcttaagaccagcgagttcggccaggccctgatccagcacatggactga

SEQ ID NO: 28158 - protein, 426 aa, Thermus aquaticus
MAYQRIQIPQEGEKITIQEGVLKVPDQPIIGFIEGDGTGPDIWRAAQPVLDAAVAKAYGGQRRIVWVELYAGEKANQVYGEPIWLPEETLEFIREYLVAIKGPLTTPVGGGIRSINVALRQELDLYACVRPVRWFQGVPSPVKHPELVNMVIFRENTEDIYAGIEWPAGSEEVKKVLDFLKREFPKAYAKIRFPETSGLGLKPISKEGTERLVEAAIEYAIKEDLPSVTLVHKGNIMKFTEGAFREWGYALAREKYGATPLDGGPWHVLKNPRTGREIVIKDMIADNFLQQILLRPDEYSVIATMNLNGDYISDALAAQVGGIGIAPGANINYKTGHAVFEATHGTAPKYAGQDKVNPSSVILSGEMMLRYLGWNEAADLIIRAMERTISKGLVTYDFHRLLVAEGKPATLLKTSEFGQALIQHMD

SEQ ID NO: 28159 - DNA, 1056 bp, Haemophilus parasuis
  CDS (1)..(1056): transl_table=11
atgctatctcaactcactacaccaaaagggcaagctattcaactaaatcatgatggttcattgtctgttccaaattacccaattattccttttattgagggagatggaattggcgttgatgtcacaccagccatgcgttttgtaattgatgctgcggtagaaaaagcctatcaaggtcaacgaaaaattgactggttagagatttatgcaggggaaaaagctaaccgactttacggtgaaaacacatggctacccgaagaaacattagcatcaattaaacagtatcatattgcgatcaaaggtccattaatgacccctgtcggcaaggggattcgttctttaaacgtagcaatgcgtcaagagttagatctctataattgcttgcgtccaatccgttactaccaaggtacgccaagtcctgtgaaatatccagaattagtggatatagtgatctttcgtgaaaattcagaggatatttatgctggggtagaatgggcggcaggttcctatgaagctgaaaaagtaatcgcttttttacggcaggaaatgggcgtgaaaaaaattcgctttacggaagaatgtggcattggtattaagcccgtttcacaagaagggactcagcgtttagtgcgggctgcattacagtacgcgattgataatgatcgtaaatcactcactttagtgcataaaggcaacatcatgaaatttaccgagggggcatttaaagagtggggataccaagttgccaaagactttggtgcagagccaatagataatggctcttggcatcgtttaaaaaatccaaatacaggacgagagatcatcatcaaagattgcattgctgatgcttttttacaagaaattttattacatccaagtgattacgatgtgattgcaacgcttaatcttaatggtgactacatatccgatgcacttgcggcacaagttggcggtattggtattgcacctggtgcaaacataggggaagaggcggctatttttgaagcaacgcatggtacagcgcctaaaatcgcaggtcaaaacaaagcaaattag

SEQ ID NO: 28160 - protein, 351 aa, Haemophilus parasuis
MLSQLTTPKGQAIQLNHDGSLSVPNYPIIPFIEGDGIGVDVTPAMRFVIDAAVEKAYQGQRKIDWLEIYAGEKANRLYGENTWLPEETLASIKQYHIAIKGPLMTPVGKGIRSLNVAMRQELDLYNCLRPIRYYQGTPSPVKYPELVDIVIFRENSEDIYAGVEWAAGSYEAEKVIAFLRQEMGVKKIRFTEECGIGIKPVSQEGTQRLVRAALQYAIDNDRKSLTLVHKGNIMKFTEGAFKEWGYQVAKDFGAEPIDNGSWHRLKNPNTGREIIIKDCIADAFLQEILLHPSDYDVIATLNLNGDYISDALAAQVGGIGIAPGANIGEEAAIFEATHGTAPKIAGQNKAN

SEQ ID NO: 28161 - DNA, 1278 bp, Leishmania major
  CDS (1)..(1278)
atggcggaatccatctctttcgcgaagggggcgctggtggtgccaagttgccccattatcccctacattgagggggacggcattggcaaggagatcacggaggtggcgcaccgcgtctttgatgcggcggtggcaaaggagtacggcaccacccggaagatttcgtggctagaggtgctcgcgggggagaaagcgttcgagcagaagggcagctggctgccggaggagaccatcgaggcatttgacaagcaccgcattggcatgaagggcccactgacaaccccggttggtgaggggatccgctcgctcaacgtggtgctgcgtcaccggctggacttgttcgtctgccagcgccccgtacgatggttcaccggcgtcggatcgccgatccgacacccggagtgggtggacatggttgtgtttcgcgagaacacggaggacatatactctggcattgagtggggccagggcacccctgaggctgccaaatttgcagactttctgacgaaggagatgggtgtgacgacggtgcgcttccctgagacgagcgcgtacggcgtgaagccggtttcgctggagggaagcgagcggctggtgcgtgcggcggtgcagtacgctatcgatcaccatcttccgtctgttacgctggtgcacaaaggcaacatcatgaagttcacagagggttgcttcaagaagtggggctacgccttggccgagcgtgagttccccgatgccgccttcaccatgacgcagtacgacgccatcaaggagaaaggcggcaaggaggcggctgagacggcgctgcgcgaggcgatggacagcggcaaagtcgttatcaaggattgcatctgtgacgcctttctgcaaaacacgattctccgcccattggactatagcgtgattgccaccatgaacctgaacggcgattacgtgtctgatcagctggccgcgcttgtcggtggcatcggcatcgcgccaggcgcgaacatcaactatgtgaccggccacgctattttcgaggcgacgcatgggacggcgccggatatcgctgggcaaggtaaagcgaacccatcctcgctcatcctatctggggctatgatgtttgactacatgggctggtccgaggtgtcggcgcgcatcatcaacgcgcttgagatggtctttcaggcaaacatggcaaccgtcgatcttgcgcggcagatgaccggtgccagggcactctcgacagcagaattcggggaggcgatcatcaagaagatcaacggcgacgaggcgtag

SEQ ID NO: 28162 - protein, 425 aa, Leishmania major
MAESISFAKGALVVPSCPIIPYIEGDGIGKEITEVAHRVFDAAVAKEYGTTRKISWLEVLAGEKAFEQKGSWLPEETIEAFDKHRIGMKGPLTTPVGEGIRSLNVVLRHRLDLFVCQRPVRWFTGVGSPIRHPEWVDMVVFRENTEDIYSGIEWGQGTPEAAKFADFLTKEMGVTTVRFPETSAYGVKPVSLEGSERLVRAAVQYAIDHHLPSVTLVHKGNIMKFTEGCFKKWGYALAEREFPDAAFTMTQYDAIKEKGGKEAAETALREAMDSGKVVIKDCICDAFLQNTILRPLDYSVIATMNLNGDYVSDQLAALVGGIGIAPGANINYVTGHAIFEATHGTAPDIAGQGKANPSSLILSGAMMFDYMGWSEVSARIINALEMVFQANMATVDLARQMTGARALSTAEFGEAIIKKINGDEA

SEQ ID NO: 28163 - DNA, 1101 bp, Homo sapiens
  CDS (1)..(1101)
atggctgggcccgcgtggatctctaaggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggtgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaa

SEQ ID NO: 28164 - protein, 366 aa, Homo sapiens
MAGPAWISKVSRLLGAFHNPKQVTRGFTGGVQTVTLIPGDGIGPEISAAVMKIFDAAKAPIQWEERNVTAIQGPGGKWMIPSEAKESMDKNKMGLKGPLKTPIAAGHPSMNLLLRKTFDLYANVRPCVSIEGYKTPYTDVNIVTIRENTEGEYSGIEHVIVDGVVQSIKLITEGVSKRIAEFAFEYARNNHRSNVTAVHKANIMRMSDGLFLQKCREVAESCKDIKFNEMYLDTVCLNMVQDPSQFDVLVMPNLYGDILSDLCAGLIGGLGVTPSGNIGANGVAIFESVHGTAPDIAGKDMANPTALLLSAVMMLRHMGLFDHAARIEAACFATIKDGKSLTKDLGGNAKCSDFTEEICRRVKDLD

SEQ ID NO: 28165 - DNA, 1113 bp, Gallus gallus
  CDS (1)..(1113)
atggctgcagccgcgtggatgcccgcggtttcccgactgctcggtgctttcaaaaaccaaaaacaggtgaccagaagttttagtagtgctgtacaaacggtgactttaatcccaggagatggcataggacctgagatttctgctgctgtcatgaagatctttgatgctgccaaagttcctattcagtgggaagaaaggaatgtcacagcaatccaaggaccaggaggaaagtggatgatacctccagatgccaaagaatccatggataaaaacaaaatgggattaaaagggcccttaaaaaccccaatcgctgcagggcacccctcgatgaatctgctgctgcgtaaaacctttgacctctatgcaaacgtccgtccctgcgtctcaattgaggggtacaaaaccccttacacagacgtaaatatcgtcacaatacgagagaacacagaaggcgaatacagtgggattgagcatgtgattgttgaaggcgttgtgcaaagcatcaagctaatcacagaggaagctagcaagcgcattgcagagtttgcttttgagtatgctagaaataaccagagaagccatgttactgctgtgcacaaggcaaatattatgagaatgtctgatgggcttttcttgagaaaatgcagggaagcagcagaaaactgtaaagacattaaatttaatgaaatgtatctggatactgtgtgtctgaatatggttcaggatccttcacaatttgatgtgcttgttatgcctaacttgtatggtgacatcctcagtgacttgtgtgctggattgattggaggtcttggagtaacaccaagtggaaatattggtgctaacggagttgccatttttgaatcggttcatggaacagcacctgatattgcaggaaaagacttggcaaatccaactgctcttctcctgagcgctgtaatgatgctgcgtcatatgggactacacaagcatgccacaaaaatcgagacagcttgctttgatacaattaaagatggaaaggccttgacaaaagacttgggtggcaatgccaagtgttcagagttcacagaagagatctgcagcagagtacgcggacacagactaaacttcatttga

SEQ ID NO: 28166 - protein, 370 aa, Gallus gallus
MAAAAWMPAVSRLLGAFKNQKQVTRSFSSAVQTVTLIPGDGIGPEISAAVMKIFDAAKVPIQWEERNVTAIQGPGGKWMIPPDAKESMDKNKMGLKGPLKTPIAAGHPSMNLLLRKTFDLYANVRPCVSIEGYKTPYTDVNIVTIRENTEGEYSGIEHVIVEGVVQSIKLITEEASKRIAEFAFEYARNNQRSHVTAVHKANIMRMSDGLFLRKCREAAENCKDIKFNEMYLDTVCLNMVQDPSQFDVLVMPNLYGDILSDLCAGLIGGLGVTPSGNIGANGVAIFESVHGTAPDIAGKDLANPTALLLSAVMMLRHMGLHKHATKIETACFDTIKDGKALTKDLGGNAKCSEFTEEICSRVRGHRLNFI

SEQ ID NO: 28167 - DNA, 1107 bp, Xenopus laevis
  CDS (1)..(1107)
atgaacatggctggcagcgcctggaggtcactgatttctcgtgtggcgggggcaatcactgcaccagaatatggcgccaggcggctttcaagtcatgtgcagactgtcactctcataccaggggatggaattggcccagagatttcagcagctgtcatgaagatttttgagactgccaaagctcctgtacagtgggaagagaggaatgttacagcaattaaaggacctggtggaaagtggatgattcccccagaagccaaagaatccatgcataagaacaaaatgggcttaaaaggacctttaaagacacccatagctgctggacatccatccatgaacttgttgctccgcaaaacatttgatctgtatgcaaatgtgcgtccatgtgtttccattgagggatacaggaccccttacacagatgtagacctggtcacaattcgtgagaacacagagggagaatatagtggaattgagcatgtgattgtggatggtgttgtacaaagtattaagcttattacagaagaagcaagccatcgcattgcacagtttgcctttgagtatgcaaggaacaaccagagaagcacggtgactgcagtgcacaaagcaaatatcatgagaatgtctgatgggctattcctgaaaaaatgtcgagaagttgcagaaaactttaaagacattaagtttaatgaaatgtatctggatacagtgtgtcttaatatggtgcaggatcctatccagtttgatgtgcttgtcatgccaaacctctacggtgacatcttgagtgatctttgcgcaggtctaattggaggcctgggagtgacacctagtggaaatatcggtgctaatggggtagcaatctttgaatcggttcatggcacagccccagatattgctggaaaagactttgccaaccccactgctcttcttctaagtgcagtcatgatgctgcggcacatgggtctccacgagtatggacgcaaaatagaaagtgcctgctttgagaccataaaatctggcaaggttctgactaaagacttgggtggtaactccaagtgctctgaatttaccaatgaaatctgccgcagaatacaggacagtgattag

SEQ ID NO: 28168 - protein, 368 aa, Xenopus laevis
MNMAGSAWRSLISRVAGAITAPEYGARRLSSHVQTVTLIPGDGIGPEISAAVMKIFETAKAPVQWEERNVTAIKGPGGKWMIPPEAKESMHKNKMGLKGPLKTPIAAGHPSMNLLLRKTFDLYANVRPCVSIEGYRTPYTDVDLVTIRENTEGEYSGIEHVIVDGVVQSIKLITEEASHRIAQFAFEYARNNQRSTVTAVHKANIMRMSDGLFLKKCREVAENFKDIKFNEMYLDTVCLNMVQDPIQFDVLVMPNLYGDILSDLCAGLIGGLGVTPSGNIGANGVAIFESVHGTAPDIAGKDFANPTALLLSAVMMLRHMGLHEYGRKIESACFETIKSGKVLTKDLGGNSKCSEFTNEICRRIQDSD

SEQ ID NO: 28169 - DNA, 1023 bp, Thermoproteus tenax
  CDS (1)..(1023): transl_table=11
atgtttaaaactcacacattttctggcgttatgaagcttgccgtaatcccgggcgacggcatagggcccgaggtagtgtcggccacgctgaaggtgatagaggcggccgcgcggcgtttctcaataccgctcgatataaaggtcgtggaggcgggcgacgtagccgcgaggaagtatggcaaacctatgcccgacgaggcgtggaagatcgtggactccgccgacgccgtactgaagggccccgtgggcgagaccgcctacgatgtaacgtccgcgataaggatgaagtacgtgttgtacgccaacataaggcctgcaaagaacctccccggcgtgcctgctgtcaagcccatcgattgcgtcttcgtgagggagaacgtcgaagatgtctatgtgggcgccgaatatagagtgggcgatgtggcgattgctctgaaggtcataacgagggagggcacggcgagggtggctagagtggcgaggaggtacgccgaaatgaggaggcggaaagtgactatcgtcacaaagtccaatgtgttgagggtggtcgacgccttctttagggatgtggccaggggggagctcgatgggcttcaagtggaggaaatgtacgtagacgcagcagcgatggagcttgtaaggaatccctcgcgcttcgacgttgtgttgacgacgaaccaatacggggatatcctcaccgatctcgccgcacaagtggcaggtagcttggggctggcgccctcggcgaatattggagacaaaaaggccatgttcgagccgatccacggggcggccttcgacatagctggaaaggggatagccaatccgatagcgaccatattgtccgccgcaatgatgttcgaatggatgggccgccaagacgctgcaaacgctgttagaggcgccgttgaggaggccttgaggcgcggggtagctacgccggacataggagggcgggccaccactgaggaggtcggcagacagatcgccgctattgttgaatcttggccaacaacgagctga

SEQ ID NO: 28170 - protein, 340 aa, Thermoproteus tenax
MFKTHTFSGVMKLAVIPGDGIGPEVVSATLKVIEAAARRFSIPLDIKVVEAGDVAARKYGKPMPDEAWKIVDSADAVLKGPVGETAYDVTSAIRMKYVLYANIRPAKNLPGVPAVKPIDCVFVRENVEDVYVGAEYRVGDVAIALKVITREGTARVARVARRYAEMRRRKVTIVTKSNVLRVVDAFFRDVARGELDGLQVEEMYVDAAAMELVRNPSRFDVVLTTNQYGDILTDLAAQVAGSLGLAPSANIGDKKAMFEPIHGAAFDIAGKGIANPIATILSAAMMFEWMGRQDAANAVRGAVEEALRRGVATPDIGGRATTEEVGRQIAAIVESWPTTS

SEQ ID NO: 28171 - DNA, 1320 bp, Thermoproteus tenax
  CDS (1)..(1320): transl_table=11
atgtcagattacctagagaaaataaaggcgcagatacccaatatccagccgtttgccggcaaatacgctgagcccgtcgagggctcgtacataacttacacaggcccaggacagttgaaagtaccagataaggtagtcataggctacattgagggcgacggcacagggcctgaggtcgcctacgccgccattaaggtggccaacgcggccgtcgagagggcctacggcaagtcgcgcagagtgctctggtatgaggtgctcgtggggtctaaggctgagaaaatattgggcagtagactgcccgatcagagcgtggaagtgctaaagaagatcagagtgttcctcaaggcgcctttagagacgcctgtgggcggcggcttccgtagccttaacgtaacattgagacagatatttgacctctacgccaacatcaggcccgtcaagtacttccccggtctaccctcgcctctgaagaggccggagagcgtagacttagtcatattcagagagaacactgaggacgtctatatgggcattgaatggccttggaattcgccggaggccgccaaggtgagagagttcttgaggagagagctcaaagtcgatataagggacgacgccggcataggcataaagcccataagcaagttcgggacccagaggatagcgcggctcgcgttgaagttcgctgtggagaacaagagaagggtcgtcaccataatgcacaaaggaaatattcagaagtacacggagggcgcgtttagagattgggcctatgaggtggccaagaacgagttcagagaccacgtggttctggaggaggagttggcccagtatggaggcaaagtgccgccgggcaagatcttggtcaatgataggatagccgacaatatgttgcaacagctgttaacgcgcaccggcgagtacgacgtcatcctagcgcccaatctcaatggggactacgtgagcgatgaggcggcgggcctagtgggcggactcggcgtggcgcccggcatagatgtgggcgattgggggatgatggccgagccagtgcatggcactgcgcccaaatacacgggcaagaactacgtcaaccccactgcgactatcctggcgcttgagctgctcttcaggttcatcggctggagagaggccgctgacttgataacgaggggcgtcagcaaggcctactcagaggggtacttcaccggcgacttagccaggcagatgaccgatgaggaaaggaaagttgtaaaggaagtgcttggaactcaagaatttgctgagaaagtagctgagataatcaaaaccgagctataa

SEQ ID NO: 28172 - protein, 439 aa, Thermoproteus tenax
MSDYLEKIKAQIPNIQPFAGKYAEPVEGSYITYTGPGQLKVPDKVVIGYIEGDGTGPEVAYAAIKVANAAVERAYGKSRRVLWYEVLVGSKAEKILGSRLPDQSVEVLKKIRVFLKAPLETPVGGGFRSLNVTLRQIFDLYANIRPVKYFPGLPSPLKRPESVDLVIFRENTEDVYMGIEWPWNSPEAAKVREFLRRELKVDIRDDAGIGIKPISKFGTQRIARLALKFAVENKRRVVTIMHKGNIQKYTEGAFRDWAYEVAKNEFRDHVVLEEELAQYGGKVPPGKILVNDRIADNMLQQLLTRTGEYDVILAPNLNGDYVSDEAAGLVGGLGVAPGIDVGDWGMMAEPVHGTAPKYTGKNYVNPTATILALELLFRFIGWREAADLITRGVSKAYSEGYFTGDLARQMTDEERKVVKEVLGTQEFAEKVAEIIKTEL

SEQ ID NO: 28173 - DNA, 1266 bp, Hydrogenobacter thermophilus
  CDS (1)..(1266): transl_table=11
atgttaaaggtggaaagtgtttataggtgggaaggtagcctgaaggtgccacaagaaggaaagtttataaaactcaaggaggacaaaagtatagaagtgcctaactttcccatcatacctttcatagagggggatggaataggtgccgagattatgcctgccatgatacacatagtaaatactgccgtagagaaggcttacggaggttcaagaaacatcttttgggtagagcttctggccggggacaaggctgaagaaaagacaggcaagcgtatgccagaagagactatagagtttttaaaggaagcggttgttggcataaagggacctcttggcacacccgtaggtaagggaggtaaatctctcaatgctatcttgcgccagtctatggacttctattcagccataagacctgtctattggctgggtcagcctgcacccatacctaaccccgagagggtcaatgtggctgtctttagagaaaattctgacgatgtttatatgtccatagagtacatgcctaaggaggaaaggacgcagaaggttaggaagttctttattgaagagatgggagtgtccgaatatgcccttcccgaggattgtggcatcacggtaaagcctatgagtgagtttaagacaaaaaggcatgtaagaaaagctctccgttgggctttgcagaataacaaaaaggtggtagctgttgtaggcaaaggcaacataatgaaagctacggaaggtgcctttatgaactgggcttttgaggtggcaaaagagcctgagtttgaaggaaaagtgataacggagggagagccaaaagatggtcaggttttgatggttaaagttatcaccgatcagatgctcatgcagctggtgttaaagccggaggcttaccatgtgataataactcaaaacctgaatggagattacatatctgaccttgcctccgcattggtgggtggtccagggtttgtgcccagcggaaacataggtgacggatatgccctgtttgaaagcactcacggaaccgcctacgacatagcaggcaaaggtattgccaatcctctatcgctgacgctgtccggtgctatgatgcttgaatacttgggttggaaagaagcctccgagcttatatactccgcagtcaaaaggaccatagctgaaaggcttggaacgccggacatagctaacggctttagaaagcagggattggaagctaaagagcttaccaccttagagtttgctaaagctatagccgataggatttaa

SEQ ID NO: 28174 - protein, 421 aa, Hydrogenobacter thermophilus
MLKVESVYRWEGSLKVPQEGKFIKLKEDKSIEVPNFPIIPFIEGDGIGAEIMPAMIHIVNTAVEKAYGGSRNIFWVELLAGDKAEEKTGKRMPEETIEFLKEAVVGIKGPLGTPVGKGGKSLNAILRQSMDFYSAIRPVYWLGQPAPIPNPERVNVAVFRENSDDVYMSIEYMPKEERTQKVRKFFIEEMGVSEYALPEDCGITVKPMSEFKTKRHVRKALRWALQNNKKVVAVVGKGNIMKATEGAFMNWAFEVAKEPEFEGKVITEGEPKDGQVLMVKVITDQMLMQLVLKPEAYHVIITQNLNGDYISDLASALVGGPGFVPSGNIGDGYALFESTHGTAYDIAGKGIANPLSLTLSGAMMLEYLGWKEASELIYSAVKRTIAERLGTPDIANGFRKQGLEAKELTTLEFAKAIADRI

SEQ ID NO: 28175 - DNA, 975 bp, Halobacterium volcanii
  CDS (1)..(975): transl_table=11
atgactgaggaaatcgtcgtcatccccggcgacggcatcggcgcggaggtcatcccggcggcggttgacgtgctgaaggccgtcggcgacttcgagttcgtcgaggccgacgccggcgaccacgtcaaagaagagaccggcgaggcgctcccgcaggagacgtacgacctcgccgccgaggccgacgcgacgctgttcggcgcggccggcgagaccgcggcggacgtcatcctgccgcttcggaccgcggtggactccttcgtcaacgtccgcccggcgaaggcctaccccggcgtcgacgcgctccgcccggagacggacctcgtcttcctccgggagaacaccgaaggcgtctactcgggccacgaggaccgcctctccgaggacctctcgacgctcacgcgcgtcgtcaccacctcggcgtccgagcgactcgccgagtacgcctgcgactacgtcggcggcgagggcggcagcttccaggtcgcccacaaggcgaacgtgatgcgcgagacggacggtcgcttccgcgacgccgccgtcgccgtcgccgacgagcgcggcgtcgagaccgaggaggtcctgatggacgccttcgcgacgcgcgtctgtctcgaccccacgcagttcgacaccatcgtctgtccgaacctcgcgggcgacgtgctgtcggacctcgccgccggcctcgtcggcggcctcggactgctcccctcggcgaacatcggcccggacgccgcgctgttcgaaccggtccacggctccgcgcccgacatcgccggcgagggcatcgccaacccggccgcgacgattctgtccgcggcgatgctgctcgactacctcgaccacgaggccgaagccgaccgcgtccggtcggccgtcgaaggcgtcctcgccgacgggccgcgcacgcccgacctcggcggcgacgcctccacggaggacgtgaccgccgcgattctcgaccgactctga

SEQ ID NO: 28176 - protein, 324 aa, Halobacterium volcanii
MTEEIVVIPGDGIGAEVIPAAVDVLKAVGDFEFVEADAGDHVKEETGEALPQETYDLAAEADATLFGAAGETAADVILPLRTAVDSFVNVRPAKAYPGVDALRPETDLVFLRENTEGVYSGHEDRLSEDLSTLTRVVTTSASERLAEYACDYVGGEGGSFQVAHKANVMRETDGRFRDAAVAVADERGVETEEVLMDAFATRVCLDPTQFDTIVCPNLAGDVLSDLAAGLVGGLGLLPSANIGPDAALFEPVHGSAPDIAGEGIANPAATILSAAMLLDYLDHEAEADRVRSAVEGVLADGPRTPDLGGDASTEDVTAAILDRL

SEQ ID NO: 28177 - DNA, 1098 bp, Brachydanio rerio
  CDS (1)..(1098)
atggctaacgcatggaggtcaacggtttcctgtataatgggagctatcaagactcagaccccacagcccagagtcttctccagagggattcaaactgtaacattaattcctggagatggaattggtccagagatctccactgcagtaatgaagatatttgaagcagcaaagaccccaattcaatgggaagagagaaatgtgactgctatcaagggacctggaggcaggtggatgatacctcctgaggcaaaagaatcgatggacaaaagcaaaattgggttaaaaggacccctgaaaacaccaattgctgctggccacccatccatgaacctgctgcttaggaagacctttgacctgtatgccaatgtgcgtccttgcgtgtccattgagggctataaaacaccttacactgatgtggatctagtcaccatcagagaaaacacagaaggagagtacagtgggattgaacatgtgatcgtggatggagttgttcagagtattaaactaatcacagaggaggccagcagacgcattgctgagtatgcatttgagtatgccaggaataaccaaagaaccagtgtcactgctgttcacaaagccaacatcatgcggatgtcagatggtctgtttttgcggaagtgcagagaggttgcagaaaattttaaggatgtgaaattcactgagatgtatctggatacagtgtgtctcaatatggtgcaagatccctctcagtttgatgtcctcgtaatgcctaacctttatggtgacatcttgagtgatctgtgtgctggattgattggcggtcttggagtcactcccagtgggaacattggagccaatggcgttgccatatttgaatctgtacatggaacggcgcctgatattgcaggcaaagacatggcaaaccccactgcccttttgcttagtgccgtcatgatgctgcgccacatgggactgcatggtcatgcaaaaaagattgagactgcttgctttgacaccatacgagataaaaaggttttgaccaaagatcttggtggaaactcgaagtgctcagagtttacagctgacatctgccgaagagtgcaggacatggaataa

SEQ ID NO: 28178 - protein, 365 aa, Brachydanio rerio
MANAWRSTVSCIMGAIKTQTPQPRVFSRGIQTVTLIPGDGIGPEISTAVMKIFEAAKTPIQWEERNVTAIKGPGGRWMIPPEAKESMDKSKIGLKGPLKTPIAAGHPSMNLLLRKTFDLYANVRPCVSIEGYKTPYTDVDLVTIRENTEGEYSGIEHVIVDGVVQSIKLITEEASRRIAEYAFEYARNNQRTSVTAVHKANIMRMSDGLFLRKCREVAENFKDVKFTEMYLDTVCLNMVQDPSQFDVLVMPNLYGDILSDLCAGLIGGLGVTPSGNIGANGVAIFESVHGTAPDIAGKDMANPTALLLSAVMMLRHMGLHGHAKKIETACFDTIRDKKVLTKDLGGNSKCSEFTADICRRVQDME

SEQ ID NO: 28179 - DNA, 1176 bp, Streptococcus thermophilus
  CDS (1)..(1176): transl_table=11
atggcagaaagaatccttatgactaatggcaagctcaaagttactgataatccgattattcctttcattgaaggagatggtgttggacgtgatatttggaagaatgctcaagcaatttttgataaagcggtagaagcagcctatgaaggacagcgtcgtattgagtggcaagagtttttggcaggtaaaaaggcttttgataaaacaggtgagtggttgccgcaagaaactttagaggctattcgagaaagcctggtagctattaaggggccacttgaaacacctgtcggaggaggaattcgttctttaaatgtagctttacgtcaagaacttgatctctacgcttgtgttcgaccggttcggtattttgaaggagtagcaagtccacttaaggaaccagaaaaaacagacattactatttttcgtgagaatactgaggatatttatgcaggaattgaatgggaagcaggaacggtagatgtagagcgcgttattgctttttttcaaacagaaatgaatgtcgataaaattcgctttcccaagtcaagtagtattggaattaagcctatttcaatagaaggaagtaaacgattgattcgttcagctattgactatgctcttaagaacaatctaaagaaagtaacattggtgcataaagggaatattcaaaaattcacagaaggtggctttcgtaaatggggctatgaagtggctgaggaagaatataaggaagaaatgcttgctggccgtctagaagttaatgatataatcgctgataattttctacaacagattcttttgaatcccgaaaaatttgatgttgttgcattaaccaacttgaatggcgattatgcaagtgatgctctagctgcccaggttggtggtatcggaatctcccctggagctaatattaactatcaaacaggccatgctatctttgaagctactcatggaacggctccagatattgcggatcaagatagggctaatccttgctctattctcttatctggctgtatgcttttagaatatatcggttggtctgaagcagctgaactcattataagtgctattgaaaaaaactttaaatcagggatttttacagttgacctagcctttggaaaacgagcctattcaaccagtggtttcagcaatcaaattctctcaattatatga

SEQ ID NO: 28180 - protein, 391 aa, Streptococcus thermophilus
MAERILMTNGKLKVTDNPIIPFIEGDGVGRDIWKNAQAIFDKAVEAAYEGQRRIEWQEFLAGKKAFDKTGEWLPQETLEAIRESLVAIKGPLETPVGGGIRSLNVALRQELDLYACVRPVRYFEGVASPLKEPEKTDITIFRENTEDIYAGIEWEAGTVDVERVIAFFQTEMNVDKIRFPKSSSIGIKPISIEGSKRLIRSAIDYALKNNLKKVTLVHKGNIQKFTEGGFRKWGYEVAEEEYKEEMLAGRLEVNDIIADNFLQQILLNPEKFDVVALTNLNGDYASDALAAQVGGIGISPGANINYQTGHAIFEATHGTAPDIADQDRANPCSILLSGCMLLEYIGWSEAAELIISAIEKNFKSGIFTVDLAFGKRAYSTSGFSNQILSII

SEQ ID NO: 28181 - DNA, 1299 bp, Myxococcus xanthus
  CDS (1)..(1299): n means a or g or c or t/u, s means g or c
atggcgcccccgtcatccggagaaaagatctccctgcagagcggcaagctgtccgtcccggacaacccgatcatccccttcatcgagggcgatggcaccggccgcgacatctggcgtgcgtcccaggcggtgttcgacgccgcggtggagaaggcctacaagggcaagaagaagatcgcctggtacgaagtcctggccggcgagaagtccttcaaggcggtcaacaactggctgcccgaggagacggtcgaggcgttccgcacctatctggtgggcatcaagggccccctgacgacgccggtgggcggcggcatccggtcgctgaacgtggccctgcggcagatgctggacctgtacgtctgcctgcgccccgtgcgctacttcaagggcgtgcccagcccggtgaagatgccggacaaggtcgacatgaccatcttccgtgagaacacggaagacatctacgcgggcatcgagttcgaggccggcacggccgccgcggagaagttcctgggcctgctgaagcaggagttcccgaaggagttcgggaagatccgcttcccgtccgacgtgggcctgggcatcaagccggtgtcccacgagggcagcgaccggctgatccgcgccgccatccagtacgccgtggaccacaagcgcaagagcgtcacgctggtccacaagggcaacatcatgaagttcaccgagggcgccttccgcaagtggggctacgagctggccgcccgggagttcggtgacaaggtctacacctgggaccagtgggaggccaccaaggccgncaagggcgaggacgccgccaacgcggagcagaaggccgcgctggccgccgggaagatcctgatcaaggactccatcgcggacatcaccctgcagcaggtcctcacccgtccggatgagttcgacgtcatcgccacgctgaacctcaacggtgactacctgtcggacgcgctggnggcgcaggtgggcggcatcggcatcgcgccgggcggcaacatcaactacgtcacgggccacgcggtgttcgaggccacgcacggcacggcgcccaagtacgccgaccaggacaaggtgaacccgggctcggtcatcctctccggtgagatgatgttccggcacctgggctggtacgaggcggccgacctgatgatccagggcatggaccgcgccatcgccagcaagacggtgacctacgacttcgcccgcctgatgaagcaggaagggcagagcggcgtctccgaggtcaagtgctccgagttcgggcaggccatcatcaagaacatgtag

SEQ ID NO: 28182 - protein, 432 aa, Myxococcus xanthus
  Xaa in positions 265 and 323 is unknown
MAPPSSGEKISLQSGKLSVPDNPIIPFIEGDGTGRDIWRASQAVFDAAVEKAYKGKKKIAWYEVLAGEKSFKAVNNWLPEETVEAFRTYLVGIKGPLTTPVGGGIRSLNVALRQMLDLYVCLRPVRYFKGVPSPVKMPDKVDMTIFRENTEDIYAGIEFEAGTAAAEKFLGLLKQEFPKEFGKIRFPSDVGLGIKPVSHEGSDRLIRAAIQYAVDHKRKSVTLVHKGNIMKFTEGAFRKWGYELAAREFGDKVYTWDQWEATKAXKGEDAANAEQKAALAAGKILIKDSIADITLQQVLTRPDEFDVIATLNLNGDYLSDALXAQVGGIGIAPGGNINYVTGHAVFEATHGTAPKYADQDKVNPGSVILSGEMMFRHLGWYEAADLMIQGMDRAIASKTVTYDFARLMKQEGQSGVSEVKCSEFGQAIIKNM

SEQ ID NO: 28183 - DNA, 993 bp, Brassica napus
  CDS (1)..(993)
atggctactctttttcccggtgatggaatcggccccgagatcgctgaatccgtcaaaaaggtgtttacaacggccggtgtgccgattgattgggaagaacacttcgttgggaccgagatagatccgagaacgcagagtttcttaacctgggagagtctcgaatccgtgcgcagaaacaaagtcggtttgaaagggccaatggcgactccgatcgggaaaggtcaccgttctttgaatttgactcttaggaaagagctgaatctatacgccaatgttaggccttgctacagtcttcctggctacaagactcgttacgatgatgttaatctcatcaccattagggagaacactgagggagaatacagtgggcttgaacatcaggttgttagaggtgtggtggagagtcttaagatcattacacgtcaggcgagtttgagagttgcggagtatgcttttcactatgctaagactcatgggagagagagggtttctgctattcacaaagctaacattatgcagaaaactgatggtcttttcctcaagtgttgtcgtgaggttgctgagaagtatcctgagatcacttacgaggaagtagtcattgacaactgctgtatgatgcttgtgaaaaacccagcactgtttgatgtgttggtgatgccaaacctgtacggtgacattatcagcgacttgtgtgctggattggttggaggactaggattgactccaagttgtaatataggagaagatggagtggcccttgctgaagcagttcacggttctgcacctgatatcgctggaaagaacttggcaaacccaacagcattgctactgagtggagtgatgatgttgcgtcacctgaagctgaacgaacaagcagaacagatccacagagcaatcatcaacaccatagcagagggaaaatacagaaccgcggatcttggaggaagttcgaccaccacggatttcacaaaagcaatctgtgatcatctctga

SEQ ID NO: 28184 - protein, 330 aa, Brassica napus
MATLFPGDGIGPEIAESVKKVFTTAGVPIDWEEHFVGTEIDPRTQSFLTWESLESVRRNKVGLKGPMATPIGKGHRSLNLTLRKELNLYANVRPCYSLPGYKTRYDDVNLITIRENTEGEYSGLEHQVVRGVVESLKIITRQASLRVAEYAFHYAKTHGRERVSAIHKANIMQKTDGLFLKCCREVAEKYPEITYEEVVIDNCCMMLVKNPALFDVLVMPNLYGDIISDLCAGLVGGLGLTPSCNIGEDGVALAEAVHGSAPDIAGKNLANPTALLLSGVMMLRHLKLNEQAEQIHRAIINTIAEGKYRTADLGGSSTTTDFTKAICDHL

SEQ ID NO: 28185 - DNA, 1104 bp, Brassica napus
  CDS (1)..(1104)
atgtctcgcagatcgctaactctcctcaagaacctcgccagaaactcaaacgcctcatgcatccaaacccgatccgtgacctacatgccccgacccggcgacggatccccgcgcgcagtcacgctcatccccggtgatgggatcggccctctcgtgaccaacgccgtggagcaggtgatggaagcgatgcacgcgccgatctacttcgagaagtacgacgtccagggggagatgagccgcgtgccggcggaggtgatggagtcgatacggaagaacaaggtgtgcttgaaaggcgggctcaagacccccgtgggcggcggcgtgagctcgctgaacgtgcagctgaggaaggagcttgacctctttgcctcgcttgtcaactgcttcaacttgcccgggttgcccaccaggcatgagaatgttgatatcgttgtgattagggagaatactgaaggcgagtatgctgggcttgagcatgaggttgttcctggtgttgttgagagtcttaaggtgatcacgaagttctgttcggagcgtatagcgaagtatgcttttgagtatgcttacctgaacaacaggaagaaagtgacggcggtgcacaaggctaacatcatgaagcttgctgatggtttgttcttggagtcttgtcgtgaggttgctaaaaagtatccagggatcacttacaatgagattattgtcgataactgctgcatgcaacttgtagccaagccagagcagtttgacgtcatggtaacacccaatctctatggtaatttagttgcaaacactgccgctggtattgctggaggcaccggagtcatgcctggaggaaacgttggggctgaccatgcggtgtttgagcaaggtgcatcagcaggaaatgtcgggaaagactcgatagtaaggaaaaacaaagcaaacccagtggcgttgcttctctcatcagccatgatgcttagacatcttcagtttccttcatttgctgaccggctcgaaacagcagtgaagaaagtgatctctgaaggaaagtgccggactaaagatcttggtggacaaagcactactcaagaggtcgttgacgcagtcattgcaaagttggagtga

SEQ ID NO: 28186 - protein, 367 aa, Brassica napus
MSRRSLTLLKNLARNSNASCIQTRSVTYMPRPGDGSPRAVTLIPGDGIGPLVTNAVEQVMEAMHAPIYFEKYDVQGEMSRVPAEVMESIRKNKVCLKGGLKTPVGGGVSSLNVQLRKELDLFASLVNCFNLPGLPTRHENVDIVVIRENTEGEYAGLEHEVVPGVVESLKVITKFCSERIAKYAFEYAYLNNRKKVTAVHKANIMKLADGLFLESCREVAKKYPGITYNEIIVDNCCMQLVAKPEQFDVMVTPNLYGNLVANTAAGIAGGTGVMPGGNVGADHAVFEQGASAGNVGKDSIVRKNKANPVALLLSSAMMLRHLQFPSFADRLETAVKKVISEGKCRTKDLGGQSTTQEVVDAVIAKLE

SEQ ID NO: 28187 - DNA, 1104 bp, Brassica napus
  CDS (1)..(1104)
atgtctcgcagatcgctaactctcctcaagaacctcgccagaaactcaaacgcctcatgcatccaaacccgatccgtgacctacatgccccgacccggcgacggatccccgcgcgcagtgaccctcatccccggcgatgggatcggccctctggtgacgaacgccgtggagcaggtgatggaagcgatgcacgcgccgatctacttcgagaagtacgacgtgcagggggagatgagccgcgtgccggcggaggtgatggagtcgatacggaagaacaaggtgtgcttgaaaggcgggctcaagacccccgtgggcggcggcgtgagctcgctcaacgtgcagctgaggaaggagcttgacctctttgcctcgcttgtcaactgcttcaacttgcccgggttgcccaccaggcatgagaatgttgatatcgttgtgattagggagaatactgaaggcgagtatgctgggcttgagcatgaggttgttcctggtgttgttgagagtcttaaggtgatcacgaagttctgttcggagcgtatagcgaagtatgcttttgagtatgcttacctgaacaacaggaagaaagtgacggcggtgcacaaggctaacatcatgaagcttgctgatggtttgttcttggagtcttgtcgtgaggttgctaaaaagtatccagggatcacttacaatgagattattgtcgataactgctgcatgcaacttgtagccaagccagagcagtttgacgtcatggtaacacccaatctctatggtaatttagttgcaaacactgccgctggtattgctggaggcaccggagtcatgcctggaggaaacgtgggggctgaccatgcggtgtttgagcaaggtgcatcagcaggaaatgtcgggaaagactcgatagtaagggaaaacaaagcaaacccagtggcgttgcttctctcatcagccatgatgcttagacatcttcagtttccttcatttgctgaccggctcgaaacagcagtgaagaaagtgatctctgaaggaaagtgccggactaaagatcttggtggacaaagcactactcaagaggtcgttgacgcagtcattgcaaagttggagtga

SEQ ID NO: 28188 - protein, 367 aa, Brassica napus
MSRRSLTLLKNLARNSNASCIQTRSVTYMPRPGDGSPRAVTLIPGDGIGPLVTNAVEQVMEAMHAPIYFEKYDVQGEMSRVPAEVMESIRKNKVCLKGGLKTPVGGGVSSLNVQLRKELDLFASLVNCFNLPGLPTRHENVDIVVIRENTEGEYAGLEHEVVPGVVESLKVITKFCSERIAKYAFEYAYLNNRKKVTAVHKANIMKLADGLFLESCREVAKKYPGITYNEIIVDNCCMQLVAKPEQFDVMVTPNLYGNLVANTAAGIAGGTGVMPGGNVGADHAVFEQGASAGNVGKDSIVRENKANPVALLLSSAMMLRHLQFPSFADRLETAVKKVISEGKCRTKDLGGQSTTQEVVDAVIAKLE

SEQ ID NO: 28189 - DNA, 1290 bp, Thiobacillus thiooxidans
  CDS (1)..(1290): transl_table=11
atgacgacccatattcagaaacccgcaacaggcagtcccttaacactgctgaatggggtgttgcaggtgcctgatcaacccattattcccttcattgaaggcgacggaattggttgtgatgtaaccccggccatgcgcagtgtggtggatgcggcagtggccaaagtctatggaggacagcggcagattgcctggatggagttgtttgcaggtcagaaggccgtgcaactgtatggtgaagggcagtatttgcccgatgagaccatggccgccattcgggaatataaagtcgccatcaaaggtcctctggaaactccggtgggcggggggattcgtagcctgaatgtggccatgcgtcaggatcttgatttgtatgtctgcctccggccggtgcgttattttgaggggacgcccagccccatgcggcatccggaaaaagtggatatggtcatttttcgcgaaaactccgaggacatttacgccggtattgaatggcctgcgggtagtcccgaagcagaaaaaatcatccgttttctgcgggaagaaatgggcgtcacaaaaatccgctttcccgacagctctgccattggcatcaaacccgtatcgacggaaggttcggaacgtctgatccggcgtaccattcaatacgctctggaacatggcaagccctctgtgagtctggtgcacaagggtaatatcatgaaattcaccgaaggcggtttccgtgactggggttatgccctggcggagcgggagttcgccggtcgggtgtttacctggaggcaaaaggccgccatcagcaaggcagagggtaaggcggcagggcagaaagccgagcagcaggccattgccgacgggaagctgatcatcaaggacgtgattgccgataattttctgcagcagattttgctgcgcccggaagattactctgtggttgccacgctgaacttgaatggtgactatgtttctgatgccctggccgcagaagtagggggtattggtatggcacccggtgccaacctttctgatacccacgcgatttttgaagctacccatggtacggcaccggatattgccgggcagggcaaagccaaccccagctcgctgattttgtcggctgtcatgatgctggagcatctgggctggggagaagctgctcaggcgattgtggcggccatgaatgccaccattgcggctggtgaagtcaccggtgatctggcggccttgcggggtgatgtgccggcactgagcaccacagagtttacggcagcactgatccggcgtttttaa

SEQ ID NO: 28190 - protein, 429 aa, Thiobacillus thiooxidans
MTTHIQKPATGSPLTLLNGVLQVPDQPIIPFIEGDGIGCDVTPAMRSVVDAAVAKVYGGQRQIAWMELFAGQKAVQLYGEGQYLPDETMAAIREYKVAIKGPLETPVGGGIRSLNVAMRQDLDLYVCLRPVRYFEGTPSPMRHPEKVDMVIFRENSEDIYAGIEWPAGSPEAEKIIRFLREEMGVTKIRFPDSSAIGIKPVSTEGSERLIRRTIQYALEHGKPSVSLVHKGNIMKFTEGGFRDWGYALAEREFAGRVFTWRQKAAISKAEGKAAGQKAEQQAIADGKLIIKDVIADNFLQQILLRPEDYSVVATLNLNGDYVSDALAAEVGGIGMAPGANLSDTHAIFEATHGTAPDIAGQGKANPSSLILSAVMMLEHLGWGEAAQAIVAAMNATIAAGEVTGDLAALRGDVPALSTTEFTAALIRRF

SEQ ID NO: 28191 - DNA, 1329 bp, Alcaligenes eutrophus
  CDS (1)..(1329): transl_table=11
atgccacagcgccatctccccgaatctcgccgaccggccatgaaccggcggcagtcacaaccgttccgtactggagacgtcatgtaccaacatatcaaggttccggccggcgaaaagatcacggtcaaccaggacttttcgctgaatgtcccggacaatccgatcattccttacatcgaaggcgacggtacgggcctcgatatcaccccggtgatgatcaaggtggtcgacgcggctgtggccaaggcctattgcggcaagcgcaagatcgcctggatggagatctacgccggcgagaagtccaccaaggtctacggcctggacgtgtggctgccggacgaaaccctggaggtgctcaaggattacgtggtctcgatcaagggtccgctgaccacgccggtgggcggcggcatccgctcgctgaacgtggcactgcgccagactggacctgacgtctgcctgcgcccggtgcgctacttcaagggcgtgccctcgcggtgcgtgagctcggaaaagaccgacatggtgatcttccgcgagaactcggaagacatctacgccggcatcgaatgggcggcggaaagcgagcatgcgaagaagctcatcaagttcctgcaggacgagatgggcgtgaagaagatccgcttcccgcgaacctcgggcatcggcatcaagccggtctcgcgcgagggcaccgagcgtctggtgcgcaaggcgatccagtacgccatcgacaacgacaagccgtcggtgacgctggtgcacaagggcaacatcatgaagttcaccgaaggtggcttccgtgactggggctacgagctggcgcataaggaattcggcgccgagctggtcgacggcgggccgtggtgcaagttcaagaacccgaagaccggcaaggacatcgtgatcaaggacgccattgccgacgccttcctgcagcagatcctgctgcgtccggccgaatactcggtgatcgccacgctgaacctgaacggcgactatgtctccgacgcgctggccgcacaggtcggcggcatcggcatcgccccgggcgccaatatgtctgactcggttgccatgttcgaggccacccacggcaccgcgccgaagtacgccggcaaggactacgtcaacccgggctcggaaatcctgtcggccgaaatgatgctgcgtcacatgggctggaccgaagccgcggacctgatcatctcgtcgatggagcagtcgatcctgtccaagaaggtgacgtatgacttcgcccgcctgctggaaggcgcgacgcaggtgtcgtgctcgggctttggccaggtgatgatcgacaatatgtaa

SEQ ID NO: 28192 - protein, 442 aa, Alcaligenes eutrophus
MPQRHLPESRRPAMNRRQSQPFRTGDVMYQHIKVPAGEKITVNQDFSLNVPDNPIIPYIEGDGTGLDITPVMIKVVDAAVAKAYCGKRKIAWMEIYAGEKSTKVYGLDVWLPDETLEVLKDYVVSIKGPLTTPVGGGIRSLNVALRQTGPDVCLRPVRYFKGVPSRCVSSEKTDMVIFRENSEDIYAGIEWAAESEHAKKLIKFLQDEMGVKKIRFPRTSGIGIKPVSREGTERLVRKAIQYAIDNDKPSVTLVHKGNIMKFTEGGFRDWGYELAHKEFGAELVDGGPWCKFKNPKTGKDIVIKDAIADAFLQQILLRPAEYSVIATLNLNGDYVSDALAAQVGGIGIAPGANMSDSVAMFEATHGTAPKYAGKDYVNPGSEILSAEMMLRHMGWTEAADLIISSMEQSILSKKVTYDFARLLEGATQVSCSGFGQVMIDNM

SEQ ID NO: 28193 - DNA, 1104 bp, Arabidopsis thaliana
  CDS (1)..(1104)
atgtctcgcagatcgctaactctcctcaagaatctagctagaaacgcgaatggatcaggtattcaaacccgatccgtgacttacatgcccagacccggtgacggagcaccacgcgcagtgacgctgatccccggagatggaatcggtcctctggtgacgaacgccgtggaacaggtgatggaagcgatgcacgctccgatcttcttcgagaagtacgatgttcacggagaaatgagccgtgtgccgccggaagtgatggagtcgataaggaagaataaggtttgtttgaaaggtgggcttaagactcctgttggtggtggtgttagttctcttaacgtccagcttaggaaagagcttgacctctttgcttctctggtcaactgttttaatttgcctggtttacctactcgccatgagaatgttgacatcgttgtcatcagagagaacactgaaggtgagtacgcggggcttgagcacgaggttgttcctggtgtcgttgagagtctgaaggtgatcacgaatttctgttcggagcgtattgcaaagtatgcttttgagtatgcctacctgaacaacaggaagaaagttacagcggtgcataaggctaacatcatgaaacttgcggatggtttgttcttggaatcttgtcgcgaggttgcgaaaaagtatcccagcatcacctacaatgaaatcattgttgataactgctgtatgcaacttgtagccaaaccagagcaattcgatgtcatggtaacgccgaatctctatgggaatttagttgcaaacactgctgctggtattgctggaggcacaggagtcatgcctggaggaaatgttggggctgaccatgcggtattcgagcaaggtgcatcagcaggaaatgttgggaaagacaagatagtattggaaaacaaagcaaacccagtggcattgcttctctcatcagcgatgatgcttagacaccttcagtttccttcatttgctgaccggctcgaaacagcagtgaagaaagtcatcgctgaaggaaagttccggacgaaagatcttggtggaacaagcacgactcaagaggtcgttgatgcggtcattgcaaaactagactga

SEQ ID NO: 28194 - protein, 367 aa, Arabidopsis thaliana
MSRRSLTLLKNLARNANGSGIQTRSVTYMPRPGDGAPRAVTLIPGDGIGPLVTNAVEQVMEAMHAPIFFEKYDVHGEMSRVPPEVMESIRKNKVCLKGGLKTPVGGGVSSLNVQLRKELDLFASLVNCFNLPGLPTRHENVDIVVIRENTEGEYAGLEHEVVPGVVESLKVITNFCSERIAKYAFEYAYLNNRKKVTAVHKANIMKLADGLFLESCREVAKKYPSITYNEIIVDNCCMQLVAKPEQFDVMVTPNLYGNLVANTAAGIAGGTGVMPGGNVGADHAVFEQGASAGNVGKDKIVLENKANPVALLLSSAMMLRHLQFPSFADRLETAVKKVIAEGKFRTKDLGGTSTTQEVVDAVIAKLD

SEQ ID NO: 28195 - DNA, 1125 bp, Arabidopsis thaliana
  CDS (1)..(1125)
atgaccattacagcatttctcgcgagacggcttatcggtaacggatcgagccagattctcgggacttcgagttctagctccggtccgttcatttccgtttctagggctttcttctcctcctccactccgatcaaagctactctctttcccggtgatgggatcggtcccgaaatcgctgaatctgtcaagcaggtgtttactgccgctgatgtggttattgattgggacgaacagtttgttggtactgaagtagatcctagaaccaatagtttcttgacatgggataatcttcaatctgtgcttaaaaacaaggttggtttgaaaggaccaatggctactccaattggaaagggtcaccgttccttgaaccttactcttaggaaagagctgaatttgtatgccaatgttaggccttgttacagtcttcctggttacaaaacccgttatgatgatgttgatctcattaccattcgtgagaacactgaaggagagtacagtgggcttgaacaccaggtcgtcaagggtgtagtggaaagtcttaaaattattacccgtaaggcgagtatgagagttgccgagtatgcctttctttatgccaagactcacggaaggaagaaagtttctgcaattcacaaagccaacattatgcagaaaactgatggtcttttcctgcagtgttgtgatgaagttgctgcgaagtatcctgagatatattacgagaaggttgttattgacaattgctgtatgatgcttgtgaaaaacccagcactttttgatgtcttggtgatgccaaatctctatggagatattatcagcgatttgtgtgctggacttgttgggggactaggactgactcctagtatgaatattggggaggatggtattgcccttgctgaagctgttcacggctctgcacctgatattgctggaatgaacctggcgaacccaacagctttgctactgagtggagtgatgatgttgcggcacctgaagctcaacaaacaagcagagcaaatccacagtgccatcatcaacacaatagccgagggaaagtatagaactgctgatctcggaggttcctcaactacaacagatttcacaaaagccatctgtgatcatctctaa

SEQ ID NO: 28196 - protein, 374 aa, Arabidopsis thaliana
MTITAFLARRLIGNGSSQILGTSSSSSGPFISVSRAFFSSSTPIKATLFPGDGIGPEIAESVKQVFTAADVVIDWDEQFVGTEVDPRTNSFLTWDNLQSVLKNKVGLKGPMATPIGKGHRSLNLTLRKELNLYANVRPCYSLPGYKTRYDDVDLITIRENTEGEYSGLEHQVVKGVVESLKIITRKASMRVAEYAFLYAKTHGRKKVSAIHKANIMQKTDGLFLQCCDEVAAKYPEIYYEKVVIDNCCMMLVKNPALFDVLVMPNLYGDIISDLCAGLVGGLGLTPSMNIGEDGIALAEAVHGSAPDIAGMNLANPTALLLSGVMMLRHLKLNKQAEQIHSAIINTIAEGKYRTADLGGSSTTTDFTKAICDHL

SEQ ID NO: 28197 - DNA, 1047 bp, Coccidioides immitis
  CDS (1)..(1047)
atggctgaaaaaatcgctaagtttcctggtacaaagggacctgatggcaaatataccgtgacattgatcgaaggagacggaattggacctgagatatcgcaatctgttaaggatatcttcagtgctgcaaaggtgccaattaaatgggaacccgtcgacgttactccaatcttaaaggacggcaaaactgccattcccgatgaagctatcaacagtgtgaaaaaaaactatgttgcattaaaagggccgcttgctaccccagtaggcaagggccacgtttccttgaacctaaccctccgaagaactttcaatctgttcgcaaatgttcgaccttgtcgttcaattgccggctacaaaaccccgtatgataacgtcaacgcggtccttatacgcgagaacacggaaggcgaatactctggcattgaacacgtcgtggtagatggtgttgttcaaagtatcaaacttattacacgggaagcttcagaacgcgtcctccgctttgctttccagtatgcgcaagaggtcggcaagcccaaagtccgcgctgttcacaaggccactatcatgaagatgtcagatgggcttttcttgcggaccgccaaagaaatttcaaaagaattcccggatattgaattcgacgcagagctccttgataacacatgcttgaggatggtcactgatccagccccgtacaatgacaaggttcttgtgatgcctaacctttatggagacatcctgtccgatatgtgtgcaggtctcatcggtggtcttggtttaaccccatccggtaacattggaaacgagtgctctatttttgaggctgtccatggatctgctcccgatattgctggcagggcattggccaaccctaccgctcttttgctgagcagtattatgatgctccgacacatgggattgaacgaccatgctaagaagatcgagactgctattttcgaaacccttgcagagggaaagaccctcactggtgaccttggtggtaaagctaagacacacgaatatgctggcgccatcattaagcgcctataa

SEQ ID NO: 28198 - protein, 348 aa, Coccidioides immitis
MAEKIAKFPGTKGPDGKYTVTLIEGDGIGPEISQSVKDIFSAAKVPIKWEPVDVTPILKDGKTAIPDEAINSVKKNYVALKGPLATPVGKGHVSLNLTLRRTFNLFANVRPCRSIAGYKTPYDNVNAVLIRENTEGEYSGIEHVVVDGVVQSIKLITREASERVLRFAFQYAQEVGKPKVRAVHKATIMKMSDGLFLRTAKEISKEFPDIEFDAELLDNTCLRMVTDPAPYNDKVLVMPNLYGDILSDMCAGLIGGLGLTPSGNIGNECSIFEAVHGSAPDIAGRALANPTALLLSSIMMLRHMGLNDHAKKIETAIFETLAEGKTLTGDLGGKAKTHEYAGAIIKRL

SEQ ID NO: 28199 - DNA, 1218 bp, Thermoplasma acidophilum
  CDS (1)..(1218): transl_table=11
atggcatatattcaagtgaaggacgatggaacccttcaggttcctgatagagtaactataggatatatagagggcgatgggatagggcctgacatatccaagacaacgataaacgtactcaacgctgctcttgaaatagcctatggtggaaagcgttcaatagagtggaagaagatactcgctggggatgaagcctacgataagacgggtgacaggctgccacagtcatcgctggacgaactgaagaagtgtgttgtggcgctgaaggggcccctcacaacgccgataggtgaaggcttcaggagccttaacgtcacgctgaggcagtacctcgatctttatgcgaacatcagaccggtaagatacttcccaggcgtgccttcccccgtggttcatccggaatatatgaacatggtcgtcttcagggagaacaccgaggatctgtacgccggaatagaatggaggtacgattcggacgggccaaagaaggtcagggaattcctggcgtcaacattcaacataaacctcacggccgatacaggcatagggataaagccaataagcaagttcaagtcaacgaggcttgtcaggaaggccatacagtacgccatagccaacaagaggaagagcgtcacgcttgtgcacaagggaaacataatgaagtacacggagggtgccttcaaggaatggggctatgaggttgcaaagacggagttcggcaactacacggtgacggaaacggaataccttcaggatcctgagaaatactcaaacaagatcgtcataaaggatcgcataacggacaacatgttccagcaggttctgaccaggactcaggagtacgatgtcattgctacgcctaacctgaacggcgattacctttcggacgctctggcggcacaggtaggcggcataggcctggcaccaggagcgaacataggtgaccactacgccgtgtttgaggcagtgcatggaaccgcaccgaagtacgccggcatggacgtcgcaaacccaacatcgctgatactctcgggagaaatgatgctgcagcacattggctggaacgaggccgctaacatactagatgaggccataatgcagacatacaaggatcagaagctgacgcaggacattgcgaggcttctcaacgtaaaagcacttaaatgctctgaattcggtgaggagataataaacaggatgaaaaagcctgttcactga

SEQ ID NO: 28200 - protein, 405 aa, Thermoplasma acidophilum
MAYIQVKDDGTLQVPDRVTIGYIEGDGIGPDISKTTINVLNAALEIAYGGKRSIEWKKILAGDEAYDKTGDRLPQSSLDELKKCVVALKGPLTTPIGEGFRSLNVTLRQYLDLYANIRPVRYFPGVPSPVVHPEYMNMVVFRENTEDLYAGIEWRYDSDGPKKVREFLASTFNINLTADTGIGIKPISKFKSTRLVRKAIQYAIANKRKSVTLVHKGNIMKYTEGAFKEWGYEVAKTEFGNYTVTETEYLQDPEKYSNKIVIKDRITDNMFQQVLTRTQEYDVIATPNLNGDYLSDALAAQVGGIGLAPGANIGDHYAVFEAVHGTAPKYAGMDVANPTSLILSGEMMLQHIGWNEAANILDEAIMQTYKDQKLTQDIARLLNVKALKCSEFGEEIINRMKKPVH

SEQ ID NO: 28201 - DNA, 1260 bp, Halobacterium volcanii
  CDS (1)..(1260): transl_table=11
atgagctacgaccagattgaggttccggacgacggcgagaaaatcacggtcgacgaggagacgggcgagctctccgtccccgacaacccgattattccgatcatccacggcgacggaatcggaacggacgtcggccccgccgcacagaaggtcctcgacgccgccgccgaggcgaccggccgctctgtctcttggatgcgcgtctacgccggttcgtccgcccgcgacaagtacgacgagaacctcccggaggacacggtaagcgccatccgcaaccaccgcgtcgcaatcaagggcccgctcacgacacccgtcggtgccggcttccgctcgctcaacgtcgcgctccgcaagaagctcgacctctacgcgaacgtccgcccgacctaccacctcgacggcgtcccgtcgcccgtgaagaacccctcggcgatggacatggtcacgttccgcgagaacaccgaagacgtgtacgccggcatcgagtgggaagccggcaccgacgaggtccagaaggtcaaggagttcgtcgaagaagagatgggcgcggacggcgtcatccacgacggtcccgtcggcatcggcatcaagcccatcaccgagttcgggacgaagcgcctcgtccgcgaggctatcgagtacgccctcgaaaacgaccgcccgtcggtcacgctcgtccacaagggcaacatcatgaagttcaccgagggtgccttccgtgactggggctacgaactcgcagaagaggagttcggcgacgtcaccatcaccgaagacgaactgtgggaagagtacgacggcaagcgtcccgaggacaaggtcgttgtcaaggaccgcatcgccgacaacatgctccagcagcttctcacccgcaccgccaactacgatgtcatcgccacgatgaacctcaacggcgactacatgtccgacgccgccggcgcgcagattggcggcctcggcatcgcccccggtgcgaacttcggtgagggcctctgtctcgcagagcccgtccacggctccgcacccaagtacgccggcaaggacaaggtcaacccgaccgcgatgattctctccggccgtctcatgttcgagtacatgggctggaaggacgccggtaagctcatccgcgacaccgtcgagaagaccatctcggacggcgacgtgacctacgacctcgaacgccagatcgagggcggcaacaagctcgccacgagcgagtacgccgacaaggtcgtcgagaacatcaaagagttagcttaa

SEQ ID NO: 28202 - protein, 419 aa, Halobacterium volcanii
MSYDQIEVPDDGEKITVDEETGELSVPDNPIIPIIHGDGIGTDVGPAAQKVLDAAAEATGRSVSWMRVYAGSSARDKYDENLPEDTVSAIRNHRVAIKGPLTTPVGAGFRSLNVALRKKLDLYANVRPTYHLDGVPSPVKNPSAMDMVTFRENTEDVYAGIEWEAGTDEVQKVKEFVEEEMGADGVIHDGPVGIGIKPITEFGTKRLVREAIEYALENDRPSVTLVHKGNIMKFTEGAFRDWGYELAEEEFGDVTITEDELWEEYDGKRPEDKVVVKDRIADNMLQQLLTRTANYDVIATMNLNGDYMSDAAGAQIGGLGIAPGANFGEGLCLAEPVHGSAPKYAGKDKVNPTAMILSGRLMFEYMGWKDAGKLIRDTVEKTISDGDVTYDLERQIEGGNKLATSEYADKVVENIKELA

SEQ ID NO: 28203 - DNA, 1182 bp, Escherichia coli
  CDS (1)..(1182): transl_table=11
atgaagatcaccctgcaaaacggcaaactcaacgttcctgaaaatccgattatcccttacattgaaggtgatggaatcggtgtagatgtaaccccagccatgctgaaagtggtcgacgctgcagtcgagaaagcctataaaggcgagcgtaaaatctcctggatggaaatttacaccggtgaaaaatccacacaggtttatggtcaggatgtctggctgcctgctgaaacccttgatctgattcgtgaatatcgcgttgccattaaaggtccgctgaccactcctgttggtggcggtattcgctctctgaacgttgccctgcgccaggaactggatctctacatctgcctgcgtccggtacgttactatcaaggcactccaagcccggttaaacaccctgaactgaccgatatggttatcttccgtgaaaactcggaagacatttatgcgggtatcgaatggaaagcagactctgccgacgccgagaaagtgattaaattcctgcgtgaagagatgggcgtgaagaaaattcgcttcccggaacattgcggtatcggtatcaagccgtgttctgaagaaggcaccaaacgtctggtccgtgccgcgattgaatacgcaattgccaacgaccgtgactctgtgaccctggtgcacaaaggcaacatcatgaagttcaccgaaggcgcgtttaaagactggggctaccagctggcgcgtgaagagtttggcggtgaactgatcgacggcggcccgtggctgaaagttaaaaacccgaacaccggcaaagagatcgtcattaaagacgtgattgctgatgcattcctgcaacagatcctgctgcgtccggctgaatatgatgttatcgcctgtatgaacctgaacggtgactacatttctgacgccctggcagcgcaggttggcggtatcggtatcgcccctggtgcaaacatcggtgacgaatgcgccctgtttgaagccacccacggtactgcgccgaaatacgccggtcaggacaaagtaaaccctggctctattattctctccgctgagatgatgttacgccatatgggttggactgaagccgctgacctgattgttaaaggtatggaaggtgcaatcaacgccaagaccgtaacctatgacttcgaacgtctgatggaaggcgctaagctgctgaaatag

SEQ ID NO: 28204 - protein, 393 aa, Escherichia coli
MKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLK

SEQ ID NO: 28205 - DNA, 1119 bp, Arabidopsis thaliana
  CDS (1)..(1119)
atggcagcaaatctagcgcgacggctgatcggaaaccgatcgactcagatccttggagccgtgaactctagctcaggtgcggctagttctgtcgctagggctttctgctcctccaccactccgatcaccgcaactctcttccctggcgatgggatcggtcccgagatcgccgaatctgtcaaaaaggtgtttacaacagctggtgtaccaattgagtgggaagaacactatgttgggactgagatagatccgagaacacagagtttcttgacatgggaaagtctcgaatctgtgcgtagaaacaaagttggtttgaaaggtccaatggctactccaattgggaaaggtcaccgttctttgaacctgactcttaggaaagagcttaatctatatgccaatgttagaccttgttacagtcttcctggttacaaaactcgttacgatgatgttgatctcattaccatcagagaaaacacggaaggagaatacagtggccttgaacatcaggttgttagaggtgtggtggaaagtcttaaaatcattacccgtcaggcgagtttgagagttgcagagtatgcttttctctatgccaagactcatggaagagagagagtttctgctatccacaaagccaacattatgcagaaaactgacggtctctttctcaagtgttgtcgtgaggttgctgagaagtatcctgagatcacttacgaggaggtcgttattgacaactgctgtatgatgcttgtgaaaaacccagcactttttgatgtcttggtgatgccaaacctgtacggtgacattattagcgatctgtgtgccggattggttggaggactaggattgactccaagttgtaatattggagaagatggtgtagcccttgctgaagcagttcacggttctgcacctgatatcgctggaaagaacttggcgaacccaaccgcgttgcttctgagtggagtgatgatgttgcgtcacctgaagttcaacgaacaagcagaacaaatccacagtgcaatcatcaacaccatagcagagggcaaatacagaaccgcggatcttggaggtagttcgaccaccacggaattcacaaaggcaatctgtgatcatctctga

SEQ ID NO: 28206 - protein, 372 aa, Arabidopsis thaliana
MAANLARRLIGNRSTQILGAVNSSSGAASSVARAFCSSTTPITATLFPGDGIGPEIAESVKKVFTTAGVPIEWEEHYVGTEIDPRTQSFLTWESLESVRRNKVGLKGPMATPIGKGHRSLNLTLRKELNLYANVRPCYSLPGYKTRYDDVDLITIRENTEGEYSGLEHQVVRGVVESLKIITRQASLRVAEYAFLYAKTHGRERVSAIHKANIMQKTDGLFLKCCREVAEKYPEITYEEVVIDNCCMMLVKNPALFDVLVMPNLYGDIISDLCAGLVGGLGLTPSCNIGEDGVALAEAVHGSAPDIAGKNLANPTALLLSGVMMLRHLKFNEQAEQIHSAIINTIAEGKYRTADLGGSSTTTEFTKAICDHL

SEQ ID NO: 28207 - DNA, 1284 bp, Coxiella burnetii
  CDS (1)..(1284): transl_table=11
atgacggagttaaccggagtatccatcgtgacttaccaacacatcaaagttcccagccaaggtgaaaaaatcaccgttaataaagccgttttagaagttcctgaccgacccattattccctttatcgaaggagatgggattggcattgatatcacgcccgtcatgaaaaacgtggtcgatgccgccgtggaaaaatcctacgctggaaagcgaaaaattgaatggatggagatctacgccggagaaaaggctacgaaagtgtatggcaaagacaattggctgcctgatgagacactcgaagccattaaggaataccaagtggccattaaaggtcccttaaccacgccggtggggggtggcatacgttcgctcaatgtcgcgctgcgccaacagttagacctgtatgtttgccttaggcccgtccgttattttacgggtgtgccaagcccggtcaaaacgcctgaaaaggtgaatatggtgattttccgcgaaaattccgaagatatttacgccggaattgaatggccggcgggaagcccggaagcggtgaaattaatcaacttccttcaaaacgaaatgggcgtaaagaaaatccgtttcccggaaacggcggggatagggattaaaccggtttctaaagaaggcacgagccgtttagtacgccgagcgattcaatatgccattgataatgaccgcgattccgtgacgctcgtccataaaggtaacatcatgaaattcacggagggggcttttaaagattggggctatgaagtcgctgtcaaagaatttggagcaaagcccttagatggcggaccctggcatgtctttgagaatccgaaaacaggccaaaagattacgattaaagacgttattgccgacgcctttttacaacaaattttattgcgtcccgccgagtacagcgtcatcgccaccttgaacctcaatggagattatatctccgacgcgttagcggccgaagtcggcggcattggcattgctccgggcgctaatttaagcgacaccgtcggtctttttgaagccactcatgggacagcgcctaaatatgcggggcaagataaagtcaatccaggctctctaattttatcagcagaaatgatgctccgttacctaggctggaaagaagccgccgaccttgtcgttcaaggtattgagggggcgattgaaagcaaaacagtaacttacgattttgcccgtttgatgaccggcgccaaagaagtaagtacctctcagttcggcaaagccataattaagcatattctgtag

SEQ ID NO: 28208 - protein, 427 aa, Coxiella burnetii
MTELTGVSIVTYQHIKVPSQGEKITVNKAVLEVPDRPIIPFIEGDGIGIDITPVMKNVVDAAVEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 28209 - DNA, 1284 bp, Coxiella burnetii
  CDS (1)..(1284): transl_table=11
atgacggagttaaccggagtatccatcgtgacttaccaacacatcaaagttcccagccaaggtgaaaaaatcaccgttaataaagccgttttagaagttcctgaccgacccattattccctttatcgaaggagatgggattggcattgatatcacgcccgtcatgaaaaacgtggtcgatgccgccgcggaaaaatcctacgctggaaagcgaaaaattgaatggatggagatctacgccggagaaaaggctacgaaagtgtatggcaaagacaattggctgcctgatgagacactcgaagccattaaggaataccaagtggccattaaaggtcccttaaccacgccggtggggggtggcatacgttcgctcaatgtcgcgctgcgccaacagttagacctgtatgtttgccttaggcccgtccgttattttacgggtgtgccaagcccggtcaaaacgcctgaaaaggtgaatatggtgattttccgcgaaaattccgaagatatttacgccggaattgaatggccggcgggaagcccggaagcggtgaaattaatcaacttccttcaaaacgaaatgggcgtaaagaaaatccgtttcccggaaacggcggggatagggattaaaccggtttctaaagaaggcacgagccgtttagtacgccgagcgattcaatatgccattgataatgaccgcgattccgtgacgctcgtccataaaggtaacatcatgaaattcacggagggggcttttaaagattggggctatgaagtcgctgtcaaagaatttggagcaaagcccttagatggcggaccctggcatgtctttgagaatccgaaaacaggccaaaagattacgattaaagacgttattgccgacgcctttttacaacaaattttattgcgtcccgccgagtacagcgtcatcgccaccttgaacctcaatggagattatatctccgacgcgttagcggccgaagtcggcggcattggcattgctccgggcgctaatttaagcgacaccgtcggtctttttgaagccactcatgggacagcgcctaaatatgcggggcaagataaagtcaatccaggctctctaattttatcagcagaaatgatgctccgttacctaggctggaaagaagccgccgaccttgtcgttcaaggtattgagggggcgattgaaagcaaaacagtaacttacgattttgcccgtttgatgaccggcgccaaagaagtaagtacctctcagttcggcaaagccataattaagcatattctgtag

SEQ ID NO: 28210 - protein, 427 aa, Coxiella burnetii
MTELTGVSIVTYQHIKVPSQGEKITVNKAVLEVPDRPIIPFIEGDGIGIDITPVMKNVVDAAAEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 28211 - DNA, 1284 bp, Coxiella burnetii
  CDS (1)..(1284): transl_table=11
atgacggagttaaccggagtatccatcgtgacttaccaacacatcaaagttcccagccaaggtgaaaaaatcaccgttaataaagccgttttagaagttcctgaccgacccattattccctttatcgaaggagatgggattggcattgatatcgcgcccgtcatgaaaaacgtggtcgatgccgccgtggaaaaatcctacgctggaaagcgaaaaattgaatggatggagatctacgccggagaaaaggctacgaaagtgtatggcaaagacaattggctgcctgatgagacactcgaagccattaaaggataccaagtggccattaaaggtcccttaaccacgccggtggggggtggcatacgttcgctcaatgtcgcgctgcgccaacagttagacctgtatgtttgccttaggcccgtccgttattttacgggtgtgccaagcccggtcaaaacgcctgaaaaggtgaatatggtgattttccgcgaaaattctgaagatatttacgccggaattgaatggccggccggaagcccggaagcggtgaaattaatcaacttccttcaaaacgaaatgggcgtaaagaaaatccgtttcccggaaacggcggggatagggattaaaccggtttctaaagaaggcacgagccgtttagtacgccgagcgattcaatatgccattgataatgaccgcgattccgtgacgctcgtccataaaggtaacatcatgaaattcacggagggggcttttaaagattggggctatgaagtcgctgtcaaagaatttggagcaaagcccttagatggcggaccctggcatgtctttgagaatccgaaaacaggccaaaagattacgattaaagacgttattgccgacgcctttttacaacaaattttattgcgtcccgccgagtacagcgtcatcgccaccttgaacctcaatggagattatatctccgacgcgttagcggccgaagtcggcggcattggcattgctccgggcgctaatttaagcgacaccgtcggtctttttgaagccactcatgggacagcgcctaaatatgcggggcaagataaagtcaatccaggctctctaattttatcagcagaaatgatgctccgttacctaggctggaaagaagccgccgaccttgtcgttcaaggtattgagggggcgattgaaagtaaaacagtaacttacgattttgcccgtttgatgaccggcgccaaagaagtaagtacctctcagttcggcaaagccataattaagcatattctgtag

SEQ ID NO: 28212 - protein, 427 aa, Coxiella burnetii
MTELTGVSIVTYQHIKVPSQGEKITVNKAVLEVPDRPIIPFIEGDGIGIDIAPVMKNVVDAAVEKSYAGKRKIEWMEIYAGEKATKVYGKDNWLPDETLEAIKGYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 28213 - DNA, 1284 bp, Coxiella burnetii
  CDS (1)..(1284): transl_table=11
atgacggagttaaccggagtatccatcgtgacttaccaacacatcaaagttcccagccaaggtgaaaaaatcaccgttaataaagccgttttagtagttcctgaccgacccattattccctttatcgaaggagatgggattggcattgatatcgcgcccgtcatgaaaaacgtggtcgatgccgccgtggaaaaatcctacgctggaaagcgaaaaattgaatggatggagatctacgccggagaaaaggctacgaaagtgtatggcaaagacaattggctgcctgatgagacactcgaagccattaaagaataccaagtggccattaaaggtcccttaaccacgccggtggggggtggcatacgttcgctcaatgtcgcgctgcgccaacagttagacctgtatgtttgccttaggcccgtccgttattttacgggtgtgccaagcccggtcaaaacgcctgaaaaggtgaatatggtgattttccgcgaaaattctgaagatatttacgccggaattgaatggccggcgggaagcccggaagcggtgaaattaatcaacttccttcaaaacgaaatgggcgtaaagaaaatccgtttcccggaaacggcggggatagggattaaaccggtttctaaagaaggcacgagccgtttagtacgccgagcgattcaatatgccattgataatgaccgcgattccgtgacgctcgtccataaaggtaacatcatgaaattcacggagggggcttttaaagattggggctatgaagtcgctgtcaaagaatttggagcaaagcccttagatggcggaccctggcatgtctttgagaatccgaaaacaggccaaaagattacgattaaagacgttattgccgacgcctttttacaacaaattttattgcgtcccgccgagtacagcgtcatcgccaccttgaacctcaatggagattatatctccgacgcgttagcggccgaagtcggcggcattggcattgctccgggcgctaatttaagcgacaccgtcggtctttttgaagccactcatgggacagcgcctaaatatgcggggcaagataaagtcaatccaggctctctaattttatcagcagaaatgatgctccgttacctaggctggaaagaagccgccgaccttgtcgttcaaggtattgagggggcgattgaaagtaaaacagtaacttacgattttgcccgtttgatgaccggcgccaaagaagtaagtacctctcagttcggcaaagccataattaagcatattctgtag

SEQ ID NO: 28214 - protein, 427 aa, Coxiella burnetii
MTELTGVSIVTYQHIKVPSQGEKITVNKAVLVVPDRPIIPFIEGDGIGIDIAPVMKNVVDAAVEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 28215 - DNA, 1074 bp, Nicotiana tabacum
  CDS (1)..(1074)
atggctcgaaaatccttcccaatcctaaaacaactcatccaacaatccaccaatcgttttttcaccactaacgcgtcgccacgagccgtgacgctgatcccaggcgacggcgttggtccactggtaaccgattcagtggaacaagtgatgcaggcgatgaaagcacccgtttacttcgagcgatacgaagtacgcggtgatatgaaatgtataccggaggaagtaattgattcaattaagaagaataaggtttgtttaaaaggagggttaaagacaccggtcggcggaggtgttagttcgctgaatgtgcttatgaggaaagaacttgatctgtccgcttctattgtgcattgtttcactttcccagggttgcctacgcggcatgaggatgtggatattgttgtgattagggagaatactgagggagagtatgcaggtcttgagcatgaggttgttcctggcgtcgttgagagccttaaggtgataacaaaatattgttcagagcgtatagcaaaatttgcgtttgagtatgctgatgtaaacaaaagaaagaaggtcacagctgtgcacaaagccaacattatgaaacttgcagatggtcttttcctaaaatcttgtagggaagttgcaagtaaatatccagaaatacagtatgaggagattattgtggacaactgctgcatgcaacttgtctcaaggccagaacaatttgatgtcatggtgactcccaacctctacggaaatctaattgcaaatacagctgctggtttagctggtggcacaggagtcttgccaggaggaaatgttggactgatcaagccagtttttgagcaaggtgcttcacctgggaatgttggccatgaaaaaattttgaagcttaagaaagcaaatccagtggcacttcttctgtcgtcagcaatgatgcttcgacatcttgaatttccatcatttgctgatcgtttagaaacagctgtaaaacgtgtaatagcagagggaaaagtcaggacaaaggaccttggaggggatagcactacccaagaagttgttgatgcaattatagctgctctagactaa

SEQ ID NO: 28216 - protein, 357 aa, Nicotiana tabacum
MARKSFPILKQLIQQSTNRFFTTNASPRAVTLIPGDGVGPLVTDSVEQVMQAMKAPVYFERYEVRGDMKCIPEEVIDSIKKNKVCLKGGLKTPVGGGVSSLNVLMRKELDLSASIVHCFTFPGLPTRHEDVDIVVIRENTEGEYAGLEHEVVPGVVESLKVITKYCSERIAKFAFEYADVNKRKKVTAVHKANIMKLADGLFLKSCREVASKYPEIQYEEIIVDNCCMQLVSRPEQFDVMVTPNLYGNLIANTAAGLAGGTGVLPGGNVGLIKPVFEQGASPGNVGHEKILKLKKANPVALLLSSAMMLRHLEFPSFADRLETAVKRVIAEGKVRTKDLGGDSTTQEVVDAIIAALD

SEQ ID NO: 28217 - DNA, 1116 bp, Nicotiana tabacum
  CDS (1)..(1116)
atggccaaacgaaccctacctcttctcaggcacctcctcagctccccatcccatggcttttcccattcattaacgtcaacccgatccgtcacctacatgccccgacccggtgatggcacaccacgcgccgtcactctcatccctggtgacgggatcgggccgctcgtcaccggcgctgtcgaacaagtcatggacgcgatgcacgctcctgtgtacttcgagcgatacgacgttcacggcgacatgaagagtgtgcctccagaggttatggaatcgatccggaagaataaggtctgtttaaaaggaggattgaagactcctgtgggtggtggtgttagttcccttaacgttcagcttaggaaggagcttgatctatatgcttcccttgttcactgcttcaacttgcaaggattacctacgcgtcatgagaacgtggatattgttgtcatcagggaaaatactgagggtgaatattccggcttggaacatgaggttgttcctggtgtcgttgaaagccttaaggtgatgacaaagttttgctcggaacgaattgcaaaatatgcctttgaatatgcatacctcaacaatcgcaaggtattgactgctgtgcacaaagcaaacattatgaaacttgcagatggtttatttttggagtcttgtcccgaggttgcaaccaaatatcctgggatcaagtacaatgaaatcattgtggacaactgttgcatgcaacttgtttcaaggcctgagcaatttgatgttatggtcactccaaatctctacggaaatctggtggcaaatacagcagctggtattgctggaggcactggtgttatgcctggaggcaatgtgggggctgaccatgctgtgtttgagcaaggtgcttcagcaggaaatgtaggaaatgagaagatactagagcaaaagaaggcgaatccagttgccttgtttctttcatcagccatgatgttgagacatctgcagtttccttcatttgcagatagactaaagacttcggtgaagcgtgtaattgctgagggtaaatacatgaccaaagatcttggtggaaattgcaccacccaagaaatcacggatgctgtcattgcaaatctggactaa

SEQ ID NO: 28218 - protein, 371 aa, Nicotiana tabacum
MAKRTLPLLRHLLSSPSHGFSHSLTSTRSVTYMPRPGDGTPRAVTLIPGDGIGPLVTGAVEQVMDAMHAPVYFERYDVHGDMKSVPPEVMESIRKNKVCLKGGLKTPVGGGVSSLNVQLRKELDLYASLVHCFNLQGLPTRHENVDIVVIRENTEGEYSGLEHEVVPGVVESLKVMTKFCSERIAKYAFEYAYLNNRKVLTAVHKANIMKLADGLFLESCPEVATKYPGIKYNEIIVDNCCMQLVSRPEQFDVMVTPNLYGNLVANTAAGIAGGTGVMPGGNVGADHAVFEQGASAGNVGNEKILEQKKANPVALFLSSAMMLRHLQFPSFADRLKTSVKRVIAEGKYMTKDLGGNCTTQEITDAVIANLD

SEQ ID NO: 28219 - DNA, 1044 bp, Methanococcus jannaschii
  CDS (1)..(1044): transl_table=11
atgatgaaggtgtgtgttatagaaggggatggaataggaaaagaagtgattccagaggccataaaaatattaaatgagttgggagagtttgaaataataaaaggagaggcaggattagaatgtttaaaaaaatatggtaatgcacttccagaggatacaatagaaaaagctaaagaggcagatattattttgtttggggctataacctcaccaaagccaggggaagttcaaaattataaaagccctataataacgttgaggaagatgtttcatttatatgcaaatgtaagaccaataaacaactttggaattggacaattaattgggaaaattgcagattatgaattcttaaatgctaagaatattgatatagttattataagagagaatacggaagatttatatgttggtagagagagattagaaaatgatacagcaatagctgagagggttataacaagaaagggtagcgagagaataataagatttgcatttgaatatgctataaaaaataataggaaaaaggtatcttgcatccataaagctaatgttttaagaataactgatggtttattcttagaggtttttaatgaaataaaaaaacattataatatagaggcagatgattatttagttgattcaacagctatgaacttaataaaacatcctgaaaaatttgatgttattgttacaacaaacatgtttggggatattttatcagatgaggcatctgcattaattggaggacttggtttagctccttcagcaaatataggagatgataaagcattatttgagccagttcatggttcagctccagatatagctgggaaaggtatagcaaatccaatggcatctatattaagtattgctatgctttttgattatattggagagaaagaaaagggagatttgattagagaggcagtgaaatactgcttaataaacaaaaaagttactcctgacttgggaggggatttaaagacaaaagatgttggagacgaaattctaaattacattagaaagaagttaaagggatattga

SEQ ID NO: 28220 - protein, 347 aa, Methanococcus jannaschii
MMKVCVIEGDGIGKEVIPEAIKILNELGEFEIIKGEAGLECLKKYGNALPEDTIEKAKEADIILFGAITSPKPGEVQNYKSPIITLRKMFHLYANVRPINNFGIGQLIGKIADYEFLNAKNIDIVIIRENTEDLYVGRERLENDTAIAERVITRKGSERIIRFAFEYAIKNNRKKVSCIHKANVLRITDGLFLEVFNEIKKHYNIEADDYLVDSTAMNLIKHPEKFDVIVTTNMFGDILSDEASALIGGLGLAPSANIGDDKALFEPVHGSAPDIAGKGIANPMASILSIAMLFDYIGEKEKGDLIREAVKYCLINKKVTPDLGGDLKTKDVGDEILNYIRKKLKGY

SEQ ID NO: 28221 - DNA, 1167 bp, Ajellomyces capsulata
  CDS (1)..(1167)
atgttctctctgagaaccgcgcagccagcgcagtctcttttccgcgctgcgacgaatacttactcgacatctctccctcgctccgcaattgctgctagatcattcgctaccgtgcaatcggacatcttcaagcctaccaagtatggcggcaaatacacagttacgctgatcccaggcgacggcatcggcacggaagtagcagaatcagtgaaaacaattttcaaagccgataatgtaccaattgagtgggagcaggtcgacgttagcgggttggacgccgggaataaacattcggaagatttgttcaaagaatctattgcctcgctgaagcgcaacaagctcggtctcaagggtatccttcacaccccagttgagcgatccggccatcaatcgttcaatgttgccctacgtcaggaactagatatctatgcgtctatcgttttgattaagaacattcccggctacaagaccagacatgacaatgtcgacctctgcattatccgtgaaaataccgaaggcgaatattctggcctcgagcatcagtctgtcagcggcgtcgtcgaatctctcaagataattactcgtgccaagtcagaacgaattgccaagtttgcttttagctttgctctagccaacaaccgtaagaaggttacctgcatccacaaggccaacatcatgaaattggccgacggccttttccgctccaccttccataaagttgccgaaagctaccccactctagaaacgaatgatatgattgtggataatgcatctatgcaagcggttgctcgtcctcagcagtttgacgtcatggttatgcctaacctttacggaggaatcctctccaacgttggagctgctctcgtcggtggccccggtattgtacctggttgcaacatgggtcgcgatgtggctgtcttcgaaccgggatgtcgacacgttggacttgatattaaaggcaaggatcaagctaaccccacagccttgattctttctggatccatgctcctgcgccacttgggtctcgatgagcatgccaacagaatctccaaggcagtttatgacgtgattggagaaggcgtcacccgcacgcgcgatatgggtggtcaagcttccacccatgaattcacccgtgctgtcctcgataagatggaatcagctctgtaa

SEQ ID NO: 28222 - protein, 388 aa, Ajellomyces capsulata
MFSLRTAQPAQSLFRAATNTYSTSLPRSAIAARSFATVQSDIFKPTKYGGKYTVTLIPGDGIGTEVAESVKTIFKADNVPIEWEQVDVSGLDAGNKHSEDLFKESIASLKRNKLGLKGILHTPVERSGHQSFNVALRQELDIYASIVLIKNIPGYKTRHDNVDLCIIRENTEGEYSGLEHQSVSGVVESLKIITRAKSERIAKFAFSFALANNRKKVTCIHKANIMKLADGLFRSTFHKVAESYPTLETNDMIVDNASMQAVARPQQFDVMVMPNLYGGILSNVGAALVGGPGIVPGCNMGRDVAVFEPGCRHVGLDIKGKDQANPTALILSGSMLLRHLGLDEHANRISKAVYDVIGEGVTRTRDMGGQASTHEFTRAVLDKMESAL

SEQ ID NO: 28223 - DNA, 1248 bp, Colwellia maris
  CDS (1)..(1248)
atgaccaataaaatcatcattccaacgactggagataaaattacctttatcgacggtaagttatcagtacctaacaatcccattattccttatattgaaggtgacggtataggcgttgatgttactcctcctatgctcaaagttgttaatgcagcggttgctaaagcttatggtggcgatagaaaaatagaatggttggaagtgtatgcgggtgagaaagcaaccaaaatgtatgatagtgaaacatggttgccagaagaaacacttaacattcttcaagaatataaagtgtctataaaagggccgctgacaaccccagtaggtggtggtatgagctctttaaatgttgctatacgacaaatgcttgacctttatgtgtgtcaacgaccagttcaatggtttactggtgtacctagtccggtaaaaagaccttcagaagttgatatggttatctttcgtgaaaatactgaagatatttatgcgggtattgagtataaagcaggtagtgacaaggcaaagtcggttattaagtttctaattgaagaaatgggtgccagtaatattcgctttactgaaaattgtggtatcggcataaaaccggtatcaaaagaaggctcacaacgcttggtaagacaagccattcaatacgccattgataataataaagactcagtaacgttagttcataaaggtaatattatgaagtttactgaaggcgcttttaaagattggggctatgaacttgcgatagaagaatttggtgcaagtttactgcacggtgggccttggtgctcacttaaaaaccctaataccggtaaagaaatcattattaaagatgttatcgctgatgctatgttgcaacaagtattattacgtcctgcggaatatagtgttatagcaacgttaaacttaaatggtgattatttatcggatgcactggccgctcaagtaggtggtataggtattgcaccaggcgcaaatttaggtgatgaagttgctgtgtttgaagcaactcatggaaccgcacctaaatatgcaggtaaaaataaagtaaacccaggctcggtaattctttcagcggaaatgatgttaagacatatgggctggcttgaagctgatttattacttaaaggtatgtcaggagcaattcaagcaaaaacagttacctatgattttgagcgacttatggatgatgcaaccttagtttcttgttctgcatttggcgattgtattattgatcatatgtag

SEQ ID NO: 28224 - protein, 415 aa, Colwellia maris
MTNKIIIPTTGDKITFIDGKLSVPNNPIIPYIEGDGIGVDVTPPMLKVVNAAVAKAYGGDRKIEWLEVYAGEKATKMYDSETWLPEETLNILQEYKVSIKGPLTTPVGGGMSSLNVAIRQMLDLYVCQRPVQWFTGVPSPVKRPSEVDMVIFRENTEDIYAGIEYKAGSDKAKSVIKFLIEEMGASNIRFTENCGIGIKPVSKEGSQRLVRQAIQYAIDNNKDSVTLVHKGNIMKFTEGAFKDWGYELAIEEFGASLLHGGPWCSLKNPNTGKEIIIKDVIADAMLQQVLLRPAEYSVIATLNLNGDYLSDALAAQVGGIGIAPGANLGDEVAVFEATHGTAPKYAGKNKVNPGSVILSAEMMLRHMGWLEADLLLKGMSGAIQAKTVTYDFERLMDDATLVSCSAFGDCIIDHM

SEQ ID NO: 28225 - DNA, 1086 bp, Kluyveromyces lactis
  CDS (1)..(1086)
atgttgagacaaggtattgctgctcaaaaaaagtccttcgctaccctagcagctgaacaattgttgccaaagaagtacggtggtcgctacactgtaactttgattccaggtgatggtgttggtaaggaagtgaccgactcagtagtcaagatcttcgaaaacgaaaatattccaatcgactgggaaactatcgacatttctggtctagaaaacactgaaaatgtacaaagagctgtcgaatctttaaagagaaacaaggttggtttgaaaggtatctggcacactccagccgaccaaaccggtcatggctcattgaacgttgctttgagaaagcaactggatattttcgccaatgtcgccttgttcaaatcaattccaggtgtcaagactagattgaataacatcgacatggttatcatcagagaaaacactgaaggtgaatactctggtttagaacacgaatctgttccaggtgtcgttgaatctttgaagatcatgaccagggctaagtcagaaagaattgctagattcgcctttgatttcgccttgaaaaacaacagaaagtcggtctgcgctgttcacaaagctaacatcatgaaattgggtgatggtttgttcagaaacaccgttaatgaaattggtgctaacgaatacccagaactcgatgtcaagaacatcatcgttgacaacgcttccatgcaagctgttgccaagccacatcaattcgatgttttggtgacaccaaacttgtacggttctatcttgggtaacattggttctgctttgatcggtggtcccggtctagtcccaggtgctaacttcggtagagaatacgctgtctttgaaccaggttccagacatgttggtttggacatcaagggtcaaaacgttgctaacccaactgctatgatcttgtcctctactctaatgttgagacatctaggtttgaacgcttacgctgatagaatttccaaagctacatatgatgtcatttctgaaggtaagtcaacaacaagagacatcggtggttcagcctccacttctgagttcaccaacgctgttatcgagaagttagccaagttatga

SEQ ID NO: 28226 - protein, 361 aa, Kluyveromyces lactis
MLRQGIAAQKKSFATLAAEQLLPKKYGGRYTVTLIPGDGVGKEVTDSVVKIFENENIPIDWETIDISGLENTENVQRAVESLKRNKVGLKGIWHTPADQTGHGSLNVALRKQLDIFANVALFKSIPGVKTRLNNIDMVIIRENTEGEYSGLEHESVPGVVESLKIMTRAKSERIARFAFDFALKNNRKSVCAVHKANIMKLGDGLFRNTVNEIGANEYPELDVKNIIVDNASMQAVAKPHQFDVLVTPNLYGSILGNIGSALIGGPGLVPGANFGREYAVFEPGSRHVGLDIKGQNVANPTAMILSSTLMLRHLGLNAYADRISKATYDVISEGKSTTRDIGGSASTSEFTNAVIEKLAKL

SEQ ID NO: 28227 - DNA, 1071 bp, Schizosaccharomyces pombe
  CDS (1)..(1071)
atgttcaaatcactagtaagaaaatcctcagcttttcaaccattaaagtatggaggtaaatacacggtaacgttgattccaggcgatggaattggacgagaaacgagcaatgcagtgacagagatctttaaaacggcaaacgttcctatcgaatttgaagaaattgatgttacaggaatggaaaaaaacaataaatcgtctggagacgcgctacatgaggcaattcaatctctcaagagaaataaagtgggtttaaagggaattctgttcactccatttgaaaaaggaggccatacctcgttcaatgttgccttgagaaaagaactcgatatctatgcctctctagtgctcatcaaaaacattcctggatttaagactcgtcatgacaatgttgattttgcaattattcgtgaaaacactgaaggtgaatactcgggtctcgagcaccagtcggtaccgggagtcgtggaatctttgaaaatcattacagaatacaaatcaaagagaattgcacaatttgcttttgattttgccttacaaaatggccgcaaatcggtcacttgcatccacaaggctaacatcatgaaattggccgacggtctctttcgaaggacgttttacgacgttgctaacggttacgacgctattactcctaaggatttaattgtcgacaatgcctccatgcaggctgtttctcgtccccagcaattcgatgttttagtgatgccgaacttgtacggtagcattcttagcaacattggaagtgctttggtcggtggccccggtgtcattccaggtgccaattttggtcgtgactatgctctattcgagcctggttgccgtcatgttggtttaagtattactggacgtggggaagccaatcctacagctgccatccttagcgcttgcttgatgcttcgtcatttaggcctaaaagattatgctgatcttatcaatgccgctacttattctgtcattgaagagggtaaaaccctgaccaaagacttgggtggttcggcttccactggtgatttcacgcatgccattttagaaagaatggaaagcttataa

SEQ ID NO: 28228 - protein, 356 aa, Schizosaccharomyces pombe
MFKSLVRKSSAFQPLKYGGKYTVTLIPGDGIGRETSNAVTEIFKTANVPIEFEEIDVTGMEKNNKSSGDALHEAIQSLKRNKVGLKGILFTPFEKGGHTSFNVALRKELDIYASLVLIKNIPGFKTRHDNVDFAIIRENTEGEYSGLEHQSVPGVVESLKIITEYKSKRIAQFAFDFALQNGRKSVTCIHKANIMKLADGLFRRTFYDVANGYDAITPKDLIVDNASMQAVSRPQQFDVLVMPNLYGSILSNIGSALVGGPGVIPGANFGRDYALFEPGCRHVGLSITGRGEANPTAAILSACLMLRHLGLKDYADLINAATYSVIEEGKTLTKDLGGSASTGDFTHAILERMESL

SEQ ID NO: 28229 - DNA, 1107 bp, Kluyveromyces lactis
  CDS (1)..(1107)
atgttcagacaatcaattgtgaagcaatcgtgtagatttttggctaccaagaaacaaccaagtatcggtagatacaccggtaagccaaacccaaagactggtaagtacactgtttccttcattgaaggtgatggtgttggtccagaaatttccaaatccgttaaggcgatcttttccgcagccaaggttcctattgaatgggaaagttgtgatgtgagtccaattttcgttaacggattaactactattccagatccagctgttgcttcaattaacaagaacttgattgctttgaagggtccattggctactccaattggtaagggtcacagatccttgaacttaaccttaagaaagactttcggtttgttcgctaatgtgcgtccagctaaatctatcgagggttacaagactacttacgaaaacgttaacttagttttgatcagagaaaacactgaaggtgaatattctggtatcgaacacgttgttgctccaggtgtcgtccaatccatcaagttgattactcaggatgcttctgaaagagtcattagatacgcttttgaatacgctagagccgttgatagatcaaaggtccttgttgttcacaaatccactatccaaagattggccgatggtttgttcgttgacgttgccaagaaattgtcttctgaataccctgacatcgaactacaaactgaattgctagataacaccgtcttgaagactgtccaacacccagaagcctacgatgatgtcgttgtcgtttgtccaaacttgtacggtgatatcttgtccgatttgaactccggtttgtccgctggttctctaggtttgactccatccgctaacattggtcacaccgtttctatcttcgaagctgtccacggttctgccccagatattgctggtcaaaacaaggctaacccaactgccttgttgctatcctctgtcatgatgttgaaccacatgggtttgactgaacacgccgacaagattgaaaaggctgtcttgaccaccattgcttctgatgctaagaacagaactggtgacttgggtggttctgcttccacatcttctttcactgatgctgtcattgaaagattataa

SEQ ID NO: 28230 - protein, 368 aa, Kluyveromyces lactis
MFRQSIVKQSCRFLATKKQPSIGRYTGKPNPKTGKYTVSFIEGDGVGPEISKSVKAIFSAAKVPIEWESCDVSPIFVNGLTTIPDPAVASINKNLIALKGPLATPIGKGHRSLNLTLRKTFGLFANVRPAKSIEGYKTTYENVNLVLIRENTEGEYSGIEHVVAPGVVQSIKLITQDASERVIRYAFEYARAVDRSKVLVVHKSTIQRLADGLFVDVAKKLSSEYPDIELQTELLDNTVLKTVQHPEAYDDVVVVCPNLYGDILSDLNSGLSAGSLGLTPSANIGHTVSIFEAVHGSAPDIAGQNKANPTALLLSSVMMLNHMGLTEHADKIEKAVLTTIASDAKNRTGDLGGSASTSSFTDAVIERL

SEQ ID NO: 28231 - DNA, 1137 bp, Schizosaccharomyces pombe
  CDS (1)..(1137)
atgtcaatgctttctactttacgtactgcaggttctttacggacgttttcaagaagcgcctgttactcttttagattttcttcaacgaaggctgccgctgggacatatgaaggagtaaagaatgccaacgggaactacacagtaacgatgattgctggcgatggcattggtccagaaattgctcagtctgtagaacgtatatttaaggctgcaaaggtccctatcgaatgggaacgtgtaaaagtatatcctattttgaaaaatggtactactactattcctgatgatgctaaggaatctgttaggaaaaataaagtggctttgaaaggtccattggcaaccccaattgggaagggtcatgtttctatgaaccttactttgcgtcgtactttcggcttgtttgccaatgttcgtccctgtgtatctattacgggatacaaaacaccttatgataacgttaataccgttttgattcgtgagaacactgagggtgaatactcaggcatcgagcatgaagttataccaggcgttgttcaatcgattaaattaattactcgcgcagcatctgagcgtgttattcgttatgcattccaatatgctcgccaaactggcaagaacaacatcaccgtagtccacaaggctaccattatgcgcatggctgacggtttatttttggaatgcgccaaggagcttgcacctgaatatcctgatatcgagcttagggaggaaatcttggataacgcctgcttgaagattgtcaccgatcctgtcccttataacaacacagttatggttatgcccaatttatacggtgatattgtttctgatatgtgcgctggtttaattggcggtcttggtttgactccttccggaaacattggcaaccaagcttccatctttgaagctgttcatggtactgcccctgatattgctggaaaaggtttagccaaccctactgctttactgttatcttctgtaatgatgttgaagcacatgaatttaaatgattatgccaaacgcatcgaatcagctatctttgatacccttgcaaacaatcccgatgctcgcaccaaggatttgggcggcaagtcaaacaatgttcaatataccgatgccattatttctaaactgaagtaa

SEQ ID NO: 28232 - protein, 378 aa, Schizosaccharomyces pombe
MSMLSTLRTAGSLRTFSRSACYSFRFSSTKAAAGTYEGVKNANGNYTVTMIAGDGIGPEIAQSVERIFKAAKVPIEWERVKVYPILKNGTTTIPDDAKESVRKNKVALKGPLATPIGKGHVSMNLTLRRTFGLFANVRPCVSITGYKTPYDNVNTVLIRENTEGEYSGIEHEVIPGVVQSIKLITRAASERVIRYAFQYARQTGKNNITVVHKATIMRMADGLFLECAKELAPEYPDIELREEILDNACLKIVTDPVPYNNTVMVMPNLYGDIVSDMCAGLIGGLGLTPSGNIGNQASIFEAVHGTAPDIAGKGLANPTALLLSSVMMLKHMNLNDYAKRIESAIFDTLANNPDARTKDLGGKSNNVQYTDAIISKLK

SEQ ID NO: 28233 - DNA, 1110 bp, Saccharomyces cerevisiae
  CDS (1)..(1110)
atgttgagaaatactttttttagaaacacctcgaggaggtttttggctactgtaaagcaaccttcaatcggaagatataccggcaaacctaacccttctaccggcaaatacacggtctcgttcattgaaggtgatggtatcggacctgaaatttccaagtctgtaaagaaaatctttagtgcagcaaacgtccccatagaatgggaatcttgtgatgttagccctatctttgtcaacggattaacgaccattcctgaccctgccgtacaatctatcacaaaaaacctggttgcactaaaaggtccactagctacacctattggtaaaggtcacagatctttgaatttgacattgagaaaaacatttgggttatttgccaacgttcgtcccgcaaagtctattgaaggttttaagaccacttacgaaaacgttgatttagttcttatcagagagaataccgaaggtgaatattctggtatcgaacacatagtttgccctggcgttgttcaatctattaaactgatcacaagagatgcctctgagcgagtcattagatacgcttttgaatatgcaagagccatcggcagaccaagagttattgtggtacataaatctactatccagagattagctgatggtttattcgttaatgttgccaaagaactatccaaagagtatcctgaccttactttagaaactgaacttattgataacagtgtgttaaaggtggtcaccaacccatctgcttacacagacgctgtttctgtttgtccaaatctatacggtgatatcttgtccgacttgaactctggtttgagcgccggttctttaggtttaactccatctgccaatattggtcataaaatctcgatctttgaagctgtccatggctctgcccctgatattgccggtcaagataaagcgaatccaactgccctacttttatcttcagtaatgatgttaaaccacatgggtctaacgaatcatgctgaccaaattcaaaatgcagtattgtctactatcgcatcaggtccagaaaacagaacaggtgacttggctggtactgctactacttcatcattcactgaagcagtcatcaagagattataa

SEQ ID NO: 28234 - protein, 369 aa, Saccharomyces cerevisiae
MLRNTFFRNTSRRFLATVKQPSIGRYTGKPNPSTGKYTVSFIEGDGIGPEISKSVKKIFSAANVPIEWESCDVSPIFVNGLTTIPDPAVQSITKNLVALKGPLATPIGKGHRSLNLTLRKTFGLFANVRPAKSIEGFKTTYENVDLVLIRENTEGEYSGIEHIVCPGVVQSIKLITRDASERVIRYAFEYARAIGRPRVIVVHKSTIQRLADGLFVNVAKELSKEYPDLTLETELIDNSVLKVVTNPSAYTDAVSVCPNLYGDILSDLNSGLSAGSLGLTPSANIGHKISIFEAVHGSAPDIAGQDKANPTALLLSSVMMLNHMGLTNHADQIQNAVLSTIASGPENRTGDLAGTATTSSFTEAVIKRL

SEQ ID NO: 28235 - DNA, 1101 bp, Bos taurus
  CDS (1)..(1101)
atggcagggcccgcgtggatctccaaggtctctcggctgctgggggcattccacaaccaaaaacaggtgaccagaggttttgctggtggtgttaagacagtaactttaattccaggagatggaattggcccagaaatttctgctgcagttatgaagatttttgatgctgccaaagcacctattcagtgggaggagcgaaacgtcgccgccattcaaggtccgggaggcaagtggatgatccctccagaagccaaagagtccatggataagaacaagatgggcttgaaaggccctttaaaaacaccaatagctgctggtcacccatctatgaatttattgctgcgtaaaacatttgacctttatgcaaatgtccgaccatgtgtctcaatcgaaggctataaaaccccttaccatgatgtaaatattgtcaccattcgagagaacacggaaggagaatacagtggaatcgagcatgtgatcgtggatggagttgtgcagagtatcaagctcatcaccgaggcagcgagcaagcgcatcgcggagtttgcatttgaatacgcacggaacaaccaccggagcaacgtcacagccgtgcacaaagccaacatcatgcgaatgtcagatgggctttttctgcaaaaatgcagggaagttgcagaaaactgtaaagatattaaatttaatgagatgtaccttgatacagtatgtttgaatatggtccaagacccgtcccagtttgatgttcttgttatgccaaatttgtatggagacatccttagtgacctgtgtgcgggattgattggaggtcttggtgtgacaccaagcggcaacattggagccaacggagttgcaatcttcgagtcggttcacgggaccgccccggacattgcgggcaaggacatggccaatcccacagccctcctgctcagcgccgtgatgatgctgcgccacatggggctttttgaccacgctgcgaagattgagacggcgtgttttgctacaattaaggatggaaagagcttaaccaaagatttgggaggcaattcaaagtgctcggacttcacagaagaaatctgtcgccgagtaaaagatttagattaa

SEQ ID NO: 28236 - protein, 366 aa, Bos taurus
MAGPAWISKVSRLLGAFHNQKQVTRGFAGGVKTVTLIPGDGIGPEISAAVMKIFDAAKAPIQWEERNVAAIQGPGGKWMIPPEAKESMDKNKMGLKGPLKTPIAAGHPSMNLLLRKTFDLYANVRPCVSIEGYKTPYHDVNIVTIRENTEGEYSGIEHVIVDGVVQSIKLITEAASKRIAEFAFEYARNNHRSNVTAVHKANIMRMSDGLFLQKCREVAENCKDIKFNEMYLDTVCLNMVQDPSQFDVLVMPNLYGDILSDLCAGLIGGLGVTPSGNIGANGVAIFESVHGTAPDIAGKDMANPTALLLSAVMMLRHMGLFDHAAKIETACFATIKDGKSLTKDLGGNSKCSDFTEEICRRVKDLD

SEQ ID NO: 28237 - DNA, 1077 bp, Caenorhabditis elegans
  CDS (1)..(1077)
atgcttggcaagtgcatcaaaaaggcgtcgtctaccgtcggacaatccatcagatacagctccggagacgttcgccgtgtcactttaattccaggagacggaattgggccggaaatttcagcttctgtacagaagatttttgaggccgccgatgccccgattgcttgggacccagttgatgtgactccagttaagggacgcgatggagtcttccgtattccaagtcgttgcatcgagcttatgcacgcgaacaaagttggacttaaaggaccactcgagaccccaattggaaaaggacacagatctttgaatttggctgtgagaaaagagtttagcctttacgccaacgttcgtccatgccgttcccttgaaggacacaagacattgtacgacaatgtcgatgttgtcacaattcgtgagaacacagagggagagtactctggaattgagcacgagattgtcccgggagttgttcaatctatcaagcttattactgaaactgcttctcgcaatgtcgccagcttcgccttcgagtatgctcgtcaaaatgggcgcaaagttgtgactgctgtccacaaagccaacattatgagacaatccgacggtttgtttttgtccatctgccgcgagcaagctgccctctacccagatatcaagttcaaggaagcctacctcgacacagtttgcttgaacatggtccaggatccatcacaatacgatgttcttgtcatgccaaacttgtatggagacattctttccgatttgtgcgctggtcttgttggaggactcggagtcaccccatctggaaatattggaaaaggagccgccgtatttgaatccgttcacggaaccgccccagatattgctggacaagacaaagcaaacccaactgctcttcttctatctgccgtcatgatgctccgttacatgaaccttccacaacacgctgctcgtatcgaaaaggctgtatttgatgcaattgctgatggacgtgccaaaactggagatctcggaggtactggaacttgctcttcattcaccgctgatgtttgtgcccgtgttaaagacctcgaataa

SEQ ID NO: 28238 - protein, 358 aa, Caenorhabditis elegans
MLGKCIKKASSTVGQSIRYSSGDVRRVTLIPGDGIGPEISASVQKIFEAADAPIAWDPVDVTPVKGRDGVFRIPSRCIELMHANKVGLKGPLETPIGKGHRSLNLAVRKEFSLYANVRPCRSLEGHKTLYDNVDVVTIRENTEGEYSGIEHEIVPGVVQSIKLITETASRNVASFAFEYARQNGRKVVTAVHKANIMRQSDGLFLSICREQAALYPDIKFKEAYLDTVCLNMVQDPSQYDVLVMPNLYGDILSDLCAGLVGGLGVTPSGNIGKGAAVFESVHGTAPDIAGQDKANPTALLLSAVMMLRYMNLPQHAARIEKAVFDAIADGRAKTGDLGGTGTCSSFTADVCARVKDLE

SEQ ID NO: 28239 - DNA, 1134 bp, Drosophila melanogaster
  CDS (1)..(1134)
atggctgctagattcatacagaaaattctcaatcaactgggtttgattgcagcgcgtgatgctccggcggtgactgcgacgccagcagtgagccaggtcaacgcgactcccgccgccagccggtcctactcctccggcaccaagaaagtcaccctcatccctggcgatggcatcggacctgagatctctgcggccgtgcagaaaatcttcaccgccgccaatgtccccatcgagtgggaggccgtggacgtgacccccgtccggggacccgacggaaagttcggcatcccacaggccgccattgactcggtgaacacgaacaagatcggcctgaagggtcctctgatgacgcccgtcggcaagggccatcggtctctgaatctggccctgcgcaaggagttcaatctgtacgccaacgtgcgtccctgccgcagtctcgagggctacaagacgctgtacgacgatgtggacgtggtcaccatccgtgagaacaccgagggcgagtactccggcatcgagcacgagatcgtcgacggcgtcgttcagagcatcaagctgatcaccgaggaagcctccaagcgtgtggccgagtacgccttccagtacgccaagaacaacaaccgcaagaaggtcaccgtggtgcacaaggcgaacattatgcgcatgtccgatggtctcttcctgcgctgcgtccgcgacatggcccagaagttcccagaaatccagttcgaagagaagtatctggatacggtgtgcctgaacatggtccagaaccccggaaaatacgacgtgctggtcatgcccaatctgtacggtgatattctgtctgacatgtgcgccggtttggtgggcggcctcggcctgacgccctccggcaacatgggcctgaacggtgccctgttcgagtctgtgcacggaaccgcccccgatattgccggcaaggacctggccaatcccactgccctgttgctgtcggcggtcatgatgctgcgccacatggagctcaacacgtacgccgataaaatcgagcgtgccgccttcgagaccatcaaggagggcaaatacctcaccggcgatctgggcggccgtgccaagtgctccgagttcacgaacgagatctgtgccaagctgtag

SEQ ID NO: 28240 - protein, 377 aa, Drosophila melanogaster
MAARFIQKILNQLGLIAARDAPAVTATPAVSQVNATPAASRSYSSGTKKVTLIPGDGIGPEISAAVQKIFTAANVPIEWEAVDVTPVRGPDGKFGIPQAAIDSVNTNKIGLKGPLMTPVGKGHRSLNLALRKEFNLYANVRPCRSLEGYKTLYDDVDVVTIRENTEGEYSGIEHEIVDGVVQSIKLITEEASKRVAEYAFQYAKNNNRKKVTVVHKANIMRMSDGLFLRCVRDMAQKFPEIQFEEKYLDTVCLNMVQNPGKYDVLVMPNLYGDILSDMCAGLVGGLGLTPSGNMGLNGALFESVHGTAPDIAGKDLANPTALLLSAVMMLRHMELNTYADKIERAAFETIKEGKYLTGDLGGRAKCSEFTNEICAKL

SEQ ID NO: 28241 - DNA, 1101 bp, Homo sapiens
  CDS (1)..(1101)
atggctgggcccgcgtggatctctaaggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaa

SEQ ID NO: 28242 - protein, 366 aa, Homo sapiens
MAGPAWISKVSRLLGAFHNPKQVTRGFTGGVQTVTLIPGDGIGPEISAAVMKIFDAAKAPIQWEERNVTAIQGPGGKWMIPSEAKESMDKNKMGLKGPLKTPIAAGHPSMNLLLRKTFDLYANVRPCVSIEGYKTPYTDVNIVTIRENTEGEYSGIEHVIVDGVVQSIKLITEGASKRIAEFAFEYARNNHRSNVTAVHKANIMRMSDGLFLQKCREVAESCKDIKFNEMYLDTVCLNMVQDPSQFDVLVMPNLYGDILSDLCAGLIGGLGVTPSGNIGANGVAIFESVHGTAPDIAGKDMANPTALLLSAVMMLRHMGLFDHAARIEAACFATIKDGKSLTKDLGGNAKCSDFTEEICRRVKDLD

SEQ ID NO: 28243 - DNA, 1101 bp, Mus musculus
  CDS (1)..(1101)
atggccgggtccgcgtgggtgtccaaggtctctcggctgctgggtgcattccacaacacaaaacaggtgacaagaggttttgctggtggtgttcagacagtaactttaattcctggagatggaattggcccagaaatttcagcctcagtcatgaagatttttgatgctgccaaagcacctattcagtgggaggagcgcaatgtcacagcaattcaaggaccaggaggaaagtggatgatccctccagaagccaaggagtccatggataagaacaagatgggcttgaaaggcccactaaagaccccaatagccgctggccatccatctatgaatctgttgcttcgtaagacatttgacctttatgccaatgtccggccatgtgtctcaattgaaggttataaaaccccttacacggatgtaaatatcgtcaccatccgagagaacacggaaggagaatacagtggaattgagcatgtgatcgttgatggggttgtgcagagcatcaagctcatcaccgaagaagcaagcaagcgcattgcagagtttgccttcgagtacgctcggaacaaccaccggagcaacgtcacagctgtgcacaaagctaacatcatgaggatgtcagatgggctctttctgcaaaaatgcagggaagttgcggagaactgtaaagacattaaatttaacgagatgtaccttgatactgtatgtttaaatatggtacaagacccatcccagtttgatgttcttgtcatgccaaatttatacggagacatccttagtgatctgtgtgcaggactgattggaggtcttggggtgactccaagtggcaatattggagccaacggtgttgccatctttgaatcggttcatggaacagccccggacattgcaggcaaggacatggccaaccccacggccctcctgcttagtgctgtgatgatgcttcgccacatgggactttttgaccatgcagcaaaaatcgaggctgcatgttttgctacaattaaggatggaaagagcttaacaaaagatctgggaggcaacgcgaagtgctctgacttcacagaagaaatctgtcgtagagtcaaagacttagattag

SEQ ID NO: 28244 - protein, 366 aa, Mus musculus
MAGSAWVSKVSRLLGAFHNTKQVTRGFAGGVQTVTLIPGDGIGPEISASVMKIFDAAKAPIQWEERNVTAIQGPGGKWMIPPEAKESMDKNKMGLKGPLKTPIAAGHPSMNLLLRKTFDLYANVRPCVSIEGYKTPYTDVNIVTIRENTEGEYSGIEHVIVDGVVQSIKLITEEASKRIAEFAFEYARNNHRSNVTAVHKANIMRMSDGLFLQKCREVAENCKDIKFNEMYLDTVCLNMVQDPSQFDVLVMPNLYGDILSDLCAGLIGGLGVTPSGNIGANGVAIFESVHGTAPDIAGKDMANPTALLLSAVMMLRHMGLFDHAAKIEAACFATIKDGKSLTKDLGGNAKCSDFTEEICRRVKDLD

SEQ ID NO: 28245 - DNA, 1422 bp, Anabaena sp
  CDS (1)..(1422): transl_table=11
atgtacaacaagattaccccccctacaaccggagaaaaaattaccttcaaaaatggtgagccggttgtgcctgacaatccaattatcccctttattcggggcgatggaacaggaattgatatttggccggctacagaaaaagtactagatgcggcggtagccaaagcgtatcaaggcaagcgtaaaattagctggtttaaggtttacgctggggatgaagcctgtgatttatacgggacttatcagtatttaccagaggatacattaacagccattagggaatatggtgtggcaattaaagggcctttgactacccctgtcggtggtggtatccgttccttaaatgtggcactcagacaaatttttgacctatatgcctgtgtacgtccttgccgttattatgcaggtacaccctcaccccacaaaaatcctgaaaaacttgatgtaattgtctatcgggaaaacacggaagatatttatttagggattgagtggaaacaaggtagtgaaataggcgatcgcctcatctctatcctcaacaaagaactcatccccgccaccccagaacacggtaaaaagcaaatccccctcgattctggtatagggatcaaacccatcagtaaaacaggttcccagcgcctagtacgccgcgccattaaacacgccctcacattacccaaagacaagcaacaagtgactttggtgcataagggtaacatcatgaagtacaccgaaggcgctttccgtgattggggttacgaattagctacaagtgagttccgccaagagactgtcactgaacgggaatcttggattttaagcaacaaggagaaaaacccgaacatttccttggaagacaacgcccgtcaaattgaccctggttttgatgcccttactccagagaaaaaggcgcaaattgtcaaggaagtagaaacagttcttaactcaatttgggaaagccacggtaacggtaagtggaaagaaaaagtgttagtcaatgaccggattgctgacagtatctttcaacaaatccaaaccagaccagatgagtattcaattctggcgacaatgaacttaaacggcgattacttgtctgatgcggcggctgctattgtcggcggcttaggaatggggccaggggcaaatattggcgattcctgcgctgtgtttgaagccactcatggtacagcacctaaacacgctggcttagacagaattaacccaggttcagtcattttatctggggtaatgatgttggagtatatgggttggcaagaagccgcagacctaattaagaaaggtttaagcgatgcgatcgctaacagtcaagtcacctatgatttagctagattactcgaaccaccagttgaacctctaaaatgttctgaatttgccgacgcaattatcaaacattttggttaa

SEQ ID NO: 28246 - protein, 473 aa, Anabaena sp
MYNKITPPTTGEKITFKNGEPVVPDNPIIPFIRGDGTGIDIWPATEKVLDAAVAKAYQGKRKISWFKVYAGDEACDLYGTYQYLPEDTLTAIREYGVAIKGPLTTPVGGGIRSLNVALRQIFDLYACVRPCRYYAGTPSPHKNPEKLDVIVYRENTEDIYLGIEWKQGSEIGDRLISILNKELIPATPEHGKKQIPLDSGIGIKPISKTGSQRLVRRAIKHALTLPKDKQQVTLVHKGNIMKYTEGAFRDWGYELATSEFRQETVTERESWILSNKEKNPNISLEDNARQIDPGFDALTPEKKAQIVKEVETVLNSIWESHGNGKWKEKVLVNDRIADSIFQQIQTRPDEYSILATMNLNGDYLSDAAAAIVGGLGMGPGANIGDSCAVFEATHGTAPKHAGLDRINPGSVILSGVMMLEYMGWQEAADLIKKGLSDAIANSQVTYDLARLLEPPVEPLKCSEFADAIIKHFG

SEQ ID NO: 28247 - DNA, 1281 bp, Aquifex aeolicus
  CDS (1)..(1281): transl_table=11
atgaataaaacaacgtttgaaaatgtttactactgggaaggaaaggcacaaatcccccaggaagggcagtttataaagctcaaagaagataaaaccttagaagttccagacaacccgataattcccttcatagagggagatgggataggtcctgaaataacgcaggctatgctccttattatcaacacagcggttgaaaaaacttacaacggaagcaagaagatttactgggtagaactcctcgcgggggataaggcggaagaaaagactggagagaggcttcctcaggaaaccctggacgttttaaaagaatcaatagtaggtataaaaggacccctcggaacgcccgtaggaaaaggtgtccgctccataaactccgccctcaggagggcatttgattactactctgcggtaagacccgtttactggatgggccaggcaactccgattccaaatcctgagagggttgacctcgtagttttcagagaaaacaccgacgacgtctacgcgggagtggagttctttgcgggaacgcccgaagccaaaaaggtaagagaattcctcataaaggagatgggggcaaaagaggaaggcttccccgaagatgtgggaataacggtaaagcccatgagcgagttcaagacaaagagacacgtgaggaaagcactcagatacgcccttgaaaacaacaagaagaacgtcgcggtaataggaaaaggaaacataatgaaggcaacggaaggggccttcataaactgggcttttgaggtagcagaagagcccgaattcaaaggaaaggtagtaacggacccggaagcagagcccggcgaaggacaggtaaaactcacaaaagtgataaccgaccagatgcttatgcaacttgtcctcaagcccgaagcttgggacgtgataatcgctcagaacttgaacggtgactacgtttccgaccttgcagcttctctgataggaggtccaggatttgttccgagcggaaacataggggacggatatgccctctttgaaagcacccacggaacagcttgggacatagcaggcaagggaatagcaaatcccctttcccttacactatctggcgcgatgatgcttgaatacataggctggaaagaagcagctcaaaaggtctacgacgcagtaagaagaacccttgcggaacatataggaacgcccgatatcgcaagcggattccagaaacagggaatagaagctaaagcagtaggcacgatggagttcgccgaagaaatttccaagaggattgagtaa

SEQ ID NO: 28248 - protein, 426 aa, Aquifex aeolicus
MNKTTFENVYYWEGKAQIPQEGQFIKLKEDKTLEVPDNPIIPFIEGDGIGPEITQAMLLIINTAVEKTYNGSKKIYWVELLAGDKAEEKTGERLPQETLDVLKESIVGIKGPLGTPVGKGVRSINSALRRAFDYYSAVRPVYWMGQATPIPNPERVDLVVFRENTDDVYAGVEFFAGTPEAKKVREFLIKEMGAKEEGFPEDVGITVKPMSEFKTKRHVRKALRYALENNKKNVAVIGKGNIMKATEGAFINWAFEVAEEPEFKGKVVTDPEAEPGEGQVKLTKVITDQMLMQLVLKPEAWDVIIAQNLNGDYVSDLAASLIGGPGFVPSGNIGDGYALFESTHGTAWDIAGKGIANPLSLTLSGAMMLEYIGWKEAAQKVYDAVRRTLAEHIGTPDIASGFQKQGIEAKAVGTMEFAEEISKRIE

SEQ ID NO: 28249 - DNA, 1239 bp, Archaeoglobus fulgidus
  CDS (1)..(1239): transl_table=11
atgcagtacgagaaggtcaaacctccagagaacggagaaaagataagatatgaaaacggcaaactcatcgttccagataaccccatcatcccgtatttcgagggagatggcataggcaaggatgtggttccagctgcaatcagagttctcgatgccgctgctgataagattggcaaggaagtcgtctggtttcaggtttatgctggggaggatgcctacaagctctacggcaactatctgcctgatgacactctgaacgccataaaggagttcagagttgccttaaaaggccctctcacaacccccgttggaggtggctacaggagtctaaatgtcacaatcagacaggttctcgacctctatgccaatgttaggccagtctactacctgaaaggagttccaagcccgataaagcatcctgaaaaggtcaacttcgttattttcagggagaacaccgaagacgtttacgctggcattgagtggccgaggggtagcgaggaagcccttaagttaataagattcctcaagaacgagtttggtgtcaccataagggaggactctggaatcggaataaagccgatcagcgagtttgccaccaagaggcttgtcaggatggccatcagatatgcaatagagaacaacaggaaaagcgtgactctcgtccacaagggcaacataatgaagtacacggagggagccttcagggattggggctacgaggtggcaaagcaggagtttggcgagtattgcataacagaggacgagctctgggacaagtacggcgggaagcagcctgagggcaagatcgtggtgaaggacaggattgcggacaacatgttccagcagattctgacgaggacagatgagtatgacgtcattgccctgccaaacctcaatggtgattacctcagcgatgctgctgctgccctgattgggggacttggaatagctccgggcagcaacataggtgatggcattggcgtcttcgagcctgtgcacggctctgcaccgaagtacgctggccagaacaaggtcaaccccacagccgaaattctcacaggagcgctgatgttcgagtacatcggctggaaggatgcgagcgagatgataaagaaagctgtggagatgacgataagcagcggaattgttacctacgacatccaccgccacatgggcgggacgaaggtaggaacgagggagtttgcagaggctgtggttgaaaacctgcagtcgctatga

SEQ ID NO: 28250 - protein, 412 aa, Archaeoglobus fulgidus
MQYEKVKPPENGEKIRYENGKLIVPDNPIIPYFEGDGIGKDVVPAAIRVLDAAADKIGKEVVWFQVYAGEDAYKLYGNYLPDDTLNAIKEFRVALKGPLTTPVGGGYRSLNVTIRQVLDLYANVRPVYYLKGVPSPIKHPEKVNFVIFRENTEDVYAGIEWPRGSEEALKLIRFLKNEFGVTIREDSGIGIKPISEFATKRLVRMAIRYAIENNRKSVTLVHKGNIMKYTEGAFRDWGYEVAKQEFGEYCITEDELWDKYGGKQPEGKIVVKDRIADNMFQQILTRTDEYDVIALPNLNGDYLSDAAAALIGGLGIAPGSNIGDGIGVFEPVHGSAPKYAGQNKVNPTAEILTGALMFEYIGWKDASEMIKKAVEMTISSGIVTYDIHRHMGGTKVGTREFAEAVVENLQSL

SEQ ID NO: 28251 - DNA, 1272 bp, Bacillus subtilis
  CDS (1)..(1272): transl_table=11
gtggcacaaggtgaaaaaattacagtctctaacggagtattaaacgtaccaaacaacccgattatcccatttatcgaaggagacggaaccggtcctgatatttggaacgcggcttcgaaggttttggaagcagcagtagaaaaagcatacaaaggcgaaaagaaaattacatggaaagaagtttacgccggagaaaaggcttataataaaacaggtgagtggctccctgctgaaacattagatgtgatccgcgaatatttcatcgcgattaaaggcccgttaacgacacctgtcggcggcggtatccgttctttgaacgtagcgctcagacaagagcttgacctattcgtctgcttaagacctgtaagatactttactggagtgccgtcaccggtaaaacgccctgaagatactgatatggtcatcttccgtgaaaatacagaagatatttacgcaggcatcgagtatgcaaaaggctctgaagaagtgcaaaagcttatcagcttccttcaaaatgagttaaacgtcaataaaatccgtttccctgagacatcaggtatcggcattaagcctgtttcagaagaaggaacaagccgcttggtcagagctgccattgattatgcgatcgagcatggccgcaaatctgtaacacttgttcacaaaggaaacatcatgaagttcacagaaggcgccttcaaaaactggggctatgaacttgctgaaaaagaatacggagataaagtcttcacatgggctcaatatgaccgcattgctgaagaacaaggaaaagacgctgccaacaaagcgcaaagcgaagcggaagcagcaggaaaaatcattatcaaagacagcattgctgacattttccttcagcagatcttaacgcgtccaaacgagtttgatgtcgttgcgacaatgaacttgaacggagattacatttctgatgctcttgctgcgcaagtcggcggaatcggcattgctcctggagcgaacatcaactacgaaacaggacatgcgattttcgaggcgacgcacggaacggctcctaaatatgcaggccttgataaagtaaacccatcttcagttattctttcaggcgttctgcttcttgagcatttaggatggaacgaagcggctgatttggttatcaaatctatggaaaaaacaatcgcttctaaagtcgtaacttacgattttgccagattaatggacggggcgactgaagtgaaatgttcagagttcggagaagaactgatcaaaaacatggactaa

SEQ ID NO: 28252 - protein, 423 aa, Bacillus subtilis
MAQGEKITVSNGVLNVPNNPIIPFIEGDGTGPDIWNAASKVLEAAVEKAYKGEKKITWKEVYAGEKAYNKTGEWLPAETLDVIREYFIAIKGPLTTPVGGGIRSLNVALRQELDLFVCLRPVRYFTGVPSPVKRPEDTDMVIFRENTEDIYAGIEYAKGSEEVQKLISFLQNELNVNKIRFPETSGIGIKPVSEEGTSRLVRAAIDYAIEHGRKSVTLVHKGNIMKFTEGAFKNWGYELAEKEYGDKVFTWAQYDRIAEEQGKDAANKAQSEAEAAGKIIIKDSIADIFLQQILTRPNEFDVVATMNLNGDYISDALAAQVGGIGIAPGANINYETGHAIFEATHGTAPKYAGLDKVNPSSVILSGVLLLEHLGWNEAADLVIKSMEKTIASKVVTYDFARLMDGATEVKCSEFGEELIKNMD

SEQ ID NO: 28253 - DNA, 1290 bp, Caldococcus noboribetus
  CDS (1)..(1290): transl_table=11
atggtctctcacccatgcactgcagatgaggctaagcctccttcagagggccagctggcaaggtttgagaacggcaagctcatagtgcctgacaacctaatagttgcttacttcaagggcgacggcatagggcctgagatagttgaaagcgctaagaaggtgcttgacgcagcagttgacaaggcctacgggggcaccaggaggatagtctggtgggaggtgacagctggcgaggaggcccagaaggagtgcggctccctcctgcccgacggcacgcttcaggccttcaagctggctcgcgtcaaccttaaggggcccctgaccacgcccgttggaggcggcttcaggagcctcaacgtgaccctcaggatggtgcttgacctgtactcaaacgtcaggccagtcaagtggtacggccagccgactccgcactgccacccagagaatatagactgggtgatatttagggagaacacggaggacgtctacgctggcatcgagtggcccttcgacagccccgaggcccagaagataagggacttcctcaagaaggagttcggtatagagctgacgccagacacaggcataggcattaagcccatatccaagtggaggacgcagaggcacgtcaggagggccatggagtgggccataaggaacggctataagcacgtgactataatgcacaagggcaacataatgaagtacacggagggcgccttcaggcagtgggcctacgacctcatactctcagagttcagggactacgtggtcaccgaggaggaggttaacaccaagtacggcggcaaggcgccggagggcaagataatagttaatgacaggattgctgacaacatgttgcagcagataataaccaggcccggcgagtacaacgttatagtaacccccaacctgaacggtgactacataagcgacgaggccaacgccctggtgggcggcattggaatggctgcgggacttgacatgggcgatggcatagcggttgcggagccagtccacggcagcgcccccaagtacgctggtaagaacgtcataaacccgaccgccgagatactgagcggcatgtacctgctcagcgacttcgtgggatggccagaggtcaagctgctggttgagtacgcagtcaagcaggcgatagcccacaagcaggtgacctatgacctggccagggagatgggaggggtaacgccaatatcgaccacggagtacaccgatgtcctagttgactacataaggcacgcggacctcaaggccctcaagggccagtga

SEQ ID NO: 28254 - protein, 429 aa, Caldococcus noboribetus
MVSHPCTADEAKPPSEGQLARFENGKLIVPDNLIVAYFKGDGIGPEIVESAKKVLDAAVDKAYGGTRRIVWWEVTAGEEAQKECGSLLPDGTLQAFKLARVNLKGPLTTPVGGGFRSLNVTLRMVLDLYSNVRPVKWYGQPTPHCHPENIDWVIFRENTEDVYAGIEWPFDSPEAQKIRDFLKKEFGIELTPDTGIGIKPISKWRTQRHVRRAMEWAIRNGYKHVTIMHKGNIMKYTEGAFRQWAYDLILSEFRDYVVTEEEVNTKYGGKAPEGKIIVNDRIADNMLQQIITRPGEYNVIVTPNLNGDYISDEANALVGGIGMAAGLDMGDGIAVAEPVHGSAPKYAGKNVINPTAEILSGMYLLSDFVGWPEVKLLVEYAVKQAIAHKQVTYDLAREMGGVTPISTTEYTDVLVDYIRHADLKALKGQ

SEQ ID NO: 28255 - DNA, 1278 bp, Helicobacter pylori J99
  CDS (1)..(1278): transl_table=11
atggcttacaaccctaaaattttacaaaagcctaaagagggcgaagaaattacgattaaagacggcaaattgcatgtgccaaattaccccattatccctttcattgagggcgatggcattggatcggatattaccccagcgatgattaaagtcgtggatagcgcggttcaaaaagcgtataagggcgagaaaaaaatcgcatggtatgaagtgtttgtgggcgaaaaatgctatcaaaaattcaaagaccataaagagttaagccctgaagagcaatggctcttaccggacactattgaagcgatcaaccactataaagtctctattaaagggcctttgaccacgcctattggtgaggggtttagatctttgaatgtggcgttacgccaaaaaatggatttgtatgtgtgcttgagaccggtaaggtggtatgggagtcctagcccggtgaaagaaccacaaaaagtggatatggtgatttttagagaaaattctgaagacatttatgcgggcattgaatggcaagaaggcagtgcggaagcgaaaaaactcatccattttttacaaaatgaactaaaggtagaaaaaatccgcttccctgaaagcagcggcgtagggataaaacccatcagcaaagaaggcacagagaggttggtgagaaaagcgattgaatacgcgattgataacgacaagccaagcgtgacttttgtgcataagggcaacatcatgaaatataccgaaggggcgttcatgaaatggggctatgcgctcgctcaaaaagaatttaacgctcaagtcattgataaaggcccatggtgttctttgaaaaaccctaaaaccggtaaagaaatcatcattaaagacatgatcgctgacgcgtttttgcaacaaattctcttgcgccctagtgaatacagcgtcattgcgaccatgaatttgaacggggattatatctctgatgcgttagcggcgatggtggggggtattggtatcgctcctggggctaatctcaatgacacggtgggcatgtttgaagccacccatggcaccgctcctaaatacgccgggctggataaagtcaatccggggtctattattttgagcgcggaaatgatgttaaggcatatgggctgggtggaagcggctgatttgatcgtttctgctatggaaaaagcgattaagagcaagaaagtaacttatgatttcgctcgtttaatggatggggctaaagaagtgaaatgctctgaattcgctagcgtgatgattgaaaacatgtga

SEQ ID NO: 28256 - protein, 425 aa, Helicobacter pylori J99
MAYNPKILQKPKEGEEITIKDGKLHVPNYPIIPFIEGDGIGSDITPAMIKVVDSAVQKAYKGEKKIAWYEVFVGEKCYQKFKDHKELSPEEQWLLPDTIEAINHYKVSIKGPLTTPIGEGFRSLNVALRQKMDLYVCLRPVRWYGSPSPVKEPQKVDMVIFRENSEDIYAGIEWQEGSAEAKKLIHFLQNELKVEKIRFPESSGVGIKPISKEGTERLVRKAIEYAIDNDKPSVTFVHKGNIMKYTEGAFMKWGYALAQKEFNAQVIDKGPWCSLKNPKTGKEIIIKDMIADAFLQQILLRPSEYSVIATMNLNGDYISDALAAMVGGIGIAPGANLNDTVGMFEATHGTAPKYAGLDKVNPGSIILSAEMMLRHMGWVEAADLIVSAMEKAIKSKKVTYDFARLMDGAKEVKCSEFASVMIENM

SEQ ID NO: 28257 - DNA, 1278 bp, Helicobacter pylori
  CDS (1)..(1278): transl_table=11
gtggcttacaaccctaaaattttacaaaagcctaaagagggcgaagaaattacgattaaagacaacaaattgcatgtgccaaaccaccccattatccccttcattgagggcgatggcattggatcagatattaccccggcgatgattaaagtcgtggatagcgcggttcaaaaagcgtataagggcgagaaaaaaatcgcatggtatgaggtgtttgtgggcgaaaaatgctatcaaaaatttaaagattataaagaattaagcccagaagagcaatggctcttaccggacactattgaagcgattaaccattataaagtttctattaaagggcctttgacaacgcctattggtgaagggtttagatctttgaatgtagcgttacgccaaaaaatggatttgtatgtgtgcttgaggccggtaaggtggtatgggagtcctagcccggtgaaagaaccacaaaaagtggatatggtgatttttagagaaaattctgaagacatttatgcgggcattgaatggcaagaaggcagtgcggaagcgaaaaaactcatccattttttacaaaatgaactaaaggttaaaaaaatccgcttccctgaaagcagcggcataggggtaaaacccatcagtaaagaaggcacagagaggctagtgagaaaggcgattgaatacgcaattgataacgacaagccaagcgtgacttttgtgcataaaggtaacatcatgaaatacaccgaaggggcgttcatgaaatggggctatgcgctcgctcaaaaagaatttaacgctcaagtcattgataaaggcccatggtgttctttgaaaaaccctaaaaacggtaaagaaatcatcattaaagacatgatcgctgacgcgtttttgcaacaaatcttattgcgccctagcgaatacagcgtcattgcgaccatgaatttgaacggggattatatctctgatgcgttagcggcgatggtggggggtattggtatcgctcctggggctaatctcaatgacacggtgggcatgtttgaagccacccatggcaccgctcctaaatatgccgggctggataaagtcaatccggggtctattattttgagcgcggaaatgatgttaaggcatatgggttgggtggaagcggctgatttgatcgtttctgcgatggaaaaagcgattaaaagcaagaaagtaacttacgatttcgctcgtttaatggatggggctaaagaagtgaaatgctctgaatttgctagcgtgatgattgaaaacatgtga

SEQ ID NO: 28258 - protein, 425 aa, Helicobacter pylori
MAYNPKILQKPKEGEEITIKDNKLHVPNHPIIPFIEGDGIGSDITPAMIKVVDSAVQKAYKGEKKIAWYEVFVGEKCYQKFKDYKELSPEEQWLLPDTIEAINHYKVSIKGPLTTPIGEGFRSLNVALRQKMDLYVCLRPVRWYGSPSPVKEPQKVDMVIFRENSEDIYAGIEWQEGSAEAKKLIHFLQNELKVKKIRFPESSGIGVKPISKEGTERLVRKAIEYAIDNDKPSVTFVHKGNIMKYTEGAFMKWGYALAQKEFNAQVIDKGPWCSLKNPKNGKEIIIKDMIADAFLQQILLRPSEYSVIATMNLNGDYISDALAAMVGGIGIAPGANLNDTVGMFEATHGTAPKYAGLDKVNPGSIILSAEMMLRHMGWVEAADLIVSAMEKAIKSKKVTYDFARLMDGAKEVKCSEFASVMIENM

SEQ ID NO: 28259 - DNA, 1452 bp, Rickettsia conorii
  CDS (1)..(1452): transl_table=11
atggcagaatttacaccgattacaattgcatacggggacggtataggtcctgaaataatggaggcagtgctttatatattacgtaaagccgaggctcgtattcgtttagaaaccattgaagtaggtgaaaagctttacaagaagcattatacttcaggcataagcgaggaaagctgggaatcaatacaacgcactggtattatacttaaagccccgattactactccgcaaggtggaggatataaaagtttaaatgtcacgattcgtaaaacattacagctttttgctaatattcgtcctgccgtttcgcttcatccttttactagaacattacatccaaatttgaacctaactattatacgtgagaatgaggaagatttatacgcaggtatagaataccgtcaaacgcataatatgtatgagtcaatgaagttgataagtcatacaggatgtgagaagattattagatatgcttttgaatatgcagtaaaaaataaccgtaaaaaagtcatgtgtttaagcaaagataatattatgaaattttccgatggggttttgcataaagtatttaatgagattgcaaaagaatacccgcaaattaataacgcgcattatattatcgatatcgggacggcaaggcttgctaccaaaccggaaatatttgatgttatcgtaacttctaatttatacggtgatatcatatctgacgtagctgctgaaatttcaggctcggtaggtcttgcaggttctgcaaatattgggcagcattatgcgatgtttgaagcggtacatggaagtgctcccgatattgccggtaaagatatcgcaaatccttcagggcttttaaatgctgcaataatgatgctagtacatatagggcagggtgatatcgctacattaatcgaaaatgcttggaaaaaaactatagaggatggcgttcatacagccgatatatataacgagcagagttctagtaaaaaagtcggtacaaaagaatttgccgaagaagtaacgaaaagattaggacagttaccgacaaagctacctaaagcagattatcccttaattgctgagaagcaagaaagcaatatagattataaaattgatactaaagaagttaagaaattggttggtacggatatatttgtgaatatgaatgtatcttccgctcatgatatagcagataaaattaataaacttgatcttggtaattttgagttaaaaacaatctcgtcaaaaggattaaagctgtggcctcgtgatacaaggtttgaaactgtttccgatcattggtgttgtcgttttatgaataaagatggcacagaaataaagcatttagatataacaagattgcttgaagctttaagcacagcaaatatcgattttatcaaagtagagaatctgtttgaatttgacggggttgcaggttatagcttggctcaaggtgagtaa

SEQ ID NO: 28260 - protein, 483 aa, Rickettsia conorii
MAEFTPITIAYGDGIGPEIMEAVLYILRKAEARIRLETIEVGEKLYKKHYTSGISEESWESIQRTGIILKAPITTPQGGGYKSLNVTIRKTLQLFANIRPAVSLHPFTRTLHPNLNLTIIRENEEDLYAGIEYRQTHNMYESMKLISHTGCEKIIRYAFEYAVKNNRKKVMCLSKDNIMKFSDGVLHKVFNEIAKEYPQINNAHYIIDIGTARLATKPEIFDVIVTSNLYGDIISDVAAEISGSVGLAGSANIGQHYAMFEAVHGSAPDIAGKDIANPSGLLNAAIMMLVHIGQGDIATLIENAWKKTIEDGVHTADIYNEQSSSKKVGTKEFAEEVTKRLGQLPTKLPKADYPLIAEKQESNIDYKIDTKEVKKLVGTDIFVNMNVSSAHDIADKINKLDLGNFELKTISSKGLKLWPRDTRFETVSDHWCCRFMNKDGTEIKHLDITRLLEALSTANIDFIKVENLFEFDGVAGYSLAQGE

SEQ ID NO: 28261 - DNA, 1452 bp, Rickettsia prowazekii
  CDS (1)..(1452): transl_table=11
atggcagcatttacaccgattacaatagcatatggggacggtataggccctgaaatcatggaggcagtactttatatattacgtaaagctgaggctcggattagtttagaaacaattgaagtaggtgaaaagctttacaaaaagcattatacttcaggcatcagcgaggaaagttgggatgtaatacaacgtacagggattatacttaaagcaccgattactactccgcaaagtggaggatataaaagtttaaacgtcacgattcgtaaaacattacagctttttgctaatattcgtcctgttgtttcattttatccttttactagaactctacatccaaatttaaacctcactattatacgtgagaatgaggaagatttatattcaggtgtagaataccgtcaaactcataatatgtatgagtcaatgaagttgataagtcatacaggatgtaaaaaaattattagatatgcttttgaatatgcaataaaaaataaccgtaaaaaagtcacgtgtttaactaaagataatattatgaaattttctgatgggatttttcatagagtatttaatgaaattgcaaaagaatatccacaaattaataatgagcattatattatcgatatcggaacggcaaagcttgctacaaagccggaaatatttgacataatcgtaacttctaatttatatggtgatattatctctgatgtcgctgctgaaatttctggttcggtgggacttgcaggttctgcaaatattgggcagcattatgcaatgtttgaagcagtacacgggagtgctccagatattgcaggtaaaggtattgctaatccttcagggcttttaaatgccgctataatgatgctagttcatataggacagggtgatattgctagtttaatcgaaaatgcttggaagaaaaccatagaggatggagtacatacattcgatatatataatgagcatagttctagtaaaaaagtatgtacaaaagaatttgctgtagaagtaattaaaagattagggcagttaccgattactttacctaaagcagcttatcctttaattgttaagaaacaagagagtaatatagattataaaattgatactagagaagttaagaagttggtcggtacagatatttttattaatatgcacgtattttctgctcatgatatagcagataaaattaataagcttgatattggtaattttgagctcaaaacaatttcgtcaaaaggattaaaattgtggcctcatgattcaaggtttgaaattatttctgatcattggtgttgtcgttttatgaataaagatggcacggaaataaagcatttagatatcacaatgttgcttcaatctttaagcaaagcaaatattgattttattaaagtagaaaatttatttgagtttgatggagtagcatggtatagccttgcacagggtgaatag

SEQ ID NO: 28262 - protein, 483 aa, Rickettsia prowazekii
MAAFTPITIAYGDGIGPEIMEAVLYILRKAEARISLETIEVGEKLYKKHYTSGISEESWDVIQRTGIILKAPITTPQSGGYKSLNVTIRKTLQLFANIRPVVSFYPFTRTLHPNLNLTIIRENEEDLYSGVEYRQTHNMYESMKLISHTGCKKIIRYAFEYAIKNNRKKVTCLTKDNIMKFSDGIFHRVFNEIAKEYPQINNEHYIIDIGTAKLATKPEIFDIIVTSNLYGDIISDVAAEISGSVGLAGSANIGQHYAMFEAVHGSAPDIAGKGIANPSGLLNAAIMMLVHIGQGDIASLIENAWKKTIEDGVHTFDIYNEHSSSKKVCTKEFAVEVIKRLGQLPITLPKAAYPLIVKKQESNIDYKIDTREVKKLVGTDIFINMHVFSAHDIADKINKLDIGNFELKTISSKGLKLWPHDSRFEIISDHWCCRFMNKDGTEIKHLDITMLLQSLSKANIDFIKVENLFEFDGVAWYSLAQGE

SEQ ID NO: 28263 - DNA, 1452 bp, Rickettsia typhi
  CDS (1)..(1452): transl_table=11
atggcagaatttacaccgattacaatagcatatggggacggtataggccctgaaatcatggatgcagtactttatatattacgtcaagctgaagctaggattagtttagaaacaattgaagtaggtgaaaaactttataagaagcattatacttcaggcataagtgaggaaagttggaatgtaatacaacgtacagggattatacttaaagcaccgattactactccgcaaagtggaggatataaaagtttaaacgttacgattcgtaaaacattacagctttttgctaatattcgtcctgctgtttcatttcatccttttactagaactctacatccaaatttaaacctaactattatacgtgagaatgaagaagatttatattcaggtatagagtaccgtcaaacgcataatatgtatgagtcactgaagttgataagtcatacaggatgtaaaaaaattattagatatgcttttgaatatgcagtaaaaaataaccgtaaaaaagttacgtgtttaagtaaagataatattatgaaattttctgatggaatttttcatagagtatttaatgaaatcgctaaagaatatccacaaattgataatgagcattatattatcgatatcggcacggcaaagcttgctacaacgccggaaatatttgacataatcgtaacttctaatttatatggtgatattatttctgatgtagctgctgaaatttctggttcagttggtcttgcaggttctgcaaatatcggtcagcattatgccatgtttgaagcagtacacggcagtgctccagatattgctggtaaaggtattgctaatccttcaggacttttaaatgccgctataatgatgctagttcatataggacaaggtgatattgctagtttaatcgaaaacgcttggaagaaaaccatagaggatggagtacatacattcgatatatatagtgagcatagttctagtaaaaaagtatgtacaaaagaatttgctgaagaagtaattaaaagattagggcagttgccgatgacattacctaaagcatcttatcctttaattgttaagaagcaagagagtaagatagagtataaaattgatactacagaagttaagaagttggtcggtacagatatttttattaatattcatgtattttctgctcatgatatagcagataaaattaataagcttgatattggtaattttgagctcaaaaccatttcgtcaaaaggattaaaattgtggcctcatgatttaaggtttgaaattatttctgatcattggtgttgtcgctttatgaataaagacggtacagaaataaagcatttagatatcataatattgcttcaagctttaagcaaagcaaatattgattttattaaagtagaaaatttatttgagtttgatggagttgcatgttatagccttgcacaaggtgaatag

SEQ ID NO: 28264 - protein, 483 aa, Rickettsia typhi
MAEFTPITIAYGDGIGPEIMDAVLYILRQAEARISLETIEVGEKLYKKHYTSGISEESWNVIQRTGIILKAPITTPQSGGYKSLNVTIRKTLQLFANIRPAVSFHPFTRTLHPNLNLTIIRENEEDLYSGIEYRQTHNMYESLKLISHTGCKKIIRYAFEYAVKNNRKKVTCLSKDNIMKFSDGIFHRVFNEIAKEYPQIDNEHYIIDIGTAKLATTPEIFDIIVTSNLYGDIISDVAAEISGSVGLAGSANIGQHYAMFEAVHGSAPDIAGKGIANPSGLLNAAIMMLVHIGQGDIASLIENAWKKTIEDGVHTFDIYSEHSSSKKVCTKEFAEEVIKRLGQLPMTLPKASYPLIVKKQESKIEYKIDTTEVKKLVGTDIFINIHVFSAHDIADKINKLDIGNFELKTISSKGLKLWPHDLRFEIISDHWCCRFMNKDGTEIKHLDIIILLQALSKANIDFIKVENLFEFDGVACYSLAQGE

SEQ ID NO: 28265 - DNA, 1269 bp, Staphylococcus aureus
  CDS (1)..(1269)
atgactgcagaaaaaattactcaaggaactgaaggattaaacgtacctaatgaaccaattatcccatttattatcggtgatggaattggaccggatatttggaaggcagcaagccgagttatagatgctgctgttgagaaagcctataatggcgaaaaacgcattgaatggaaagaagtgctagctggccaaaaagcatttgatacaactggtgaatggttacctcaagaaacacttgatacaattaaagaatatttaattgctgttaaaggacctttaacaacaccaattggtggtggtattagatcattaaatgtggctttacgccaagaattagatttatttacttgcttaagaccggtacgttggtttaaaggagtaccatcacctgttaaacgtccacaagatgttgatatggttattttccgtgaaaatactgaagacatttatgctggtattgaatttaaagaaggtacaacagaagttaaaaaggtaattgacttcttacaaaacgaaatgggtgcgacaaacattcgattcccagaaacttcaggtattggtattaaaccagtttctaaagaaggaactgagcgattagttagagcagctatacaatatgctatcgataataaccgtaaatcagttactttagttcataaaggtaatattatgaaatttacagaaggctcatttaagcagtggggttacgatttagcattatctgaatttggtgatcaagtattcacttggcaacaatatgacgaaattgttgaaaatgaaggcagagatgctgctaatgctgctcaagaaaaagctgaaaaagaaggcaagattatcattaaagattctattgctgacattttcttacaacaaattttaactcgtccagctgagcatgatgttgtagcaactatgaacttgaatggtgactatatttcagatgctttagctgcacaagttggtggtattggtattgcgccaggtgcaaacattaattatgaaacaggtcatgctatttttgaagcaacacatggtacagctccaaaatatgcaggtttaaataaagtgaatccatcttcagtaattttaagttctgtattaatgttagaacatttaggatggcaagaagcggcagataagattacagattcaattgaagatacaattgcttcaaaagttgttacttatgactttgcccgtttaatggatggtgctgaagaagtttctacatcagcatttgcagatgaattgattaaaaatttaaaataa

SEQ ID NO: 28266 - protein, 422 aa, Staphylococcus aureus
MTAEKITQGTEGLNVPNEPIIPFIIGDGIGPDIWKAASRVIDAAVEKAYNGEKRIEWKEVLAGQKAFDTTGEWLPQETLDTIKEYLIAVKGPLTTPIGGGIRSLNVALRQELDLFTCLRPVRWFKGVPSPVKRPQDVDMVIFRENTEDIYAGIEFKEGTTEVKKVIDFLQNEMGATNIRFPETSGIGIKPVSKEGTERLVRAAIQYAIDNNRKSVTLVHKGNIMKFTEGSFKQWGYDLALSEFGDQVFTWQQYDEIVENEGRDAANAAQEKAEKEGKIIIKDSIADIFLQQILTRPAEHDVVATMNLNGDYISDALAAQVGGIGIAPGANINYETGHAIFEATHGTAPKYAGLNKVNPSSVILSSVLMLEHLGWQEAADKITDSIEDTIASKVVTYDFARLMDGAEEVSTSAFADELIKNLK

SEQ ID NO: 28267 - DNA, 1269 bp, Staphylococcus aureus
  CDS (1)..(1269): transl_table=11
atgactgcagaaaaaattactcaaggaactgaaggattaaacgtacctaatgagccaattatcccatttattatcggtgatggaattggaccggatatttggaaggcagcaagccgagttatagatgctgctgttgagaaagcctataatggcgaaaaacgcattgaatggaaagaagtgctagctggtcaaaaagcatttgatacaactggcgaatggttacctcaagaaacacttgatacaattaaagaatatttaattgctgttaaaggacctttaacaacaccaattggtggtggtattagatcattaaatgtagctttacgccaagaattagatttatttacttgtttaagaccggtacgttggtttaaaggagtaccatcacctgttaaacgtccacaagatgttgatatggttattttccgtgaaaatactgaagacatttatgctggtattgaatttaaagaaggaacaacagaagttaaaaaggtaattgatttcttacaaaacgaaatgggtgcgacaaatattcgattcccagaaacttcaggtattggtattaagccagtttctaaagaaggtactgagcgattagttagagcagcaattcaatatgctatcgataataaccgtaaatcagttactttagttcataaaggtaatattatgaaatttacagaaggctcatttaagcagtggggttacgatttagcattaactgaatttggtgatcaagtatttacttggcaacaatatgacgaaattgttgaaaaagaaggcagagatgctgctaatgttgcacaagaaaaagctgaaaaagaaggcaagattatcattaaagattctattgctgacattttcttacaacaaattttaactcgtccagctgagcatgatgttgtagcaactatgaacttgaatggtgactacatttcagatgcattagctgcacaagttggtggtattggtattgcgccaggtgcaaacattaattatgaaacagggcatgctatttttgaagcaacacatggtacagctccaaaatatgcaggtttaaataaagtgaatccatcttcagtaattttaagttctgtattaatgttagaacatttaggatggcaagaagcggcagataagattacagattcaattgaagatacaattgcttcaaaagttgttacttatgactttgcccgtttaatggatggtgctgaagaagtttctacatcagcatttgcagatgaattgattaaaaatttaaaataa

SEQ ID NO: 28268 - protein, 422 aa, Staphylococcus aureus
MTAEKITQGTEGLNVPNEPIIPFIIGDGIGPDIWKAASRVIDAAVEKAYNGEKRIEWKEVLAGQKAFDTTGEWLPQETLDTIKEYLIAVKGPLTTPIGGGIRSLNVALRQELDLFTCLRPVRWFKGVPSPVKRPQDVDMVIFRENTEDIYAGIEFKEGTTEVKKVIDFLQNEMGATNIRFPETSGIGIKPVSKEGTERLVRAAIQYAIDNNRKSVTLVHKGNIMKFTEGSFKQWGYDLALTEFGDQVFTWQQYDEIVEKEGRDAANVAQEKAEKEGKIIIKDSIADIFLQQILTRPAEHDVVATMNLNGDYISDALAAQVGGIGIAPGANINYETGHAIFEATHGTAPKYAGLNKVNPSSVILSSVLMLEHLGWQEAADKITDSIEDTIASKVVTYDFARLMDGAEEVSTSAFADELIKNLK

SEQ ID NO: 28269 - DNA, 1269 bp, Staphylococcus aureus
  CDS (1)..(1269): transl_table=11
atgactgcagaaaaaattactcaaggaactgaaggattaaacgtacctaatgaaccaattatcccatttattatcggtgatggaattggaccggatatttggaaggcagcaagccgagttatagatgctgctgttgagaaagcctataatggcgaaaaacgcattgaatggaaagaagtgctagctggccaaaaagcatttgatacaactggtgaatggttacctcaagaaacacttgatacaattaaagaatatttaattgctgttaaaggacctttaacaacaccaattggtggtggtattagatcattaaatgtggctttacgccaagaattagatttatttacttgtttaagaccggtacgttggtttaaaggagtaccatcacctgttaaacgtccacaagatgttgatatggttattttccgtgaaaatactgaagacatttatgctggtattgaatttaaagaaggtacaacagaagttaaaaaggtaattgacttcttacaaaacgaaatgggtgcgacaaatattcgattcccagaaacttcaggtattggtattaaaccagtttctaaagaaggaactgagcgattagttagagcagctatacaatatgctatcgataataaccgtaaatcagttactttagttcataaaggtaatattatgaaatttacagaaggctcatttaagcagtggggttacgatttagcattatctgaatttggtgatcaagtattcacttggcaacaatatgacgaaattgttgaaaaagaaggcagagatgctgctaatgctgctcaagaaaaagctgaaaaagaaggcaagattatcattaaagattctattgctgacattttcttacaacaaattttaactcgtccagctgagcatgatgttgtagcaactatgaacttgaatggtgactatatttcagatgctttagctgcacaagttggtggtattggtattgcgccaggtgcaaacattaattatgaaacaggtcatgctatttttgaagcaacacatggtacagctccaaaatatgcaggtttaaataaagtgaatccatcttcagtaattttaagttctgtattaatgttagaacatttaggatggcaagaagcggcagataagattacagattcaattgaagatacaattgcttcaaaagttgttacttatgactttgcccgtttaatggatggtgctgaagaagtttctacatcagcatttgcagatgaattgattaaaaatttaaaataa

SEQ ID NO: 28270 - protein, 422 aa, Staphylococcus aureus
MTAEKITQGTEGLNVPNEPIIPFIIGDGIGPDIWKAASRVIDAAVEKAYNGEKRIEWKEVLAGQKAFDTTGEWLPQETLDTIKEYLIAVKGPLTTPIGGGIRSLNVALRQELDLFTCLRPVRWFKGVPSPVKRPQDVDMVIFRENTEDIYAGIEFKEGTTEVKKVIDFLQNEMGATNIRFPETSGIGIKPVSKEGTERLVRAAIQYAIDNNRKSVTLVHKGNIMKFTEGSFKQWGYDLALSEFGDQVFTWQQYDEIVEKEGRDAANAAQEKAEKEGKIIIKDSIADIFLQQILTRPAEHDVVATMNLNGDYISDALAAQVGGIGIAPGANINYETGHAIFEATHGTAPKYAGLNKVNPSSVILSSVLMLEHLGWQEAADKITDSIEDTIASKVVTYDFARLMDGAEEVSTSAFADELIKNLK

SEQ ID NO: 28271 - DNA, 1269 bp, Staphylococcus epidermidis
  CDS (1)..(1269): transl_table=11
atgtctgcagaaaaaataacacagagtaaagatggtttaaatgtacctaatgaacctattattccgtttattattggtgatggtattggaccagatatttggaaagcagctagccgagtaatcgatgctgctgttgaaaaagcgtataatggagaaaaacgtatagaatggaaagaagtcttagcaggtcaaaaagcttatgatgaaactggagaatggttgccacaagaaacgttagaaacaatcaaagaatatttaattgctgttaaaggtcctttaacaactccaattggtggtggaattcgttcattaaacgtagcactgagacaagagttagatttattcacttgtttacgtccggtacgttggttcaaaggcgttccttcaccagttaagcgacctgaagatgttgatatggttattttccgtgaaaataccgaagatatatatgcagggatagaatttaaacaaggtacatcagaagtaaaaaaagttatagatttcttacaaaatgaaatgggagcaactaatattcgtttccctgaaacttctggtattggtataaagccagtatctaaagaaggtacagaacgtctagtaagagcagctattcaatatgcacttgataataatcgtaaatcagtaactttagttcataaaggtaatattatgaaatttactgaaggttcatttaagcagtggggctatgatttagctcataatgaatttggtgataaagtgtttacatggcaacaatatgatgaaattgttgaacaaaagggtaaagatgctgcgaatgaagcacaaagtaaagctgaacaagaaggtaaaattattattaaagactctattgctgatatcttcttacaacaaatattaactcgtccagctgaacatgatgttgtggcaactatgaatttaaatggtgactatatctctgatgctcttgcagctcaagttggaggcattggtattgcgcctggtgctaacattaactatgaaactggacatgctatttttgaagcaacacatggtactgcacctaaatatgctggtttaaataaggttaatccgtcatcagaaattttaagttcagttttaatgcttgaacatttaggttggcaagaagccgcagataaaatcactgactctattgaggcaacaattgcttcaaaaatcgtaacatatgattttgcgcgtcttatggatggtgcaaaagaagtttcaacatctgattttgctgatgaactaattaagaatattagataa

SEQ ID NO: 28272 - protein, 422 aa, Staphylococcus epidermidis
MSAEKITQSKDGLNVPNEPIIPFIIGDGIGPDIWKAASRVIDAAVEKAYNGEKRIEWKEVLAGQKAYDETGEWLPQETLETIKEYLIAVKGPLTTPIGGGIRSLNVALRQELDLFTCLRPVRWFKGVPSPVKRPEDVDMVIFRENTEDIYAGIEFKQGTSEVKKVIDFLQNEMGATNIRFPETSGIGIKPVSKEGTERLVRAAIQYALDNNRKSVTLVHKGNIMKFTEGSFKQWGYDLAHNEFGDKVFTWQQYDEIVEQKGKDAANEAQSKAEQEGKIIIKDSIADIFLQQILTRPAEHDVVATMNLNGDYISDALAAQVGGIGIAPGANINYETGHAIFEATHGTAPKYAGLNKVNPSSEILSSVLMLEHLGWQEAADKITDSIEATIASKIVTYDFARLMDGAKEVSTSDFADELIKNIR

SEQ ID NO: 28273 - DNA, 1182 bp, Streptococcus mutans
  CDS (1)..(1182): transl_table=11
atggcagaaaaagtaagttttgaagaagggaaattacaggtgcctgataagcccgttattccttacattgaaggagatggtgttggtcaggatatttggaagaatgcgcaaatcgtttttgataaagccattgctaaagtttatggaggtcacaagcaggttatttggcgggaggtcttagctggtaaaaaagcttataatgaaacaggcaactggctgcctaatgagactttagaaattatcaagacgcatttacttgctattaaaggtccattggaaactcctgttggaggtggcattcgttccttaaatgttgccctgcgtcaagaattggatctctttgcttgcgtgcgtccagtgcgttatttcaaaggtgtccctagtccacttaagcatcctgaaaaaacggctattaccatttttcgagaaaatactgaagatatttacgcaggtatcgaatggaatgcgggtacagcagaagttcaaaaggtcatcaactttttacaagatgatatgcaggttaagaaaattcgttttccaaaaagcagcagtatagggattaaacctatttcaattgaaggcagccaacgtttgattcgtgcagctatcgaatatgctctggccaacaatctgaccaaggtaactttggttcataaaggaaatattcaaaaattcactgaaggtggctttagaaaatggggctatgaattagcaaaacgtgagtatgctgccgaacttgccagtggtcaattggtagttgatgatattattgctgacaatttcttgcaacaaattctgctcaagcctgagcgttttgatgtagttgccttaacgaatctcaatggagactatgccagcgatgccttagcagcacaagttggcggtattggtatttcgccaggagctaatattaactatcaaacgggacatgctatttttgaagcaacccatggaacggctccagatattgcaggtcaagacttggccaacccatcttctgttttattatcaggctgcatgctttttgactatattggttggtcaaaagtctcagatttaatcatgaaagctgttgaaaaagctattgcaaatggtcaagttaccattgattttgccaaggaactaggggttgaagcattgacaacccgtcagttttctgaagttctattgacttatttatag

SEQ ID NO: 28274 - protein, 393 aa, Streptococcus mutans
MAEKVSFEEGKLQVPDKPVIPYIEGDGVGQDIWKNAQIVFDKAIAKVYGGHKQVIWREVLAGKKAYNETGNWLPNETLEIIKTHLLAIKGPLETPVGGGIRSLNVALRQELDLFACVRPVRYFKGVPSPLKHPEKTAITIFRENTEDIYAGIEWNAGTAEVQKVINFLQDDMQVKKIRFPKSSSIGIKPISIEGSQRLIRAAIEYALANNLTKVTLVHKGNIQKFTEGGFRKWGYELAKREYAAELASGQLVVDDIIADNFLQQILLKPERFDVVALTNLNGDYASDALAAQVGGIGISPGANINYQTGHAIFEATHGTAPDIAGQDLANPSSVLLSGCMLFDYIGWSKVSDLIMKAVEKAIANGQVTIDFAKELGVEALTTRQFSEVLLTYL

SEQ ID NO: 28275 - DNA, 1176 bp, Streptococcus salivarius
  CDS (1)..(1176): transl_table=11
atggcagaaaaaatcgtaatgaaaaatggacagcttcaagtttctgatcgtccaattatcccttttattgaaggcgatggtgttggacatgatatctggaagaatgcccaagcaatctttgataaagcagtagaagtagcctatgaaggaaagcgtcatattgaatggcaagagcttctagccggtaagaaggcttatgacaaaacaggtgaatggttgccgaaagaaactttggaagctattcgagaaagtttagtagctattaagggaccgcttgagacgccagtaggtggtggtatccgttcattaaatgtagcattacgtcaagaacttgatctctacgcttgtgttagacctgttcgttactttgacggagtagcaagtccacttaaggaaccagaaaaaacaaatattactatcttccgtgaaaataccgaagatatttatgctgggattgaatgggaagcaggaacggcagatgtcaagcgcgtgattgagtttctccagacagaaatgaatgttaataaaattcgcttcccagagtcaagtagtatcggaattaagccaatttcaatagaaggaagtaaacgtctcattcgctctgctatcgactatgctctcaagaacaatctaaagaaagtgacattggttcataaagggaatattcaaaaattcacagaaggtggcttccgtaaatggggttatgaagtagctcaggaagactataaagaagaattgctggctggtcgtttagagattaatgatataatcgctgataactttctccaacagattcttttaaatccagaaaaatttgatgttgttgccttaaccaacttgaatggtgattatgccagtgatgccttggctgcacaagttggtggtatcggcatctcccctggagccaacattaactatcaaacaggccatgctatttttgaagcaacacatggaacagctccggatattgcagatcaagataaggctaatccttgctcagttttattatctggctgcatgcttctagattatattggttggactgaggcagctcaactgattacaagtgctattgagaagacatttaaagctgatatctttacagctgacttagcatttgggaaacaagcttattcaacgagtgcctttagcaatcaaattctttcaattatgtga

SEQ ID NO: 28276 - protein, 391 aa, Streptococcus salivarius
MAEKIVMKNGQLQVSDRPIIPFIEGDGVGHDIWKNAQAIFDKAVEVAYEGKRHIEWQELLAGKKAYDKTGEWLPKETLEAIRESLVAIKGPLETPVGGGIRSLNVALRQELDLYACVRPVRYFDGVASPLKEPEKTNITIFRENTEDIYAGIEWEAGTADVKRVIEFLQTEMNVNKIRFPESSSIGIKPISIEGSKRLIRSAIDYALKNNLKKVTLVHKGNIQKFTEGGFRKWGYEVAQEDYKEELLAGRLEINDIIADNFLQQILLNPEKFDVVALTNLNGDYASDALAAQVGGIGISPGANINYQTGHAIFEATHGTAPDIADQDKANPCSVLLSGCMLLDYIGWTEAAQLITSAIEKTFKADIFTADLAFGKQAYSTSAFSNQILSIM

SEQ ID NO: 28277 - DNA, 1428 bp, Synechocystis sp
  CDS (1)..(1428): transl_table=11
atgtacgaaaaacttcagccccccagcgttgggtcaaaaatcacctttgttgcaggtaagcccgtagtacccaacgatccgattattccctacatccggggggacggcaccggggttgatatttggcccgctacggaattagtcatcaatgcagcgatcgccaaggcctatggcggccgagaggaaatcaactggttcaaagtctatgccggggacgaagcctgtgaattgtacggcacttatcagatatttccggaagacactttaacagcgattaaggagtatggggtagccatcaaagggcctctcacaaccccggtgggcggtggtatccgttccctaaacgtggccctgagacaaatttttgacctctacacctgtgtgcggccctgtcgttactatcccggtactccgtctccccacaaaaccccggaaaaattagacattatcgtttatcgggaaaatacggaagatatttacctaggcattgaatgggcggaaggtacggaaggggcgaaaaagttaatcgcttaccttaacgatgaactcattcccacaactccagctttgggcaaaaaacaaattcgcctcgactctggcattggtattaaaccgattagtaagactggttcccaacggttggtgcggcgggctattctccatgctaagcgcttgccgaaagcaaaacagatggtgacgttggtccataagggcaacattatgaagttcaccgaagggccgtttcgggattggggttacgagttggctacgacggaatttcgggcggaatgcgttacggaacgggaatcttggatttgcggcaataaggaaagtaatccggacttaaccattgaggccaacgcccacatgattgaccccggttatgacactttgaccgaagaaaaacaagcggtcattaaacaagaagtggagcaggttttaaattccatttgggaatcccatggtaatggccagtggaaagaaaaagtcatggtcaatgaccgcattgccgatagtattttccaacagatccaaacccgccccgatgagtattccattctggcgaccatgaatttgaacggggattacctttccgatgccgccgccgctgtggtgggaggtttgggcatgggccccggagctaacattggggatagtgcagccatttttgaagccacccacggcactgcccccaaacatgctggtttagaccggatcaaccccggctctgtgatcctttccggcgtaatgatgctggaatttatgggctggcaggaggccgctgatctgattaaaaaaggtatcggagcggcgatcgccaatcgggaagttacctacgatttagcccggttaatggaaccgaaggtggataaacccctaaaatgctccgagtttgcccaggcgatcgtcagtcatttcgatgattaa

SEQ ID NO: 28278 - protein, 475 aa, Synechocystis sp
MYEKLQPPSVGSKITFVAGKPVVPNDPIIPYIRGDGTGVDIWPATELVINAAIAKAYGGREEINWFKVYAGDEACELYGTYQIFPEDTLTAIKEYGVAIKGPLTTPVGGGIRSLNVALRQIFDLYTCVRPCRYYPGTPSPHKTPEKLDIIVYRENTEDIYLGIEWAEGTEGAKKLIAYLNDELIPTTPALGKKQIRLDSGIGIKPISKTGSQRLVRRAILHAKRLPKAKQMVTLVHKGNIMKFTEGPFRDWGYELATTEFRAECVTERESWICGNKESNPDLTIEANAHMIDPGYDTLTEEKQAVIKQEVEQVLNSIWESHGNGQWKEKVMVNDRIADSIFQQIQTRPDEYSILATMNLNGDYLSDAAAAVVGGLGMGPGANIGDSAAIFEATHGTAPKHAGLDRINPGSVILSGVMMLEFMGWQEAADLIKKGIGAAIANREVTYDLARLMEPKVDKPLKCSEFAQAIVSHFDD

SEQ ID NO: 28279 - DNA, 1491 bp, Thermus thermophilus
  CDS (1)..(1491): transl_table=11
atgcccctgatcaccacggaaaccggcaagaagatgcacgttctcgaggacgggcgcaagctcatcaccgtcatccccggagacggcatcgggcccgagtgcgtggaggctaccctcaaggtcctagaggcggccaaggcccccctggcctacgaggtgcgagaggcgggggcgagcgtcttccggcggggcatcgcctcgggcgttccccaggagaccattgagtccatccgcaagacccgggtggtcctgaagggtcccctggaaaccccggtgggctacggggagaagagcgccaacgtcaccctaaggaagctctttgagacctacgccaacgtccgccccgtgcgggagttccccaacgtccccaccccctatgcgggccggggcattgacctcgtggtggtgcgggagaacgtggaggacctctacgccgggattgagcacatgcagaccccgagcgtggcccagaccctcaagctcatctcctggaagggatcggagaagatcgtccgcttcgcctttgagctggcccgggccgaggggcggaagaaggtccactgcgccaccaagtccaacatcatgaagctcgccgaagggaccctgaagcgggcctttgagcaggtggcccaggagtaccccgacatagaagcggtccacatcatcgtggacaacgctgcccaccagctggtgaaaaggcccgagcagtttgaggtgatcgtcaccaccaacatgaacggagacatcctctccgacctcacctcggggctcattgggggcctgggcttcgctccctcggccaacatcggcaacgaggtggccatctttgaggccgtccacggttccgcccccaagtacgccgggaagaacgtcatcaaccccaccgcggtcctcctctcggcggtgatgatgctccgctacctggaggagttcgccacggcggaccttatagagaacgccctcctctacaccctcgaggagggccgggtcctcacgggggacgtggtgggctacgaccggggggccaagaccacggagtacaccgaggccatcatccagaacctgggcaagaccccaaggaagacccaggtgcggggctacaagcccttccgcctgccccaggtggacggggccatcgcccccatcgtccctaggagccgccgggttgtgggggtggacgtcttcgtggaaaccaacctcctgcccgaggccctgggaaaggccctggaggaccttgccgcgggcacccccttccggctcaagatgatctccaaccggggcacccaggtctacccccccaccggcgggctcacggacctggtggaccactaccgctgccgcttcctctacacgggggagggggaggctaaggacccggagatcctggacctcgtaagccgggtggcaagccgcttccgctggatgcacctggagaagctccaggaatttgacggcgagcccggcttcaccaaggcccaaggggaagactaa

SEQ ID NO: 28280 - protein, 496 aa, Thermus thermophilus
MPLITTETGKKMHVLEDGRKLITVIPGDGIGPECVEATLKVLEAAKAPLAYEVREAGASVFRRGIASGVPQETIESIRKTRVVLKGPLETPVGYGEKSANVTLRKLFETYANVRPVREFPNVPTPYAGRGIDLVVVRENVEDLYAGIEHMQTPSVAQTLKLISWKGSEKIVRFAFELARAEGRKKVHCATKSNIMKLAEGTLKRAFEQVAQEYPDIEAVHIIVDNAAHQLVKRPEQFEVIVTTNMNGDILSDLTSGLIGGLGFAPSANIGNEVAIFEAVHGSAPKYAGKNVINPTAVLLSAVMMLRYLEEFATADLIENALLYTLEEGRVLTGDVVGYDRGAKTTEYTEAIIQNLGKTPRKTQVRGYKPFRLPQVDGAIAPIVPRSRRVVGVDVFVETNLLPEALGKALEDLAAGTPFRLKMISNRGTQVYPPTGGLTDLVDHYRCRFLYTGEGEAKDPEILDLVSRVASRFRWMHLEKLQEFDGEPGFTKAQGED

SEQ ID NO: 28281 - DNA, 981 bp, Archaeoglobus fulgidus
  CDS (1)..(981): transl_table=11
atgaagaaaattgtggtaatccccggagacggcataggcaaggaggttatggaggctgcgatgctaattctcgagaagctcgacctgccctttgaatacagctactacgatgctggagatgaggctctggagaagtacggaaaagctctgcctgatgagacgctggaagcttgcaggaagagcgatgcggtgcttttcggtgccgccggggaaacggcggcagatgtcatagtgaggctgagaagggagctcggaacctttgccaacgtcaggccagcgaaggcaattgagggcattgaatgcctctatcccggcttagacattgttgtggtgagggaaaacacagagtgcctttacatgggcttcgagttcggcttcggggacgttactgaagccatcagagtgattacgagagaggcttccgagagaattgcgaggtatgcttttgagctggctaaaagggagggcaggaagaaggttacagccctgcacaaagccaatgttatgaagaaaacatgcgggctatttagggatgtgtgcagagaagttgcgaaagattatcccgaaattcagtacaatgactactacatcgatgcagcttgcatgtacctcgttatggaccccttccgcttcgatgtaatcgttacgacaaacatgtttggtgatatcgtctctgacttagctgcaggcctcgttggaggacttggtcttgccccctcagccaatgttggggagaggacggccattttcgagccggtacatggtgctgccttcgacatcgctggaaagggaattgcaaatccaactgccatgattctcacagcctgcatgatgctccgccacttcggctatgttgaggaggccaagaaggttgaggaagctgttgagaagaccattaaggaggggaagaagactccggatttgggaggtaacctcaaaactatggagtttgccaacgaagttgcatcccttttggattag

SEQ ID NO: 28282 - protein, 326 aa, Archaeoglobus fulgidus
MKKIVVIPGDGIGKEVMEAAMLILEKLDLPFEYSYYDAGDEALEKYGKALPDETLEACRKSDAVLFGAAGETAADVIVRLRRELGTFANVRPAKAIEGIECLYPGLDIVVVRENTECLYMGFEFGFGDVTEAIRVITREASERIARYAFELAKREGRKKVTALHKANVMKKTCGLFRDVCREVAKDYPEIQYNDYYIDAACMYLVMDPFRFDVIVTTNMFGDIVSDLAAGLVGGLGLAPSANVGERTAIFEPVHGAAFDIAGKGIANPTAMILTACMMLRHFGYVEEAKKVEEAVEKTIKEGKKTPDLGGNLKTMEFANEVASLLD

SEQ ID NO: 28283 - DNA, 1002 bp, Methanococcus jannaschii
  CDS (1)..(1002): transl_table=11
atgcataaaatatgtgttatagaaggagatggaattggtaaagaggttgttccagcaacaattcaagttttagaagctactggtttgccatttgagtttgtctatgctgaggcaggggatgaggtttataaaagaactggtaaggcattaccagaagaaacaattgaaactgccttagactgtgatgctgttttatttggagcggctggagaaacagcggcagatgttattgttaaattgaggcatatattggatacttatgcaaacattagaccagttaaagcatacaaaggagttaagtgcctaaggccagatattgattacgttatagttagggaaaacactgaagggctttataaaggaatagaggcagagattgatgaaggaattacaatagctacaagagttataacagaaaaagcatgtgagagaatatttagatttgcttttaacttagcaagggaaagaaagaagatgggcaaagaaggaaaggttacatgtgctcacaaagcaaatgtcttaaaattaactgatgggttatttaaaaagatattttataaagttgcagaggaatatgacgatataaaagcagaagattattacatagatgcaatgaatatgtatatcataacaaaaccgcaagtatttgatgttgtagttacttccaacttatttggagatattttatcagatggagctgctggaactgttgggggattaggtttagctccttcagcgaatataggagatgaacatggattatttgagccggttcatggttcagctccagatattgctggaaaaaagatagctaatccaacagctacaatattaagtgctgttttaatgcttagatacttaggagagtatgaagctgcagataaagttgaaaaagcattggaggaagttttagctttaggtttaacaacacctgacttaggaggtaatttaaatacatttgaaatggctgaagaagtagctaaaagagtaagagaagaataa

SEQ ID NO: 28284 - protein, 333 aa, Methanococcus jannaschii
MHKICVIEGDGIGKEVVPATIQVLEATGLPFEFVYAEAGDEVYKRTGKALPEETIETALDCDAVLFGAAGETAADVIVKLRHILDTYANIRPVKAYKGVKCLRPDIDYVIVRENTEGLYKGIEAEIDEGITIATRVITEKACERIFRFAFNLARERKKMGKEGKVTCAHKANVLKLTDGLFKKIFYKVAEEYDDIKAEDYYIDAMNMYIITKPQVFDVVVTSNLFGDILSDGAAGTVGGLGLAPSANIGDEHGLFEPVHGSAPDIAGKKIANPTATILSAVLMLRYLGEYEAADKVEKALEEVLALGLTTPDLGGNLNTFEMAEEVAKRVREE

SEQ ID NO: 28285 - DNA, 990 bp, Methanobacterium thermoautotrophicum
  CDS (1)..(990): transl_table=11
gtgaaatcaatgaagatagcagtcatacccggtgatggaatcggagtggaggtgatggaggcagccctccacatcctgaacaccctcgaccttgaccttgaattcatacatgcagatgccggtgatgcctgccttaaaaggacagggacggcactgccagaggagacccttgaagccgtgggtgaagccagggcaaccctcttcggggctgcgggtgaaagcgcagctgacgttatagtccgcctgaggcgtgaatttgatctttttgcgaatttgaggcctgttaagtccctgccaggtgtcccctgcctctacccggaccttgactttgtgattgtgcgggagaacaccgaggacctctatgtcggtgacgaggagtacacccctgagggcgccgttgcaaaaagaatcataacaagaaccgcctccaggagaatcagccaattcgccttccagtacgcccagaaagagggcatgcaaaaggtaacagcagtccacaaggccaacgtactcaaaaaaaccgacggaatcttcagagacgaattctataaagtggcatcagaatacccccagatggaggccaccgactactacgtggacgccacagcaatgtacctcataacccagccccaggaattccagaccatcgtcacaaccaacctattcggagacatactatcagacgaagccgcaggactcatcggaggactcggactcgcaccatcagcaaacataggagaaaaaaacgcactattcgaaccagtgcacggatcagcaccccaaatcgcaggaaaaaacatagccaaccccacagccatgatactaacaaccacactaatgctaaaacacctcaacaaaaaacaagaagcccaaaaaatagaaaaagcactccaaaaaacccttgcagagggtcttgtgacaccggacctcggtgggaagcttggcaccatggagatggctgccgagatagccagacacctggaggattga

SEQ ID NO: 28286 - protein, 329 aa, Methanobacterium thermoautotrophicum
MKSMKIAVIPGDGIGVEVMEAALHILNTLDLDLEFIHADAGDACLKRTGTALPEETLEAVGEARATLFGAAGESAADVIVRLRREFDLFANLRPVKSLPGVPCLYPDLDFVIVRENTEDLYVGDEEYTPEGAVAKRIITRTASRRISQFAFQYAQKEGMQKVTAVHKANVLKKTDGIFRDEFYKVASEYPQMEATDYYVDATAMYLITQPQEFQTIVTTNLFGDILSDEAAGLIGGLGLAPSANIGEKNALFEPVHGSAPQIAGKNIANPTAMILTTTLMLKHLNKKQEAQKIEKALQKTLAEGLVTPDLGGKLGTMEMAAEIARHLED

SEQ ID NO: 28287 - DNA, 1074 bp, Solanum tuberosum
  CDS (1)..(1074)
atggctcttcagattgcgaaaagactccttcgatgccgcgctgattctgttgcatcctctgttagatttttcgatcggaccttcacttccgaatccaattccaacttgatccgcgctacgcttttccccggcgatggtattggacctgaaatcgccgagtccgtcaggcagatattcaaggttgctgaggtaccaattgaatgggaagaacactatgtggggacggaggtagaccctagaaccaacagctttctaacatgggaaagtcttgaatcagtgagacggaataaggttggtttgaaagggccaatggccactcctattggaaaaggtcatcgttccttgaaccttacattgaggaaggagttaaatctatatgccaatgtcagaccttgctacagcctacctggatataagactcgctacgatgatgtgaatctcatcactattagagagaacactgaaggagagtacagtggtcttgaacatcaagtagtaagaggtgtggttgaaagtctcaagatcattacccgtcaagcaagtttaagggttgcagagtatgcatttcactatgccaagacccatggaagagagagagtgtctgcaattcacaaagccaacatcatgcagaagacagatggtctttttcttaagtgttgccgagaggtcgcggaaaagtaccctgagataaagtatgaggaagttgtcattgacaattgctgtatgatgcttgtgaaaaatccagcactttttgatgttctggtgatgcctaatctttatggtgacataatcagtgatctttgtgctggtttgattggtggtttgggcttaactccaagttgcaatattggcgagggaggtattgcccttgctgaggctgtgcatggttcagcacctgatattgccggaaagaatttggcgaatccaactgctttgcttttgagttctgtctctatgcttcgtcatctagagcttcatgataaagctgatcgcatccaagatgccatcctaaaaacaattgcaggagggaaagtaccgaactggcgaccttggaggcactgctacaacaactga

SEQ ID NO: 28288 - protein, 357 aa, Solanum tuberosum
MALQIAKRLLRCRADSVASSVRFFDRTFTSESNSNLIRATLFPGDGIGPEIAESVRQIFKVAEVPIEWEEHYVGTEVDPRTNSFLTWESLESVRRNKVGLKGPMATPIGKGHRSLNLTLRKELNLYANVRPCYSLPGYKTRYDDVNLITIRENTEGEYSGLEHQVVRGVVESLKIITRQASLRVAEYAFHYAKTHGRERVSAIHKANIMQKTDGLFLKCCREVAEKYPEIKYEEVVIDNCCMMLVKNPALFDVLVMPNLYGDIISDLCAGLIGGLGLTPSCNIGEGGIALAEAVHGSAPDIAGKNLANPTALLLSSVSMLRHLELHDKADRIQDAILKTIAGGKVPNWRPWRHCYNN

SEQ ID NO: 28289 - DNA, 25 bp, Artificial sequence
  (1)..(25): primer
atggaaagtaaagtagttgttccgg

SEQ ID NO: 28290 - DNA, 24 bp, Artificial sequence
  (1)..(24): primer
ttacatgttttcgatgatcgcgtc

SEQ ID NO: 28291 - protein, 481 aa, Artificial sequence
  Variant (2)..(3): xaa in position 2 to 3 is any amino acid
  Variant (5)..(5): xaa in position 5 is any amino acid
  Variant (11)..(11): xaa in position 11 is any amino acid
  Variant (14)..(19): xaa in position 14 to 19 is any amino acid
  Variant (21)..(23): xaa in position 21 to 23 is any amino acid
  Variant (25)..(26): xaa in position 25 to 26 is any amino acid
  Variant (27)..(34): xaa in position 27 to 34 is any or no amino acid
  Variant (36)..(36): xaa in position 36 is any or no amino acid
  Variant (38)..(38): xaa in position 38 is any amino acid
  Variant (39)..(42): xaa in position 39 to 42 is any or no amino acid
  Variant (44)..(52): xaa in position 44 to 52 is any amino acid
  Variant (53)..(62): xaa in position 53 to 62 is any or no amino acid
  Variant (65)..(65): xaa in position 65 is any amino acid
  Variant (66)..(67): xaa in position 66 to 67 is any or no amino acid
  Variant (69)..(70): xaa in position 69 to 70 is any amino acid
  Variant (72)..(75): xaa in position 72 to 75 is any amino acid
  Variant (77)..(77): xaa in position 77 is any amino acid
  Variant (83)..(83): xaa in position 83 is any amino acid
  Variant (88)..(93): xaa in position 88 to 93 is any or no amino acid
  Variant (95)..(96): xaa in position 95 to 96 is any or no amino acid
  Variant (101)..(101): xaa in position 101 is any amino acid
  Variant (104)..(107): xaa in position 104 to 107 is any amino acid
  Variant (110)..(111): xaa in position 110 to 111 is any amino acid
  Variant (115)..(118): xaa in position 115 to 118 is any amino acid
  Variant (119)..(119): xaa in position 119 is any or no amino acid
  Variant (121)..(122): xaa in position 121 to 122 is any or no amino acid
  Variant (124)..(125): xaa in position 124 to 125 is any amino acid
  Variant (126)..(139): xaa in position 126 to 139 is any or no amino acid
  Variant (143)..(143): xaa in position 143 is any amino acid
  Variant (149)..(150): xaa in position 149 to 150 is any amino acid
  Variant (152)..(152): xaa in position 152 is any amino acid
  Variant (156)..(164): xaa in position 156 to 164 is any amino acid
  Variant (165)..(193): xaa in position 165 to 193 is any or no amino acid
  Variant (196)..(196): xaa in position 196 is any or no amino acid
  Variant (199)..(200): xaa in position 199 to 200 is any amino acid
  Variant (203)..(203): xaa in position 203 is any amino acid
  Variant (206)..(208): xaa in position 206 to 208 is any amino acid
  Variant (210)..(211): xaa in position 210 to 211 is any amino acid
  Variant (214)..(216): xaa in position 214 to 216 is any amino acid
  Variant (217)..(221): xaa in position 217 to 221 is any or no amino acid
  Variant (223)..(224): xaa in position 223 to 224 is any amino acid
  Variant (227)..(227): xaa in position 227 is any amino acid
  Variant (236)..(236): xaa in position 236 is any amino acid
  Variant (240)..(240): xaa in position 240 is any amino acid
  Variant (242)..(247): xaa in position 242 to 247 is any amino acid
  Variant (250)..(251): xaa in position 250 to 251 is any amino acid
  Variant (252)..(322): xaa in position 252 to 322 is any or no amino acid
  Variant (324)..(326): xaa in position 324 to 326 is any or no amino acid
  Variant (328)..(328): xaa in position 328 is any amino acid
  Variant (330)..(330): xaa in position 330 is any amino acid
  Variant (332)..(336): xaa in position 332 to 336 is any amino acid
  Variant (339)..(340): xaa in position 339 to 340 is any amino acid
  Variant (342)..(343): xaa in position 342 to 343 is any amino acid
  Variant (345)..(345): xaa in position 345 is any amino acid
  Variant (346)..(347): xaa in position 346 to 347 is any or no amino acid
  Variant (350)..(352): xaa in position 350 to 352 is any amino acid
  Variant (355)..(355): xaa in position 355 is any amino acid
  Variant (358)..(358): xaa in position 358 is any amino acid
  Variant (362)..(363): xaa in position 362 to 363 is any amino acid
  Variant (366)..(366): xaa in position 366 is any amino acid
  Variant (367)..(367): xaa in position 367 is any or no amino acid
  Variant (374)..(374): xaa in position 374 is any amino acid
  Variant (376)..(376): xaa in position 376 is any amino acid
  Variant (380)..(383): xaa in position 380 to 383 is any amino acid
  Variant (384)..(387): xaa in position 384 to 387 is any or no amino acid
  Variant (393)..(393): xaa in position 393 is any amino acid
  Variant (399)..(400): xaa in position 399 to 400 is any amino acid
  Variant (403)..(406): xaa in position 403 to 406 is any amino acid
  Variant (409)..(409): xaa in position 409 is any amino acid
  Variant (416)..(416): xaa in position 416 is any amino acid
  Variant (420)..(420): xaa in position 420 is any amino acid
  Variant (421)..(421): xaa in position 421 is any or no amino acid
  Variant (424)..(428): xaa in position 424 to 428 is any amino acid
  Variant (430)..(431): xaa in position 430 to 431 is any amino acid
  Variant (433)..(434): xaa in position 433 to 434 is any amino acid
  Variant (437)..(439): xaa in position 437 to 439 is any amino acid
  Variant (441)..(445): xaa in position 441 to 445 is any amino acid
  Variant (446)..(447): xaa in position 446 to 447 is any or no amino acid
  Variant (449)..(449): xaa in position 449 is any amino acid
  Variant (451)..(459): xaa in position 451 to 459 is any amino acid
  Variant (460)..(472): xaa in position 460 to 472 is any or no amino acid
  Variant (474)..(476): xaa in position 474 to 476 is any amino acid
  Variant (478)..(480): xaa in position 478 to 480 is any amino acid
IXXIXGDGIGXDIXXXXXXVXXXAXXXXXXXXXXIXWXXXXXGXXXXXXXXXXXXXXXXXXXLPXXXLXXIXXXXVXIKGPLXTPVGXXXXXXGXXSLNVXLRXXXXLYXXLRPXXXXXGXXSXXXXXXXXXXXXXXXXMVIXRENTEXXYXGIEXXXXXXXXXXXXXXXXXXXXXXXXXXXXXXXXXXXXXXIKXISXXGSXRLXXXAXXYAXXXXXXXXRXXVTXVHKGNIMKXTEGXFXXXXXXVAXXXXXXXXXXXXXXXXXXXXXXXXXXXXXXXXXXXXXXXXXXXXXXXXXXXXXXXXXXXXXXXXXXXXXXXXXIXXXDXIXDXXXXXILXXPXXYXXXVIXXXNLXGDXISDXXAAXXVGGIGIXPXANIXXXXXXXXAIFEAXHGTAPXXAGXXXXNPXSLILSAXMMLXXHLXXXXXAXXIXXAIXXXIXXXXXXXTXDXXXXXXXXXXXXXXXXXXXXXXFXXXIXXXL

SEQ ID NO: 28292 - protein, 7 aa, Artificial sequence
  Variant (2)..(2): xaa in position 2 is any amino acid
  Variant (6)..(6): xaa in position 6 is any amino acid
IXGDGXG

SEQ ID NO: 28293 - protein, 30 aa, Artificial sequence
  Variant (2)..(2): xaa in position 2 is any amino acid
  Variant (3)..(3): xaa in position 3 is any or no amino acid
  Variant (5)..(5): xaa in position 5 is any or no amino acid
  Variant (7)..(7): xaa in position 7 is any amino acid
  Variant (8)..(8): xaa in position 8 is Ala, Gly or Ser
  Variant (9)..(9): xaa in position 9 is any amino acid
  Variant (11)..(12): xaa in position 11 to 12 is any amino acid
  Variant (14)..(14): xaa in position 14 is Ile, Leu, Met or Val
  Variant (16)..(16): xaa in position 16 is Leu or Val
  Variant (17)..(17): xaa in position 17 is any amino acid
  Variant (18)..(18): xaa in position 18 is Ile, Leu, Met or Val
  Variant (20)..(23): xaa in position 20 to 23 is any amino acid
  Variant (25)..(25): xaa in position 25 is Phe or Tyr
  Variant (26)..(26): xaa in position 26 is any amino acid
  Variant (27)..(27): xaa in position 27 is Cys or Asn
  Variant (28)..(28): xaa in position 28 is any amino acid
PXXTXPXXXGXXSXNXXXRXXXXLXXXXRP

SEQ ID NO: 28294 - protein, 12 aa, Artificial sequence
  Variant (4)..(4): xaa in position 4 is Glu, Ser or Thr
  Variant (6)..(6): xaa in position 6 is Asp or Gly
  Variant (7)..(7): xaa in position 7 is any amino acid
  Variant (9)..(9): xaa in position 9 is any amino acid
  Variant (11)..(11): xaa in position 11 is Ile, Leu or Val
RENXEXXYXGXE

SEQ ID NO: 28295 - protein, 35 aa, Artificial sequence
  Variant (2)..(5): xaa in position 2 to 5 is any amino acid
  Variant (6)..(6): xaa in position 6 is any or no amino acid
  Variant (8)..(15): xaa in position 8 to 15 is any amino acid
  Variant (16)..(19): xaa in position 16 to 19 is any or no amino acid
  Variant (21)..(23): xaa in position 21 to 23 is any amino acid
  Variant (25)..(25): xaa in position 25 is Ala, Asp or Gly
  Variant (27)..(27): xaa in position 27 is Ile or Val
  Variant (28)..(28): xaa in position 28 is any amino acid
  Variant (29)..(29): xaa in position 29 is Lys or Arg
  Variant (30)..(30): xaa in position 30 is any amino acid
  Variant (31)..(31): xaa in position 31 is Ala, Ser or Thr
  Variant (32)..(32): xaa in position 32 is any amino acid
  Variant (34)..(34): xaa in position 34 is any amino acid
RXXXXXAXXXXXXXXXXXXTXXXKXNXXXXXXGXF

SEQ ID NO: 28296 - protein, 31 aa, Artificial sequence
  Variant (2)..(3): xaa in position 2 to 3 is any amino acid
  Variant (4)..(5): xaa in position 4 to 5 is any or no amino acid
  Variant (8)..(8): xaa in position 8 is any amino acid
  Variant (11)..(12): xaa in position 11 to 12 is any amino acid
  Variant (15)..(20): xaa in position 15 to 20 is any amino acid
  Variant (21)..(21): xaa in position 21 is any or no amino acid
  Variant (23)..(23): xaa in position 23 is Gly or Ser
  Variant (24)..(24): xaa in position 24 is Ile, Leu, Pro or Val
  Variant (26)..(26): xaa in position 26 is Phe, Ile, Leu, Met or Val
  Variant (27)..(27): xaa in position 27 is any amino acid
  Variant (28)..(28): xaa in position 28 is Ala, Gly or Pro
  Variant (29)..(29): xaa in position 29 is Gly or Ser
  Variant (30)..(30): xaa in position 30 is any amino acid
  Variant (31)..(31): xaa in position 31 is Asp or Asn
VXXXXNLXGDXXSDXXXXXXXGXXGXXXXXX

SEQ ID NO: 28297 - protein, 29 aa, Artificial sequence
  Variant (2)..(2): xaa in position 2 is Ala, Pro or Ser
  Variant (3)..(3): xaa in position 3 is any amino acid
  Variant (6)..(6): xaa in position 6 is Ser or Thr
  Variant (9)..(10): xaa in position 9 to 10 is any amino acid
  Variant (13)..(13): xaa in position 13 is any amino acid
  Variant (14)..(14): xaa in position 14 is Ala, Asp, Gly or Asn
  Variant (15)..(16): xaa in position 15 to 16 is any amino acid
  Variant (19)..(20): xaa in position 19 to 20 is any amino acid
  Variant (21)..(22): xaa in position 21 to 22 is any or no amino acid
  Variant (24)..(28): xaa in position 24 to 28 is any amino acid
  Variant (29)..(29): xaa in position 29 is Phe, Ile, Leu or Met
EXXHGXAPXXAGXXXXNPXXXXLXXXXXX

SEQ ID NO: 28298 - DNA, 1392 bp, Escherichia coli K12
  CDS (1)..(1392): transl_table=11
atgagtcactcatccgcccccgaaagggctactggagctgtcattacagattggcgaccggaagatcctgcgttctggcaacaacgcggtcaacgtattgccagccgcaacctgtggatttccgttccctgtctgctgctggcgttttgcgtatggatgttgttcagcgctgttgcggtgaacctaccgaaagtcggctttaattttacgaccgatcagctatttatgttgactgcgctgccttcggtttctggcgcgttattacgtgttccatactcctttatggttcctatcttcggtggtcgtcgctggacggcgttcagcaccggtattctgattattccttgcgtctggctgggttttgccgtgcaggatacctccacgccttatagcgtcttcatcatcatctctctgctatgcggctttgctggcgcgaacttcgcatccagtatggcaaacatcagcttcttctttccgaaacagaagcagggtggcgcgctgggtctgaatggtggtctgggaaacatgggcgtcagcgtcatgcagttggttgctccgctggtggtatcactgtcgattttcgcagtatttggtagccagggcgtcaaacagccggatgggactgagctgtatctggcgaatgcgtcctggatatgggtgccgttccttgccatcttcaccattgcggcgtggtttggcatgaacgatcttgctacctcgaaagcctccatcaaggagcagttgccggtactcaaacggggtcatctgtggattatgagcctgctgtatctggcaaccttcggctccttcatcggcttctccgcgggctttgcaatgctgtcaaaaacgcagttcccggatgttcagattctgcaatacgctttcttcgggccgtttattggtgcgctggcgcgttctgcaggtggtgcattatctgaccgtctgggcggaactcgtgtcacgctggtgaactttattctgatggcgattttcagcggcctgctgttcctgaccttaccgactgacgggcagggcggaagcttcatggcgttcttcgcggtcttcctggcgctgttcctgacagctgggctgggtagtggttccactttccagatgatttcagtgatcttccgtaaactgacaatggatcgcgtgaaagcagaagggggttctgacgaacgtgcgatgcgtgaagcggcaaccgacacggcggcggcgctgggtttcatctctgcgattggcgcgattggtggcttctttatcccgaaagcgtttggtagctcgctggcattaacgggttcgccagtcggcgcaatgaaggtatttttgattttctatatcgcctgcgtagtgattacctgggcggtatatggtcggcattctaaaaaataa

SEQ ID NO: 28299 - protein, 463 aa, Escherichia coli K12
MSHSSAPERATGAVITDWRPEDPAFWQQRGQRIASRNLWISVPCLLLAFCVWMLFSAVAVNLPKVGFNFTTDQLFMLTALPSVSGALLRVPYSFMVPIFGGRRWTAFSTGILIIPCVWLGFAVQDTSTPYSVFIIISLLCGFAGANFASSMANISFFFPKQKQGGALGLNGGLGNMGVSVMQLVAPLVVSLSIFAVFGSQGVKQPDGTELYLANASWIWVPFLAIFTIAAWFGMNDLATSKASIKEQLPVLKRGHLWIMSLLYLATFGSFIGFSAGFAMLSKTQFPDVQILQYAFFGPFIGALARSAGGALSDRLGGTRVTLVNFILMAIFSGLLFLTLPTDGQGGSFMAFFAVFLALFLTAGLGSGSTFQMISVIFRKLTMDRVKAEGGSDERAMREAATDTAAALGFISAIGAIGGFFIPKAFGSSLALTGSPVGAMKVFLIFYIACVVITWAVYGRHSKK

SEQ ID NO: 28300 - DNA, 1428 bp, Aquifex aeolicus VF5
  CDS (1)..(1428): transl_table=11
atgaatttcctgaaggagataattgaagcaattaagaagggaaatccaaaagctctgtttgccagttttatatactttgaccattcattcagtatatggctactcttaggagctcttggaccttttatagctgagtccttcggactctcaggagcccaaaaaggttttatggttgcaattcccgtaatagccgcagccatattcagactcaacttcggacatatgttccagtatatagacgggaagtacatagcgataatgggcataatcctttcctctatccctcacctttacatgatactcagcggatatcgtgtaacctacgatgaccttctctggatgggggtttttctcggtatcgcaggagcaagctttgcgatagccctccctatggcgggaagtaactacccgaaagaggttcaaggactcgtacttggacttgccgcggcgggaaacataggagctgttttagacggtatactctttcctcctattgcaaggtccatcggttgggaaaataccttcgttctttcgggaatactccttcttatagccctgttttttgtcgttatctgggcgcgggaccttaccaagaagaacgaagggaataggttttatcccgtatttgcattctttgccactatagcttttatggtaatactggctctcggttttcaaaagggatggttcggtataaccggaaacgctggaaaactcctcataccggtacttggttctgtatttgctatactccttatgcctcttgcctttaaaaaggtgttcctggaaagggacacgtgggtacttatgctcgcttactccataactttcggcggttttgtaggaatgtcctcgtacgtggctatgctccttagggacatatacggtatatccaaagtggaggcaggagctcttatgtccctttttgcctttacgggtgcgatgataagacctctggggggacatatcgcggataaaataagcggagctacagcacttctctttttcctcgcgggcatagcgggagttaacttcatattttccctcgtaacaccgcctctggcggtaggtatagttttattccttgcactctactccttctatggacttggaaacggtgctgtatttcagctcgttcctcacaggtggccatatcaaactggacttatgacgggaataatcggagctgccggaggtatcggtggtttttacctgcccgttgtaaacggaatagtctttgagtccacgggagcttacaacctggcgtttgcactcttcggaggaatagccctgctgtgtctccttatagttaagcttcttcatgctcgctggatggaatgggcctacgttcgctacgactacgaaaaagaaacgttggttggtattgatcctaagagtggaagggtaattatggagttggcaagatga

SEQ ID NO: 28301 - protein, 475 aa, Aquifex aeolicus VF5
MNFLKEIIEAIKKGNPKALFASFIYFDHSFSIWLLLGALGPFIAESFGLSGAQKGFMVAIPVIAAAIFRLNFGHMFQYIDGKYIAIMGIILSSIPHLYMILSGYRVTYDDLLWMGVFLGIAGASFAIALPMAGSNYPKEVQGLVLGLAAAGNIGAVLDGILFPPIARSIGWENTFVLSGILLLIALFFVVIWARDLTKKNEGNRFYPVFAFFATIAFMVILALGFQKGWFGITGNAGKLLIPVLGSVFAILLMPLAFKKVFLERDTWVLMLAYSITFGGFVGMSSYVAMLLRDIYGISKVEAGALMSLFAFTGAMIRPLGGHIADKISGATALLFFLAGIAGVNFIFSLVTPPLAVGIVLFLALYSFYGLGNGAVFQLVPHRWPYQTGLMTGIIGAAGGIGGFYLPVVNGIVFESTGAYNLAFALFGGIALLCLLIVKLLHARWMEWAYVRYDYEKETLVGIDPKSGRVIMELAR

SEQ ID NO: 28302 - DNA, 1212 bp, Pseudomonas aeruginosa PAO1
  CDS (1)..(1212): transl_table=11
atgaacaacagcttctggaaggccggccatgcgccgaccctgttcgcggcgtttctctatttcgacctgagcttcatggtctggtacgtgctcggcccgctgggggtgcagattgccggcgacctgcaactgagcacccaacagcgcgcgatgatggtcgccacgccgatcctcgccggcgccgtactgcgcttcctgctcggcctgctggccgatcgctggtcgccgaagagcgccggcatcctcgcccaggtcatcgtcatcgccgccctggcggccgcctggctgctgggcgtgaacagctatgcgcaggcactgctgctggggttgttcctcggcttcgccggggcatccttcgccgtggccctgccgctcgcatcgcaatggtacccgccgcaacaccagggcaaggccatgggcatcgccggcgcgggcaactccggcaccgtgctcgccgccctcttcgcccccggcctggccgccgcgttcggctggaacaatgtgttcggcttcgccctgctgccgctcgtcctgaccctcctggtgttcgccatggtcgcgcgcaacgccccgcagcggccggcgcccaaggccatgggcgattacctgaaagccctcggcgaccgcgacagctggtggttcatgttcttctacagcgtcaccttcggcggcttcctcggcctggccagcaccctgcccggctatttccacgaccagtacggcctgaacccggtgaccgccggctactacaccgccgcctgcgtcttcgccggcagcctgatgcgcccgctcggtggcgccctcgccgatcgcatcggcggcatccgcagcctgctgatggtgtacaccctggccgccatctgcatcgccgcggtcggtttccacttgcccagcgcgatggccgccctcggcctgttcgtggtcgccatgctcagtctcggtgccggtaatggcgcggtgttccagttggtaccgcagcgcttccacaaggaaatcggcgtgatgaccgggctgatcggcatggccggcggcatcggcggcttctgcctgactgccggcctcggcgcgatcaagcaaagcaccggcgactaccagctcggcctgtggctgttcgccagtctcggcgtgctggcctggttcggcctccacggggtgaagcggcgctggcgcaccacctggggctcggccgcggtcaccgccgcgcgggtctga

SEQ ID NO: 28303 - protein, 403 aa, Pseudomonas aeruginosa PAO1
MNNSFWKAGHAPTLFAAFLYFDLSFMVWYVLGPLGVQIAGDLQLSTQQRAMMVATPILAGAVLRFLLGLLADRWSPKSAGILAQVIVIAALAAAWLLGVNSYAQALLLGLFLGFAGASFAVALPLASQWYPPQHQGKAMGIAGAGNSGTVLAALFAPGLAAAFGWNNVFGFALLPLVLTLLVFAMVARNAPQRPAPKAMGDYLKALGDRDSWWFMFFYSVTFGGFLGLASTLPGYFHDQYGLNPVTAGYYTAACVFAGSLMRPLGGALADRIGGIRSLLMVYTLAAICIAAVGFHLPSAMAALGLFVVAMLSLGAGNGAVFQLVPQRFHKEIGVMTGLIGMAGGIGGFCLTAGLGAIKQSTGDYQLGLWLFASLGVLAWFGLHGVKRRWRTTWGSAAVTAARV

SEQ ID NO: 28304 - DNA, 1407 bp, Pseudomonas aeruginosa PAO1
  CDS (1)..(1407): transl_table=11
atgggcatgatcgccaatacccaactgaaagccgcacggggaccgctgctgctcgactggcgccccgaggaccccgagttctgggcgcgcaacggcaagcgcatcgccagccgcaacctgtggatctcgatccccgcgctgctgctcgccttcgccgtgtggatgatctggagcacggtgactgtgcgcctgaacagcgccggcttcgccttcagcaacgaccagctgttcctgctcgcggcgctgccgtcgatctccggcgccaccctgcgggtgttctattcgttcatggtgccgatcttcggcggtcgtcgctggaccgccctgagcaccgcctcgatgctgatcccgtgcatctggctgggcttcgccgtgcaggacccgagtaccccgtactgggtgttcgccctgatcgcgctgctctgcggcttcggcggcggcaacttcgcctcgagcatgtccaatatcagcttcttctatccgaagagccagcagggcaccgccctcggcctgaatgccgggctcggcaacctcggcgtctcggtgatgcagttcgccgtgccgctggcggtggccggcggcctgttcggcgccttcggcggcgagccgcagcagctcggcgacggcggtcgcctgtggctgcagaacgccggctggatctgggtgccgttcatcgccgtggtatcggtcgcggcctggttcgggatgaacgacatcgccgacgccaaggcctcgttccgcgaccaggcggtgatcttcaagcgcaagcacaactggctgatgtgctggctgtacgtggccaccttcggctcgttcatcggcttctcggccggcttcgcgatgctcagcaagacccagttccccgacgtcaacccgctgcaatacgccttcctcggtccgctggtgggcgccctcagccggcctctgggcggctggctggcggacaagttcggcggcgcgcggatcaccctgtggaactacgcgctgatgatcggcggggtgttcgcggtgatcgccttcctgccgggcgacggcggccagggcaacttcttcggcttccttggcgccttcatcctgctgttcttcttcgccggcatcggcaacggctccaccttccgcatgatcccggtgatcttccgcaacgagtgggcccggcgggtgcgcgacggccaggccgacgaagccggcgcggcgcgcaacgcgagcatggagtcggccgcggtgatcggcttctccgccgccatcggcgccttcggcgggttcttcatcccgaaggcgttcggcacctcgctgcacatgaccggcagcgccgagggcgccctctacgtgttcatcgcctactacctgagctgcatcgtcgccacctggtggtggtacgcgcgcaagggtgcggagagtccctgttga

SEQ ID NO: 28305 - protein, 468 aa, Pseudomonas aeruginosa PAO1
MGMIANTQLKAARGPLLLDWRPEDPEFWARNGKRIASRNLWISIPALLLAFAVWMIWSTVTVRLNSAGFAFSNDQLFLLAALPSISGATLRVFYSFMVPIFGGRRWTALSTASMLIPCIWLGFAVQDPSTPYWVFALIALLCGFGGGNFASSMSNISFFYPKSQQGTALGLNAGLGNLGVSVMQFAVPLAVAGGLFGAFGGEPQQLGDGGRLWLQNAGWIWVPFIAVVSVAAWFGMNDIADAKASFRDQAVIFKRKHNWLMCWLYVATFGSFIGFSAGFAMLSKTQFPDVNPLQYAFLGPLVGALSRPLGGWLADKFGGARITLWNYALMIGGVFAVIAFLPGDGGQGNFFGFLGAFILLFFFAGIGNGSTFRMIPVIFRNEWARRVRDGQADEAGAARNASMESAAVIGFSAAIGAFGGFFIPKAFGTSLHMTGSAEGALYVFIAYYLSCIVATWWWYARKGAESPC

SEQ ID NO: 28306 - DNA, 1296 bp, Pseudomonas aeruginosa PAO1
  CDS (1)..(1296): transl_table=11
atggcttccctacgtcagaaacagtactccgtcctcggcatgagtaccttgtccttcgcggtgaatttcgccgtgtggacgatgttttcgatcatcggcatccgcatcaaggacgagctcggcctgagcgaatcccagttcggcttgatggtcgccctgccgatcctcaccggctccctggtgcgcctgccgctgggcctgatcaccgaccgcttcggcggccgcatcgtgttcttcatccacatgctgctggtggccatcccgatctacggcctggccttcgccagccagtactggcactacctggtgctcggcctgttcgtcggcctggccggcggctccttcgcggtcggcatcgcctacacctcggcctggttcgagaaggagcgccagggcaccgcgatgggcatcttcggcgccggcaacgccggcgcggcgatcaccaacctggtggcgccgatgatcgtggtcgccttcggctggcgcatggtgccgcaggtctactcggtggccatgctggtcaccgccgtgctgttctggctgttcacctggaccgatccggcgcaccttaagggtgccgccgaggccagccagcggccgaacctggccaagcaactggcgccgctcgccgagctgcgcgtctggcgcttcggcctgtactacttcttcgtcttcggcggcttcgtcgccctggccctgtggctgccgaagtactacatcgccgaatacggcctggacctgaagaccgcatccttcatcaccatgctgttcaccttgccgtccggcctgatccgcgccctcggcggctggttcagcgaccactacggcgcgcgctcggtgaactggggcgtgttctgggtctgcctggtgtgcctgttcttcctctcctacccgcagaccaccatgaccatccacggcatccagggcgacctcagcctgggcatcggcctgaacgtctggctgttcaccttcctggtgttcgtcgtcggcattgcccagggcttcggcaaggccagcgtgtaccggatcatccacgactactacccgagcaacatgggcaccgtcggcggcatggtcggggtgatcggcggcctcggcggcttctgcctgccgatcctgttcggctacgccgccgaccacatcggcgtgcgctcctcctgcttcatgttgctgttcggcctgaccgtggtctgcatggtctggatgcactacgcgatcaagcagcaacgccgcatcgacggccaggccgcctcggccgacgtcgaccttcctcccacccttcccacccactcctga

SEQ ID NO: 28307 - protein, 431 aa, Pseudomonas aeruginosa PAO1
MASLRQKQYSVLGMSTLSFAVNFAVWTMFSIIGIRIKDELGLSESQFGLMVALPILTGSLVRLPLGLITDRFGGRIVFFIHMLLVAIPIYGLAFASQYWHYLVLGLFVGLAGGSFAVGIAYTSAWFEKERQGTAMGIFGAGNAGAAITNLVAPMIVVAFGWRMVPQVYSVAMLVTAVLFWLFTWTDPAHLKGAAEASQRPNLAKQLAPLAELRVWRFGLYYFFVFGGFVALALWLPKYYIAEYGLDLKTASFITMLFTLPSGLIRALGGWFSDHYGARSVNWGVFWVCLVCLFFLSYPQTTMTIHGIQGDLSLGIGLNVWLFTFLVFVVGIAQGFGKASVYRIIHDYYPSNMGTVGGMVGVIGGLGGFCLPILFGYAADHIGVRSSCFMLLFGLTVVCMVWMHYAIKQQRRIDGQAASADVDLPPTLPTHS

SEQ ID NO: 28308 - DNA, 1554 bp, Mycobacterium leprae TN
  CDS (1)..(1554): transl_table=11
atggatcagctggtgttgctgcaagccgaggagtcgctgtacggccccggtcgcagatcgaaaactgtaccgattgaccatcggcacagtctaaagtcgagctttttccggctgcgtttgaggagagcgtgtcgcatctcgcattgggaccccgaggatcaagcggcttgggaggctggcaacaaaaccatcgcccggctcaatctgctctggtcggtcctgaccgtccacctggggtattcggtgtggacgctctggccggtgatggagctgttcatgcccaaggacgtatatggcttttccgcgggtgacaagtttctgctcgctaccaccgcaaccttggttggggcgtgcctgcgggtgccgtactcgttggccaccgcacttttcggtggccgcaactgggcgattttctcggtgatggtgctgttgatccccactattgccaccatggtgctgttggctcatccaggcttgccgctttggccttatctggcgtgcgcggcactgaccggcttgggcggcggtaatttcgcggcgtcgatgactaacgccaacgccttctacccgcatcggctcaagggtgcggcattcgggctcgctggtggggccggcaaccttggggtgtcggtgatccaggtggtcgggatgctggtcatcgccagcgtcggtgaccgaaagccttacattgtgtgtggactttatgtggtgctgttgataatcgccgggatcggagcaatgttgttcatgaacgacattgagcatcaccgtatcggggtgaacaccatccggccagtactgttcgtcgtggtttccacgcgtgatagctgggttctcgcgctgctctacctggcgagtttcggttcgttcatcggtttttcattcgcattcggccaggtgctggaaaccaacttcgtcgccggcggacaaagtacggctcaggccgcgttgcacgccgctgagcttgcattcatcggaccgacgttggccgcggtagcccggttttggggtggccgactggccgaccgacttggagggagtcgcgtcaccctggtggtcttcggtgccatggtttttgccgccgggttgctgggtgtactgggcataattgagggctcacgcgtgtgcccgatcaggggtgtcatgatggccagctacttcgctggattcatcactctgttcatcttgtctgggttgggcaatggatcggtgtacaagatgatcccgacaattttcgaggcctgcagccattccctgggaatcaacgacgacgagtgccgcgactggtcacgagtgatttccggggtcgtcattggctttgtcgcggaggtcggcgcactcggcggtgttgggatcgacctggcgttgcgagagtcctacctcaacactggcggggttaccgcagcgttttggatattcatgttgtgctatgccgcggccggtgtcctgacctggaagatgtacgtgtgtcgaccattgccaggcaacttgcacgacgaagcggctaatgcgtttgcggccagcgtcggagccagcagaactcaccggggctga

SEQ ID NO: 28309 - protein, 517 aa, Mycobacterium leprae TN
MDQLVLLQAEESLYGPGRRSKTVPIDHRHSLKSSFFRLRLRRACRISHWDPEDQAAWEAGNKTIARLNLLWSVLTVHLGYSVWTLWPVMELFMPKDVYGFSAGDKFLLATTATLVGACLRVPYSLATALFGGRNWAIFSVMVLLIPTIATMVLLAHPGLPLWPYLACAALTGLGGGNFAASMTNANAFYPHRLKGAAFGLAGGAGNLGVSVIQVVGMLVIASVGDRKPYIVCGLYVVLLIIAGIGAMLFMNDIEHHRIGVNTIRPVLFVVVSTRDSWVLALLYLASFGSFIGFSFAFGQVLETNFVAGGQSTAQAALHAAELAFIGPTLAAVARFWGGRLADRLGGSRVTLVVFGAMVFAAGLLGVLGIIEGSRVCPIRGVMMASYFAGFITLFILSGLGNGSVYKMIPTIFEACSHSLGINDDECRDWSRVISGVVIGFVAEVGALGGVGIDLALRESYLNTGGVTAAFWIFMLCYAAAGVLTWKMYVCRPLPGNLHDEAANAFAASVGASRTHRG

SEQ ID NO: 28310 - DNA, 1389 bp, Escherichia coli O157:H7
  CDS (1)..(1389): transl_table=11
atggcactgcaaaatgagaaaaatagtcgttatcttttacgcgactggaaaccagaaaatccggccttctggaaaaataaaggaaaacatattgctcgaagaaacctctggatatcagtcagttgtctacttcttgccttctgtgtctggatgctatttagcgcagttaccgttaatctcaataaaatcggttttaatttcactaccgatcaactctttttattaaccgcattaccctccgtttctggcgcattattacgtgtcccctactcctttatggtgcctatattcggtggacgtcgatggacggtttttagtactgcaatcctgattattccttgcgtctggctcggaattgccgtgcagaatccgaatactccttttgggatatttatcgttatcgctttgctatgcggttttgcaggtgcgaactttgcttcgagcatgggcaatatcagtttcttctttccaaaagccaggcaaggtagcgctcttgggattaatggcggattaggaaacttaggtgtaagtgtaatgcagctggttgcaccgctggtcatttttgtacccgtatttgcctttctcggcgtcaatggagtaccgcaggccgacggttcggtgatgtcgctggcgaatgccgcatggatttgggtaccgctactagcgattgccacgatcgccgcctggtcagggatgaatgatatcgccagttcacgcgcgtcaattgccgaccagctccctgtcttacaacgcctgcatctctggctgctgagcctgctttaccttgccaccttcggttcgtttatcggtttttctgcgggtttcgccatgctggcaaaaacccagttcccggatgtgaatattctgcgcctggcgttctttggcccatttatcggtgccatcgcgcggtcggtgggtggtgctatttccgataaattcggcggcgtgcgggtgacgttgatcaactttatttttatggcgattttcagcgccctgctgttccttaccttaccgggcacaggctccggtaacttcatcgccttttacgccgtatttatggggctgtttctgaccgcgggtctgggaagtggttctactttccagatgatcgccgtcatctttcgccagataaccatttatcggatgaagatgaaaggcggtagtgatgagcaagctcagagagaagccgtcaccgaaacggcggcggctctgggctttatctcagccatcggcgcagtgggcggcttttttattccgcaggcatttggcatgtcactcaatatgaccggctctccagtgggcgcgatgaaagtgtttttaatcttctacatcgtttgtgtgctactgacctggctggtttatggtcggcggaagttcagccaaaaataa

SEQ ID NO: 28311 - protein, 462 aa, Escherichia coli O157:H7
MALQNEKNSRYLLRDWKPENPAFWKNKGKHIARRNLWISVSCLLLAFCVWMLFSAVTVNLNKIGFNFTTDQLFLLTALPSVSGALLRVPYSFMVPIFGGRRWTVFSTAILIIPCVWLGIAVQNPNTPFGIFIVIALLCGFAGANFASSMGNISFFFPKARQGSALGINGGLGNLGVSVMQLVAPLVIFVPVFAFLGVNGVPQADGSVMSLANAAWIWVPLLAIATIAAWSGMNDIASSRASIADQLPVLQRLHLWLLSLLYLATFGSFIGFSAGFAMLAKTQFPDVNILRLAFFGPFIGAIARSVGGAISDKFGGVRVTLINFIFMAIFSALLFLTLPGTGSGNFIAFYAVFMGLFLTAGLGSGSTFQMIAVIFRQITIYRMKMKGGSDEQAQREAVTETAAALGFISAIGAVGGFFIPQAFGMSLNMTGSPVGAMKVFLIFYIVCVLLTWLVYGRRKFSQK

SEQ ID NO: 28312 - DNA, 1410 bp, Mycobacterium tuberculosis CDC1551
  CDS (1)..(1410): transl_table=11
atgggccgttcccaccagatctccgactgggatcccgaagactcggtggcgtgggaggccggcaacaaattcatcgcccgacgcaatctgatctggtcggtggccgccgagcacgtcggattttccgtctggtccctctggtcggtgatggtgctgttcatgcccacatcggtgtacggcttttccgccggcgacaagttcctgctcggcgccaccgcgaccttggtcggggcatgcctgcgcttcccttacacatttgccaccgcaaagttcggggggcgcaactggaccatcttttccgcactggtgctgttgattccgaccgttggcagcattctgttgctggccaaccctggtttgccactgtggccgtatctggtgtgcggtgcgctagccggcctcggcggcggcaacttcgccgcctccatgacgaacatcaacgctttctttccgcaacgactcaagggcgccgcgcttgcgctcaacgcgggtggcggcaacctcggggtgccgatggtgcagttggtcggcctgctggtgatcgcaacggccggtgaccgcgagccctactgggtgtgcgcgatatatctggtgctgctggcggtcgccggcctcggcgccgcactgtacatggacaacctgacggagtatcgcatcgagctgaacaccatgcgtgcggtagtgtccgagccgcacacctgggtgatctcgctgctgtacatcggcactttcggctcgttcatcgggttctctttcgcattcggtcaggtgctgcagatcaacttcatcgccagcggtcagagcacggcgcaggcctcgctgcatgcggcccagatcgccttcctggggccgctattgggatcgctgtcccgaatatatggcggcaagctcgccgaccgtatcggtggcggccgagtcaccctagctgccttctgcgccatgctgctggccaccggaatactcatcagcgcaagcactttcggtgaccacctggccgggccgatgccgactgcgacgatggtcggctacgtcatcggcttcacggctctgttcattttgtccggcatcggcaatggctctgtgtacaagatgattccgtcgatcttcgaggcgcgcagccattcgctgcagatcagtgaagccgagcgcaggcagtggtcgcggtcgatgtcaggcgcgctgatcggcctggccggggcggtcggcgcgctcggcggagtgggcgtcaacctggctctgcgagagtcctacctgaccagtggcacggccacctcggcattttgggccttcggggtgttctacctggtcgcctcggtgctgacctgggcgatttatgtgcgtcggggcctaaagagcgccggcgagctcgtgccggcgaccaccgcacccgcgggcttggcctacgtctag

SEQ ID NO: 28313 - protein, 469 aa, Mycobacterium tuberculosis CDC1551
MGRSHQISDWDPEDSVAWEAGNKFIARRNLIWSVAAEHVGFSVWSLWSVMVLFMPTSVYGFSAGDKFLLGATATLVGACLRFPYTFATAKFGGRNWTIFSALVLLIPTVGSILLLANPGLPLWPYLVCGALAGLGGGNFAASMTNINAFFPQRLKGAALALNAGGGNLGVPMVQLVGLLVIATAGDREPYWVCAIYLVLLAVAGLGAALYMDNLTEYRIELNTMRAVVSEPHTWVISLLYIGTFGSFIGFSFAFGQVLQINFIASGQSTAQASLHAAQIAFLGPLLGSLSRIYGGKLADRIGGGRVTLAAFCAMLLATGILISASTFGDHLAGPMPTATMVGYVIGFTALFILSGIGNGSVYKMIPSIFEARSHSLQISEAERRQWSRSMSGALIGLAGAVGALGGVGVNLALRESYLTSGTATSAFWAFGVFYLVASVLTWAIYVRRGLKSAGELVPATTAPAGLAYV

SEQ ID NO: 28314 - DNA, 1392 bp, Mycobacterium tuberculosis CDC1551
  CDS (1)..(1392): transl_table=11
atggcactcaccaccgccccggcaatcgattatgcgctgccacgccagcaggatgagggcgatcactggatcgacgactggcgcccggaagacccggtgttctgggagacgatcggcaggccgatcgcccgccgtaacctgatcttctccatcttcgccgagcacgtcggcttcagcgtgtggatgctgtggagcatcgtggttgtccagatgaccgccgccgctcccgggcaccccgccgcgtccggctgggcgctgtccgccagccaggccctatgtttggtcgccgtccccagcggtgtcggggcgttcctccggctgccgtacaccttcgcgatcccgatctttggtggccgcaactggacgaccgtctcggcggcgctgctggtgatcccgtgcctgctgctggcttgggcggtgagccacccttccctgccgttcgcggtgttggtggtgatcgcggccaccgccggtttcggtggcggcaactttgcctcatcgatggccaacatctcgttcttctacccggagaaggacaagggttgggcgctgggcctgaacgcggccggaggcaacatcggggtggcggtggtgcagaagatcattccgcccatcgtggtcgccggcagtggggtggcactgtcgcgtgccggactgttcttcgtgcccttggccgtcgccgccgcggtgtgcgcattcctgtttatgaacaacctcacggaggccaaggccgatgtgaagccggtgtggcagtcgctgcggcatgccgacacctggatcatgtcgctgctgtacatcggcacctttgggtcgttcatcgggtattcggcggccttcccgacgttgctcaagaccgtgtttggccgtggtgacatcgcgttgggttgggccttcctcggcgcgggcatcggttccctggtccgtccgctgggcggcaagctcgccgaccggatcggcggtgcgcggatcaccgcggccagtttcgtcatgctggcggccggggcggctgcggcgttgtggtcggtgcagtcggtcaatctgccggtgttcttcgtcagcttcatgttcttgttcgttgccaccggcatcggcaatggttcgagctaccggatgatctcgaggatcttccaggtcaaaggcgaagtcgccggcggggatccggaaacgatggtgaacatgcgccgacaggccgccggagcgctgggcatcatctcctcgatcggcgcgttcggcgggtttgtggtgccgctggcctacgcctggtcgaaggtgcacttcggcaatatcgaacccgccctgcacttctacgtggcgttcttccttgccctgctcgtcgtcacctggtactgctacctgcgtagaaccacccccatgggccaggtgggggtgtag

SEQ ID NO: 28315 - protein, 463 aa, Mycobacterium tuberculosis CDC1551
MALTTAPAIDYALPRQQDEGDHWIDDWRPEDPVFWETIGRPIARRNLIFSIFAEHVGFSVWMLWSIVVVQMTAAAPGHPAASGWALSASQALCLVAVPSGVGAFLRLPYTFAIPIFGGRNWTTVSAALLVIPCLLLAWAVSHPSLPFAVLVVIAATAGFGGGNFASSMANISFFYPEKDKGWALGLNAAGGNIGVAVVQKIIPPIVVAGSGVALSRAGLFFVPLAVAAAVCAFLFMNNLTEAKADVKPVWQSLRHADTWIMSLLYIGTFGSFIGYSAAFPTLLKTVFGRGDIALGWAFLGAGIGSLVRPLGGKLADRIGGARITAASFVMLAAGAAAALWSVQSVNLPVFFVSFMFLFVATGIGNGSSYRMISRIFQVKGEVAGGDPETMVNMRRQAAGALGIISSIGAFGGFVVPLAYAWSKVHFGNIEPALHFYVAFFLALLVVTWYCYLRRTTPMGQVGV

SEQ ID NO: 28316 - DNA, 1188 bp, Mycobacterium tuberculosis CDC1551
  CDS (1)..(1188): transl_table=11
atgagagggcaagcggccaatctcgtgctggccacctggatctcggtggtcaacttctgggcgtggaacctgatcggcccgctgtcgaccagctacgcgcgtgacatgtcactgtccagcgccgaggcgtcgctgctcgtcgccaccccgatcctggtgggtgcccttggccgcatcgtcaccgggccgctcaccgaccgcttcggcgggcgcgccatgctcatcgcggtgacgctggcgtcgatcctcccggtgctcgcggtcggggtcgcggcaaccatgggctcctacgcgttgctggtgtttttcgggctcttcctgggcgttgccggcacgatcttcgccgtcggcatcccgttcgccaacaactggtaccagccggcgcggcgcggtttctccaccggcgtgttcggtatgggcatggtcggcaccgcgctctcggcgttcttcaccccgcggtttgtacggtggttcggcctgttcaccacccacgccatcgtcgcggccgcgctcgcgtcgaccgccgtggtggccatggtcgtgcttcgtgatgcaccctactttcggcccaacgccgacccggtgctgcccaggctcaaggccgcggcacggttgccggtgacctgggagatgtcgtttctgtacgcgatcgtgttcggcgggttcgtggcgttcagcaactacctgcccacctacatcaccacgatctacgggttctccacggtcgacgcgggcgctcgcaccgccgggttcgccctggcggcggtgctggcccggccggtgggcgggtggctctccgaccggatcgcaccgaggcacgtggtgctggcctcgctcgccgggaccgcgctgctggcgttcgccgcggcgttgcagccgccgccggaggtgtggtcggcggccaccttcatcaccctggcggtctgcctcggcgtgggcaccggcggcgtgttcgcgtgggtggcccgccgcgccccggccgcatcggtcggctcggtcaccggaatcgtcgccgcggcaggcggattgggcggttacttcccgccgctggtgatgggcgcgacctacgacccggtcgacaacgactacacggtcgggttgctgctgctggtggcgaccgcgctggtcgcgtgtacctacaccgcgctgcacgcgcgggagccggtgagtgaggaggcgtccaggtga

SEQ ID NO: 28317 - protein, 395 aa, Mycobacterium tuberculosis CDC1551
MRGQAANLVLATWISVVNFWAWNLIGPLSTSYARDMSLSSAEASLLVATPILVGALGRIVTGPLTDRFGGRAMLIAVTLASILPVLAVGVAATMGSYALLVFFGLFLGVAGTIFAVGIPFANNWYQPARRGFSTGVFGMGMVGTALSAFFTPRFVRWFGLFTTHAIVAAALASTAVVAMVVLRDAPYFRPNADPVLPRLKAAARLPVTWEMSFLYAIVFGGFVAFSNYLPTYITTIYGFSTVDAGARTAGFALAAVLARPVGGWLSDRIAPRHVVLASLAGTALLAFAAALQPPPEVWSAATFITLAVCLGVGTGGVFAWVARRAPAASVGSVTGIVAAAGGLGGYFPPLVMGATYDPVDNDYTVGLLLLVATALVACTYTALHAREPVSEEASR

SEQ ID NO: 28318 - DNA, 1548 bp, Mycobacterium tuberculosis CDC1551
  CDS (1)..(1548): transl_table=11
atggaacagcacacgctgctgcaacgcgaggagtcgccgcgcagtcccgcggccccttcgctcaggcgcctgggtggctcacgtcacatcacgcattgggatcccgaggatctaggagcgtgggaggcaggcaacaagggcattgcccgacgcaatctgctttggtcggtcgtgacggttcacctgggttactcggtgtggacgctctggccggtgctggagttgctgatgccccaggacgtctacggcttttcaaccagtgacaagtttctgctcggcaccatcgcgacgctgtttggcgcgttcctgcggatgccctacgcgttggccagcgcgatctttggcggtcgcaactgggcgactttttcggcaatcgtgttgctaattccggccattggcacaacggtgttgttgacccatccggggctaccgctgtggccgtatctggtgtgtgcggccctgaccggcttaggcggcggcaacttcgcgtcgtcaatgagcaacgccaatgctttctatccacatcggctcaagggttcggcgctcggaattgccggtggggtaggcaatctcggggtgccggcgatccagctagttgggttgttggcaatcgccactgtcggtgagcggaagccttacctggtctgcgcactgtatgtggttctggtggcaatcgcggtaatcggagtgtcgctgttcatgaacaatgtcgaacagcaccgggtgcaggtgaaccggcttcggccgatcgtttccgcggttctgtcgacccgcgacacgtggttgctctcgctgctctacctcggcactttcggctcattcatcggcttctccttcgtgtttggccaggtgttgcagaccaacttcctggcgtgcggacaaagcccggcgcgcgcgacgctgcatgccgtcgagttggcgtttgtcgggccgttgctggcggcggtggcccggatttacggtggccggctggccgatcgagtcggtggaagccgcttgacccttatagtctttgtggcgatgacgctcgccgctgggctgctgatcagtgccagcaccctcgaaggccgacatgtcggccagcatcggggcgctaccatggtcggctacttcgtctgcttcgtcgcgttgttcgtcctatccgggttgggcaacgggtctgtgtacaagatgattccgacgatttttgaggcgtgcagccgctccctggatctcagtgaagccgaacgccgcgactggtcacgcatcatctcaggagtagtcatcgggtttgtggccgccttcggcgcgctcggcggggtcggaatcaatatggcgctgcgtgagtcctacctcagcaccggcagtgggaccgatgcgttctggatcttcatgatgtgctacgccgctgccgccgttctgacttggaaagtgtacgaccgccgaacggtcaccgacatggggatgttgcaggcggccttggtgcggcagccggcatcgacgccagccgaacttatcggtcccagaactcaatcggaccgattctccgggtgcagcatctcggcgtaa

SEQ ID NO: 28319 - protein, 515 aa, Mycobacterium tuberculosis CDC1551
MEQHTLLQREESPRSPAAPSLRRLGGSRHITHWDPEDLGAWEAGNKGIARRNLLWSVVTVHLGYSVWTLWPVLELLMPQDVYGFSTSDKFLLGTIATLFGAFLRMPYALASAIFGGRNWATFSAIVLLIPAIGTTVLLTHPGLPLWPYLVCAALTGLGGGNFASSMSNANAFYPHRLKGSALGIAGGVGNLGVPAIQLVGLLAIATVGERKPYLVCALYVVLVAIAVIGVSLFMNNVEQHRVQVNRLRPIVSAVLSTRDTWLLSLLYLGTFGSFIGFSFVFGQVLQTNFLACGQSPARATLHAVELAFVGPLLAAVARIYGGRLADRVGGSRLTLIVFVAMTLAAGLLISASTLEGRHVGQHRGATMVGYFVCFVALFVLSGLGNGSVYKMIPTIFEACSRSLDLSEAERRDWSRIISGVVIGFVAAFGALGGVGINMALRESYLSTGSGTDAFWIFMMCYAAAAVLTWKVYDRRTVTDMGMLQAALVRQPASTPAELIGPRTQSDRFSGCSISA

SEQ ID NO: 28320 - DNA, 1170 bp, Staphylococcus aureus subsp. aureus Mu50
  CDS (1)..(1170): transl_table=11
atgtacaaaacaaaaggtggctttcaacttacattacaaacattaagtttagtggttgggtttatggcttggagtataattgcgccattaatgccctttattaaacaagatgtcaatgttactgaaggtcaaatatcaatcattttagcgataccagttattttgggatcagtgctccgtgtgccatttggttatttaacaaatattgttggtgctaaatgggtattctttacaagttttatcgtattgttattcccgatatttttcttaagccaagcacaaacgccgggtatgttaatggcatcaggatttttccttggcgtaggtggcgcaattttctctgttggtgttacatcagttcctaaatatttcccaaaagaaaaagtaggtctagcaaatggtatttatggtatggggaatatcggtacagcagtttcttcatttttagcaccaccgatagcgggtattattggttggcaaacaacagttagaagttacttaattattatcgctttatttgcattaattatgttcatttttggtgacacacaagaacgtaaaattaaagtgccattaatggcccaaatgaaaacattatctaaaaactacaaattatattacttaagttattggtatttcattacttttggtgcttttgtagcatttggtattttcttacctaactacttagtaaatcattttggaattgacaaagtagatgctggtattcgttcaggtgtattcattgcgctggcaacattcttgagaccaataggtggtatactaggtgataaatttaatgcagttaaagtactgatgattgattttgttattatgattatcggtgccgttattttaggtatttcagaccatatcgcattattcactgtaggctgtttaacaataagtatttgtgcaggtattggtaacggcttaatttttaaattagtaccatcctacttctcaaatgaagcaggatcagcaaatggtatcgtatcaatgatgggtggtttaggaggattcttcccaccgttggtcatcacatacgtagctaatttaacaggttcaagccatttagcatttattttcttagcggtatttggatgcattgcattatttaccatgcgccatttatatcaaaaagaatatggttcattgaaacacagttga

SEQ ID NO: 28321 - protein, 389 aa, Staphylococcus aureus subsp. aureus Mu50
MYKTKGGFQLTLQTLSLVVGFMAWSIIAPLMPFIKQDVNVTEGQISIILAIPVILGSVLRVPFGYLTNIVGAKWVFFTSFIVLLFPIFFLSQAQTPGMLMASGFFLGVGGAIFSVGVTSVPKYFPKEKVGLANGIYGMGNIGTAVSSFLAPPIAGIIGWQTTVRSYLIIIALFALIMFIFGDTQERKIKVPLMAQMKTLSKNYKLYYLSYWYFITFGAFVAFGIFLPNYLVNHFGIDKVDAGIRSGVFIALATFLRPIGGILGDKFNAVKVLMIDFVIMIIGAVILGISDHIALFTVGCLTISICAGIGNGLIFKLVPSYFSNEAGSANGIVSMMGGLGGFFPPLVITYVANLTGSSHLAFIFLAVFGCIALFTMRHLYQKEYGSLKHS

SEQ ID NO: 28322 - DNA, 1422 bp, Caulobacter crescentus CB15
  CDS (1)..(1422): transl_table=11
ttgctgagcaagcgtgcgagattgcagagcctgagggcggcccgtcgccgcgcaggtgactccgatcctccgccacgctcaactcggatcaaggccaccgaacaacggcgttcgcggctgccagaggaccgctccgatgcggtcagtcgcccgaggcgccgccgcctcgctctcgcagacacgcagacgatcgaggccattatgctctcccgcgaattcctgaaggctggacacgcgccgaccctgttcgccgcctttctctatttcgacctcagcttcatggtctgggtgatcctgggtccgctgggcgtggcgatcgccaaggacttcaatctggacccggcccagaagggcctgatggtcgccgtgccggtgctcgccggcgcggtcctgcggctcgtgaacggcgtgctcgtcgatcgtatcggccccaagaagaccgggatcatcggccagctgatcgtgctggcgggtctggtcaccgcctgggctgttggtcttcacaactatcagcagatcctggcgctgggcctggtgctgggcgtggccggcgcgtccttcgcggtggcgctgccgctggcctcgcgctggtatccgcaggagcatcaggggctggccctgggcatcgccggggccggcaactccggcacggccctggccgccctgttcgcgccggccttggccaagaccttcggctggcagaacgtcatcggcctggcggcgatcccgctggccttcgccttcgtcgcctatctggtcctggccaaggacgcccccgagcagcccgcgcccaagaagctcgccgagtacctggatgtcctgaaggttcccgacgcctggtggctgatgctgctttacggtgtcacgttcggcggcttcgtcggtctcgcctcgtccctgaccatgtacttcaactccgagtacggcctggacccggtgatcgccgggttcttcaccgccgcctgtgtgttcgccggctcgttcatccgcccggtcggcggggcgctcgccgaccgctacggcggggtgcgaaccctgggcgtggtctatgtcctggccgcgatcggcctgacggtggccggcttccaattgccgtccgctggcctcgccctggccgtcctgctgttcgcgatgctggccctgggcgcgggcaatggcgcggtgttccagctggccccgcaaaggttccgtaatgagatcggggtgatgaccggcctgatcggcatgaccggcgggatcggcggcttctatctcgcctcgacgctcggtctggccaagaagatgaccggctcctaccagtccggcttcatcggtttcgccctgctggccgtcttcgccttgatcgcgctgttcagtctcaaggcccgctggcgagccgtgtggccgaccctgcacggcgacgccgcgcccgtccgcgtctaa

SEQ ID NO: 28323 - protein, 473 aa, Caulobacter crescentus CB15
MLSKRARLQSLRAARRRAGDSDPPPRSTRIKATEQRRSRLPEDRSDAVSRPRRRRLALADTQTIEAIMLSREFLKAGHAPTLFAAFLYFDLSFMVWVILGPLGVAIAKDFNLDPAQKGLMVAVPVLAGAVLRLVNGVLVDRIGPKKTGIIGQLIVLAGLVTAWAVGLHNYQQILALGLVLGVAGASFAVALPLASRWYPQEHQGLALGIAGAGNSGTALAALFAPALAKTFGWQNVIGLAAIPLAFAFVAYLVLAKDAPEQPAPKKLAEYLDVLKVPDAWWLMLLYGVTFGGFVGLASSLTMYFNSEYGLDPVIAGFFTAACVFAGSFIRPVGGALADRYGGVRTLGVVYVLAAIGLTVAGFQLPSAGLALAVLLFAMLALGAGNGAVFQLAPQRFRNEIGVMTGLIGMTGGIGGFYLASTLGLAKKMTGSYQSGFIGFALLAVFALIALFSLKARWRAVWPTLHGDAAPVRV

SEQ ID NO: 28324 - DNA, 1275 bp, Sinorhizobium meliloti 1021
  CDS (1)..(1275): transl_table=11
atgtccgctcttcaccagacgcagtcgacctataagggcgcaccaggacgcgctttgtgggtctcaacgggtgcatttacggtctgtttcgccatatggaccattttttcgatcatcggcgtgcgcataaaggatgaactcggcctgagcgaagccgagttcgggctcctgatcggcatgccgatcctgacgggctcgctcgtccgcatcgtcctgggcatctggaccagccggtatggcggccgcctcgtctacacgctcaccatgctggcggcagcactcgccaccttcctgctcgcttatgctacgacctatccgcagatgctcctcgcagggctgggtgtcggtctggcgggaggctcttttgccgtgggggtcgcctatgtttcgcctttctttccgccggaaaaacagggcaccgctctcgggattttcggtgccggcaacgtcggcgccgcggtcacgaaatttctggcgccattcgttctcgtcgccttcggctggcaggccgtcgcggaggtctgggcggccgcgcttctcgtcacggcggtcgtcttctggttctcgacggaagacgatccgcaattccgcgcccgccgcgatgtcggtgcaccaaggaagagcttcctgagtgaattcgagccactcaagaacattcaggtctggcgcttctcgctctactacttctttgccttcggcggcttcgtggcgctcgcgctctggctgccgcgctatctcgtcggcgtctacggtttcgacatcgagaccgccggcatgatcgccgccgcctattccattcccggcagtatcttccgcgcctatggcggcgctttgtcggacaagctcggcgcccgcaggatcatgtatgccatgttcgccgtgtctgccgtcgcaacggccattctgtcgatacctgcaggtgctgccggcggtgcgatgccgatcctggttaccccgatcgtcttcgtcgtcgtgaccttcgtgctcggcttcgtcatgagcctcggcaaggcagcggtctacaagcacatacccgtctattatccctcccatgtgggcgccgtcggcggcatcgtcggcatgatgggcgggctcggcggcttcgtcctgccgatcgccttcggcttcctcaaggatgtgaccggcctttggtccagctgcttcatgctgctcttcgtcatcgtagccgtctccatggtctggatgaatgtctcgatccggcagatcaagcgcgaggccgaccgaggtgtcccggccggggcgcttgcacgatag

SEQ ID NO: 28325 - protein, 424 aa, Sinorhizobium meliloti 1021
MSALHQTQSTYKGAPGRALWVSTGAFTVCFAIWTIFSIIGVRIKDELGLSEAEFGLLIGMPILTGSLVRIVLGIWTSRYGGRLVYTLTMLAAALATFLLAYATTYPQMLLAGLGVGLAGGSFAVGVAYVSPFFPPEKQGTALGIFGAGNVGAAVTKFLAPFVLVAFGWQAVAEVWAAALLVTAVVFWFSTEDDPQFRARRDVGAPRKSFLSEFEPLKNIQVWRFSLYYFFAFGGFVALALWLPRYLVGVYGFDIETAGMIAAAYSIPGSIFRAYGGALSDKLGARRIMYAMFAVSAVATAILSIPAGAAGGAMPILVTPIVFVVVTFVLGFVMSLGKAAVYKHIPVYYPSHVGAVGGIVGMMGGLGGFVLPIAFGFLKDVTGLWSSCFMLLFVIVAVSMVWMNVSIRQIKREADRGVPAGALAR

SEQ ID NO: 28326 - DNA, 1398 bp, Salmonella typhimurium LT2
  CDS (1)..(1398): transl_table=11
atgagtcacttatccgccccggaaagggcaactggcgctgttatcacggaatggcgtccggaagatccggcattctggcagcagcgcggccatcgtgtcgccagccgtaatttgtggatttctgtgccgtgtttactgctggcgttttgcgtctggatgctattcagcgcagtggcggtgaacctgccgaaagtgggatttaattttacgaccgatcagctctttatgttgactgcgctgccatctgtttccggcgcgctgctacgggtgccttactcctttatggtgccgctatttggcggacgtcgctggacagcgttcagtaccggtatcctcatcgtgccctgcgtatggttaggctttgccgttcaggataccagtacgccatttagcaccttcattattatttccttgctgtgtggttttgccggcgcgaactttgcctccagtatggcgaacatcagctttttctttcctaaacaaaagcagggcggcgcgctgggtctgaacggtggtctgggcaatatgggcgtgagcgtgatgcaactggttgcgccgctggtggtttcgctctctatctttgccgcctttggcagccacggtgtagagcagccggacggttctcagctctatctggcgaacgcggcctggatttgggtgcctttcctggccatttttacgctggcggcgtggttcggcatgaacgaactggcgacgtctaaggcctcgctaaaagagcaactgccggtgctcaaacgtggtcatctgtggatcatgagtctgctgtatctggcgaccttcggatcgtttatcggtttctccgcggggttcgcgatgctgtctaaaacgcaattcccggatgtgcagatcctgcattatgcgtttttcggtccgtttatcggcgcgctggcgcgttcggcaggcggcgcaatttctgaccgtctgggggggactcgcgtcacgcttatcaactttgtcctgatggcgattttcagcggtctgctgttcctgacattacctactggcggcgttggcggtagctttatcgcgttctacggggtatttctggcgctgttcctgacggctgggttggggagtggttctaccttccagatgatctccgttatcttccgtaaactgacaatggaccgggtaaaagcggaaggcgggtcggaagaaagagccatgcgtgaagcggcaactgatacggcggcggcgctgggctttatttccgcgattggcgcgattggcggcttttttattccgaaagcgtttggttcatctttagcattaaccggttctccagtcggcgcgatgaaagtctttcttattttctatatcgcctgcgtcgttattacctgggcggtatatggacgtcattctaaaaataaaaagtaa

SEQ ID NO: 28327 - protein, 465 aa, Salmonella typhimurium LT2
MSHLSAPERATGAVITEWRPEDPAFWQQRGHRVASRNLWISVPCLLLAFCVWMLFSAVAVNLPKVGFNFTTDQLFMLTALPSVSGALLRVPYSFMVPLFGGRRWTAFSTGILIVPCVWLGFAVQDTSTPFSTFIIISLLCGFAGANFASSMANISFFFPKQKQGGALGLNGGLGNMGVSVMQLVAPLVVSLSIFAAFGSHGVEQPDGSQLYLANAAWIWVPFLAIFTLAAWFGMNELATSKASLKEQLPVLKRGHLWIMSLLYLATFGSFIGFSAGFAMLSKTQFPDVQILHYAFFGPFIGALARSAGGAISDRLGGTRVTLINFVLMAIFSGLLFLTLPTGGVGGSFIAFYGVFLALFLTAGLGSGSTFQMISVIFRKLTMDRVKAEGGSEERAMREAATDTAAALGFISAIGAIGGFFIPKAFGSSLALTGSPVGAMKVFLIFYIACVVITWAVYGRHSKNKK

SEQ ID NO: 28328 - DNA, 1314 bp, Ralstonia solanacearum GMI1000
  CDS (1)..(1314): transl_table=11
atgtcctccactcccatcgtttcgcaagatgccatcgcgcaagcggccgttgtaccgcgtgcctattcggtactggcctcatccaccttcgccttcaccatctgcttcgcggtgtggacgatgttcgccattctcgggattccgctgcagaagcagctcggcctgtcggaaaccgaattcggcctgattgccgcaacgcccatcctgacgggctcgctggcgcgcgtgccgctgggcatgtggacggaccgcttcggcgggcgcatcgtgtttttcctgctgatgctggccacggtcgtcccgatctggtttgtggccgaggcgacgcggctgtggcagttcctgctgctcgggatgctggtcgggctggtcggcggctcgttctcggtgggcacgccatacgtggcgcgctggttccccaagagccggcagggctttgccatgggcatcttcggcgccggcaacgcgggcgctgcgctcaacaagttcgtcgcgccgctgctggtggtcgccgcgggcacgtggacggtggtgccgcgcgtgtacgccgtcgccatgctggtcaccgcgctgctgttctggttcggctcggccaccaatccggcccatgccgcgggcaaatcggtctcgctgcgcgcgcagctgcgggtgatgaaggatccgcgcgtgtggcgctactcgcagtattactcggtggtgttcggcggctatgtcgggctgtcgctgtggctcacgcggtactacgtgtcggagtacggcttctcgatcaagaccgcggccttcctggcggcgtgcttctcgctgccgggcggcgtgctgcgcgcggtgggcggctggctgtcggaccgctacggcgcctcccgcaccacctgggcggtgatgtgggtgtgctgggtcgcgttcttcctgctgagctatccgcagacgcagttcacggtgaccagcacgcgcggcccgctggacttccacatcggcctgtcgccgctggccttcaccgcgctgatcggcgtggtgggcgtggccatggccatcggcaaggcctcggtcttcaagttcatctcgaacgatttcaccgacaacatcggcgcagtctcgggcgcggtgggcctggccggcgggctggcgggcttcgtcctgccgatcctgttcggcgtgctggtcgatctcaccggcatccgctcgacctgcttcatgttgctgtacggcgccgtgtgcgtgagcctggtgtggatgcacttcagcttccgcgccgggcgcggcggcatgccgtccgaaccgccgcgcccggctgccctcgcgcagcgcgccgcctga

SEQ ID NO: 28329 - protein, 437 aa, Ralstonia solanacearum GMI1000
MSSTPIVSQDAIAQAAVVPRAYSVLASSTFAFTICFAVWTMFAILGIPLQKQLGLSETEFGLIAATPILTGSLARVPLGMWTDRFGGRIVFFLLMLATVVPIWFVAEATRLWQFLLLGMLVGLVGGSFSVGTPYVARWFPKSRQGFAMGIFGAGNAGAALNKFVAPLLVVAAGTWTVVPRVYAVAMLVTALLFWFGSATNPAHAAGKSVSLRAQLRVMKDPRVWRYSQYYSVVFGGYVGLSLWLTRYYVSEYGFSIKTAAFLAACFSLPGGVLRAVGGWLSDRYGASRTTWAVMWVCWVAFFLLSYPQTQFTVTSTRGPLDFHIGLSPLAFTALIGVVGVAMAIGKASVFKFISNDFTDNIGAVSGAVGLAGGLAGFVLPILFGVLVDLTGIRSTCFMLLYGAVCVSLVWMHFSFRAGRGGMPSEPPRPAALAQRAA

SEQ ID NO: 28330 - DNA, 1386 bp, Ralstonia solanacearum GMI1000
  CDS (1)..(1386): transl_table=11
atgtcgtcaaacgtcctcacgcactgggagccggagaacccttcgttctggcgcgccaccggccagtcggtggcctatcgcaacctgtggatctcgattcccgccctgatgatcgcgttcgcggtctggtcgttgtggagcgtggtcgtggtcaacctcgacaaagcggggtttgcgctcaccaagaaccagatgttctggctcaccgccttgccggcgctgtcgggcgccacgctgcgcatcttctattcgttcctggtgccgattttcggcgggcggcgctggacggcgctgtccacggccagcctgctgatccccgcgctgggcatgggcatggcgctgcgcgatccgcagacgggctttccgaccctgctggtcctggcgctgctgtgcggcctgggcggcggcaatttcagttcgtcgatggccaacatcagcttcttcttccccaagcagaagaaggggctggccacggggctgaacgccggcatcggcaacctgggcgtgtcggcggtgcagttcatcacgccgctggtgatttcggtcggcgtgttcggcgcgctgggcggcgacccgcagacctacacggccggcggcgtggagcgcagcctgtggctccagaatgcgggcttcctgtgggtgccgttcattctcgcggcgacgctggccgcgtggttcggcatgcatgacattgccgatgcccgcgcctccttcgccgaccaggccgtgatcttcaagcgcacccacaactggctgatgtgcctgctgtacgtcggcaccttcggctcgttcatcggcttctcggccgggctggcactgctgaccaagtcgcagtttcccgatgtcgacccgaccgcctacgtgttcctcgggccgctggccggcgcgctcacgcggccggtggggggctggatttcggacaagctcggcggggcgcgcgtcacgctgttcaccttcgccggcatgatcgcggcggtggtgggcgtgctgatgttcctgcccgccgagggcaatcccggcagcttcgcgggcttcctcgccatgttcatcgtgctgttcgcgctgaccggcatcggcaacggctcgaccttccgcatgatcccgatcatcttcctcacgcagcatcagcgggcggcccggggccaggacgacgccgcgcagcgccaggccgtccaggacgccggcaaggaatcggccgccgtgctgggcttcaccggcgcgatcggcgcgtacggcggcttcttcatccccaagagcttcggcacctcgctggagctgacgggctcggtcaatgccgcgctgtactgcttcatcgccttctacgtggtgtgcgcactggtgacgtgggccatctacgcccgccgcaacgcgcccatgccgtgctga

SEQ ID NO: 28331 - protein, 461 aa, Ralstonia solanacearum GMI1000
MSSNVLTHWEPENPSFWRATGQSVAYRNLWISIPALMIAFAVWSLWSVVVVNLDKAGFALTKNQMFWLTALPALSGATLRIFYSFLVPIFGGRRWTALSTASLLIPALGMGMALRDPQTGFPTLLVLALLCGLGGGNFSSSMANISFFFPKQKKGLATGLNAGIGNLGVSAVQFITPLVISVGVFGALGGDPQTYTAGGVERSLWLQNAGFLWVPFILAATLAAWFGMHDIADARASFADQAVIFKRTHNWLMCLLYVGTFGSFIGFSAGLALLTKSQFPDVDPTAYVFLGPLAGALTRPVGGWISDKLGGARVTLFTFAGMIAAVVGVLMFLPAEGNPGSFAGFLAMFIVLFALTGIGNGSTFRMIPIIFLTQHQRAARGQDDAAQRQAVQDAGKESAAVLGFTGAIGAYGGFFIPKSFGTSLELTGSVNAALYCFIAFYVVCALVTWAIYARRNAPMPC

SEQ ID NO: 28332 - DNA, 2856 bp, Brucella melitensis 16M
  CDS (1)..(2856): transl_table=11
atgcaacatgtcgcaggggaaaaccccagggcgcagactacggcgctagcgatgagcgcgaccgcttttacagtctgttttgcggtctggaccatctttgctatcatcggcattgaaattcgatccgagcttggcctgactgagacacagttcggcctgcttgttagcacgcccatcctgaccggatcgctgatccgcgtcattctgggcatatgggtggaccgctatggcggccgtgccatcttcacgctcacaatgctggtttcggctgtcgccacctatctcctgacctatgccacgacctatccgcaaatgctgctcgcagccctcggcgtcggcgtggcgggcgggtcgttctcggtcggcgtcgcttatgtctcgcgctggtatccacctgaaaagcagggcgttgcgctcggcattttcggcgcgggcaatgtcggcgcggcggtgacgaagttctttgcaccgatggtcatggttgcatttggctggcatacggttgccgaagtctgggcggccgcaatggttgtcatggcgctggtcttctatttcaccaccaacgacgatcccgttctggtcgaacgccgtcgcaagggtgaaaagcccaccagcacgctgatggagctggaaccactcaagaacattcaggtctggcgtttctcgctttattacttcttcgtgttcggcgcctttgtggcgctctccctgtggctgccgcaatatctgatccatgtctatggcgtcgatatccgttttgccggcatcatcgcggcattcttctccatcccggccagccttttccgcgcttatggcgggcatctttcagatgtctacggcgcgcgcagggtcatgtactggaccttcgccgtctcgctggtggcgaccttcattctgtcttatccgccaacggattatgtcatccagagcgataatggcccgctggccttccacgccgaaatgggcgtaatcggtttcacggtaacggtcttcatcctcggcttcttcatggccctgggcaaggcagccgtcttcaagcatatcccggtctattatcccggcaatgtcggcgctgtcggcggtctcgtcggcatgatcggcggccttggcggcttcatcctgccgatcctgttcggcgtgctgctggaccagaccggcctgtggacgagctgcttcatgctgctcttcgtcatcgtcgtcgtgtccttcgtgtggatgcatgtctccattcgccagatggaacacgcagccgaaggcaaggctacggaagaacttcccgccttcgccgaattgcagggcctgaaaaaggctgaggtcaagcctgcgacgggcgaatccgtcctcaccgactggcggcctgacgatccggccttctgggaacagaaaggcaggcgcatcgccaagcgcaatctgtggctctccatcccggcgcttctcctctccttcgccatctggcaggtctggtccgtcgtggtggcaaaactgccgctggtgggctatcagttcacgaccgaccagctcttctggctggccgctctgcccggcatttcgggcgcaaccctgcgtatcttctattccttcatggtcccgatctttggcggccgcctttggacgacgcttaccacctggtcgctcgtcattccggccatcggcatcggctatgcggtccagaatccggatacgccttacttcatcttcctccttctggcactcttctgcggctttggcggcggtaacttcgcctcctccatgtccaacatttccttcttcttcccgaagacggaaaagggcaatgcggcggcactgaacgcaggcctcggcaatctcggcgtcagcgtcgtgcagttcgtcgttccgctggtcatcaccgcaggcatcttcggcaagctcggcggcaacccggcaatggtcgcaaccgcggctggcgaagccccgctctggctccagaacgccggcttcatcttcgtgccgttcatcatcgtcacggctttcgccaactggttcggcatgaacgacatcgcctctgccaaggcttcgtttgccgatcaggccgtcatcttccgccgcaggcataactggatcatgtgctggctttacaccggtacgttcggttcgttcatcggctattcggcaggtttcccgctgctcaccaacatcctgttccccgaggtcaatgcgctgcaattcgccttcctcggacctttggtcggtgcattgtcgcggtcgggttccggctggctggcagacaaatacggcggcggtcgcgttaccatctgggctttcatcctgatgatggttggcgtggcaggcgtgctctacttcgtcggcatcaaggatgagccgaatgccttctggggcttcttcgccgccttcatcctgctgttcttcgccaccggcattggcaatgcctccaccttccagatgatcccggcgatcatggcgaaggatatggaacggctgatgcccatggcttcggcagaagaacgccgccgccaggcagacaaggaatccgcagccatcaccggcttcacctcggccatcgctgccttcggcgccttcttcatccccaagggatacggcacctcgatcagcctgaccggaggaccggaaatggcgctgtgggcattcctgatcttctacgtgacctgcctcatcatcacctggggcgtctatacccgaaaaggcggactgctggactgctctacgacgtcgagcgccgcctcaagccggccgcagccgccgcttgaagaaaaactgagaggatataatcatgagtctactcctcgaccgcctgaacttcctggcacgcaggaatgtcggcaccttctcggaagggcacggcgtcaccaccaatga

SEQ ID NO: 28333 - protein, 951 aa, Brucella melitensis 16M
MQHVAGENPRAQTTALAMSATAFTVCFAVWTIFAIIGIEIRSELGLTETQFGLLVSTPILTGSLIRVILGIWVDRYGGRAIFTLTMLVSAVATYLLTYATTYPQMLLAALGVGVAGGSFSVGVAYVSRWYPPEKQGVALGIFGAGNVGAAVTKFFAPMVMVAFGWHTVAEVWAAAMVVMALVFYFTTNDDPVLVERRRKGEKPTSTLMELEPLKNIQVWRFSLYYFFVFGAFVALSLWLPQYLIHVYGVDIRFAGIIAAFFSIPASLFRAYGGHLSDVYGARRVMYWTFAVSLVATFILSYPPTDYVIQSDNGPLAFHAEMGVIGFTVTVFILGFFMALGKAAVFKHIPVYYPGNVGAVGGLVGMIGGLGGFILPILFGVLLDQTGLWTSCFMLLFVIVVVSFVWMHVSIRQMEHAAEGKATEELPAFAELQGLKKAEVKPATGESVLTDWRPDDPAFWEQKGRRIAKRNLWLSIPALLLSFAIWQVWSVVVAKLPLVGYQFTTDQLFWLAALPGISGATLRIFYSFMVPIFGGRLWTTLTTWSLVIPAIGIGYAVQNPDTPYFIFLLLALFCGFGGGNFASSMSNISFFFPKTEKGNAAALNAGLGNLGVSVVQFVVPLVITAGIFGKLGGNPAMVATAAGEAPLWLQNAGFIFVPFIIVTAFANWFGMNDIASAKASFADQAVIFRRRHNWIMCWLYTGTFGSFIGYSAGFPLLTNILFPEVNALQFAFLGPLVGALSRSGSGWLADKYGGGRVTIWAFILMMVGVAGVLYFVGIKDEPNAFWGFFAAFILLFFATGIGNASTFQMIPAIMAKDMERLMPMASAEERRRQADKESAAITGFTSAIAAFGAFFIPKGYGTSISLTGGPEMALWAFLIFYVTCLIITWGVYTRKGGLLDCSTTSSAASSRPQPPLEEKLRGYNHESTPRPPELPGTQECRHLLGRARRHHQ

SEQ ID NO: 28334 - DNA, 1293 bp, Clostridium perfringens str. 13
  CDS (1)..(1293): transl_table=11
atgaaaaacttaaatcttaaaggtaatccaaatcgtggattaataggagctacattaggtttcttcataggttttgcagcagtttctctttatggaccaacttctgcagtatttaaagaagctttcgtaaaccttaatccagtattattagcattacttattgcagcccctaacttatcaggttctttacttagaatacctttttcagcatgggttgacacaactggtgggagaaaaccacttatagttttactacttttatcaataataggtatgggtggtttatacatagtattagctttctttagcgataacttaaatcaatattattatttattatttgcacttggactattatctggatgtggtatagcaacattctctgttggtgtcagccaagcatcatattggttcccaaaaagcaaacaaggtgtagctttaggaatatatggtggtgttggtaacttagcacctggaatatttgcattattaattccaaacttagcacttcctctattaggattacctggttcttacttagcttggttaatattcttaatagttggtactgtaatttacataaaaataggtcaaaacgcttggtacttccaacttgttgacaaaggaataaataaagatgaagctaaggaaatagcatcaaaagagtatggtcaagaattattccctaagggaaaagcaagtgaaacacttttaatatcagctaagtcatggaaaacttgggctttagtatttatctatttcacaactttcggtggattcttagcattaacaggttggttccctaactactggatgacttatttcggattaaatatgaaagttgcaggtcttttaacagctttatattctatattaacttcattaactagaatatatggtggaaaagttgctgataaaaatggtggagaaataactactatagtttctctaggaatagcacttatcggtgcaatttgtatgacttttgcttcaactatgactttagcaataataggtataatcttacttgctattggtatgggagttgcaaacgcagcagtatttaaaatagttcctaacgcagttccagaggcaatgggtggagcttcaggatggattggtggattaggtgctttaggtggattcttaatacctcctgtaatggcatcattcctaaacagatcaggatttgctggatattcacaaggattttcagtatttatagttttaataattgtagcaattggagtaatagctttattccaagctttacaaaagaaatcagcaaaataa

SEQ ID NO: 28335 - protein, 430 aa, Clostridium perfringens str. 13
MKNLNLKGNPNRGLIGATLGFFIGFAAVSLYGPTSAVFKEAFVNLNPVLLALLIAAPNLSGSLLRIPFSAWVDTTGGRKPLIVLLLLSIIGMGGLYIVLAFFSDNLNQYYYLLFALGLLSGCGIATFSVGVSQASYWFPKSKQGVALGIYGGVGNLAPGIFALLIPNLALPLLGLPGSYLAWLIFLIVGTVIYIKIGQNAWYFQLVDKGINKDEAKEIASKEYGQELFPKGKASETLLISAKSWKTWALVFIYFTTFGGFLALTGWFPNYWMTYFGLNMKVAGLLTALYSILTSLTRIYGGKVADKNGGEITTIVSLGIALIGAICMTFASTMTLAIIGIILLAIGMGVANAAVFKIVPNAVPEAMGGASGWIGGLGALGGFLIPPVMASFLNRSGFAGYSQGFSVFIVLIIVAIGVIALFQALQKKSAK

SEQ ID NO: 28336 - DNA, 1338 bp, Corynebacterium glutamicum ATCC 13032
  CDS (1)..(1338): transl_table=11
gtgacacaactcaacaccaaaggcgttgttctgcaagggtgggatccagaagatcctgaacattgggactcgaaaattgcatggcgaaccctgtggattaccaccttctccatgattattgggttctgcgtgtggtatttggtttctgccatcgctcccctactcaatcgaattggatttgatctctcagcaggtcagctttattggctcgcatctatccccggtttggccggcggattaatccgattgatttacatgttccttccaccgattcttggaacccgcaaattggtcggaatttcctccggtctatttttgatccccatgtttgggtggttcctggctgtccaagattcaagcactccctactggtggcttctcacactcgctgcactcactggcattggtggtggcgtgttctctggatatatgccgtccacgggatacttcttccccaaggcaaaatcgggcactgcgctgggcattcaggcaggtatcggcaacctcggcgtctcgataattcagttcatgggcccatgggtcatgggtttcggtctgctgggcattggtttcctcaccccgcagcgcaccattgaaggcaccacggtgtttgtgcacaatgctgcgattgtgttggtcccgtggactattctcgcggccgttttatccttcctgtttcttaaagatgtcccagtcaccgcaaatttccggcaacagatcgatatctttggcaacaagaacacatggattttgtccattatctacttgatgacattcggtgccttcgccggtttcgccgcgcagttcggtctgatcatcaacaacaacttcggcatcgcttccccgatggcagagacttatccagctgagatgcttcacgccggtgctacgttcgcgtttcttggacctttgattggtgctttggtgcgtgctgcatggggtccactgtgtgacagattcggtggagctatctggacctttgtcggtggcatcggaatgactatcgccactgcagctgccgcaatcttcctaagcagagcggagacacctgatgatttctggccattcctgtggtccatgcttgccctgttcttcttcaccggtctgggcaatgctggcaccttcaaacaaatgcccatgattttgcctaaacgccaagcaggtggcgtgatcggctggaccggtgccattggtgccttcggccccttcattgtcggtgtcttgctctccttcactccaactgtcgcgttcttctggggctgcgtggtgttcttcatcatcgccaccgctttgacctggatctactacgcccgcccgaacgctccattcccgggataa

SEQ ID NO: 28337 - protein, 445 aa, Corynebacterium glutamicum ATCC 13032
MTQLNTKGVVLQGWDPEDPEHWDSKIAWRTLWITTFSMIIGFCVWYLVSAIAPLLNRIGFDLSAGQLYWLASIPGLAGGLIRLIYMFLPPILGTRKLVGISSGLFLIPMFGWFLAVQDSSTPYWWLLTLAALTGIGGGVFSGYMPSTGYFFPKAKSGTALGIQAGIGNLGVSIIQFMGPWVMGFGLLGIGFLTPQRTIEGTTVFVHNAAIVLVPWTILAAVLSFLFLKDVPVTANFRQQIDIFGNKNTWILSIIYLMTFGAFAGFAAQFGLIINNNFGIASPMAETYPAEMLHAGATFAFLGPLIGALVRAAWGPLCDRFGGAIWTFVGGIGMTIATAAAAIFLSRAETPDDFWPFLWSMLALFFFTGLGNAGTFKQMPMILPKRQAGGVIGWTGAIGAFGPFIVGVLLSFTPTVAFFWGCVVFFIIATALTWIYYARPNAPFPG

SEQ ID NO: 28338 - DNA, 1239 bp, Streptomyces coelicolor A3(2)
  CDS (1)..(1239): transl_table=11
atgctccagccgtcgacacagcacagcgagatcacatcgcagtccgtacccggtcgggcctggttgatgttggcactcgccaccctgggcttcgccctcaacttctgggcctgggcactgctgagcccgctcggcccccggttcaaggacagcctggacctgagctccttccagcagtcgttgctggtcgccgtaccggtggtggtcggctcgctggggcggatacccgtcggcgcgctgaccgaccggttcggaggacgagtgatgttcccgctcgtctccgccgccaccatcgtcccggtcctctacctcgggctggccgggcactcctccctgaccgccctgctggtcggaggcttcctcctcggcatcggcggcaccgcgttcgccgtcggagtccccttcaccagcgcctggttcccgcccgagcggcggggcctggccatcggcatcttcggcgccggcatgggcggcaccgccatcagcgccctgaccacggtgaagctggtcgacgcgtacggcatggccaacccgttcctcgtcaccgccgccgtcctggccgtctacgccgtggtggcggcactgctgctgcgcgacgcacccggccggaccgtgcccgcggagtccctgggccaccgcatggcggccacgtgcaagttgggcatcacctggcaggcgtcggcgctctacgcggtcgccttcggcggctacgtcgccttctccgtctacctgcccacctacctcaagaccggctacggcctcacccaggccgacgcggccaaccgcatggcgggattcgttctgctcgcggtcgccatgcgcccgatgggcggctggctctccgaccgactggggccggtcaaggtcctggccggctcgttggccgtggtgctggccggagcgctcgcccagtcgccgaccccggccctgatgccggtcggtacgatcgccttcctcgccatggccgccgcgctcggtgcgggcagcggcgccgtgttcgccctggtcgccttcctctcgccggcgaacaaggtcggttcggtcaccggcatggtgggcgcggccggcggactcggcggcttcctcccgccgttggtgatggggacgctgtacggttccttcggctcgtacgcgatcggcctgatcctgctcgccgcggtcgcggcggcggcgcttgccttcaccggcaccggactgagccatgccgtctctcgtcgcgcgaccgcgcactcgcactga

SEQ ID NO: 28339 - protein, 412 aa, Streptomyces coelicolor A3(2)
MLQPSTQHSEITSQSVPGRAWLMLALATLGFALNFWAWALLSPLGPRFKDSLDLSSFQQSLLVAVPVVVGSLGRIPVGALTDRFGGRVMFPLVSAATIVPVLYLGLAGHSSLTALLVGGFLLGIGGTAFAVGVPFTSAWFPPERRGLAIGIFGAGMGGTAISALTTVKLVDAYGMANPFLVTAAVLAVYAVVAALLLRDAPGRTVPAESLGHRMAATCKLGITWQASALYAVAFGGYVAFSVYLPTYLKTGYGLTQADAANRMAGFVLLAVAMRPMGGWLSDRLGPVKVLAGSLAVVLAGALAQSPTPALMPVGTIAFLAMAAALGAGSGAVFALVAFLSPANKVGSVTGMVGAAGGLGGFLPPLVMGTLYGSFGSYAIGLILLAAVAAAALAFTGTGLSHAVSRRATAHSH

SEQ ID NO: 28340 - DNA, 1359 bp, Streptomyces coelicolor A3(2)
  CDS (1)..(1359): transl_table=11
atgaaagcccgtggcggacgctggatcgagtactgggatcccgagaacgagaccttctggaaggagacgggacggcgaacggcccggcggaacctgttcttctccgtgctctccgagcacatcgggttctccgtctggaccctgtggtccgtgctggtgctcttcatgggcccggagtacgggctgtccccggccgacaagttcctgctgacgtccgtggtgaccctcgtcggggccgtcgtacgggtgccgtacaccttcgccgtggccgtcttcggcgggcggaactggacggtcgtctcggcgagcatgctgctcgtgccgacgctcgcggccttcgtcgtgatggagcccgggacgtccttctcgacgttcctgctggtcgggctgctggccgggatcggcggcggcaacttcgcctcctccatgaccaacatcaacgccttcttcccgctcagggagaagggctgggcgctcggcctcaacgccggcggcgggaacgtcggtgtgcccgtcatccagctcgtcgcgctcgcgatcatcggggcgagcggcgggccccgggtgctgctcggcatctacatcccgctgatcctcgtggccgccgtcctcgccgcgcgcttcatggacaacctcaccacggtgaagaacgacaccggagcggccaaggacgcggccagggacgcccacacctggatcatgtcggtgctgtacgtcggcaccttcggttccttcatcggctacagcttcgccttcggacaggtgctgaccacccagttcgggcggacaccgctccaggcggcctacctcacgttcatcggaccgctgctcggctccctcgtccgtccgctgggcggcaggctcgccgaccggtacggcggttcgaggatcaccctgtggaacttcgtcgccatggccgcggccaccgcggtcctcgtcgtggccagcatggagaggtcgctggcgctgttcgtgaccgtgttcgtggcgctgttcgtgctcagtgggctcggcaacggctcgacgttcaagatgatcccgcacatcttccactccaaggcgctggcccgggggctgacgggagaggaggccgtgctgcacgggcggcggctgtcgggggcggcgatggggctgatcggcgcggtgggaggcctcgggggcgtcgggatcaacctcgccttccgtcagtccttcctctcctcgggttcgggcaccggtgccttcgtcgccttcctggcctgctacgccgtgtgcatcgcggtgacctggtcggtataccttcgccgtcccgccgggcggagcgggaccggggcgggaccggcggcggaggagacgcggcgcagctacgccgaggtgtga

SEQ ID NO: 28341 - protein, 452 aa, Streptomyces coelicolor A3(2)
MKARGGRWIEYWDPENETFWKETGRRTARRNLFFSVLSEHIGFSVWTLWSVLVLFMGPEYGLSPADKFLLTSVVTLVGAVVRVPYTFAVAVFGGRNWTVVSASMLLVPTLAAFVVMEPGTSFSTFLLVGLLAGIGGGNFASSMTNINAFFPLREKGWALGLNAGGGNVGVPVIQLVALAIIGASGGPRVLLGIYIPLILVAAVLAARFMDNLTTVKNDTGAAKDAARDAHTWIMSVLYVGTFGSFIGYSFAFGQVLTTQFGRTPLQAAYLTFIGPLLGSLVRPLGGRLADRYGGSRITLWNFVAMAAATAVLVVASMERSLALFVTVFVALFVLSGLGNGSTFKMIPHIFHSKALARGLTGEEAVLHGRRLSGAAMGLIGAVGGLGGVGINLAFRQSFLSSGSGTGAFVAFLACYAVCIAVTWSVYLRRPAGRSGTGAGPAAEETRRSYAEV

SEQ ID NO: 28342 - DNA, 1236 bp, Xanthomonas campestris pv. campestris str. ATCC 33913
  CDS (1)..(1236): transl_table=11
ttggccatcgcattcggagatgcctctatgcagcgttcgttctggcgatctgggcacacgcccaccttgttcgcatccttcctgtatttcgacctgagtttcatggtgtggtatctgctcggtccgctgcaggtgccgatcgcgcaagcgctgggattggacacgcagcagcgcgccttgatggtggcggtgcccatcctgtgcggcgcggtgttgcgcctggtgttgggcatgctggccgaccgtatcggcgccaagcgcgccggcgtggtggcgcagttggcggtgatcgcctcgttgtttggtgcctggcaactcggcgtgcacagcatgggccaggtgctgctgctgggcgtgctgctcggcattgccggcgcctcgtttgcagtggcgctgccgctggcatcgcgctggtacccgccggaacaccagggcacggcgatgggcattgccggtgccggcaactccggcacggtgctggcggccttgttcgcgccgatgctggcgctggcattcggctaccagaacgtgttcgggctggcgtgcattccactggtgctgacgctgctcgtgtttgtgttgattgcccgcgaagcgcccataccggttgcgcgcaagcgctgggccgattacggccgcgtgctggttggcaatcgcgacgcatggcgcttcatgtttttttactcagtgacctttggcggcttctccggatttgctagcgcgttgccgggttacttccacgaccagttcggtttcgatgcgcgcaccgcgggctgggccacggccgcctgcgtgttggccggctcggtgatgcgcccgctcggcggtgtcatcgccgaccgcgttggcggcacgcgcgccttgctggcggtgtacttgctggtcgccaccttggtcggcatcgccggctttggcgcaggtggggccacgatcaccttggggctgttcgtgctcacgctgctgtgcctgggcgccggcaatggagcggtgttccagctggtgccgcagcgcttcggccaggacatcggggtgatgaccggcctgatcggcatggccggcggcgttggcggctttgcattggccgcggggctgggcgtgctcaagcagcacaccggcagctatgcgatcggcatgtggttgttcgcggcgttcgccctgggtggctgggcgctgctggccggcgtcaagacccaatggcgcagtgaatggtccaccgccggcgcggcgcgcgtctga

SEQ ID NO: 28343 - protein, 411 aa, Xanthomonas campestris pv. campestris str. ATCC 33913
MAIAFGDASMQRSFWRSGHTPTLFASFLYFDLSFMVWYLLGPLQVPIAQALGLDTQQRALMVAVPILCGAVLRLVLGMLADRIGAKRAGVVAQLAVIASLFGAWQLGVHSMGQVLLLGVLLGIAGASFAVALPLASRWYPPEHQGTAMGIAGAGNSGTVLAALFAPMLALAFGYQNVFGLACIPLVLTLLVFVLIAREAPIPVARKRWADYGRVLVGNRDAWRFMFFYSVTFGGFSGFASALPGYFHDQFGFDARTAGWATAACVLAGSVMRPLGGVIADRVGGTRALLAVYLLVATLVGIAGFGAGGATITLGLFVLTLLCLGAGNGAVFQLVPQRFGQDIGVMTGLIGMAGGVGGFALAAGLGVLKQHTGSYAIGMWLFAAFALGGWALLAGVKTQWRSEWSTAGAARV

SEQ ID NO: 28344 - DNA, 2688 bp, Brucella suis 1330
  CDS (1)..(2688): transl_table=11
atgagcacgaccgcttttacagtctgttttgcggtctggaccatctttgctatcatcggcattgaaattcgatccgagcttggcctgactgagacacagttcggcctgcttgttggcacgcccatcctgaccggatcgctgatccgcgtcattctgggcatatgggcggaccgctatggcggccgtgccatcttcacgctcacaatgctggtttcggctgtcgccacctatctcctgacctatgccacgacctatccgcaaatgctgctcgcagccctcggcgtcggcgtggcgggcgggtcgttctcggtcggcgtcgcttatgtctcgcgctggtacccacctgaaaagcagggcgttgcgctcggcattttcggcgcgggcaatgtcggcgcggcggtgacgaagttctttgcaccgatggtcatggttgcatttggctggcatacggttgccgaagtctgggcggccgcaatggttgtcatggcgctggtctactatttcaccaccaacgacgatcccgttctggtcgaacgccgtcgcaagggtgaaaagcccaccagcacgctgatggagctggaaccactcaagaacattcaggtctggcgtttctcgctttattacttcttcgtgttcggcgcctttgtggcgctctccctgtggctgccgcaatatctgatccatgtctatggcgtcgatatccgttttgccggcatcatcgcggcattcttctccatcccggccagccttttccgcgcttatggcgggcatctttcagatgtctacggcgcgcgcagggtcatgtactggaccttcgccgtctcgctggtggcgaccttcattctgtcttatccgccaacggattatgtcatccagagcgataatggcccgctggccttccacgccgaaatgggcgtaatcggtttcacggtaacggtcttcatcctcggcttcttcatggccctgggcaaggcagccgtcttcaagcatatcccggtctattatcccggcaatgtcggcgctgtcggcggtctcgtcggcatgatcggcggccttggcggcttcatcctgccgatcctgttcggcgtgctgctggaccagaccggcctgtggacgagctgcttcatgctgctcttcgtcatcgtcgtcgtgtccttcgtgtggatgcatgtctccattcgccagatggaacacgcagccgaaggcaaggctacggaagaacttcccgccttcgccgaattgcagggcctgaaaaaggctgaggtcaagcctgcgacgggcgaatccgtcctcaccgactggcggcctgacgatccggccttctgggaacagaaaggcaggcgcatcgccaagcgcaatctgtggctctccatcccggcgcttctcctctccttcgccatctggcaggtctggtccgtcgtcgtggcaaaactgccgctggtgggctatcagttcacgaccgaccagctcttctggctggccgctctgcccggcatttcgggcgcaaccctgcgtatcttctattccttcatggtcccgatctttggcggccgcctttggacgacgcttaccacctggtcgctcgtcattccggccatcggcatcggctatgcggtccagaatccggatacgccttacttcatcttcctccttctggcgctcttctgcggctttggcggcggtaacttcgcctcctccatgtccaacatttccttcttcttcccgaagacggaaaagggcaatgcggcggcactgaacgcaggcctcggcaatctcggcgtcagcgtcgtgcagttcgtcgttccgctggtcatcaccgcaggcatcttcggcaagctcggcggcaacccggcaatggtcgcaaccgcggctggcgaagccccgctctggctccagaacgccggcttcatcttcgtgccgttcatcatcgtcacggctttcgccaactggttcggcatgaacgacatcgcctctgccaaggcttcgtttgccgatcaggccgtcatcttccgccgcaggcataactggatcatgtgctggctttacatcggtacgttcggttcgttcatcggctattcggcaggtttcccgctgctcaccaacatcctgttccccgaggtcaatgcgctgcaattcgccttcctcggacctttggtcggtgcattgtcgcggtcgggttccggctggctggcagacaaatacggcggtggtcgcgttaccatctgggctttcatcctgatgatggttggcgtggcaggcgtgctctacttcgtcggcatcaaggatgagccgaatgccttctggggcttcttcgccgccttcatcctgctgttcttcgccaccggcattggcaatgcctccaccttccagatgatcccggcgatcatggcgaaggatatggaacggctaatgcccatggcttcggcagaagaacgccgccgccaggcagacaaggaatccgcagccatcaccggcttcacctcggccatcgctgccttcggcgccttcttcatccccaagggatacggcacctcgatcagcctgaccggaggaccggaaatggcgctgtgggcattcctgatcttctacgtgacctgcctcatcatcacctggggcgtctatacccgaaaaggcggactgctctacgacgtcgagcgccgcctcaagccggccgcagccgccgcttga

SEQ ID NO: 28345 - protein, 895 aa, Brucella suis 1330
MSTTAFTVCFAVWTIFAIIGIEIRSELGLTETQFGLLVGTPILTGSLIRVILGIWADRYGGRAIFTLTMLVSAVATYLLTYATTYPQMLLAALGVGVAGGSFSVGVAYVSRWYPPEKQGVALGIFGAGNVGAAVTKFFAPMVMVAFGWHTVAEVWAAAMVVMALVYYFTTNDDPVLVERRRKGEKPTSTLMELEPLKNIQVWRFSLYYFFVFGAFVALSLWLPQYLIHVYGVDIRFAGIIAAFFSIPASLFRAYGGHLSDVYGARRVMYWTFAVSLVATFILSYPPTDYVIQSDNGPLAFHAEMGVIGFTVTVFILGFFMALGKAAVFKHIPVYYPGNVGAVGGLVGMIGGLGGFILPILFGVLLDQTGLWTSCFMLLFVIVVVSFVWMHVSIRQMEHAAEGKATEELPAFAELQGLKKAEVKPATGESVLTDWRPDDPAFWEQKGRRIAKRNLWLSIPALLLSFAIWQVWSVVVAKLPLVGYQFTTDQLFWLAALPGISGATLRIFYSFMVPIFGGRLWTTLTTWSLVIPAIGIGYAVQNPDTPYFIFLLLALFCGFGGGNFASSMSNISFFFPKTEKGNAAALNAGLGNLGVSVVQFVVPLVITAGIFGKLGGNPAMVATAAGEAPLWLQNAGFIFVPFIIVTAFANWFGMNDIASAKASFADQAVIFRRRHNWIMCWLYIGTFGSFIGYSAGFPLLTNILFPEVNALQFAFLGPLVGALSRSGSGWLADKYGGGRVTIWAFILMMVGVAGVLYFVGIKDEPNAFWGFFAAFILLFFATGIGNASTFQMIPAIMAKDMERLMPMASAEERRRQADKESAAITGFTSAIAAFGAFFIPKGYGTSISLTGGPEMALWAFLIFYVTCLIITWGVYTRKGGLLYDVERRLKPAAAAA

SEQ ID NO: 28346 - DNA, 1389 bp, Shigella flexneri 2a str. 301
  CDS (1)..(1389): transl_table=11
atggcactgcaaaatgagaaaaatagtcgttatcttttacgcgactggaaaccagaaaatccggccttctgggaaaataaaggaaaacatattgctcgaagaaacctctggatatcagtcagttgtctacttcttgccttctgtgtctggatgctatttagcgcagttaccgttaatctcaataaaatcggttttaattttactaccgatcaactctttttattaaccgcattaccctccgtttctggcgcattattgcgtgttccctactcctttatggtgcctatattcggtggacgccgatggccggtttttagtactgcaatcctgattattccttgcgtctggctcggaattgccgtgcaaaatccgaatactccttttgggatatttatcgttatcgctttgctatgcggttttgcaggtgcaaactttgcttcgagcatgggcaatatcagtttcttctttccaaaagccaaacaagggagcgctcttgggattaatggcggattaggaaacttaggtgtaagtgtaatgcagctggttgcaccgctggtcatttttgtacctgtatttgcctttctcggcgtcaatggcgtaccgcaggccgacggttcggtgatgtcgctggcgaatgccgcatggatttgggtaccgctactggcgattgccacgatcgccgcctggtcagggatgaatgatatcgccagttcacgcgcctcaattgccgaccagctccctgtcttacaacgcctgcatctctggctgctgagcctgctttaccttgccaccttcggttcgtttatcggtttttctgcgggttttgccatgctggcaaaaacccagttcccggatgtgaatattctgcgcctggcgttctttggcccatttattggtgccatcgcgcggtcggttggtggtgctatttccgataaattcggcggcgtgcgggtgacgttgatcaactttatttttatggcgattttcagtgccctgctgttccttaccttaccgggcacaggctccggtaatttcatcgccttttacgccgtatttatggggctgtttctgaccgcgggtctgggaagtggttctactttccagatgatcgccgtcatctttcgccagataaccatttatcgggtgaagatgaaaggcggtagtgatgagcaagctcagagagaagccgtcaccgaaacggcggcaacgctgggctttatctcagccattggcgcagtgggcggcttttttattccgcaggcatttggcatgtcgctcaatatgaccggctctccggtcggcgcgatgaaagtgtttttaatcttctacatcgtttgtgtgctgctgacctggctggtttatggtcggcggaagttcagccaaaaataa

SEQ ID NO: 28347 - protein, 462 aa, Shigella flexneri 2a str. 301
MALQNEKNSRYLLRDWKPENPAFWENKGKHIARRNLWISVSCLLLAFCVWMLFSAVTVNLNKIGFNFTTDQLFLLTALPSVSGALLRVPYSFMVPIFGGRRWPVFSTAILIIPCVWLGIAVQNPNTPFGIFIVIALLCGFAGANFASSMGNISFFFPKAKQGSALGINGGLGNLGVSVMQLVAPLVIFVPVFAFLGVNGVPQADGSVMSLANAAWIWVPLLAIATIAAWSGMNDIASSRASIADQLPVLQRLHLWLLSLLYLATFGSFIGFSAGFAMLAKTQFPDVNILRLAFFGPFIGAIARSVGGAISDKFGGVRVTLINFIFMAIFSALLFLTLPGTGSGNFIAFYAVFMGLFLTAGLGSGSTFQMIAVIFRQITIYRVKMKGGSDEQAQREAVTETAATLGFISAIGAVGGFFIPQAFGMSLNMTGSPVGAMKVFLIFYIVCVLLTWLVYGRRKFSQK

SEQ ID NO: 28348 - DNA, 1434 bp, Corynebacterium efficiens YS-314
  CDS (1)..(1434): transl_table=11
atgaccttagcaggtcacgccgtgttagattggtttcaatgcagtcacggaagggtttccggaacgcccttcgaccccaatcagaagaggcataaagtgacagaactcaacacaaagggaaaaactctccacgggtgggatcccgaggtccccgagcagtgggattccaggatcgcctggcgcaccctggccattaccacattttccctcatcatcggcttcagcgtctggtacctggtctcggccatcgccccgctgctcaaccgtatcggtttcgacctcagcgcggcccagctctactggctgaccgcggtaccgggactggccggaggtattctccgtctggtcttcatgttcctgcccgcccgcatcggcacccgcaacctggtggggttctcctcagccctgtttctcatccccatgttcggctggttcctcgcggtccagaacgccaacaccccctactggtggctgctggtcctggcggccatgaccggaatcggtggcggttgcttctccgggtacatgccctccaccggctggttcttccccaaggccaagtccggcaccgccctgggtatccaggcgggtgtgggcaacctcggggtctccgtgatccagttcctcggtccgtgggtgatgggtttcggtctgctgggcatcggattcatcaccccgcagcgcacggtggagggcagtgaggtcttcgttcacaacgccgccatcgtgctggtgccgtgggcgatgctggcctcggtcctggccttcctgttcctcaaggacatcccgatgaaggtgaacttcagggaccagttgaacttcttccgcaacaagaacacctggatcctcagcatcgtctacatgatgaccttcggggccttcgccggtttcgccgcccagttcggtctgatcatcaacaaccacttcggtatcgcctccccgatggcagagcagttccccgcggaggcgctgcacgccggtgccacctacgccttcctcggccccctcatcagtgccctggtccgtgcaggatggggcccactgtgtgacaagttcggtggtgcggtgtggaccttcgtcagtggcgtgggcatgatcgcctccaccgtggccgccgccatcttcctgtcacgggcggagaccccggatgatttctacccgttcctgtggtccatgctcgccctgttcttcttcaccggtatcggcaacgccggcaccttcaagcagatgccgatgatcctgcccaggaaacaggccggaggtgttatcggatggacaggagccatcggcgcattcggccccttcgtggtcggtgtgctgctctccatgacccccaccgtgaccttctactggggctgtgtggtcttcttcaccatcgccaccgccctgacctggatctactatgcacgcccgaacgccccgttcccgggataa

SEQ ID NO: 28349 - protein, 477 aa, Corynebacterium efficiens YS-314
MTLAGHAVLDWFQCSHGRVSGTPFDPNQKRHKVTELNTKGKTLHGWDPEVPEQWDSRIAWRTLAITTFSLIIGFSVWYLVSAIAPLLNRIGFDLSAAQLYWLTAVPGLAGGILRLVFMFLPARIGTRNLVGFSSALFLIPMFGWFLAVQNANTPYWWLLVLAAMTGIGGGCFSGYMPSTGWFFPKAKSGTALGIQAGVGNLGVSVIQFLGPWVMGFGLLGIGFITPQRTVEGSEVFVHNAAIVLVPWAMLASVLAFLFLKDIPMKVNFRDQLNFFRNKNTWILSIVYMMTFGAFAGFAAQFGLIINNHFGIASPMAEQFPAEALHAGATYAFLGPLISALVRAGWGPLCDKFGGAVWTFVSGVGMIASTVAAAIFLSRAETPDDFYPFLWSMLALFFFTGIGNAGTFKQMPMILPRKQAGGVIGWTGAIGAFGPFVVGVLLSMTPTVTFYWGCVVFFTIATALTWIYYARPNAPFPG

SEQ ID NO: 28350 - DNA, 1302 bp, Corynebacterium efficiens YS-314
  CDS (1)..(1302): transl_table=11
atgaccaacgcccgcgatcaccacacccccctgaccaccgatccacctgtcgccaccagcccgacacgtgagacacccggtgcctaccgggtgctgaccatggccaccctgggcttcacgctgatgttcgccgcctggatgatgttcggagttctgggcatccccatccaggaagaattcggactgacggatgtccagctgtccctcatcagctcggtggccatcctcaacggttcactgtggcgcctgcccgccggaatcatcgccgaccgcctcggtggtcgcatcgtgatgacggtgctgctggtcgcctccgctgttttcagctacatggtctcactggccgattcctactccatgctcctggggctcgcgtttgccgtgggccttgccggcaactcattctccgtcggcaacacctgggtggcagcctggttcagcaaacgccgaaatggtctagcgatgggggtgttcggtgccggcaacgtcggtgcatccgtcaccaaattcatcggccccgtcatcatcgcggccacagccggttccctgtacttcgggggattggtggagggtggctggcggctggtacccgtgatctacgccgtggccctgctggccaccgcggtgatgttgtggttcatcacgccggcacaggataagaaaccggggcagggtcggaaactctctgagatgctcgcgcccctgaaacagggccgcgtctggcgtttcagtctctactatgtggcggtcttcggtgcctatgtcgccctgtcctcctggatgcccaagtactacatcgacatgtacggtgtctccacctccaccgccgcgctgctgacggcgctgttcatcttcccggcctccctgatgcgtccggtggggggatccctgtccgaccgtttcggggcccgacagacgaccatcttcgccctgttgatcatgctcaccgccagcggcatcctcgcgctccccctcaccatcaacatcgtgctgttcaccctcctcctgttcacgctgggtgtgggcatgggtatcggcaaggcctcggtgttcaagtacatcccggattacttcccgggcaatgtcgggtccgtcggtggcctggtgggtatgttcggtggcctgggtggcgccttcctccccccgctcttcgccggtgtgaaaaccgcaacgggactggagcaggccaccttcctggtgatcttcgtgctcgtggccttctgcctggcctggttactgcgcgccatctccctgatgaagcgcacctcccccgacccgctgtggcgacgcttcggcatctag

SEQ ID NO: 28351 - protein, 433 aa, Corynebacterium efficiens YS-314
MTNARDHHTPLTTDPPVATSPTRETPGAYRVLTMATLGFTLMFAAWMMFGVLGIPIQEEFGLTDVQLSLISSVAILNGSLWRLPAGIIADRLGGRIVMTVLLVASAVFSYMVSLADSYSMLLGLAFAVGLAGNSFSVGNTWVAAWFSKRRNGLAMGVFGAGNVGASVTKFIGPVIIAATAGSLYFGGLVEGGWRLVPVIYAVALLATAVMLWFITPAQDKKPGQGRKLSEMLAPLKQGRVWRFSLYYVAVFGAYVALSSWMPKYYIDMYGVSTSTAALLTALFIFPASLMRPVGGSLSDRFGARQTTIFALLIMLTASGILALPLTINIVLFTLLLFTLGVGMGIGKASVFKYIPDYFPGNVGSVGGLVGMFGGLGGAFLPPLFAGVKTATGLEQATFLVIFVLVAFCLAWLLRAISLMKRTSPDPLWRRFGI

SEQ ID NO: 28352 - DNA, 1236 bp, Pseudomonas putida KT2440
  CDS (1)..(1236): transl_table=11
ttgtactaccgagtgaggtgttcgatgagtgccagcttctggaaatccgggcatgtgcccacgctgttcgccgcgtttctgtacttcgacctcagcttcatggtctggtacctgctgggcccgttggcggtgcagattgctgccgacctgcaactgagcgcacaacaacggggcctgatggtggccacgccgatcctggccggggcaatcctgcgcttcgccatgggcgttctggtcgaccgcctgtcgcccaagacggctggcctgatcggccaggtggtggtcatcgtcgccctggccgcagcctggcaccttggcgtacacagctatgaacaggccctgctgctaggcgtgttcctgggctttgccggtgcgtccttcgccgtttcgctgccgctggcctcgcagtggtacccgccacagcaccagggcaaggccatgggcatcgccggcgcaggcaactccggcacggtgttcgcggccttgctggcaccggcactggcagccggctttggctggaacaatgtgttcggctttgcgctgatcccgctgtcactggcgctggtggtgttcgccctgttggcgcgcaatgccccgcaacggcccaagccgaaagccatggccgactacctcaaggcactgggcgaccgtgacagctggtggttcatgtttttctacagcgttaccttcggcggcttcatcggcctggccagcgccctgcccggctatttcagcgaccaatacggcctgagcccggtcaccgccggctactacaccgccgcttgtgtgttcgccggcagcctgatgcgcccgctcggcggcgccctggctgaccgttttggcggcatccgcaccctgctgggcatgtacggcgtggccgccatctgcattgccgcagtcggcttcaacctgccctctgccgcggccgcactggcgttgttcgtcagcgccatgctcggcctgggtgccggcaatggcgcagtgttccaactggtgccacaacgcttccgccaagagatcggggtaatgaccggcctgatcggcatggccgggggcatcggcggcttcctgctggcggccgggcttggcaccatcaagcagcacactggcgattaccaactggggctgtggctgttcgccagcctgggcctgctggcctggttcggcctgcacggggtgaaacagcgctggcgcaccacctggggctcggctgcagtcaccgcagcacgggtctga

SEQ ID NO: 28353 - protein, 411 aa, Pseudomonas putida KT2440
MYYRVRCSMSASFWKSGHVPTLFAAFLYFDLSFMVWYLLGPLAVQIAADLQLSAQQRGLMVATPILAGAILRFAMGVLVDRLSPKTAGLIGQVVVIVALAAAWHLGVHSYEQALLLGVFLGFAGASFAVSLPLASQWYPPQHQGKAMGIAGAGNSGTVFAALLAPALAAGFGWNNVFGFALIPLSLALVVFALLARNAPQRPKPKAMADYLKALGDRDSWWFMFFYSVTFGGFIGLASALPGYFSDQYGLSPVTAGYYTAACVFAGSLMRPLGGALADRFGGIRTLLGMYGVAAICIAAVGFNLPSAAAALALFVSAMLGLGAGNGAVFQLVPQRFRQEIGVMTGLIGMAGGIGGFLLAAGLGTIKQHTGDYQLGLWLFASLGLLAWFGLHGVKQRWRTTWGSAAVTAARV

SEQ ID NO: 28354 - DNA, 1164 bp, Staphylococcus epidermidis ATCC 12228
  CDS (1)..(1164): transl_table=11
atgaacatgaaaaagggtgtttctcagcttacgttacagacattgagtttggtcgcaggctttatggcatggagtatcatttctccattaatgccatttatttcacaagatgttgatatttctccaggacaaatatctgtcattttagctattcctgttattttaggttctgtactacgtgtaccatttgggtacttaactaacattgtaggagcgaaatgggtgtttttctggagttttattgtactattacttccaatttttcttttaggtcaagctcaatcacccggtatgctaatgttatcaggattctttctaggaattggtggcgcaattttttcagtaggtgttacttcagtacctaaatacttttcaaaagacaaagttggtttagcaaatggtatatatggtgtaggtaatattggtactgcagtttcatcattttgtgccccagtgttagcaggtgcaattggctggcaaaatacagttcgtagttatttaattattctaagtatatttgcaattttaatgttttttttaggagataaaaatgagccgaaagtgaagattcctttgatggctcaagtcaaagacctatctaagaattataagttgtattatttaagtttgtggtattttattacttttggagcttttgtggcttttgggatttttttaccgaactttctagttgatcattttagtattgataaagtggatgcaggtattcgttcaggtatatttatagcactagcgacgttcttaagaccggttggtggtgttataggtgataaatttaatgcagtacaagcgcttatcatcgacttcgtgataatgattattggtgcgcttatattaagcttatctagtcatattgttctgtttacgataggctgtttagcaattagtatctgtgcaggtataggtaatggtttaatatttaaattagtaccttcatacttttctaaagaagcaggttcagcgaatggtattgtatccatgatgggaggactaggcggtttcttcccaccactagtgattacttttgtaacgagtatcactggttcaagtcatctcgctttcttcttcttggctatatttggtgtaattgctcttattacaatgattcatttaaataaaaaagaaaaagctattcgtatataa

SEQ ID NO: 28355 - protein, 387 aa, Staphylococcus epidermidis ATCC 12228
MNMKKGVSQLTLQTLSLVAGFMAWSIISPLMPFISQDVDISPGQISVILAIPVILGSVLRVPFGYLTNIVGAKWVFFWSFIVLLLPIFLLGQAQSPGMLMLSGFFLGIGGAIFSVGVTSVPKYFSKDKVGLANGIYGVGNIGTAVSSFCAPVLAGAIGWQNTVRSYLIILSIFAILMFFLGDKNEPKVKIPLMAQVKDLSKNYKLYYLSLWYFITFGAFVAFGIFLPNFLVDHFSIDKVDAGIRSGIFIALATFLRPVGGVIGDKFNAVQALIIDFVIMIIGALILSLSSHIVLFTIGCLAISICAGIGNGLIFKLVPSYFSKEAGSANGIVSMMGGLGGFFPPLVITFVTSITGSSHLAFFFLAIFGVIALITMIHLNKKEKAIRI

SEQ ID NO: 28356 - DNA, 1380 bp, Bradyrhizobium japonicum USDA 110
  CDS (1)..(1380): transl_table=11
atgacgaagaatccgacctggatttcagactggcgccccgaggatgaggcgttctggaatgcgactggcaagactatcgcgcgacgcaacctgatctggtcgatcgtggccgagcatatcggcttctcggtctggctgatctggagcatcgtcaccaccaagctgccgcaggcaggcttccattacaccaccgaccagctgttccagctcgtcgcggtgccgggcctgatcggcgccttgatgcgctttccctacacattcgcggtgacgacgttcggcggtcgcaactggaccattttcagcgcggccatcctgttcattccgacgttgtcgctcgcctggttcgtcagtcagcccgacacgccgttctggctgatgctgctgatcgcctcgactgccggtctcggcggcggcaatttcgcctccagcatgacaaacatctccttcttcttcccggacaggatgaagggatgggcgctgggcctcaacgcggccggcggtaatatcggcgtctccagcgtgcagctcctaaccccgatcctgatgacgctcgccgtcattaacctgttccaggcaacccccgtcgacggcgtgttccttcagaacgccggcctgatgtgggtgctgccgatcgcgatcgcggtgttcggcgcggtgttcttcatgaacaacctgaccacggccaagtcgtcgatcagcaatcagctggcggtggtcaagcgcaagcatacctggatcatggcgtacctctatatcggcacgttcggatccttcatcggctactccgcggcgtttccgctgctgatcaagacgcagtttccgtcggtgacgatcgcgatcgcgttcctcgggcctctcgttggttcgctgtcgcgcccgttcggcggctggctggccgacaggatcggcggctcggtcatcacgttctggaacttcatcgtgatggcgggcgccaccgtcggcgtgctctatttcgtcgggcagaaggatttcatcggcttcctgtcgatgttcctgatcctgttcgtgacgacgggcatcggcaacggctcgacctaccgcatgatcccctcgatcttccgcgagcagaacctgttcaaggtgcgcggcaagggcgatgcggcgcgcgcagccgccctgaagacggcgagtatcgagagcggtgcggcggttggcttcatcggcgcggtcggcgcggtcggcggctatctgatcccgagcggtttcggcaagtcgatcgccatgaccggcgggccgcagcttgcgctcgcgatctatctcgccttctacgcctcctgcctcggcctgacctggtggttctacctgcgtcgcagcccgcagcgtgaaggcgcgccaagcctcgccgaagctcgcgtttag

SEQ ID NO: 28357 - protein, 459 aa, Bradyrhizobium japonicum USDA 110
MTKNPTWISDWRPEDEAFWNATGKTIARRNLIWSIVAEHIGFSVWLIWSIVTTKLPQAGFHYTTDQLFQLVAVPGLIGALMRFPYTFAVTTFGGRNWTIFSAAILFIPTLSLAWFVSQPDTPFWLMLLIASTAGLGGGNFASSMTNISFFFPDRMKGWALGLNAAGGNIGVSSVQLLTPILMTLAVINLFQATPVDGVFLQNAGLMWVLPIAIAVFGAVFFMNNLTTAKSSISNQLAVVKRKHTWIMAYLYIGTFGSFIGYSAAFPLLIKTQFPSVTIAIAFLGPLVGSLSRPFGGWLADRIGGSVITFWNFIVMAGATVGVLYFVGQKDFIGFLSMFLILFVTTGIGNGSTYRMIPSIFREQNLFKVRGKGDAARAAALKTASIESGAAVGFIGAVGAVGGYLIPSGFGKSIAMTGGPQLALAIYLAFYASCLGLTWWFYLRRSPQREGAPSLAEARV

SEQ ID NO: 28358 - DNA, 1191 bp, Lactobacillus plantarum WCFS1
  CDS (1)..(1191): transl_table=11
atgactgttgaagatgctcaaacaagtacgcgttggcgggcctatttagcgttaggcttggcaacggtggcgatgatcgtttgctttatgtcatggtcaaactttgcaccattagcgggagagctcgcaatcaagtttcacttgagtgtgtcgcaacggacgctgctactagcaacgccagtactactcgggtcaatcatgcgaattccagtcggaattttgagtgatcggtatggtggtaaaaaggtttatctgatcctgatggccttcattttgatcccactgttgatgattacgaaggtacacacgtacggtatgttgttagtcgcagcgttactcgttgggatggccggaacgtcttttgctgtcggggtttcgtatgcctcagtctggtttccgcctgaaaagcaaggactagcattaggaatcgtcagcatggggaacatggggaatgcggtcgctgcgttgacgttgccatccatatcgacctcgtatgggtttaacatggtttactatttcctgatggtattaacggtcattttggctgtcctgttcgccatcttttgtcgcgaaatgccggttgataagacgaaaactgtgacgggcgcattggctgtcgcaaaggaaagtagtacttggtacttgtcattattttattttctaacgtttggtctgtttgtctcattcactaatttgacaccattgttcttggaagatattttccgtgtgccacaagtaacagcaggcttatacgctgccttatttgctggcctttgtaccgttgttcgaccaattgggggagcggcggccgataagtggcgaccgatgcagatgttacagtggatctttatcggcattaccgtctttgccgtgattattacgctgacctttagcaaccagtcgctgtttatctttggtattgttggtgccggattgattgccggcttcggtaacggggtcatctttaagatggtgccgtatgtattacaaggaaatactggtgcggtcaccggttttgtcggcgctttgggtggcctgggcggtttcttcccaccactattagtggggtggattcatacttggacgggaagttatcggcttggtatcgtgctcttagccctcacgggattagtttgttggtatgccctttggcgccggtttattcatggtgacgtccacattgttaaataa

SEQ ID NO: 28359 - protein, 396 aa, Lactobacillus plantarum WCFS1
MTVEDAQTSTRWRAYLALGLATVAMIVCFMSWSNFAPLAGELAIKFHLSVSQRTLLLATPVLLGSIMRIPVGILSDRYGGKKVYLILMAFILIPLLMITKVHTYGMLLVAALLVGMAGTSFAVGVSYASVWFPPEKQGLALGIVSMGNMGNAVAALTLPSISTSYGFNMVYYFLMVLTVILAVLFAIFCREMPVDKTKTVTGALAVAKESSTWYLSLFYFLTFGLFVSFTNLTPLFLEDIFRVPQVTAGLYAALFAGLCTVVRPIGGAAADKWRPMQMLQWIFIGITVFAVIITLTFSNQSLFIFGIVGAGLIAGFGNGVIFKMVPYVLQGNTGAVTGFVGALGGLGGFFPPLLVGWIHTWTGSYRLGIVLLALTGLVCWYALWRRFIHGDVHIVK

SEQ ID NO: 28360 - DNA, 1212 bp, Pseudomonas syringae pv. tomato str. DC3000
  CDS (1)..(1212): transl_table=11
atggatacaagcttctggaaggccggtcacagaccgaccctgttcgcagcctttctgtatttcgacctgagcttcatggtctggtacctgcttggcccgatggcggtacaaatcgccaccgacctgcacctcacgactcaacagcgcggcctgatggtggccacgccgattctggccggtgccgtgctgcgcttgttcatgggtctgctggccgaccagttgtcccccaagacagccggcatcatcggtcaggtgattgtgatcggtgccttgttcactgcctggcaattgggtattcacagctacgagcaggtcttgctgctaggcctgttcctgggcatggccggcgcgtcgttcgccgttgcgttgccgctggcctcgcagtggtatccgccacagcaccagggcaaggcgatgggtattgccggtgccggcaactccggcaccgtgctggcggcattgatcgcaccggtgctggcggccagttttggctggggcaatgtgttcggcctggcgctgatcccgctggttctgacgctgattgccttcaccctgatggcgcgcaacgcgccggagcgcagcaaacccaaatccatggcggattacctcaaggcactgggcgaccgtgacagctggtggttcatgtttttctacagcgtgaccttcggtggcttcatcggtctggccagcgccctgcccggctacttcaacgaccagtatggcctgagtccgatcacggccggttactacaccgcagcctgtgtgttcggcggcagcctgatgcgcccgctcggtggcgcgctggccgaccgctttggcgggatccgcaccctgaccgtgatgtacacggtagctgctgtcggtatcgcggcagtgggcttcaacctgccgagttcgtgggcagcactggcgttgttcgttgcagcgatgcttggcctgggtgccggtaacggtgcagtcttccagttggtgccgcagcggttccgcaaggaaatcggcgtgatgaccggcctgatcgggatggctggcggtatcggcggcttcctgctggcagccggtctgggcgccatcaagcagaataccggtgattaccagttgggcctgtggctgttcgcaggtctggcggtactggcctggttcggcctgttgaacgtcaagcgtcgctggagaaccacctggggttcggcggccgtgaccgcggcgcgggtctga

SEQ ID NO: 28361 - protein, 403 aa, Pseudomonas syringae pv. tomato str. DC3000
MDTSFWKAGHRPTLFAAFLYFDLSFMVWYLLGPMAVQIATDLHLTTQQRGLMVATPILAGAVLRLFMGLLADQLSPKTAGIIGQVIVIGALFTAWQLGIHSYEQVLLLGLFLGMAGASFAVALPLASQWYPPQHQGKAMGIAGAGNSGTVLAALIAPVLAASFGWGNVFGLALIPLVLTLIAFTLMARNAPERSKPKSMADYLKALGDRDSWWFMFFYSVTFGGFIGLASALPGYFNDQYGLSPITAGYYTAACVFGGSLMRPLGGALADRFGGIRTLTVMYTVAAVGIAAVGFNLPSSWAALALFVAAMLGLGAGNGAVFQLVPQRFRKEIGVMTGLIGMAGGIGGFLLAAGLGAIKQNTGDYQLGLWLFAGLAVLAWFGLLNVKRRWRTTWGSAAVTAARV

SEQ ID NO: 28362 - DNA, 1389 bp, Salmonella enterica subsp. enterica serovar Typhi Ty2
  CDS (1)..(1389): transl_table=11
atgacacgacaaaacgagaattataaccgttatctcttgagtgactggcgacccgaaaatccagccttctgggagaataaagggaaaggcatcgccagaagaaacttatggatttcagtaagttgtttgctccttgcattttgcgtctggatgttgtttagcgctgttgccgtcaacctcaataaaattggatttgattttacgaccgaccaactctttttattaaccgcattaccttctctttccggcgcaatattacgcgttccctactcctttatggtaccactgtttggtggtcgtaaatggaccgtattaagtaccgtaatattgattattccttgcgcctggctgggattcgccgtgcaaaatcctgccacccctttcggggtatttatactcatcgctctgttgtgcggttttgcgggggcaaatttcgcgtccagtatgggcaacatcagttttttctttccaaaagccagacaaggtagcgcgttgggtattaacgacggactgggaaatcttggcgtcagtgtgatgcagttgattgcgccgctggttatttttttgccgatatttacttttttaggcgtccggggcgtgccgcaacctgatggctccctgctcgccctcactaacgccgcctggatctgggtgccgttactggctgttgcgacgcttgccgcctggtttggtatgaacgatatcggcagttcaaaagcgtctgtcgcctcgcaattgccggtgctaaaacgtctgcacctgtggctgcttagcctgctgtacctggcgacattcgggtcattcatcggcttttccgcaggtttcgccatgctcgccaaaacgcaatttcccgacgtaaacattctgcaactggcgttctttggcccctttatcggcgcgctggcgcgatcggcaggcggcgtgatctccgataaattcggcggcgttcgcgtcacgctcattaattttatctttatggcgctgtttaccgccctgctattcctcacgctgccaggctccggcgcaggcagctttagcgcgttctatcttgtttttatgggcctgtttttgacagcgggtctcggcagcggttctaccttccagatgattgcggtgatcttccggcagatcacgctctacaacgtcaaactgcgcggcgggagcgatgagcaggcgcagcgcgaagcggtgacggataccgccgccgcgctcggttttatctccgctattggcgctgtgggcggcttctttattccaaaagcgtttggcacctctttggccttgaccggctcgccggtgggcgccatgaaaatctttttgctgttttacatcgcttgcgtcctgctgacctggctggtctacgggcgtcttaagcctaaacaacaataa

SEQ ID NO: 28363 - protein, 462 aa, Salmonella enterica subsp. enterica serovar Typhi Ty2
MTRQNENYNRYLLSDWRPENPAFWENKGKGIARRNLWISVSCLLLAFCVWMLFSAVAVNLNKIGFDFTTDQLFLLTALPSLSGAILRVPYSFMVPLFGGRKWTVLSTVILIIPCAWLGFAVQNPATPFGVFILIALLCGFAGANFASSMGNISFFFPKARQGSALGINDGLGNLGVSVMQLIAPLVIFLPIFTFLGVRGVPQPDGSLLALTNAAWIWVPLLAVATLAAWFGMNDIGSSKASVASQLPVLKRLHLWLLSLLYLATFGSFIGFSAGFAMLAKTQFPDVNILQLAFFGPFIGALARSAGGVISDKFGGVRVTLINFIFMALFTALLFLTLPGSGAGSFSAFYLVFMGLFLTAGLGSGSTFQMIAVIFRQITLYNVKLRGGSDEQAQREAVTDTAAALGFISAIGAVGGFFIPKAFGTSLALTGSPVGAMKIFLLFYIACVLLTWLVYGRLKPKQQ

SEQ ID NO: 28364 - DNA, 1392 bp, Streptomyces avermitilis MA-4680
  CDS (1)..(1392): transl_table=11
atgacagccccgagcacagcccccgcagcgagtccgccgagcaggaaaggccgctggatcgaggagtgggatccggaggacgaggccttctgggaggagaagggggagaagaccgcgcggcggaatctgctcttctccgtgctgtccgagcacgtcgggttctccatctggaccctgtggtccgtgatggtgctgttcatgggacccgagtacgggctcacccccgccgacaagttcttcatcgtgtcgatggcgacgctggtcggcgcgatcgtccgcgtcccctacaccttcgccgtcgccctgttcggcgggcggaactggaccatcgtctccgcgagcctcctgctcatccccaccatcgcggccttcgtggtgatggagccgggcacctcgttcaccaccttcctggtgtgcgccatgctcgccggtatcggcggcggcaacttcgcctccagcatgaccaacatcaacgccttcttcccgctcaggaagaagggatgggcgctcgggctcaacgcgggcggcggcaacatcggggtgccggtggtgcagctggtcgggctcgccgtcatcggggccagtggcggcccgcgcgtactgctgggcatctacatcccgttcatcgtgctcgccgccggcctcgccgccgtgaagatggacaacatcgcgtccctcaagaacgacaccggcgcggcccgggaagccgtcaaggacgcccacacctggatcatgtcgttcctgtacgtcgggacgttcgggtccttcatcgggtacagcttcgcgttcggtctcgtcctgcagacgcagttcggccgtacgccgttgcagtccgcgtacgtcaccttcatcggcccgctgctgggctccctcatccggcccgtgggcggctggctcgccgaccgctacggcggcgcgaagatcacgctgtggaacttcgtcggcatggcggcggccaccggtgtcatcgtgatcgcgtccatgcagaagtcgctgccgctgttcaccaccgcgttcatcgcgctgttcgtgctcagcggcctcggcaacgggtccacgtacaagatgattcccgggatcttccacgccaaggccgtcgccaagggactcgaaggggaggaggcggccgcctacggacgccggctgtccggcgcctccatggggctcatcggagccgtcggcgcgctcggcgggctcggcatcaacctcgccttccggcagtcgttcctgagcgtgggctccggcaccggcgccttcgtctccttcctcgccttctacgcggcctgcttcgcggtcacctgggccgtataccttcgccgccaggccggggccgaagcccatgccaccgccgcctccggggcgaagccgcagctcagctatgtcgaggtgtga

SEQ ID NO: 28365 - protein, 463 aa, Streptomyces avermitilis MA-4680
MTAPSTAPAASPPSRKGRWIEEWDPEDEAFWEEKGEKTARRNLLFSVLSEHVGFSIWTLWSVMVLFMGPEYGLTPADKFFIVSMATLVGAIVRVPYTFAVALFGGRNWTIVSASLLLIPTIAAFVVMEPGTSFTTFLVCAMLAGIGGGNFASSMTNINAFFPLRKKGWALGLNAGGGNIGVPVVQLVGLAVIGASGGPRVLLGIYIPFIVLAAGLAAVKMDNIASLKNDTGAAREAVKDAHTWIMSFLYVGTFGSFIGYSFAFGLVLQTQFGRTPLQSAYVTFIGPLLGSLIRPVGGWLADRYGGAKITLWNFVGMAAATGVIVIASMQKSLPLFTTAFIALFVLSGLGNGSTYKMIPGIFHAKAVAKGLEGEEAAAYGRRLSGASMGLIGAVGALGGLGINLAFRQSFLSVGSGTGAFVSFLAFYAACFAVTWAVYLRRQAGAEAHATAASGAKPQLSYVEV

SEQ ID NO: 28366 - DNA, 1170 bp, Bacillus cereus ATCC 14579
  CDS (1)..(1170): transl_table=11
atgaaaagtcctaattttcaattaagtttacaaacttctaatctaattatcggttttatggtatgggtcattttatcatcattaatgccttatattaaagcggatattccattaactgcgggacaaatttctatggtcacagcagtacctgttattttaggctctattcttcgtattccaattggttattggacgaatcgtttcggagcaagaaaattattctttattagttttattctattattatttcctgttttttatattagtgttgccaattctatgatggatttaattattggtggattatttgtaggaatcggtggtgctgtattctctgtaggagtaacttctttaccaaaatactttccgaaagagagtcacggttttgtaaatggtatttacggtgtcggtaacgccggaacagcaattacttcgtttttagcacctgtcattgcaacttcagttggctggagaacgacagtacaatgttatttagttttacttgcagcgtttgcacttatgaactttttattaggtgatcgtaaggagaaaaaagtgaatacaccactaatggaacaaataaaaggtgtatataaaaatgagaaactttggtttttatgtatcttttactttttaacattcggatcatttgtcgcatttacagtatacttaccaaactttctagtatctcacttcggattagagaaagtagatgcaggtatgcggacagccggattcatcgtactcgcaacaattatgcgcccgattggtggttggctcggtgataagtttaatccatttaaaatattaatcttcgtatttatcggtttaacactttcaggtattattttatcgtttatgccaagtatgaacgtgtatacatttggttgcttactagtagcattttgtgcagggattggtaatggtacaatcttcaaactcgttccaatgtatttctcagaacaagctggtattgtaaatggtctcgtatcagctttaggtggactaggaggattcttcccaccgctaattttaacattactattccaattaacaggtcattatgcaattggatttatggcgctatcagaagtcgcacttgcttgtttaatcattacagtatggatgtatagccaagagaaattgttagtgatgttaaagaatcattaa

SEQ ID NO: 28367 - protein, 389 aa, Bacillus cereus ATCC 14579
MKSPNFQLSLQTSNLIIGFMVWVILSSLMPYIKADIPLTAGQISMVTAVPVILGSILRIPIGYWTNRFGARKLFFISFILLLFPVFYISVANSMMDLIIGGLFVGIGGAVFSVGVTSLPKYFPKESHGFVNGIYGVGNAGTAITSFLAPVIATSVGWRTTVQCYLVLLAAFALMNFLLGDRKEKKVNTPLMEQIKGVYKNEKLWFLCIFYFLTFGSFVAFTVYLPNFLVSHFGLEKVDAGMRTAGFIVLATIMRPIGGWLGDKFNPFKILIFVFIGLTLSGIILSFMPSMNVYTFGCLLVAFCAGIGNGTIFKLVPMYFSEQAGIVNGLVSALGGLGGFFPPLILTLLFQLTGHYAIGFMALSEVALACLIITVWMYSQEKLLVMLKNH

SEQ ID NO: 28368 - DNA, 1389 bp, Shigella flexneri 2a str. 2457T
  CDS (1)..(1389): transl_table=11
atggcactgcaaaatgagaaaaatagtcgttatcttttacgcgactggaaaccagaaaatccggccttctgggaaaataaaggaaaacatattgctcgaagaaacctctggatatcagtcagttgtctacttcttgccttctgtgtctggatgctatttagcgcagttaccgttaatctcaataaaatcggttttaattttactaccgatcaactctttttattaaccgcattaccctccgtttctggcgcattattgcgtgttccctactcctttatggtgcctatattcggtggacgccgatggccggtttttagtactgcaatcctgattattccttgcgtctggctcggaattcccgtgcaaaatccgaatactccttttgggatatttatcgttatcgctttgctatgcggttttgcaggtgcaaactttgcttcgagcatgggcaatatcagtttcttctttccaaaagccaaacaagggagcgctcttgggattaatggcggattaggaaacttaggtgtaagtgtaatgcagctggttgcaccgctggtcatttttgtacctgtatttgcctttctcggcgtcaatggcgtaccgcaggccgacggttcggtgatgtcgctggcgaatgccgcatggatttgggtaccgctactggcgattgccacgatcgccgcctggtcagggatgaatgatatcgccagttcacgcgcctcaattgccgaccagctccctgtcttacaacgcctgcatctctggctgctgagcctgctttaccttgccaccttcggttcgtttatcggtttttctgcgggttttgccatgctggcaaaaacccagttcccggatgtgaatattctgcgcctggcgttctttggcccatttattggtgccatcgcgcggtcggttggtggtgctatttccgataaattcggcggcgtgcgggtgacgttgatcaactttatttttatggcgattttcagtgccctgctgttccttaccttaccgggcacaggctccggtaatttcatcgccttttacgccgtatttatggggctgtttctgaccgcgggtctgggaagtggttctactttccagatgatcgccgtcatctttcgccagataaccatttatcgggtgaagatgaaaggcggtagtgatgagcaagctcagagagaagccgtcaccgaaacggcggcaacgctgggctttatctcagccattggcgcagtgggcggcttttttattccgcaggcatttggcatgtcgctcaatatgaccggctctccggtcggcgcgatgaaagtgtttttaatcttctacatcgtttgtgtgctgctgacctggctggtttatggtcggcggaagttcagccaaaaataa

SEQ ID NO: 28369 - protein, 462 aa, Shigella flexneri 2a str. 2457T
MALQNEKNSRYLLRDWKPENPAFWENKGKHIARRNLWISVSCLLLAFCVWMLFSAVTVNLNKIGFNFTTDQLFLLTALPSVSGALLRVPYSFMVPIFGGRRWPVFSTAILIIPCVWLGIPVQNPNTPFGIFIVIALLCGFAGANFASSMGNISFFFPKAKQGSALGINGGLGNLGVSVMQLVAPLVIFVPVFAFLGVNGVPQADGSVMSLANAAWIWVPLLAIATIAAWSGMNDIASSRASIADQLPVLQRLHLWLLSLLYLATFGSFIGFSAGFAMLAKTQFPDVNILRLAFFGPFIGAIARSVGGAISDKFGGVRVTLINFIFMAIFSALLFLTLPGTGSGNFIAFYAVFMGLFLTAGLGSGSTFQMIAVIFRQITIYRVKMKGGSDEQAQREAVTETAATLGFISAIGAVGGFFIPQAFGMSLNMTGSPVGAMKVFLIFYIVCVLLTWLVYGRRKFSQK

SEQ ID NO: 28370 - DNA, 1203 bp, Chromobacterium violaceum ATCC 12472
  CDS (1)..(1203): transl_table=11
atggaccgtaccttctggcaggccgggcaccggccgacgctggtttccgcctttctgtacttcgatctgagcttcatggcctggtatctgctgggaccgctgcaggtgcccatcgccgccgcgctgcagctttccacccagcagcgcggcctgatggtggccacgcccatcctggccggcgcgctgctgcgcccgctgatgggcatgctggtggaccgcatcggcgccaagcgcgccgggctgctcggccagatcgtcgtcatcgccgcgttgctcggcgcctggctcgctaatctgtccagcttgggcggcatgctggccttgggcgcgctgctgggcgtggccggggcctcgttcgccgccgccttgccgctggcttcgcgctggtatccgccgcggcaccagggcacggcgctgggcatcgccggggcgggcaattccggcaccgtgctggcggcgctgttcgcgccggcgctggccgcggccttcggctggcgcaatgtgttcggcctggcctgcctgcccttgctgctggtgctggcgatctacgcggtctgggccagggaggcgccggccgcggcggggcccaagcgcctgtccgactacctctccgtgctgaaggagaaggacgcctggtggttcatgttcttctactcgatgaccttcggcggttttgccggcttcgccggcgccttgcccggctatttccatgaccagttcggcttcgacgccaaagccgccggcctctacaccgccgcctgcgtgttcgccggctcggtgatgcggcccttgggcggcatgctggccgaccgcatgggtggaacccgctcgctgctggcggtctatctggcatgcgcgctgttgatggccgccgccgcgctgaacgccggcggcgctggcgcggcgctggccctgttcgtgctggccatgctgtgcctgggcgccggcaacggcgcggtgttccagctggtgccgcagcgcttcggccgggagctgggcgtgatgaccggcctggtgggcatggccggcggcatcggcggcttcctgctggcggccgggctgggcgcggtcaagcaggccagcggcgattacgcgccgggcttgtggctgttcgcgggcctctgcctgctggcctggctcagcctggcgggcgtgcagcggcattggcgcgacaactgggcggtggcggccgcccgcgtgtga

SEQ ID NO: 28371 - protein, 400 aa, Chromobacterium violaceum ATCC 12472
MDRTFWQAGHRPTLVSAFLYFDLSFMAWYLLGPLQVPIAAALQLSTQQRGLMVATPILAGALLRPLMGMLVDRIGAKRAGLLGQIVVIAALLGAWLANLSSLGGMLALGALLGVAGASFAAALPLASRWYPPRHQGTALGIAGAGNSGTVLAALFAPALAAAFGWRNVFGLACLPLLLVLAIYAVWAREAPAAAGPKRLSDYLSVLKEKDAWWFMFFYSMTFGGFAGFAGALPGYFHDQFGFDAKAAGLYTAACVFAGSVMRPLGGMLADRMGGTRSLLAVYLACALLMAAAALNAGGAGAALALFVLAMLCLGAGNGAVFQLVPQRFGRELGVMTGLVGMAGGIGGFLLAAGLGAVKQASGDYAPGLWLFAGLCLLAWLSLAGVQRHWRDNWAVAAARV

SEQ ID NO: 28372 - DNA, 1380 bp, Chromobacterium violaceum ATCC 12472
  CDS (1)..(1380): transl_table=11
atgacttatctgatcaaacactgggagccggaatcggcttcgttctggcagcagcagggacgctcggtggcgcggcgcaacctgtggatctcgattccggcgctgacgctggccttcgtgatctggcaggtgtggagcgtggcggtgctgaacatgcccaatatcggcttcggctacacccagaaccagctgttctggctggcggcgctgccggccttgtccggcgccacgctgcgcatcttctattccttcatggtgccggtgttcggcggccgcaagtggacggcgatctccaccgccagcctgctgattccggcggtgggcataggcttcgcggtgcagaacccggacaccagctatgtgaccatggtgacgctggcgctgctgtgcggcttcggcggcggcaatttcagctccagcatggccaatatcagcttcttcttccccaagtcggaaaagggcaccgcgctgggcctgaacgccggcctgggcaatctgggcgtatccatcgtgcagttcgtggtgcccatcgtcatcaccatgggcctgttcggccagttgggcggcgatccgcagcactgggtgaagggcgcggcagccaaacagatgtggctgcagaacgccggcttcgtctgggtgccgttcatcgtgctgtccacgctggcggcctggttcggcatgaacgacctggcctcggccaaatcctcgttttccgagcaggcggtgatcttcacccgcaagcataactggctgatgtgctggctgtacgtgggcaccttcggttctttcatcggcttctccgccggcttcccgctgctggtcaagggccagttccccgacatcgaccccacccgctacgccttcctgggccccttggtcggcgcgctgacccgcccgctgggcggctggctggccgacaagataggcggcgccaaggtgacgcagacggtgttcgcgctgatggtgctgggcgtgctgggcgtgatctttttcctgccgcacggcggccagggcggcaacttctacggtttcttcgcgatgttcctgtgcctgttcgcgctgaccggcgtcggcaatggctccaccttcatgcaggtgccggccattttcctgacgctgcaccagcgcatggccggcccgggcgagtcggccatgcggcaggccacccaggacgccacccgcgaggcggcggcggtgctcggtttcgccggcgcgatcggcgcctacggcggcttcttcatccccaagagctacggcacctccatcgcgatgaccggcggggtagaggcggcgctgtacctgttcatcgccttctacctgagctgcctggcgatcaacggctggtactacgcccgcaagaacgcggaagtgcgttgctga

SEQ ID NO: 28373 - protein, 459 aa, Chromobacterium violaceum ATCC 12472
MTYLIKHWEPESASFWQQQGRSVARRNLWISIPALTLAFVIWQVWSVAVLNMPNIGFGYTQNQLFWLAALPALSGATLRIFYSFMVPVFGGRKWTAISTASLLIPAVGIGFAVQNPDTSYVTMVTLALLCGFGGGNFSSSMANISFFFPKSEKGTALGLNAGLGNLGVSIVQFVVPIVITMGLFGQLGGDPQHWVKGAAAKQMWLQNAGFVWVPFIVLSTLAAWFGMNDLASAKSSFSEQAVIFTRKHNWLMCWLYVGTFGSFIGFSAGFPLLVKGQFPDIDPTRYAFLGPLVGALTRPLGGWLADKIGGAKVTQTVFALMVLGVLGVIFFLPHGGQGGNFYGFFAMFLCLFALTGVGNGSTFMQVPAIFLTLHQRMAGPGESAMRQATQDATREAAAVLGFAGAIGAYGGFFIPKSYGTSIAMTGGVEAALYLFIAFYLSCLAINGWYYARKNAEVRC

SEQ ID NO: 28374 - DNA, 1284 bp, Chromobacterium violaceum ATCC 12472
  CDS (1)..(1284): transl_table=11
atgacttccccgacattcaaacgctacagcgtgctggccagcagcacgctggctttcaccctctgcttcatggtctggatgatgttcgcggtgctgggcatcccgatcaagcagcagctgggcctcaatgaaaccgagttcggcatcctggccgccacgccggtgctgaccggttcgctgatccgcgtgccgctgggcatctggaccgaccgctacggcggccgcccggtgctgttcgcgctgatgctcagctgcgtgctgcccatctacctgatgcagttcgccagcgcctactggcagttcctgctggccgggctattcgtcggcctggccggcggttcgttctcggtcggcacgccctatgtggcgcgctggttccgcaaggagcagcagggcctggccatgggcattttcggcgccggcaacgccggctcggcgctgaccaagctggtggccccggcgctgatcctggcctggggctggcagagcgtgcccaccgcctacgcgctgatcatgctggccgccgccatcctgttctggctgttctccttcagcgatccggcccacaaggcgccgtccacggtgacgctgcgccagcagctggcgctgatgaagcatccggcggtgctgcgctattgccagtactactcggtggtgttcggcggctacgtggcgctggcgctgtggatgaccaagtactacgtcggcgagtacgggctggacctgaagcacgcggcgttgctggcggcctgtttctccttgccgggcggcgtgctgcgcgcggtggggggctatctgtctgaccgcttcggcccctacgtggtcacttgggcggtgatgtgggtgtgctgggtggccttcttcctgctgtcctatccgcagaccgagatgcgcgtggcgaccaccggcgggccgctcagcctgcacatcggcctcaacgtctacctgttcaccggcctgctgttcctggtgggcgtggcgatggcgataggcaaggcctcggtgttcaagttcatctccgacgaatttcccgactccatcggcgcggtgtccggcgtggtcggcctgtccggcggcctgggcggcttcctgctgcccatcctgttcggcgtcttgctcgacctgaccggcgtgcgcagcagcgccttcatgctgctgtacggcacggtgtgcgtcagcctggtgtggatgcatttttccttcaaatcggcggcaagagccaaggcgcgggcgcgcgcggccgagcccgtcaatcccattcccttgaccaacgaacgcggctga

SEQ ID NO: 28375 - protein, 427 aa, Chromobacterium violaceum ATCC 12472
MTSPTFKRYSVLASSTLAFTLCFMVWMMFAVLGIPIKQQLGLNETEFGILAATPVLTGSLIRVPLGIWTDRYGGRPVLFALMLSCVLPIYLMQFASAYWQFLLAGLFVGLAGGSFSVGTPYVARWFRKEQQGLAMGIFGAGNAGSALTKLVAPALILAWGWQSVPTAYALIMLAAAILFWLFSFSDPAHKAPSTVTLRQQLALMKHPAVLRYCQYYSVVFGGYVALALWMTKYYVGEYGLDLKHAALLAACFSLPGGVLRAVGGYLSDRFGPYVVTWAVMWVCWVAFFLLSYPQTEMRVATTGGPLSLHIGLNVYLFTGLLFLVGVAMAIGKASVFKFISDEFPDSIGAVSGVVGLSGGLGGFLLPILFGVLLDLTGVRSSAFMLLYGTVCVSLVWMHFSFKSAARAKARARAAEPVNPIPLTNERG

SEQ ID NO: 28376 - DNA, 1380 bp, Chromobacterium violaceum ATCC 12472
  CDS (1)..(1380): transl_table=11
atgaccgtaagcatcaagcgttgggagccggaaaacgtcattttctggctgagccgcggccgcggcatcgcccggcgcaatctgtggctgtccgtgttttccctgcacctcaacttcaacatctggatgatgtggagcatggtggtggtcaatctgccggcggtcggcttcctgatctccggccagcagcagttcctgctggtgtcgattccgcccttggtcggcgcgctgatgcgcttgatctactcgtggatctggagctgggtgggcggcggcctatggctggggctatcgacgctattgctgctgctgccggcctggggcgtaggccgggtggtgcaggacatcgcctcgccgttctggcagctgctgctggtggcgggattgtgcggcgtaggcggcggcgccagcgcgtcccacttgtccaataccagcttcttcttccccaggtccgagaagggcttggcgatggggctcaacgccggtttcggcaacctgggcgtgtcggtggcgcagctgctgatccccttgtgcatcctgtatccgctgttcggcgcttgggccggcgagccccaggtgtggggccgcggcggcgaggtgcatttcgtctggctgcagaacgccgcctacgtctggctgccattgatcgcgctgatcgccgcggcctgcctgctgtacgcgcacgacctgcccaagctgcgcatcacgccgcacgaccagctggacgcgatgcgcgaggggcacacctggtatatctgcttgctgtacatgggcagctacggcacctttctcggtttttccgccgccttcccgctgctcgcccgcgcgatgtttccccaggtggacgccagcccctatctattcgtcgggcccatggtgtgcgcgctgtcgcgtcctctgggcggctggatgggcgaccgcgtcggcggcggcgtggccaccgtggccagcaatctgctgatggcgctgggcaccgtcggcgtctacctgagcctgccgtctgcggtcagcggcggttcgttctggctgttcctggcgatgttccagctgatctttttcgccgccggcgtcggcaacggctcgtcctaccagctggcgcccaaggtcttcctgatccaggccggccgcgacgcgcagcgtcatggcgaaagcctgcagcaggcttatgccagaggaggccgacgcggcgcttcggcgatgaatgtcagttcggtgatggcggccttcggcggtttcgtgattcccaaggccttcggttcctcgctgagctggttcggcagctttctgccggcattcgggatgttcttcctgttctatctgctgtgctgcgcggtggcatggtggcagtacagccgtccgggggcggcgatgcgttgctga

SEQ ID NO: 28377 - protein, 459 aa, Chromobacterium violaceum ATCC 12472
MTVSIKRWEPENVIFWLSRGRGIARRNLWLSVFSLHLNFNIWMMWSMVVVNLPAVGFLISGQQQFLLVSIPPLVGALMRLIYSWIWSWVGGGLWLGLSTLLLLLPAWGVGRVVQDIASPFWQLLLVAGLCGVGGGASASHLSNTSFFFPRSEKGLAMGLNAGFGNLGVSVAQLLIPLCILYPLFGAWAGEPQVWGRGGEVHFVWLQNAAYVWLPLIALIAAACLLYAHDLPKLRITPHDQLDAMREGHTWYICLLYMGSYGTFLGFSAAFPLLARAMFPQVDASPYLFVGPMVCALSRPLGGWMGDRVGGGVATVASNLLMALGTVGVYLSLPSAVSGGSFWLFLAMFQLIFFAAGVGNGSSYQLAPKVFLIQAGRDAQRHGESLQQAYARGGRRGASAMNVSSVMAAFGGFVIPKAFGSSLSWFGSFLPAFGMFFLFYLLCCAVAWWQYSRPGAAMRC

SEQ ID NO: 28378 - DNA, 1332 bp, Corynebacterium diphtheriae NCTC 13129
  CDS (1)..(1332): transl_table=11
atggcaaccattaatacttctggtcgagtcctaactggctggaacccagaagatcccgaagcttgggactctaagattgcgtggcgcaccctcgtcatcactacatactcattgttcattggtttttccacgtggtacttggtatccgccattgcaccacagctcaaccaaatcggattcaatttctccaaaacgcagttgtactggctgtcttccgcatcgggcctagcagcaggcttctctcgcttagcgtttatgttcctgccacctatcgtcggtacgcgcaagctagtcaccatctcctcctttgttctcgtcctgcctatgttgggctggttctttgccatcatcaatccagcaacaccgtactggtggatgcttgttctctctgttgcaggcggcctcggcggcggtgtgttctccggctacatgccttccaccggctatttcttccccaaagcaaaggctggtacagcccttggcttacaagccggtatcggcaacttcggtgtgtccttcattcagctcgcagcaccactactgatgggtgtgtccttgctcggtgtcagtgccaagccacaattgcgcacagatggtagcgaggtatttgttcacaccccagcaatcttcatggttccatggaccatcctcgctggtgttctggcatggatgtatctgaaagatgttccagtcaaagcaaacttccgtcagcaaatggacatctttggcaacttcaacacctggatcatgacccttatctacttggccaccttcggcgcattttccggttttgctgcccaattcgcgctgttggtcaataacatctacggtgccaattcttcactggctgatacttttgctgctagtgagttgcctaagggcgctgctttcgccttcctcgggccactgatttctgctgctgtccgtgctgcatggggcccattctgtgaccgcttcggtggtgcgatctggacctttatttcctgcgccggtatggcagtctccactgctgttgctgcactcctccttaatccaaccgatccaagccagttctggtacttcctcgcagcaatgctgaccatgttcttctttactggtcttggcaacgccggcacgttcaaacaaatgccgatgattttcccccgtcgtcaagcaggtggcgttattggttggactgcagcaatcgccgccttcggcccattctttgtcggcgttattgtttccacccttggtgcaccagccttcttctggggttgcgttgtgttctttgctctgtgcgctgcactgacttggatcttctacgcacgccctcaggcaccattcccaggctaa

SEQ ID NO: 28379 - protein, 443 aa, Corynebacterium diphtheriae NCTC 13129
MATINTSGRVLTGWNPEDPEAWDSKIAWRTLVITTYSLFIGFSTWYLVSAIAPQLNQIGFNFSKTQLYWLSSASGLAAGFSRLAFMFLPPIVGTRKLVTISSFVLVLPMLGWFFAIINPATPYWWMLVLSVAGGLGGGVFSGYMPSTGYFFPKAKAGTALGLQAGIGNFGVSFIQLAAPLLMGVSLLGVSAKPQLRTDGSEVFVHTPAIFMVPWTILAGVLAWMYLKDVPVKANFRQQMDIFGNFNTWIMTLIYLATFGAFSGFAAQFALLVNNIYGANSSLADTFAASELPKGAAFAFLGPLISAAVRAAWGPFCDRFGGAIWTFISCAGMAVSTAVAALLLNPTDPSQFWYFLAAMLTMFFFTGLGNAGTFKQMPMIFPRRQAGGVIGWTAAIAAFGPFFVGVIVSTLGAPAFFWGCVVFFALCAALTWIFYARPQAPFPG

SEQ ID NO: 28380 - DNA, 1299 bp, Corynebacterium diphtheriae NCTC 13129
  CDS (1)..(1299): transl_table=11
atgagtcaccctcctatccacggcgagaatgcctcgtcgcccgagctcgaaccaaccccccagggcgccaattccgtcctcatcttctccaccgtgtcctttaccatgatgtttgccgtctggctcatgtttggcatcttgggcactcccatccaaaaggaatttggattaagcgacactcagctttcatggatcctggccgttgccatccttaacggatcaatgtggcgcctaccagcaggcatcttggccgacaagattggtggccgcaaggtaatgctgggcatcacgctcttttctgcggtagcttccctcggcgttgcgttctcacaaaactacaccatgaccctagtgctggccttcttggtgggattctgcggcaattctttcacagcaggtgcagcgtgggcatccgcttggttccctaagcacaagcagggttttgcccttggcgttttcggcgccggcaacgttggcgcctccgtcactaaattcatcggccctgtgatcattgctagcaccgcaggtgcaacatactttggctttatcccagcaggttggcgtctcatccctatcatctacagcgtcaccctagtcattgttgccatcctcatgatgatttacacccccaaggttgatcgttttggcagctctggtcgtagcttggcagagatgcttcttcctctcaagcaggtgcgagtatggcgttttagcctctactacgtcgttgttttcggtgcttatgttgctctgtctgcaactttgcccaagtactacatctctaactatgacgtaagtcttgccgctgctggtctactcacagcaatcttcatcttcccggcatccctgctgcgtccagtcggtggttggttctccgatcgctacggtgctcgccgcgctatgtatggcactttctttgttatgggtaccgcagcaggcctactctgccttcccagtaacatcatcaacatcttcgtctttacccttttgattttctcccttggctgcgccatgggcgtgggcaaagccgcagtatataagcacatcccagaatacttcccgcatgacgttggagccgttggcggcctggtgggcatgttgggcggcttgggcggtttcttcctcccaccactatttgcttacaccaaggcgtggactggatggagcaccagcccattcatcgtgttgctcatcttggtagcggtgtctgcactgtggatgcacgtaacggttcaccgcatgttacacagccatgttcccgagctgaaacaccacatggaggtgccagccactcaataa

SEQ ID NO: 28381 - protein, 432 aa, Corynebacterium diphtheriae NCTC 13129
MSHPPIHGENASSPELEPTPQGANSVLIFSTVSFTMMFAVWLMFGILGTPIQKEFGLSDTQLSWILAVAILNGSMWRLPAGILADKIGGRKVMLGITLFSAVASLGVAFSQNYTMTLVLAFLVGFCGNSFTAGAAWASAWFPKHKQGFALGVFGAGNVGASVTKFIGPVIIASTAGATYFGFIPAGWRLIPIIYSVTLVIVAILMMIYTPKVDRFGSSGRSLAEMLLPLKQVRVWRFSLYYVVVFGAYVALSATLPKYYISNYDVSLAAAGLLTAIFIFPASLLRPVGGWFSDRYGARRAMYGTFFVMGTAAGLLCLPSNIINIFVFTLLIFSLGCAMGVGKAAVYKHIPEYFPHDVGAVGGLVGMLGGLGGFFLPPLFAYTKAWTGWSTSPFIVLLILVAVSALWMHVTVHRMLHSHVPELKHHMEVPATQ

SEQ ID NO: 28382 - DNA, 1281 bp, Cupriavidus necator
  CDS (1)..(1281): transl_table=11
atggccaccccacatcccgcgcgggcgccgatcccgcccggtgcctatacgacgctggcatccagcactttcgccttcaccatctgctttgccgtctggatgctgttcgcggtgctcggcattccgctcaagaaggaactcggcctgaacgacaccgagttcgggctgctggcggcaacgccagtcctgagcggctcgctgatccgcgtgccgctaggcctctggaccgaccgctacggcggccgcatcgtcttcttcgtgctgatgctggccaccgtgatcccgatctggctgatctcgtacgcgcacagcctgtggcaactgctggtgctgggcctgttcgtcggcctggccggcggctcattctcggtgggcacgccgtatgtggcgcgctggttcccgcgctcgcgccagggcctggcgatgggcatcttcggcgccggcaactcgggcgcggcgctgaccaagttcgtcgcgccggcgatgatcctggccgccggcacttgggaaatcgtgccgcgcgtctattcgctggcgatgctcgccaccgcgctggtgttctgggtgttctcgcgcagcaaccccgcgcacctggtcaagtccagcaccggctggcgcgagcagctttccatgctgcgcgacccgcgcgtgtggcgctactcgcagtactactcggtggtgttcggcggctacgtgggcctgtcgctgtggatgaccaagtactacatcggcgaatacggtttcgacatcaagaccgccgccttcctggccgcctgcttctcgctgcccggcggcgcgctgcgtgccatcggcggctggatctccgaccgctacggcgcgcaccgcaccacctggtgggtgatgtgggtgagctgggtcggcttcttcctgctgagctatccgcagacggacttcatcgtccagaccaccagcggtccgcaggggttccgcatcgcgctgacgcccacggtgttcaccttgctgctgttcgtggtcggcatcgccttcgccatcggcaaggcctcggtgttcaagttcatctccaacgacttcaaccacaacatcggcgcggtttccggcgtggtgggcctggctggcgggctgggtggctttgtcctgcccattctgttcggcatgctggccgacctcaccggcatccgcagcagctgcttcatgctgatgtacggcaccgtgtgcgtgagcctggtgtggatgcactacagccaccgcaccgaacgccagcgcaaggaacaggcagtgggcctgacccagccggcctga

SEQ ID NO: 28383 - protein, 426 aa, Cupriavidus necator
MATPHPARAPIPPGAYTTLASSTFAFTICFAVWMLFAVLGIPLKKELGLNDTEFGLLAATPVLSGSLIRVPLGLWTDRYGGRIVFFVLMLATVIPIWLISYAHSLWQLLVLGLFVGLAGGSFSVGTPYVARWFPRSRQGLAMGIFGAGNSGAALTKFVAPAMILAAGTWEIVPRVYSLAMLATALVFWVFSRSNPAHLVKSSTGWREQLSMLRDPRVWRYSQYYSVVFGGYVGLSLWMTKYYIGEYGFDIKTAAFLAACFSLPGGALRAIGGWISDRYGAHRTTWWVMWVSWVGFFLLSYPQTDFIVQTTSGPQGFRIALTPTVFTLLLFVVGIAFAIGKASVFKFISNDFNHNIGAVSGVVGLAGGLGGFVLPILFGMLADLTGIRSSCFMLMYGTVCVSLVWMHYSHRTERQRKEQAVGLTQPA

SEQ ID NO: 28384 - DNA, 1395 bp, Cupriavidus necator
  CDS (1)..(1395): transl_table=11
atgtctacctccgtactcacccgctgggagcccgagaacgcggccttctggcaaagcaaaggcgaacgcatcgcctatcgcaacctcgggatctcgattccggcgctgatgctggctttcgtggtctggatgctgtggagcgtggtcgcggtcaacctcgaccgcgccggcttccagttcaccaagaaccagctgttctggctgaccgcgctgccggcgctgtccggcgccacgctgcgcatcttctattccttcctggtgccggtgttcggcgggcgccgcttcaccgcgatctccaccgcgctgctgctaatcccggcgctgggcatgggctttgcgctgcgcgacccgtccaccggctacccgacgctgctggtgctggcgctgctgtgcgggctgggcggggccaacttcagctcatcgatggccaatatcagcttcttcttccccaaggcgaagaaggggctggccaccgggctcaacgcgggcatcggcaacctgggggtgtcggtggtgcagttcgtcacgccgctggtagtgtcggtggccatcttcggcgcgcttggcggcgagccgcagcaattcccggccaacgaggccaacggcaccacgcagagtctgtggctgcagaacgccggcttcatctgggtgccgttcatcgtggtatcggcgctggcggcgtggttcggcatgcacgatatcgccgatgccaaggcatcgttcgccgaacaggccgtgatcttcaagcgcaagcacaactggctgatgtgctggctgtacgtgggcaccttcggttcgttcatcggcttctcggccgggctggcactgctgaccaagtcgcagttcccgggcgtgaacccgaccgcctatgccttcctcgggccgctggtgggcgcgctcacgcgcccggtgggcggctggatctcggacaagctcggcggcgcacgcgtcacgctgtggaccttcgccggcatgatcgccgcggtgttcgcggtgctggcagcgctgccgcatgacggcgccggcggcaacttcatgtacttcctggcggccttcgtcgcgttgttcgcgctgaccggcatcggcaacggctcgaccttccgcatgatcccggtgatcttcctgaccgagcgccagcgcgctgccgccggcaagggcgacgtggcgcagaagcaggccctgcaggaagccggcaaggaatccgccgccgtgctgggcttctccggtgcgatcggcgcctacggcggcttctttatccccaagagcttcggcacctcgctggagctgaccggcgccgccgacgccgcgctgtattgctttatcgccttctacctcagctgcgtgctggtgacgtggtggcactacgcgcgccgcaacgcgcccatgccttgctaa

SEQ ID NO: 28385 - protein, 464 aa, Cupriavidus necator
MSTSVLTRWEPENAAFWQSKGERIAYRNLGISIPALMLAFVVWMLWSVVAVNLDRAGFQFTKNQLFWLTALPALSGATLRIFYSFLVPVFGGRRFTAISTALLLIPALGMGFALRDPSTGYPTLLVLALLCGLGGANFSSSMANISFFFPKAKKGLATGLNAGIGNLGVSVVQFVTPLVVSVAIFGALGGEPQQFPANEANGTTQSLWLQNAGFIWVPFIVVSALAAWFGMHDIADAKASFAEQAVIFKRKHNWLMCWLYVGTFGSFIGFSAGLALLTKSQFPGVNPTAYAFLGPLVGALTRPVGGWISDKLGGARVTLWTFAGMIAAVFAVLAALPHDGAGGNFMYFLAAFVALFALTGIGNGSTFRMIPVIFLTERQRAAAGKGDVAQKQALQEAGKESAAVLGFSGAIGAYGGFFIPKSFGTSLELTGAADAALYCFIAFYLSCVLVTWWHYARRNAPMPC

SEQ ID NO: 28386 - DNA, 1458 bp, Mycobacterium avium subsp. paratuberculosis K-10
  CDS (1)..(1458): transl_table=11
atggcacggacgcgacgcatcgcgcattgggatcccgaggatctggtggcctgggaagcgggcaacaagctcatcgcccggcgcaacctgatctggtcgatcgccaccatgcacgtcgccttttccatctggtacctgtggtcggtgatggtgctgttcatgccgcaggcccgctacggtttcacgaccggcgacaagctgctggtgggcgccaccgcggcactggtcggggcgctggtgcgcatcccgtacgccatgggcaccgcgcggctgggcggtcgcaactgggccgtgctgtcgtcgctggtgctgctgatccccacgctcgcggccatcgtgctgctggcacacccagggttgccgttgtggccgtatctggtgtgcgcggcgctgaccggcttgggcggcgggaactacgcggccgcgctggccaacgtcgaatcgtttttcccgcagcggcgcaaggggttcgcgctgggtctcaccggaggcgtcggcaatctcggcgcggccggcatccaggcggtcgggctggtggtgctggccaccgccggtaaccaggcgccgtactgggtgtgcgccgtctatctggtgctgctggcgctcgtcggggtgggcgccgcgctgttcatggacaacctggaccattccgtcgaggtcggtcacgtgcgctcggtgctgacggtgcccgacacctggacgatttcgttcctgtacatgtgcgcgtcgggctcgttcatcggattcgcgttcgccttcggccaggtgatagcccacaacctgatcgccggcgggcagacgcacgggcaggccgcgctgcacgccgccgagatcgccttcgccgggccgctgctcggatcgatggcgcgggtggtcggcggcaagctgggggaccgcttcgacggcggccgggtcaccctgaccgtgctggccgccatgatcgtcgccggcggcttcctggtcgcggtgagcacgcacgacgacctgacccgcccgtccggcgcgccggtgtcgctgtacacgaccgccggctacatcgccggcttcatcgcgttgttcatctgctgcggcgtcggcaagggatcggtgttcaagctgatcccgtcggtcttcgcacagcgcagccgggcgttggagctcggcgacaccgaacgacgccactgggaacgggcccggtcggcggcgctgatcggcttcgccggctcgttcggcgcgctgggcggcgtggtgatcaacctggcgctgcgccagtcctatgccagcaccggcagctcgacgccggcgttcggggcgttcatgctgtgctacgtcgcggcggcggccctgacctgggccagatatgtgcgcccacgccgggcccgagccgcgcatcgcgccggactggcagccgatggccgagcagccggtcagctcgtgagggcctccgacaggttctccgggtgcagcatctcggcgtag

SEQ ID NO: 28387 - protein, 485 aa, Mycobacterium avium subsp. paratuberculosis K-10
MARTRRIAHWDPEDLVAWEAGNKLIARRNLIWSIATMHVAFSIWYLWSVMVLFMPQARYGFTTGDKLLVGATAALVGALVRIPYAMGTARLGGRNWAVLSSLVLLIPTLAAIVLLAHPGLPLWPYLVCAALTGLGGGNYAAALANVESFFPQRRKGFALGLTGGVGNLGAAGIQAVGLVVLATAGNQAPYWVCAVYLVLLALVGVGAALFMDNLDHSVEVGHVRSVLTVPDTWTISFLYMCASGSFIGFAFAFGQVIAHNLIAGGQTHGQAALHAAEIAFAGPLLGSMARVVGGKLGDRFDGGRVTLTVLAAMIVAGGFLVAVSTHDDLTRPSGAPVSLYTTAGYIAGFIALFICCGVGKGSVFKLIPSVFAQRSRALELGDTERRHWERARSAALIGFAGSFGALGGVVINLALRQSYASTGSSTPAFGAFMLCYVAAAALTWARYVRPRRARAAHRAGLAADGRAAGQLVRASDRFSGCSISA

SEQ ID NO: 28388 - DNA, 1392 bp, Mycobacterium avium subsp. paratuberculosis K-10
  CDS (1)..(1392): transl_table=11
atgggccgcgaccaccgcatcacggactggaatccggaagacgcagcggcctgggaggccggcaacaaaaggatcgcccgtcgcaacctgctgtgcaccatcgccggtgaccacgtggcgttttcgatctggaccctgtggccggtgatggcgctgttcatgcccgcggccgtgtacggcttctccgccggcgacaagctgctgctgggcgcggtggccaccctggtcggtggctgcgcccggatcccctacaccctgggcatcgcggccttcggcggccgcaaatggacgactttctcggcggtcgtattgctgatccccaccgtcggcaccatcgtcttgctggccaatcccggtctgccgctgtggcttttcgtgctgtgcgccgccctgaccgggctgggcggcggcaactatgcggcgtctctggccaacgtcaacgcgttctatccgcagcggctcaagggcgcggccatggccgtcaacgccggcgtcgccaacctgggggtggcggtgatccagctggtcggcctgctggtgctggccaccgccggacaccaggccccgtactgggtgtgcgcggtgtatctggtgttcctggccgcggtggccatcgccgccgcgatgttcatggacgacatcaaccacggcacccagctgagcaccatgcgctcgatcttgttcgaacgcgacacccatgtgatctcgctgctctacatcgccaccttcggctcctggatcggcttctcgttcgccttcgggcaggtgatgcaggtcaacttcctggagaacggggaaagcgccaagcatgccgcgctgcacgccgcccagctggccttcatcggcccgctgctgggctcggtggcgcggatctacggcggccggctggccgaccgtgtcggcggcagccgcgtcacgctgggcgtgctggccgcgatgaccctggcggccggcctgctggtgatcgtcagcaccgtcgacgaccagcacgcgggcgcgcattcggtcagcatgatcggctacgtcgtcggcttcatggtgctgttcatcctgtccggcatgggcaacggctcggtgttcaagctgatcccgtcggtctacgaggcccgcagccgcggccgggacaccagcgaggacgagcgccgccaatgggcgcgcgccatgtcggggtcgctgatcggcatctgctcggcggtcggggcgttcggcggggtggcgatcaacttggcgctgcaccagtcctacctgagcaccggaaccgagacgtcggcgtactggatgttcatggcgtcctacgtcgtcgccgccatcatgacctggctggtgtacgtgcggcggccggtcgccgcgcccggggtctcgctgccggaaacccaggccgcgcggctgtga

SEQ ID NO: 28389 - protein, 463 aa, Mycobacterium avium subsp. paratuberculosis K-10
MGRDHRITDWNPEDAAAWEAGNKRIARRNLLCTIAGDHVAFSIWTLWPVMALFMPAAVYGFSAGDKLLLGAVATLVGGCARIPYTLGIAAFGGRKWTTFSAVVLLIPTVGTIVLLANPGLPLWLFVLCAALTGLGGGNYAASLANVNAFYPQRLKGAAMAVNAGVANLGVAVIQLVGLLVLATAGHQAPYWVCAVYLVFLAAVAIAAAMFMDDINHGTQLSTMRSILFERDTHVISLLYIATFGSWIGFSFAFGQVMQVNFLENGESAKHAALHAAQLAFIGPLLGSVARIYGGRLADRVGGSRVTLGVLAAMTLAAGLLVIVSTVDDQHAGAHSVSMIGYVVGFMVLFILSGMGNGSVFKLIPSVYEARSRGRDTSEDERRQWARAMSGSLIGICSAVGAFGGVAINLALHQSYLSTGTETSAYWMFMASYVVAAIMTWLVYVRRPVAAPGVSLPETQAARL

SEQ ID NO: 28390 - DNA, 1392 bp, Mycobacterium avium subsp. paratuberculosis K-10
  CDS (1)..(1392): transl_table=11
atgaccacgaccatcaccccggtaccgcagcccgcggcggcgcccgagcggcacaaggggcggcactggatcgacgactggcggcccgaagaccccgaattctgggagacgacgggcaaggcgatcgcccgccgcaacctgatcttctcgatcttcgccgaacacgtcgggttcagcgtgtggatgctgtggagcatcgtggtggtgcacatgacggccggaccgcacgggcacccgtcggcgtccgggtgggcgctgaccgccagccaggcgctgtgcctggtcgccgtgcccagcggggtcggcgccttcctgcggctgccctacacgttcgccgtcccggtgttcggcggccgcaactggacgaccatctcggcagccttgctgctgatcccgtgcctgctgctggcgtgggcggtgagccatcccggcatcccgttcggggtgctggtggcgatcgccgcgaccgccgggttcggcggcggcaacttcgcctcgtcgatggccaacatctccttcttctacccggagaaggacaagggctgggcgctggggctcaacgcggccggcggcaacatcggcgtggcgatggtgcagaaggtcatcccgcccgtcgtgatcgcgggcggcggcgtggcgctgtcccgggccgggctgttctacgtgccgctggcggtcgtggctgcggtgtgcgcgttcctgttcatgaacaacctgaccgagatcaaggccgacgtgaagccggtgtggcagtcgctgcgccacgccgacacctggatcatgtcgctgctctacatcggcaccttcggatccttcatcggctactcggccgccttcccgaccctgctcaaaacggtgttcgggcgcggcgacatcgcgctggcgtgggcgtttctgggcgccgccatcgggtcggtgatccggccgctgggcggcaagctggccgaccgggtcggcggggcgcggatcaccgcggccagctttgtgatgctggccgtcggcgcggcggccgcgctgtggtcggtgaaggcggtgaacctgccggccttcttcgccagcttcatgttcctgttcgttgcgaccggcatcggcaacggttcgacctaccggatgatctcgcggatcttcaagatcaagggcgagctggccgggggcgatcccgacaccatggtgacgatgcgccgccaggccgccggcgcgctgggcgtcatctcggcggtgggcgccttcggcgggttcatcgtgccgctggcctacgcctggtcgaagtcgcagttcggcagcatcgaacccgcgctgcgcttctatgtggtgttcttcctgggcttgctggccgtcacctggtactgctacctgcgcaagcacaacgcgatcacccgggtcggcatctag

SEQ ID NO: 28391 - protein, 463 aa, Mycobacterium avium subsp. paratuberculosis K-10
MTTTITPVPQPAAAPERHKGRHWIDDWRPEDPEFWETTGKAIARRNLIFSIFAEHVGFSVWMLWSIVVVHMTAGPHGHPSASGWALTASQALCLVAVPSGVGAFLRLPYTFAVPVFGGRNWTTISAALLLIPCLLLAWAVSHPGIPFGVLVAIAATAGFGGGNFASSMANISFFYPEKDKGWALGLNAAGGNIGVAMVQKVIPPVVIAGGGVALSRAGLFYVPLAVVAAVCAFLFMNNLTEIKADVKPVWQSLRHADTWIMSLLYIGTFGSFIGYSAAFPTLLKTVFGRGDIALAWAFLGAAIGSVIRPLGGKLADRVGGARITAASFVMLAVGAAAALWSVKAVNLPAFFASFMFLFVATGIGNGSTYRMISRIFKIKGELAGGDPDTMVTMRRQAAGALGVISAVGAFGGFIVPLAYAWSKSQFGSIEPALRFYVVFFLGLLAVTWYCYLRKHNAITRVGI

SEQ ID NO: 28392 - DNA, 1170 bp, Bacillus anthracis str. Sterne
  CDS (1)..(1170): transl_table=11
atgaaaagtcctaattttcaattaagtttacaaacttctaatctaattatcggttttatggtgtgggttattttatcatcattaatgccctatattaaagtggatatcccattaactgcgggacaaatttctatggtaacagcagtacccgttattttagggtctgttcttcgtattccaattggttattggacaaatcgtttcggagcaagaaaattattctttattagttttattctattattatttcctgttttttatattagtgttgccaattctatgatggatttaattattggtggattatttgtaggaatcggtggtgctgtattctctgtaggagtaacttctttaccaaaatactttccaaaagagagtcacggttttgtaaatggtatttacggtgtcggtaacgctggaacagcaattacttcatttttagcgcctgttatcgcaacttcagttggctggagaacgacagtacagtgttatttagttttacttgcagcgtttgcacttatgaactttttattaggtgatcgtaaagagaaaaaagtgaatacaccactaatggaacaaataaaaggtgtatataaaaatgagaaactttggtttttatgtatcttttactttttaactttcggatcatttgttgcatttaccgtatacttaccaaactttttagtatctcatttcggattagagaaagtagatgcaggtatgcggacagccggattcatcgtactcgcaacaattatgcgtccgattggtggttggctcggtgataaatttaacccatttaaaatattaatcttcgtatttatcggtttaacactttcaggtattattttatcatttatgccaagcatgaacgtatatacattcggttgcctattagtcgcattttgtgcaggtatcggtaatggtacaattttcaaactcgttccgatgtatttctcagaacaagctggtattgtaaatggactcgtttcagctttaggcggacttggaggattcttcccgccactaattttaacattactgttccaactaacaggtcattatgcaattggatttatggcgttatcagaagtcgcacttgcttgtttaatcattacagtatggatgtatagtcaagaaaagctgttagtgatgttaaagaatcattaa

SEQ ID NO: 28393 - protein, 389 aa, Bacillus anthracis str. Sterne
MKSPNFQLSLQTSNLIIGFMVWVILSSLMPYIKVDIPLTAGQISMVTAVPVILGSVLRIPIGYWTNRFGARKLFFISFILLLFPVFYISVANSMMDLIIGGLFVGIGGAVFSVGVTSLPKYFPKESHGFVNGIYGVGNAGTAITSFLAPVIATSVGWRTTVQCYLVLLAAFALMNFLLGDRKEKKVNTPLMEQIKGVYKNEKLWFLCIFYFLTFGSFVAFTVYLPNFLVSHFGLEKVDAGMRTAGFIVLATIMRPIGGWLGDKFNPFKILIFVFIGLTLSGIILSFMPSMNVYTFGCLLVAFCAGIGNGTIFKLVPMYFSEQAGIVNGLVSALGGLGGFFPPLILTLLFQLTGHYAIGFMALSEVALACLIITVWMYSQEKLLVMLKNH

SEQ ID NO: 28394 - DNA, 1170 bp, Bacillus thuringiensis serovar konkukian str. 97-27
  CDS (1)..(1170): transl_table=11
atgaaaagtcctaattttcaattaagtttacaaacttctaatctaattatcggttttatggtgtgggttattttatcatcattaatgccctatattaaagtggatatcccattaactgcgggacaaatttctatggtaacagcagtacccgttattttaggttctgttcttcgcattccaattggttattggacaaatcgtttcggagcaagaaaattattctttattagttttattctattattatttcctgttttttatattagtgttgccaattctatggtggatttaattattggtggattatttgtaggaatcggtggtgctgtattctctgtaggagtaacttctttaccaaaatactttccaaaagagagtcacggttttgtaaatggtatttacggtgtcggtaacgctggaacagcaattacttcatttttagcgcctgttatagcaacttcagttggctggagaacgacagtacaatgttatttagttttacttgcagcgtttgcacttatgaactttttattaggtgatcgtaaagagaaaaaagtgaatacaccactaatggaacaaataaaaggtgtatataaaaatgagaaactttggtttttatgtatcttttactttttaactttcggatcatttgttgcatttacagtatatttaccaaactttttagtatctcatttcggattagagaaagtagatgcaggtatgcgaacagccggattcatcgtactcgcaacaattatgcgtccgattggtggttggctcggtgataagtttaatccatttaaaatattaatcttcgtatttatcggtttaacactttcaggtattattttatcatttatgccaagcatgaacgtatatacatttggttgcctattagtcgcattttgtgcaggtatcggtaatggtacaattttcaaactcgttccgatgtatttctcagaacaagctggtattgtaaatgggctcgtttcagctttaggcggacttggaggattcttcccgccattaattttaacattactgttccaactaacaggtcattatgcaattggatttatggcgttatcagaagtcgcacttgcttgtttaatcattacagtatggatgtatagtcaagaaaagctgttagtgatgttaaagaatcattaa

SEQ ID NO: 28395 - protein, 389 aa, Bacillus thuringiensis serovar konkukian str. 97-27
MKSPNFQLSLQTSNLIIGFMVWVILSSLMPYIKVDIPLTAGQISMVTAVPVILGSVLRIPIGYWTNRFGARKLFFISFILLLFPVFYISVANSMVDLIIGGLFVGIGGAVFSVGVTSLPKYFPKESHGFVNGIYGVGNAGTAITSFLAPVIATSVGWRTTVQCYLVLLAAFALMNFLLGDRKEKKVNTPLMEQIKGVYKNEKLWFLCIFYFLTFGSFVAFTVYLPNFLVSHFGLEKVDAGMRTAGFIVLATIMRPIGGWLGDKFNPFKILIFVFIGLTLSGIILSFMPSMNVYTFGCLLVAFCAGIGNGTIFKLVPMYFSEQAGIVNGLVSALGGLGGFFPPLILTLLFQLTGHYAIGFMALSEVALACLIITVWMYSQEKLLVMLKNH

SEQ ID NO: 28396 - DNA, 1170 bp, Staphylococcus aureus subsp. aureus MRSA252
  CDS (1)..(1170): transl_table=11
atgtacaaaacaaaaggtggctttcaacttacattacaaacattaagtttagtggttggatttatggcttggagtattattgctcctttaatgccttttattaaacaggatgtcaatgtaactgaaggtcaaatatcaatcattttagcgataccagttattttgggatcagtgctccgtgtgccatttggttatttaacaaatattgttggtgctaaatgggtattctttacaagttttatcgtattgttattcccgatatttttcttgggccaagcacaaacgccggggatgttaatggcatcaggatttttccttggcgtaggtggcgcaattttctctgttggtgttacatcagttcctaaatatttccctaaagaaaaagtaggtctagcaaatggtatttatggtatggggaatatcggtacagcagtttcttcatttttagcaccaccgatagcgggtattattggttggcaaacaacagttagaagttacttaattattatcgctttatttgcattaattatgttcatttttggtgacacacaagaacgtaaaattaaagtgccattaatggcccaaatgaaaacattatctaaaaactacaaattatattacttaagttattggtatttcattacttttggtgcttttgttgcatttggtattttcttacctaactacttagtaaatcattttggaattgacaaagtagatgctggtattcgttcaggtgtattcattgcgctggcaacattcttgagaccaataggtggtatactaggtgataaatttaatgcagttaaagtactgatgattgattttgttattatgattatcggtgccgttattttaggtatttcagaccatatcgcattatttactgtaggttgtttaacaataagtatttgtgcaggtattggtaacggcttaatttttaaattagtaccatcatacttctcaaatgaagcaggatcagcaaatggtatcgtatcaatgatgggtggtttaggaggattcttcccaccgttggtcatcacatacgtagctaatttaacaggttcaagccatttagcatttattttcttagcggtattcggatgcattgcattatttacaatgcgccatttatatcaaaaagaatatggttcattgaaacacagttga

SEQ ID NO: 28397 - protein, 389 aa, Staphylococcus aureus subsp. aureus MRSA252
MYKTKGGFQLTLQTLSLVVGFMAWSIIAPLMPFIKQDVNVTEGQISIILAIPVILGSVLRVPFGYLTNIVGAKWVFFTSFIVLLFPIFFLGQAQTPGMLMASGFFLGVGGAIFSVGVTSVPKYFPKEKVGLANGIYGMGNIGTAVSSFLAPPIAGIIGWQTTVRSYLIIIALFALIMFIFGDTQERKIKVPLMAQMKTLSKNYKLYYLSYWYFITFGAFVAFGIFLPNYLVNHFGIDKVDAGIRSGVFIALATFLRPIGGILGDKFNAVKVLMIDFVIMIIGAVILGISDHIALFTVGCLTISICAGIGNGLIFKLVPSYFSNEAGSANGIVSMMGGLGGFFPPLVITYVANLTGSSHLAFIFLAVFGCIALFTMRHLYQKEYGSLKHS

SEQ ID NO: 28398 - DNA, 1170 bp, Staphylococcus aureus subsp. aureus MSSA476
  CDS (1)..(1170): transl_table=11
atgtacaaaacaaaaggtggctttcaacttacattacagacattaagtttagtggttgggtttatggcttggagtataattgcgccattaatgccctttattaaacaagatgtcaatgttactgaaggtcaaatatcaatcattttagcgataccagttattttgggatcggtgctccgtgtgccatttggttatctaacaaacattgttggcgctaaatgggtattctttactagttttatcgtattgttattcccgatatttttcttaagccaagcacaaacaccgggtatgttaatggcgtcaggatttttccttggtgtaggtggtgcaattttctcagttggtgttacatcagttcctaaatatttccctaaagaaaaagtaggtctagcaaatggtatttatggtatgggaaatatcggtacagcagtttcttcatttttagcaccgccaattgcgggtattattggttggcaaacaactgttagaagttacttaattattatcgctttatttgcattaattatgtttatatttggtgatacacaagaacgtaaaattaaagtgccattaatggcacaaatgaaaacattatctaaaaactacaaattatattacttaagttattggtatttcattacttttggtgcttttgtagcatttggtattttcttacctaactacttagtaaatcattttggaattgacaaagtagatgctggtattcgatcaggtgtattcattgcgctggcaacattcttaagaccaataggtggcattttaggtgataaatttaatgcagttaaagtattgatgattgattttgttgttatgattatcggtgccattattttaggtatttcagaccatatcgcattattcactgtaggctgtttaacaataagtatttgtgcaggtattggtaacggcttaatcttcaaattagtaccatcctacttcttaaatgaagcgggatccgcaaatggtatcgtatcaatgatgggtggtttaggaggattcttcccaccactagtaatcacgtacgtagctaatttaacaggatcaagtcatttagcatttattttcttagcggtatttggatgtattgcattatttaccatgcgtcatttataccaaaaagaatatggctcattgaaaaacggttga

SEQ ID NO: 28399 - protein, 389 aa, Staphylococcus aureus subsp. aureus MSSA476
MYKTKGGFQLTLQTLSLVVGFMAWSIIAPLMPFIKQDVNVTEGQISIILAIPVILGSVLRVPFGYLTNIVGAKWVFFTSFIVLLFPIFFLSQAQTPGMLMASGFFLGVGGAIFSVGVTSVPKYFPKEKVGLANGIYGMGNIGTAVSSFLAPPIAGIIGWQTTVRSYLIIIALFALIMFIFGDTQERKIKVPLMAQMKTLSKNYKLYYLSYWYFITFGAFVAFGIFLPNYLVNHFGIDKVDAGIRSGVFIALATFLRPIGGILGDKFNAVKVLMIDFVVMIIGAIILGISDHIALFTVGCLTISICAGIGNGLIFKLVPSYFLNEAGSANGIVSMMGGLGGFFPPLVITYVANLTGSSHLAFIFLAVFGCIALFTMRHLYQKEYGSLKNG

SEQ ID NO: 28400 - DNA, 1389 bp, Erwinia carotovora subsp. atroseptica SCRI1043
  CDS (1)..(1389): transl_table=11
atgacgcagccttcatcacccgaaaaagtatcgcaaagcacgctcctaagggaatgggatcctgaagatactaaattctggcaatctggcggacaacggatagcacagcgtaatctttggatctctgtaccgtgcctgctgttatcgttttgtgtctggatgattttcagcaccgtggccgttaacctaaacaaggtcggatttagttttaccacagaccagctatttttgcttaccgcgctgccttccgtttccggcgcgctgttacgtgtgccttactcctttgttattccaatcgttggtggttgccgttggacgacattaagcaccattattctggttatcccatgtatttggctcgggtttgtcgtacagaacccacaaacgccttaccgcgttttcgtcacgatttctctgctgtgtggttttgccggtgctaacttcgcatccagcatggctaacatcagtttcttcttccccaaatcacgtcagggcagtgcgttaggtattaacggtgggttgggtaatctcggtgtgagcgtaatgcagttgctggtgccggtggtgattttcctgccgattctgggattctccggcaatggcgttgtgcaacctgatggccaccagatttggctgcatcatgccgcgtggatgtgggtaccgtttttggtgattgccgcaaccgctgcttggtttggcatgaacgatctttcgacggccaatgcgtctatacgcaaacagctgccagtgttgaagcaaatgcacctgtgggtgctcagcttcctgtatctgtccacctttggttcatttatcggtttttcagcaggcttcgggatgctgtccagaacgcagttcccagacatcgtgattctgtactacgcattcttcgggccgctgctaggggcgttggcgcgtccggttggcggaatgctgtccgatcgctttggcggtgtgaaagtcacgttgattaacttcatcctgatggcgattttctcggtgttgttattcttgtctctgccgagtgcgagctctgctggttcattcggaatgttctttggcatcttcatgatgctgttcctgacggctggtttgggtagtggatcaacgttccagatgattgccgtcattttccgtaaattaacggcggatcgcgttaaatcggaaggcgggaaagatgctgacgcgcagcgtgcggcagtcacggataccgcagcggcgttgggctttatttcggccattggcgctatcggcggtttcttcattcctcaagcctttgggatgtcgcttgagttaacgggttcacccaccggtgcgatgaaagtgtttgtggtgtgctacgtggtgtgtgtactggtgacgtggttgttttatgccagaaagaaaaattag

SEQ ID NO: 28401 - protein, 462 aa, Erwinia carotovora subsp. atroseptica SCRI1043
MTQPSSPEKVSQSTLLREWDPEDTKFWQSGGQRIAQRNLWISVPCLLLSFCVWMIFSTVAVNLNKVGFSFTTDQLFLLTALPSVSGALLRVPYSFVIPIVGGCRWTTLSTIILVIPCIWLGFVVQNPQTPYRVFVTISLLCGFAGANFASSMANISFFFPKSRQGSALGINGGLGNLGVSVMQLLVPVVIFLPILGFSGNGVVQPDGHQIWLHHAAWMWVPFLVIAATAAWFGMNDLSTANASIRKQLPVLKQMHLWVLSFLYLSTFGSFIGFSAGFGMLSRTQFPDIVILYYAFFGPLLGALARPVGGMLSDRFGGVKVTLINFILMAIFSVLLFLSLPSASSAGSFGMFFGIFMMLFLTAGLGSGSTFQMIAVIFRKLTADRVKSEGGKDADAQRAAVTDTAAALGFISAIGAIGGFFIPQAFGMSLELTGSPTGAMKVFVVCYVVCVLVTWLFYARKKN

SEQ ID NO: 28402 - DNA, 1317 bp, Propionibacterium acnes KPA171202
  CDS (1)..(1317): transl_table=11
gtgagcacaagcccttcccaccatctcatcgagaactgggatcccgaggaaaactgggattccggtatcgcatggcgaactttgaccatttcgacgttctccatgatcatcgcattttgcgtatggttcttggtgagtgcgattgcacccaaactcaacgccatcggattccacctgacgaagtcacagctgtactggctcaccgccatgccagggctctcgggaggattcatccgcctggtctacatgttcctaccgccggtgatcggcactcgcaggctcgtgggatacagctccctgctctacctcatccctatgctgggctggtttttcgccgtccagaacacgtcgaccgggtacggcacccttctcctcctcgccttcctatgcggcgttgggggcggttctttctccggttacatgccatcaacgggctacttcttccctaaaagcaagcagggcaccgctttgggagtacaggctggcatcggcaacctggggatgtccatcgttcagttgctcggcccatggctcatgggcttcgggctcctcggcctcacgtggatcgccccgcagcacaccgccgggagccccttgtgggtgcacaatatcgccatcgtcttcgtcccgtggaccatcctggccacgattttggcatttaccatgctcaaagacgttccggtaaaggcgaacttccgtcggcagatcgacatcttcaccaaccccgacacttggatcatgacgctcatgtacgtcatgacgttcggcctgttcagcggcttcagcgcccagttcgggctactcatcgagaatacgtatggcaactcgagcaacttggcccacggattttctaacttgcccgccggcgcctcctacgccttcctcggcccactgatcggctcgttggtgcgtgtcgtctgggggccgctctgcgaccgattcggtggggcgatctggacccttgtctcaggaatcgggatggcactgacgttcgggttctgcgccttcttcctcaaccccacaagtccaagccagttcggctacttcctgtggggaatgctcaccatgttcttcttctccggtatcggcaacgccgggacgttcaagcagatgcccatgatcatgcctgccagacaagccggtggagccatcgggttcaccgccgccatcggctgtttcggcccattcgtcgtcggtgtcgccctgtcatcgatgtcagccgttgcctggttctggatctgcaccgtcttctgcattgtgtgctcgatcatctgctggatccgttatgcccgcccaggtgctccatgccctggctga

SEQ ID NO: 28403 - protein, 438 aa, Propionibacterium acnes KPA171202
MSTSPSHHLIENWDPEENWDSGIAWRTLTISTFSMIIAFCVWFLVSAIAPKLNAIGFHLTKSQLYWLTAMPGLSGGFIRLVYMFLPPVIGTRRLVGYSSLLYLIPMLGWFFAVQNTSTGYGTLLLLAFLCGVGGGSFSGYMPSTGYFFPKSKQGTALGVQAGIGNLGMSIVQLLGPWLMGFGLLGLTWIAPQHTAGSPLWVHNIAIVFVPWTILATILAFTMLKDVPVKANFRRQIDIFTNPDTWIMTLMYVMTFGLFSGFSAQFGLLIENTYGNSSNLAHGFSNLPAGASYAFLGPLIGSLVRVVWGPLCDRFGGAIWTLVSGIGMALTFGFCAFFLNPTSPSQFGYFLWGMLTMFFFSGIGNAGTFKQMPMIMPARQAGGAIGFTAAIGCFGPFVVGVALSSMSAVAWFWICTVFCIVCSIICWIRYARPGAPCPG

SEQ ID NO: 28404 - DNA, 1206 bp, Bacillus licheniformis ATCC 14580
  CDS (1)..(1206): transl_table=11
ttgaaattggcggatttgaggaagagcggacacgcgccttccttgttgtcatcttttttatatttcgatgtcagctttatgatttgggtgttgctgggggcgcttggtgtttatgttacggctgattttgatttatcgccttcacaggtcggattgattgtcgccatacctactttggccggatcgtttttccggattgcgctcggcattttaaccgaccgtttcggaccgaaaaagacggctgttggcggaatgctggtgacgatgattccgttgttatggggatggcagttcggttcatcggtcgccgagctgtatatcatcggaattttactcggtgtggcaggcgcaagcttttccgcttcccttcctatggcgagccgctggtatccgccgcacttgcaaggtcttgccatggggatcgccggggcgggaaacagcggaacactgcttgctacgctattcggccctcgccttgcggagcaagtgggctggaacggcgtcatgggactggcgctgattcctttaaccctcgtgttattcagctatttccttatggctaaagaacctccgaatcagccggctcctaaaccgctcaaagactattttgccgttttcaaagaaagggacacttggtatttttgccttctctacagcgtgacattcgggggttttgtcggcctgtccaactttttaagctacttttttgcatcccagtatgccgttccggcggtaagagccggcgaatttgtcacgcttgtcgttgcatccggaagctgcctccgccctgtcggcggattgattgccgataaaatcggcggcgtgcgtttgcttcaattcctctttatcggagtggctctgtgcatgttctcggtcagtatgctcccgtctctaggcgttgtcacagccgcattatttatcggcatgggctgcctcggaatggggaacggcgcgatattccagtttgtaccgcagcgatttcaacaagagatcgggatggtgacggggatcgtcggcgctgcggggggaatcggcggattcttccttccgaatatcctcggaacgctgaagcaaattacaggtacgtattcaagcgggttcctaacctttaccgttattgcatttttagcgctcggtctgcttttgtttgctcaggccggatggaaaaaacagtggaaagccgaggagaaatcaatccgaatttaa

SEQ ID NO: 28405 - protein, 401 aa, Bacillus licheniformis ATCC 14580
MKLADLRKSGHAPSLLSSFLYFDVSFMIWVLLGALGVYVTADFDLSPSQVGLIVAIPTLAGSFFRIALGILTDRFGPKKTAVGGMLVTMIPLLWGWQFGSSVAELYIIGILLGVAGASFSASLPMASRWYPPHLQGLAMGIAGAGNSGTLLATLFGPRLAEQVGWNGVMGLALIPLTLVLFSYFLMAKEPPNQPAPKPLKDYFAVFKERDTWYFCLLYSVTFGGFVGLSNFLSYFFASQYAVPAVRAGEFVTLVVASGSCLRPVGGLIADKIGGVRLLQFLFIGVALCMFSVSMLPSLGVVTAALFIGMGCLGMGNGAIFQFVPQRFQQEIGMVTGIVGAAGGIGGFFLPNILGTLKQITGTYSSGFLTFTVIAFLALGLLLFAQAGWKKQWKAEEKSIRI

SEQ ID NO: 28406 - DNA, 1185 bp, Bacillus licheniformis ATCC 14580
  CDS (1)..(1185): transl_table=11
atggcaaatcgtcaaaaaatacaattaccgctgcagtcatttagtttagtcgcaggatttatggtttgggtattgatttcctctttaatgccccacattaagcaggacatcgccctgacagacagcgaggtctcccttgttacggccattccggtcatactcgggtcgcttctcaggattccgctgggctactacacgaacagatttggagcaagaattacattcatgatcagctttttgctgcttctgttcccggttttttggatcagcacagccgattcgctgttcgacttgatccttggcggcttcttcctcggcatcggcggagcggtcttttccatcggggtcacatcactgccgaaatactaccctaaagaaaagcacgggtttgtcaatgggatctacggcgctgggaacgtcggtacagcgattactacgtttgccgctcctgttgtcgcaaaaaccgccgggtgggaaaatacggtgcggatgtacatcgtgttagtcgccgtattcgctttattgaactttatccttggagatcgaaaagaaacaaaagttacggtatctgtaacagagcaaatgaaggcagtctaccgaaatcagacattatggtttttaagcttgttttacttcattacattcggatctttcgtcgcgtttacgatttatcttccgaactttcttgttaatcacttcgggcttgatcccgtcgattcagggctgagaaccgccggatttatcgctgtcgccacttttctgaggcctgtcggcggctggctggcagacaaattcaacccgctgaagctgttgatgtatgtatttgccggctgcaccttgtcagggattttattggccttttcgccgagcctcggactgtacgggtttggggtattaaccgttgccgtgtgcgccggactcggaaacgggatcatctttaagctcgtgccgctttatttttcaaatcaggccggcatcgttaatgggatcgtatcagcgatgggcggcttgggaggatttttcccgcctctcatcctgtcaagcgtttttcaggcaaccggccattatgcgatcggattcatggcgctgtcagaagcggctcttgcaagctttgtgatcgtggtctggatgtattttcaggaagtgaacaaaacatcgtccaaaacgaaggccaaccatttataa

SEQ ID NO: 28407 - protein, 394 aa, Bacillus licheniformis ATCC 14580
MANRQKIQLPLQSFSLVAGFMVWVLISSLMPHIKQDIALTDSEVSLVTAIPVILGSLLRIPLGYYTNRFGARITFMISFLLLLFPVFWISTADSLFDLILGGFFLGIGGAVFSIGVTSLPKYYPKEKHGFVNGIYGAGNVGTAITTFAAPVVAKTAGWENTVRMYIVLVAVFALLNFILGDRKETKVTVSVTEQMKAVYRNQTLWFLSLFYFITFGSFVAFTIYLPNFLVNHFGLDPVDSGLRTAGFIAVATFLRPVGGWLADKFNPLKLLMYVFAGCTLSGILLAFSPSLGLYGFGVLTVAVCAGLGNGIIFKLVPLYFSNQAGIVNGIVSAMGGLGGFFPPLILSSVFQATGHYAIGFMALSEAALASFVIVVWMYFQEVNKTSSKTKANHL

SEQ ID NO: 28408 - DNA, 1230 bp, Burkholderia mallei ATCC 23344
  CDS (1)..(1230): transl_table=11
gtgctcgcgtcgagcacgattgcattcacgctgtgcttcgccgtatggatgatgttcgcgatcctcggcattccgctgaagaaaaccctcggcctgaacgacaccgaattcggcctcatcgccgcgatgcccgtgctcaccggctcgctgatccgcgtgccgctcggcatctggaccgaccgctacggcggacgcatcgtgttcttcatcctgatgctcgtcaccgtcgtgccgatctggctgatctcgtacgcgaccgagctctggcagttcctcctgctcggcctgttcgtcgggctcgcgggcggctcgttctcggtcggcacgccctacgtcgcgcgctggttcccgaaagcgcgccagggtctcgcgatgggcgtgttcggcgccggcaactcgggcgcggccgtcaacaagttcgtcgcgcccgcgctgatcgccgcggcgggcacatggaccatcgtgccgcgcgtctacgcggtcgcgatgctcgcgatggcgctcctcttctggctgttctccgccaccgatcccgcgcaccgctcgacgaacgcgacatcgctgcgcgcgcaactgcgcgtgctgaagaacccgcgcgtatggcgctactcgcagtactactcggtcgtgttcggcggctacgtcgggctgtcgctgtggctcacgcagtactacgtcggcgaatacggcttcggcatccagtcggccgcgttcctcgccgcgtgcttctcgctgccgggcggcgtgctgcgcgcgatcggcgggtggctttccgaccgctacggcgcgtatcgcacgacgtggtgggtgatgtgggtctgctgggtgatgttcttcctgctcagctatccgccgaccgatttcacgatccgcgccgcgcacggcccgctcggcttccatctgtcgctcacgcccgtcgcgttcaccgcgctgctgttcgcggtcggcatcgcgatggcggtcggcaaggcgtcggtcttcaagttcatcgccgacgagttcccgaacgacatcggcgcggtgtcgggcgtcgtcggcctcgcgggcggcctggccggcttcgcgctgccgattctgttcggcgcgctcgtcgacctcacgggcgtgcgctcgacctgcttcatgctgctctacggcgccgtcagcgtgagcctcgtctggatgtacttcagcttccgcgccgagcgtgccgcgcacgaccagcgcgtgctcgccacccgctccgcgtga

SEQ ID NO: 28409 - protein, 409 aa, Burkholderia mallei ATCC 23344
MLASSTIAFTLCFAVWMMFAILGIPLKKTLGLNDTEFGLIAAMPVLTGSLIRVPLGIWTDRYGGRIVFFILMLVTVVPIWLISYATELWQFLLLGLFVGLAGGSFSVGTPYVARWFPKARQGLAMGVFGAGNSGAAVNKFVAPALIAAAGTWTIVPRVYAVAMLAMALLFWLFSATDPAHRSTNATSLRAQLRVLKNPRVWRYSQYYSVVFGGYVGLSLWLTQYYVGEYGFGIQSAAFLAACFSLPGGVLRAIGGWLSDRYGAYRTTWWVMWVCWVMFFLLSYPPTDFTIRAAHGPLGFHLSLTPVAFTALLFAVGIAMAVGKASVFKFIADEFPNDIGAVSGVVGLAGGLAGFALPILFGALVDLTGVRSTCFMLLYGAVSVSLVWMYFSFRAERAAHDQRVLATRSA

SEQ ID NO: 28410 - DNA, 1404 bp, Burkholderia mallei ATCC 23344
  CDS (1)..(1404): transl_table=11
atggatactctgcgcacctccctccgaagcggcaactggcgctcgcttctcgcgtgtttcctttatttcgatacgggcttcaccgtctgggtgctgtacgggccgctcgcgccgttcatcagcaaggacatcgcgatgacggccgcgcagcaaggctttctcgtcgcggtgccggtgctcgcggcggccatcctgcgcgtgacgctcggcaacctttaccagtccgccgacggccggcgcatcgcgctgatgggcgtactgctgtccgcgctgcccgccgccgtgctgccgttcgtgcccggcacgccgtcgtacacgctgctcctcgtgctcggcgtgttcctcgggatcggcggcgcgagcttcgcggtcgcgctgccgatggcgggcagcagctatccgccgaaggtgcagggcctcgtgctcggcctcgccgccgcgggcaacatcggcgcggtgctcgacggcttcatgttcccgcacatcgcggccgcgctcggctggaagttctcgacggccgccgcgctgccgctgctcgcgatcgcgggcttcgcgctcttcgcgtgggccgacgaccgcgcagagaaatcgggcagcgcggcgcgcgcgttcggcgcgttcgtgatcacgctcggcggtctcgtcgcgctcgtgctcgccgtgcacgcgggcctgttcggcgcgggcaaggcaggcgtgctgctgcccgtgatgggcgcgctgctcgcgatcgccgtgctgcccagccgctatcgcgcggtgctcgccgagcgcgacacgtgggtcatcatgctgatctacagcatcacgttcggaggcttcgtcggcatgtcgtcgtacgtgacgctgctgctgacgacgctctaccagatgccgaagatcgaagcgggcctgttcatgtcgctgctcgcgtttctcggcgcgatcgtgcgcccgttcggcggccacctcgccgaccgcatcaccggcgtgcgcgcgctcatggcgatcctcgccgcgatcgccgcggccgacttcgcgttcgcggccgtgatgccgccgctcgcgggcggcatcgcgctgctcgtgtgcctgtacgtcgcgttcggcctcggcaacggctcgacgttccagctcgtcccgcaccgctggcagggcaagacgggcctgctgtccggcatcgtcggcgcggcgggcagcatcggcggcttctatctgcccgtcgtgatgggcatcgcgaaggaaagcacgggcagctatcagctcggcttcgcgacgttcggcgcgctcgcgacctgcgcgctcgtcgcgctcgcgatgctgcgcgcgcagtggctgcgctgggcggcgcccgagctcgccgcggccgagccgtcggcgggcgccgggatgccgatcggcggcgcggcgcgcgtcggcgactga

SEQ ID NO: 28411 - protein, 467 aa, Burkholderia mallei ATCC 23344
MDTLRTSLRSGNWRSLLACFLYFDTGFTVWVLYGPLAPFISKDIAMTAAQQGFLVAVPVLAAAILRVTLGNLYQSADGRRIALMGVLLSALPAAVLPFVPGTPSYTLLLVLGVFLGIGGASFAVALPMAGSSYPPKVQGLVLGLAAAGNIGAVLDGFMFPHIAAALGWKFSTAAALPLLAIAGFALFAWADDRAEKSGSAARAFGAFVITLGGLVALVLAVHAGLFGAGKAGVLLPVMGALLAIAVLPSRYRAVLAERDTWVIMLIYSITFGGFVGMSSYVTLLLTTLYQMPKIEAGLFMSLLAFLGAIVRPFGGHLADRITGVRALMAILAAIAAADFAFAAVMPPLAGGIALLVCLYVAFGLGNGSTFQLVPHRWQGKTGLLSGIVGAAGSIGGFYLPVVMGIAKESTGSYQLGFATFGALATCALVALAMLRAQWLRWAAPELAAAEPSAGAGMPIGGAARVGD

SEQ ID NO: 28412 - DNA, 1281 bp, Burkholderia pseudomallei K96243
  CDS (1)..(1281): transl_table=11
atggctgcaacctccgcttcccccgcctcgctcgacaagcgcgcgatgcccgtgctcgcgtcgagcacgattgcattcacgctgtgcttcgccgtatggatgatgttcgcgatcctcggcattccgctgaagaaaaccctcggcctgaacgacaccgaattcggcctcatcgccgcgatgcccgtgctcaccggctcgctgatccgcgtgccgctcggcatctggaccgaccgctacggcggacgcatcgtgttcttcatcctgatgctcgtcaccgtcgtgccgatctggctgatctcgtacgcgaccgagctctggcagttcctcgtgctcggcctgttcgtcgggctcgcgggcggctcgttctcggtcggcacgccctacgtcgcgcgctggttcccgaaagcgcgccagggtctcgcgatgggcgtgttcggcgccggcaactcgggcgcggccgtcaacaagttcgtcgcgcccgcgctgatcgccgcggcgggcacatggaccatcgtgccgcgcgtctacgcggtcgcgatgctcgcgatggcgctcctcttctggctgttctccgccaccgatcccgcgcaccgctcgacgaacgcgacatcgctgcgcgcgcaactgcgcgtgctgaagaacccgcgcgtatggcgctactcgcagtactactcggtcgtgttcggcggctacgtcgggctgtcgctgtggctcacgcagtactacgtcggcgaatacggcttcggcatccagtcggccgcgttcctcgccgcgtgcttctcgctgccgggcggcgtgctgcgcgcgatcggcggatggctttccgaccgctacggcgcgtatcgcacgacgtggtgggtgatgtgggtctgctgggtgatgttcttcctgctcagctatccgccgaccgatttcacgatccgcgccgcacacggcccgctaggcttccatctgtcgctcacgcccgtcgcgttcaccgcgctgctgttcgcggtcggcatcgcgatggcggtcggcaaggcgtcggtcttcaagttcatcgccgacgagttcccgaacgacatcggcgcggtgtcgggcgtcgtcggcctcgcgggcggcctggccggcttcgcgctgccgattctgttcggcgcgctcgtcgacctcacgggcgtgcgctcgacctgcttcatgctgctctacggcgccgtcagcgtgagcctcgtctggatgtacttcagcttccgcgccgagcgtgccgcgcacgaccagcgcgtgctcgccacccgctccgcgtga

SEQ ID NO: 28413 - protein, 426 aa, Burkholderia pseudomallei K96243
MAATSASPASLDKRAMPVLASSTIAFTLCFAVWMMFAILGIPLKKTLGLNDTEFGLIAAMPVLTGSLIRVPLGIWTDRYGGRIVFFILMLVTVVPIWLISYATELWQFLVLGLFVGLAGGSFSVGTPYVARWFPKARQGLAMGVFGAGNSGAAVNKFVAPALIAAAGTWTIVPRVYAVAMLAMALLFWLFSATDPAHRSTNATSLRAQLRVLKNPRVWRYSQYYSVVFGGYVGLSLWLTQYYVGEYGFGIQSAAFLAACFSLPGGVLRAIGGWLSDRYGAYRTTWWVMWVCWVMFFLLSYPPTDFTIRAAHGPLGFHLSLTPVAFTALLFAVGIAMAVGKASVFKFIADEFPNDIGAVSGVVGLAGGLAGFALPILFGALVDLTGVRSTCFMLLYGAVSVSLVWMYFSFRAERAAHDQRVLATRSA

SEQ ID NO: 28414 - DNA, 1386 bp, Burkholderia pseudomallei K96243
  CDS (1)..(1386): transl_table=11
atgtccacttctctactcgtgcgctgggatcccgaaaacccggccttctggcaagccaaggggcgccccgtcgcgtggcgcaatctcgcgatctcgattcccgcgctgatgctcgcgttcgtcgtctggtcgctctggagcgtcgtcgtcgtcaacctcgatcgcgcgggctttcacttcagcaagaaccagctgttctggctcaccgcgctgcctgcgctttccggcgcgacgctgcgcatcttctattcgttcctcgtgccgatcttcggcggccgccgcttcaccgcgatctcgaccgcgacgctgctgattcccgcgctcggaatgggcttcgcgctgcgcgaccccggcacgggctacccgacgctcctcatcctcgcgctgctctgcgggttcggcggcgcgaacttcagctcgtcgatggcgaacatcagcttcttcttcccgaaggcgaagaaagggctcgcgaccggcctgaacgcgggcatcggcaacctcggcgtgtcggtcgtgcagttcgtcacgccgctcgtgatctcggcgggcctgttcggcgcgctcgcgggcgatccgcagagcgtcgtcgcgcacggcgcgacgacgaacctgtggttgcagaacgcgggcttcgtgtgggtgccgttcatcgtcgtcgcgacgctcgccgcgtggttcgggatgaatgacatcgccgacgcgaaggcgtcgttcgccgagcaggcggtgatcttccgccgactgcacaactggctgatgtgctggctgtacgtcggcaccttcggttcgttcatcggcttctcggcgggcttcgcgctcctcacgaaggcgctcttcccgaacgtgaacccgaccgcgtacgcgttcatcggcccgctcgcgggcgcgctgatgcgccccgtcggcggatgggtgtccgaccgcatcggcggcgcgcgcgtgacgttctggaccttcgccgcgatgatcgcggccgtcggcggcgtgatcgcgacgctgccctcgggcggcgccgcgggcagcttcgcgggcttcctcgcgatgttcatcgtgctgttcgcgctcacgggcatcggcaacggctcgacgttccggatgatcccggtgatcttcctcaccgagcggcagcgcgccgcgcaaggccaggacgaggccgcgcgcaagcaggcggtgctcgacgccggcaaggaatcggccgcggtgctcggcttttcgggcgcgatcggcgcgtacggcggcttctttatcccgaagagtttcggcacgtcgctcgacatgacgggctcggccgtgccggcgctcgtgtgcttcatcgcgttctacgtgtcgtgcgtcgcgatcacctggtggttctacgcgcgccgcaacgcgtcgatgccgtgctga

SEQ ID NO: 28415 - protein, 461 aa, Burkholderia pseudomallei K96243
MSTSLLVRWDPENPAFWQAKGRPVAWRNLAISIPALMLAFVVWSLWSVVVVNLDRAGFHFSKNQLFWLTALPALSGATLRIFYSFLVPIFGGRRFTAISTATLLIPALGMGFALRDPGTGYPTLLILALLCGFGGANFSSSMANISFFFPKAKKGLATGLNAGIGNLGVSVVQFVTPLVISAGLFGALAGDPQSVVAHGATTNLWLQNAGFVWVPFIVVATLAAWFGMNDIADAKASFAEQAVIFRRLHNWLMCWLYVGTFGSFIGFSAGFALLTKALFPNVNPTAYAFIGPLAGALMRPVGGWVSDRIGGARVTFWTFAAMIAAVGGVIATLPSGGAAGSFAGFLAMFIVLFALTGIGNGSTFRMIPVIFLTERQRAAQGQDEAARKQAVLDAGKESAAVLGFSGAIGAYGGFFIPKSFGTSLDMTGSAVPALVCFIAFYVSCVAITWWFYARRNASMPC

SEQ ID NO: 28416 - DNA, 1458 bp, Burkholderia pseudomallei K96243
  CDS (1)..(1458): transl_table=11
ttgccctttttccaccatccgccgtcgaccggcatacgcgaggcttcaccgatggatactctgcgcacctccctccgaagcggcaactggcgctcgcttctcgcgtgtttcctttatttcgatacgggcttcaccgtctgggtgctgtacgggccgctcgcgccgttcatcagcaaggacatcgcgatgacggccgcgcagcaaggctttctcgtcgcggtgccggtgctcgcggcggccatcctgcgcgtgacgctcggcaacctttaccagtccgccgacggccggcgcatcgcgctgatgggcgtactgctgtccgcgctgcccgccgccgtgctgccgttcgtgcccggcacgccgtcgtacacgctgctcctcgtgctcggcgtgttcctcgggatcggcggcgcgagcttcgcggtcgcgctgccgatggcgggcagcagctatccgccgaaggtgcagggcctcgtgctcggcctcgccgccgcgggcaacatcggcgcggtgctcgacggcttcatgttcccgcacatcgcggccgcgctcggctggaagttctcgacgaccgccgcgctgccgctgctcgcgatcgcgggcttcgcgctcttcgcgtgggccgacgaccgcgcagagaaatcgggcagcgcggcgcgcgcgttcggcgcgttcgtgatcacgctcggcggtctcgtcgcgctcgtgctcgccgtgcacgcgggcctgttcggcgcgggcaaggcaggcgtgctgctgctgcccgtgatgggcgcgctgctcgcgatcgccgtgctgcccggccgctatcgcgcggtgctcgccgagcgcgacacgtgggtcatcatgctgatctacagcatcacgttcggcggcttcgtcggcatgtcgtcgtacgtgacgctgctgctgacgacgctctaccagatgccgaagatcgaagcgggcctgttcatgtcgctgctcgcgtttctcggcgcgatcgtgcgcccgttcggcggccacctcgccgaccgcatcaccggcgtgcgcgcgctcatggcgatcctcgccgcgatcgccgcggccgacttcgcgttcgcggccgtgatgccgccgctcgcgggcggcatcgcgctgctcgtgtgcctgtacgtcgcgttcggcctcggcaacggctcgacgttccagctcgtcccgcaccgctggcagggcaagacgggcctgctgtccggcatcgtcggcgcggcgggcggcatcggcggcttctatctgcccgtcgtgatgggcatcgcgaaggaaagcacgggcagctatcagctcggcttcgcgacgttcggcgcgctcgcgacctgcgcgctcgtcgcgctcgcgatgctgcgcgcgcagtggctgcgctgggcggcgcccgagctcgccgcggccgagccgtcggcgggcgccgggatgccgatcggcggcgcggcgcgcgtcggcgactga

SEQ ID NO: 28417 - protein, 485 aa, Burkholderia pseudomallei K96243
MPFFHHPPSTGIREASPMDTLRTSLRSGNWRSLLACFLYFDTGFTVWVLYGPLAPFISKDIAMTAAQQGFLVAVPVLAAAILRVTLGNLYQSADGRRIALMGVLLSALPAAVLPFVPGTPSYTLLLVLGVFLGIGGASFAVALPMAGSSYPPKVQGLVLGLAAAGNIGAVLDGFMFPHIAAALGWKFSTTAALPLLAIAGFALFAWADDRAEKSGSAARAFGAFVITLGGLVALVLAVHAGLFGAGKAGVLLLPVMGALLAIAVLPGRYRAVLAERDTWVIMLIYSITFGGFVGMSSYVTLLLTTLYQMPKIEAGLFMSLLAFLGAIVRPFGGHLADRITGVRALMAILAAIAAADFAFAAVMPPLAGGIALLVCLYVAFGLGNGSTFQLVPHRWQGKTGLLSGIVGAAGGIGGFYLPVVMGIAKESTGSYQLGFATFGALATCALVALAMLRAQWLRWAAPELAAAEPSAGAGMPIGGAARVGD

SEQ ID NO: 28418 - DNA, 1275 bp, Burkholderia pseudomallei K96243
  CDS (1)..(1275): transl_table=11
atgggctcacggcacggttccggcgcgttcgaccccgcgcccgcgattcccgcacgcgcctggtcggtgctcttcgcgagcacgctcgcgtttctcgtgtgtttcgtcgtctggatgatgttcggcgtgctcggcgtcccgttgcgcgaggatctgcatctgaattcgaccgagttcgggctcctcacgtcgacgcccgtgctgacgggcgcgctgatgcggctgccgctcggcgcatggaccgaccgcttcggcgggcgcatcgtgatgacggtgctgctcgtcgtctgctcggtgcccgtctatggggtcagctatgcgaacgcgctgtggcagtttctgctgatcgggctgttcctcggctgcgtcggcgcgtcgttcgcggtcggcacgccatacgtcgcgcgtttcttcccgccgcggcggcgcgggctcgcgatgggcgtgttcggcgcgggcaccgtgggcgcggcggtgaacctgttcgtcacgccgctcttgctcgccgcgtacggctggcgcgtcgtgccgcgcgtctacgcgctcgcgctcgtcgtcaccgccgcggtcttctggttcgcgtcggcgcccgatcccggcgcgggcgagcagaagggctcatgggtcgattcgttcaaggtgctgcgcgatccgcgcgtctggaagctttgccagtactactcgatcacgttcggcggcttcaccgcgctgtcgctgtggattccgcagtacctgaagaacggctatgggatgtcgctcgtcgcggcttccgcgttcgcggcgggcttttcgctgccgggctcggtgctgcgcgcgctcggcggcgcgctcgccgaccgctacggcgcgcacgcggtcacctggtgggggctgtgggtcgcgtggatttgcctgttcctgctgtcctatccgccgaccgacctcgtgattcacacgatcgacggcaccgcgacgctgcggcttcatgtgccgctcgcggcgttcgtcgtgctgacgttcgtgctgggcgcggtgttcgcgttcgggatggcgtcgacgttcaagtacgtcgccgacgatttcccgaacaacatgggcgtcgtcaccggcatcgtcgggctcgcgggcgggctcggcggctttctgctgccgatcatcttcggcgcgctcgtcgatctgctgcgcgtgcgctcgacgtgcttcatgttcctgtacgggatcgtctgggtgtcgctgatcctgctgtacctcgcggaaatccggcgcgcgcccgtcacgggcgcgcccccgcgctga

SEQ ID NO: 28419 - protein, 424 aa, Burkholderia pseudomallei K96243
MGSRHGSGAFDPAPAIPARAWSVLFASTLAFLVCFVVWMMFGVLGVPLREDLHLNSTEFGLLTSTPVLTGALMRLPLGAWTDRFGGRIVMTVLLVVCSVPVYGVSYANALWQFLLIGLFLGCVGASFAVGTPYVARFFPPRRRGLAMGVFGAGTVGAAVNLFVTPLLLAAYGWRVVPRVYALALVVTAAVFWFASAPDPGAGEQKGSWVDSFKVLRDPRVWKLCQYYSITFGGFTALSLWIPQYLKNGYGMSLVAASAFAAGFSLPGSVLRALGGALADRYGAHAVTWWGLWVAWICLFLLSYPPTDLVIHTIDGTATLRLHVPLAAFVVLTFVLGAVFAFGMASTFKYVADDFPNNMGVVTGIVGLAGGLGGFLLPIIFGALVDLLRVRSTCFMFLYGIVWVSLILLYLAEIRRAPVTGAPPR

SEQ ID NO: 28420 - DNA, 1275 bp, Methylococcus capsulatus str. Bath
  CDS (1)..(1275): transl_table=11
atgaacctaaaagaattcaagcaggccggacattggccgaccctgctctccgcctttctctatttcgacgtgtccttcatggtctgggtgatgctcggaccgctttccctctatatcaccaaggacctggcgctgccgctcgaagagaagttcaccatcgtcgccatacccatcctctccggcgcggtgttccgcatcatcctgggctccatggccgaccatgtcggccccaagccgaccggcatcctggcccaactgctggtgatcctgggccttgcctatgtgttctggttcggtctgcactccaagctggaagtggagctgctaggtctgctgctgggcgtggccggcgccagcttcgccgtggccctgccgcaggccagccgctggtatccgcccaagttccagggggtggtgatgggcatcgccggggccggcaacatgggcgtggtgctcgattccatgatcgtgccctggctggccgagaaattcggctggcaggcggtgttcggcttcctgctcattcccttggtgatagtcctgaccgtctacgcggtgctggtgaaggatgccccggacaagcgcgcgccggtcaccctggcgaactatgcctcagtcatgaaagacccggacgcctggtggttcatgttcttctactccatcaccttcggaggcttcgtcggtctcggcaacgccctgccgctgtacttcacccactggtatcacgtctccggcatcgcggccggcatgatggtcgccatcgtggtgttcgccggctcgatgttccgtccggtcggcggctatctcgccgaccgcatcggcggcatccgcgccctccagatcctgttcgtggtggtgtcgctggcctacctggcgatctcgttcatgcccgaaggcccggcacctgaagcgctgggcaccgccaaggtggccggctggagcttgggggaactgccggcacaaggctggggagcggtcgccgtcttcttcgccggtaccctggcgctggggatgggcaacggctcggtgttccaactggtgccgctgcgcttccgcaaggaaatcggggtggtcaccggcctcgtcggctgcgccggcggcgtgggcggcttcttcctggcgaaaaccctcggcctgtcatgggaaatacagcacggcttcgcactcggattcagcgtattcgccgtccttccgctgctcggcctgggcgggctgatgctggtgaggaaacgctggcgcacgacctggggcgcggtttccggggcgcgggtctga

SEQ ID NO: 28421 - protein, 424 aa, Methylococcus capsulatus str. Bath
MNLKEFKQAGHWPTLLSAFLYFDVSFMVWVMLGPLSLYITKDLALPLEEKFTIVAIPILSGAVFRIILGSMADHVGPKPTGILAQLLVILGLAYVFWFGLHSKLEVELLGLLLGVAGASFAVALPQASRWYPPKFQGVVMGIAGAGNMGVVLDSMIVPWLAEKFGWQAVFGFLLIPLVIVLTVYAVLVKDAPDKRAPVTLANYASVMKDPDAWWFMFFYSITFGGFVGLGNALPLYFTHWYHVSGIAAGMMVAIVVFAGSMFRPVGGYLADRIGGIRALQILFVVVSLAYLAISFMPEGPAPEALGTAKVAGWSLGELPAQGWGAVAVFFAGTLALGMGNGSVFQLVPLRFRKEIGVVTGLVGCAGGVGGFFLAKTLGLSWEIQHGFALGFSVFAVLPLLGLGGLMLVRKRWRTTWGAVSGARV

SEQ ID NO: 28422 - DNA, 1470 bp, Nocardia farcinica IFM 10152
  CDS (1)..(1470): transl_table=11
ttgttgagcacgctgacgcgtaaccgcaacatcgagcactgggatgccgaagacgtcgaggcatgggaggccggtggcaagcacatcgcccggcgcaacctgatctggtcggtcttcgccgagcacgtcggattctcgatctggtcgatctggtcggtgatggtgctgttcatgcccgccgagaagtacggcatcgacgcggcgggtaagttcttcctgatggcggtgccgaccctggtcggtgcggtgctgcgcattccctacaccgtcgccaccgcccgcttcggtggccgcaactggaccgtcttctcggccttgctgctgctggtgcccacgctgctgacgctgtacttcatcaaccagcccggcacctcgtacaccaccttcctggtggtggcggccttcgccggtgtcggtggcggcaacttcgcctcgtcgatgaccaacatcaacgccttctacccgcagcggctcaagggctgggcgctcgggctgaacgccggcggcggcaacatcggcgtgccggtcatccagctgatcggcctgctggtcatcgccaccctcggcaacgagtacgccagcctgatctgcgcgatctacctggtgctgatcgcgatcaccggcctgggcgccgcgctgtacatggacaacctgcgcaaccagaaggcggacctgtccgacatggtgaccgcgctgaaagtgccgcagtcctgggcgatcgcgttcctctacatcggcacgttcggatcgttcatcggctacagcttcgccttcggccagatcctgcagatcagcttcaaggccggtggcgacaccgccgcgcaggccgcgctgcacgccgcccagatcgccttcatcggcccgctgctcggctcgctggcccgcccctacggcggcaagtgggccgaccggatcggcggcagccgcgtcgcgctggtcaccttcggcgcgatgatggccgcggccgcgctggtgatcggggccagcaccgtggccgacggcaacggcggcgtcgcaggcggcgcggtgatggcggtgctcgtgatcggtttcgtcgccctgttcgtgctctcgggcatcggcaacggcgcggtcaccaagatcatcccgtcggtgttcgacgccaagtcgcgcagcctcgacctgagccccgccgatcgggccgcctggtcgcagaacacctccggcgcgctgatcggtttcgtcggcgccatcggagcgctgggcggcgtcggcatcaacctggtcctgcgctcctcctacgcctcgaccaactcggccaccaccgcgttctgggtcttcctggccttctacgtggtgtgcgccgcggtcacctggctggtcttcctgcgccgtccgagcctgcgctcggtggccgacgacgatgtggtcgtcgaggccgaggccctcgttcgccgcgccgaacaggccgttcccgccacctcgtccgtcccgtcggcccgcgcctga

SEQ ID NO: 28423 - protein, 489 aa, Nocardia farcinica IFM 10152
MLSTLTRNRNIEHWDAEDVEAWEAGGKHIARRNLIWSVFAEHVGFSIWSIWSVMVLFMPAEKYGIDAAGKFFLMAVPTLVGAVLRIPYTVATARFGGRNWTVFSALLLLVPTLLTLYFINQPGTSYTTFLVVAAFAGVGGGNFASSMTNINAFYPQRLKGWALGLNAGGGNIGVPVIQLIGLLVIATLGNEYASLICAIYLVLIAITGLGAALYMDNLRNQKADLSDMVTALKVPQSWAIAFLYIGTFGSFIGYSFAFGQILQISFKAGGDTAAQAALHAAQIAFIGPLLGSLARPYGGKWADRIGGSRVALVTFGAMMAAAALVIGASTVADGNGGVAGGAVMAVLVIGFVALFVLSGIGNGAVTKIIPSVFDAKSRSLDLSPADRAAWSQNTSGALIGFVGAIGALGGVGINLVLRSSYASTNSATTAFWVFLAFYVVCAAVTWLVFLRRPSLRSVADDDVVVEAEALVRRAEQAVPATSSVPSARA

SEQ ID NO: 28424 - DNA, 1485 bp, Nocardia farcinica IFM 10152
  CDS (1)..(1485): transl_table=11
atgaccgccacagccgcagccaccggccggcagccgggcacaccggtgttcacgcaccacacgcgcggacgctggctcgaacactgggagccggacaatcccgaattctgggaagccggcggaaagcgcaccgcgcgaaagaatctcgccttctcggtgttcgccgagaatctgggcttcagtgtctgggtcatctggggcaccgtcgtcaccagcatgggcgcggcgggcttcccgttcctggccggactcggccagggcaacccggtcgcggtgagcaacgcactgctgctcacctcgacaccgacgctggtcggcgcggccctgcgcattccctacaccttcgccatcccacggttcggcggccgcgccttcaccgcgttcagcgcggcgatgctgctggtaccgaccctgggcctggcctggttcgtcaaccagccgggcaccccgatgtgggtgttcatggtgctggcggcgctggcgggattcggcggcggcaacttctcctcgtcgatggccaacatctcgttcttcttccccgagggcaagaagggcgcggcgctcggaatcaacgccgccggaggcaatctcggcgtcgcgcagacccagctggtgctgccgctgctgatcaccctcggcacccacctcaccgcgaaggaccccgcaggctaccgtttcggcatcacgctctcggtgctggtgtgggtgccgttcatcctgatcgccaccgtcggcgcgctgcgctacatggacagcatcgccaccgcgaaatccgatgggaagtcctacaagctggcgctgaccaaccggcacacctgggtgatgtcgttcctctacatcggcaccttcggctcgttcatcggcttctccttcgccttcccgacgctgatcaaggccaacttcccgagcctggccgggatcggctggatcaccacgctgggcaacctcgccttcctcggcgcgctggtcggctcgttcagccgtccgttcggcggctggatctccgacaaggtgggcggggcacggatcaccgtgttcgtcttcggcggcatggcggtcgcggtggccgcgatcatggcggcgctggagctgaagagcttcccgctctacctgatcgccttcctggtgctgttcgtgctcaccggcgtcggcaacggctcgacctaccggatgatcccgtccatcttcagcgcggaatccaagaagtacgccgccgaacacggcctcgacccggccgacgcggcggcctcggccaagcggcaggcgggcgcggcgatcggcgtgatcggagcgatcggcgcctccggcggctacctgctccagcaggcactgcggttgtccaacatcaacttcggcagcatggcgcccgcgttctgggcctacgccgcggcgttcctggtgatggccggggtgacctggttctactacctgcgctcgtcgttcgcgatcggccggttcacctcgctggcctacgccaacgtatga

SEQ ID NO: 28425 - protein, 494 aa, Nocardia farcinica IFM 10152
MTATAAATGRQPGTPVFTHHTRGRWLEHWEPDNPEFWEAGGKRTARKNLAFSVFAENLGFSVWVIWGTVVTSMGAAGFPFLAGLGQGNPVAVSNALLLTSTPTLVGAALRIPYTFAIPRFGGRAFTAFSAAMLLVPTLGLAWFVNQPGTPMWVFMVLAALAGFGGGNFSSSMANISFFFPEGKKGAALGINAAGGNLGVAQTQLVLPLLITLGTHLTAKDPAGYRFGITLSVLVWVPFILIATVGALRYMDSIATAKSDGKSYKLALTNRHTWVMSFLYIGTFGSFIGFSFAFPTLIKANFPSLAGIGWITTLGNLAFLGALVGSFSRPFGGWISDKVGGARITVFVFGGMAVAVAAIMAALELKSFPLYLIAFLVLFVLTGVGNGSTYRMIPSIFSAESKKYAAEHGLDPADAAASAKRQAGAAIGVIGAIGASGGYLLQQALRLSNINFGSMAPAFWAYAAAFLVMAGVTWFYYLRSSFAIGRFTSLAYANV

SEQ ID NO: 28426 - DNA, 1323 bp, Haloarcula marismortui ATCC 43049
  CDS (1)..(1323): transl_table=11
atgggactgatcaagatgacgaagtaccggacgctgctgctggcgaccatcggcttcaatttctcgttccttatttggttctcgttcgcgccgtttactggcccgatggccgaggagttcggactgtcgacggcggagatcgggattctggcgagttcggccatctggatggctccgtttggccgaatgctcaccggctggctctcggataagttcggtgcaccggccatctttgccatcgtgctggcctacgttggtgtgttctcgatcgggagcgccttcgcacaggactactccgtgttcttcgtgctccgactcatcgtggcgacggccggcatcacgttcgtcatcggcatccagcacgtcgccgagtggttcgaggaggagaacctcggtctggcggagggcatctacgccggtgtcgggaacgccggcgccgccggcggcgcgctgattctccctcgcgtgttcgggtccgggtggaacgggccgctgttctcgaccaactggcgagccgcgttcttctacaccggcatcgtctccatcctcctcgcaatcgcctactacacactcggcgaggccgccaagaccgaggcgaaacgccaggcgaccaaagagaacaccaacttcaaaggctggctgcacacggccacgcggtacggcactgtcgtccttgccgccgcgtacatcatgtcttttggcctcgaactgtcgatgaacgggtggctcgccacctactaccgcgaggcgttcaaccaggacaacctcgtcatcgcgagcaccttcgctgcgacgttctcgattgctgcgggactgctccggccctttggcggctacggcagtgacctgctggcccgcaaggagaagaacctcctgccgttcttcaagggccagtaccgcgagcagtggacgttcctcgggctctgctttattgtggtgatgatgttcgccatgacgctggccggcctctccggggtcctgctgaacgcggtcgtcatcggcttcctcgtgggcacgggctgtgcctgggctgagggcgctatcttcgcgcaggtgcctgcgatgttccccaacgactctggctcggtcgccggtgtcgtcggcggcgtcggcactgtcggtgggattgtctacccgctgttttactccgcgccgtggttggcgaacctccacctggggtattccgtggccgccgttaccatgattccgattgtgttgctgtctgcatgggtgttccagccggaaatcgcgaaagtcgctaacacggctgggttcgtcggaagcacgcaggaaggcaccaccgtcgcctccggcgacgactga

SEQ ID NO: 28427 - protein, 440 aa, Haloarcula marismortui ATCC 43049
MGLIKMTKYRTLLLATIGFNFSFLIWFSFAPFTGPMAEEFGLSTAEIGILASSAIWMAPFGRMLTGWLSDKFGAPAIFAIVLAYVGVFSIGSAFAQDYSVFFVLRLIVATAGITFVIGIQHVAEWFEEENLGLAEGIYAGVGNAGAAGGALILPRVFGSGWNGPLFSTNWRAAFFYTGIVSILLAIAYYTLGEAAKTEAKRQATKENTNFKGWLHTATRYGTVVLAAAYIMSFGLELSMNGWLATYYREAFNQDNLVIASTFAATFSIAAGLLRPFGGYGSDLLARKEKNLLPFFKGQYREQWTFLGLCFIVVMMFAMTLAGLSGVLLNAVVIGFLVGTGCAWAEGAIFAQVPAMFPNDSGSVAGVVGGVGTVGGIVYPLFYSAPWLANLHLGYSVAAVTMIPIVLLSAWVFQPEIAKVANTAGFVGSTQEGTTVASGDD

SEQ ID NO: 28428 - DNA, 1200 bp, Geobacillus kaustophilus HTA426
  CDS (1)..(1200): transl_table=11
ttgaaagtttgggaggggcttttcatgaataaacaaaaggcgctgctgccgattacgacgttcgccatgatgttttcattcgccgtgtgggccgtgttttcgccgcttgcgagtacgtttcaacaaatgtacgggctgacatcgacgcaaaaaagcattttggtcgccattcccgttttgctcggttcggtgatgcggttgccgcttggcatttggacggaccggatcggcgggcgcaggctgttttcgctgctgctcttgtttcttgtcattccgcttgttggcgcagggtttgcagattcgtatgcgatgcttctgttttgggcgtttttcatcggcatggccggaacgtcgttcgccatttcggtgacgttcgtttcccgcttgactccgccggaaaagcaagggacggcgcttgggattaacgcgatgggcaacttcggcacggcggttgctgcgttttccgttccatcgattgccgcagcgtttggtgtgccttgggctttttgggggatgatcattccggttgtcgtcatgctcgttctcgtttggtttttcacaccggatatgccgaaaccgaaacaacaaaaaacggtgcgtgaatcgctgtcggtattgaaatataaacatacgtggacgttgtcgctcttttacttcgttacgttcggggcgtttgtcgctttcggcatttacttgccgtcgctgctcgttgacttgtatgggttgacgccggtggatgctgggatgcgcgcggctgggtttactgtactcgctacgcttgcgcggccagtcggcggctatcttggcgataaaatcggtgctgaacgggtgttgacgttcgtctacgctggaatgacaatcggcgcgttggtgatcgcgtttggaatggaaaatatttgggtgatgacagcggcttgtttgtttgtggccgtgatgtctgggctgggcaacggtgcggtgttcaaactcgtgccgcagctgttcccagccgaaacgggcgccgtcaccggccttgtcggggcctggggcggacttggcggcttttttccgccgattgtcatggggatcattaaagatgcaacaggttcgtacgtgctcagttttctgctccttagcttgtttacccttatttgcttcttgctgaaccggctcgtatttggcaaaaaagccggcgaaccggcgaagcggttcgcttcttga

SEQ ID NO: 28429 - protein, 399 aa, Geobacillus kaustophilus HTA426
MKVWEGLFMNKQKALLPITTFAMMFSFAVWAVFSPLASTFQQMYGLTSTQKSILVAIPVLLGSVMRLPLGIWTDRIGGRRLFSLLLLFLVIPLVGAGFADSYAMLLFWAFFIGMAGTSFAISVTFVSRLTPPEKQGTALGINAMGNFGTAVAAFSVPSIAAAFGVPWAFWGMIIPVVVMLVLVWFFTPDMPKPKQQKTVRESLSVLKYKHTWTLSLFYFVTFGAFVAFGIYLPSLLVDLYGLTPVDAGMRAAGFTVLATLARPVGGYLGDKIGAERVLTFVYAGMTIGALVIAFGMENIWVMTAACLFVAVMSGLGNGAVFKLVPQLFPAETGAVTGLVGAWGGLGGFFPPIVMGIIKDATGSYVLSFLLLSLFTLICFLLNRLVFGKKAGEPAKRFAS

SEQ ID NO: 28430 - DNA, 1203 bp, Geobacillus kaustophilus HTA426
  CDS (1)..(1203): transl_table=11
atggcgaggaaatcgttttggcgcgtcgggcatgcgccgacgcttttatcgtcgtttttgtattttgatatcagctttatgatttggaacttgcttggcgcgcttggtgtatttgtcgctgagtcgtttgcgctcacgccggcggaaaaagggatgatggtcgccattcccgtgttgggcggggcgctgcttcgcattccgatggggatgctcgccgaccgctggggcgggaagcgggctggtctgcttggcatggcggtgacagctgtgccgcttgtgtgggggtggcagttcgctgaccggatgtcggatgtgtatgcgctcggatttttattaggggtgggcggagccagctttgccgttgcgttgccgcttgcgagccgctggtatccgaaagaatatcaagggctggccatggggatcgctggggccggaaacagcgggacggtgctggcaacgctgtttggcccgcggctggcggaggcgtatgggtggaacgcggtgttcggattggcgctcgtcccgctagttgttgtcttttttctattcgcttggctggcgcgtgaatgtccaacagcggtgaaacccgtttcgttgcgtgaatacggagccgttctccgtcgaaaagaagcatggctgttttgtttcttctacagcttgtcattcggcggatttgtcgggctgacgggatacttaggcattttcttctttgatgaatacggcgtcagtaaagtcacggccggcgatttcgtcaccgccgtcgtgtttgcgggcagtttcatccgcccgattggcggttatctcgctgaccggatcggcggaatgcggcttctttccttgttgtttgccgttggtgcggttttgcttgcgttcatcggcgcattgccgccccttctcatcgtgttcggattgatggtcgttctttttctttgctttggtgcggcaaacggtgctttgttccaagtcgttccaacctggtttccgaaagaagtcggtttgttgacgggcatcatcggcgccgctggcggactgggagggtttttgctgccgaacgtgctcggggtgatgaagcagtggaccggctcttcggcgtatgggttttggatgcttgctttcgttttcgcgatcgcggtgatggctgctcgtcgccttcaagggacgacggttacgatcgaacatttctctcaaaaagcagcagaatga

SEQ ID NO: 28431 - protein, 400 aa, Geobacillus kaustophilus HTA426
MARKSFWRVGHAPTLLSSFLYFDISFMIWNLLGALGVFVAESFALTPAEKGMMVAIPVLGGALLRIPMGMLADRWGGKRAGLLGMAVTAVPLVWGWQFADRMSDVYALGFLLGVGGASFAVALPLASRWYPKEYQGLAMGIAGAGNSGTVLATLFGPRLAEAYGWNAVFGLALVPLVVVFFLFAWLARECPTAVKPVSLREYGAVLRRKEAWLFCFFYSLSFGGFVGLTGYLGIFFFDEYGVSKVTAGDFVTAVVFAGSFIRPIGGYLADRIGGMRLLSLLFAVGAVLLAFIGALPPLLIVFGLMVVLFLCFGAANGALFQVVPTWFPKEVGLLTGIIGAAGGLGGFLLPNVLGVMKQWTGSSAYGFWMLAFVFAIAVMAARRLQGTTVTIEHFSQKAAE

SEQ ID NO: 28432 - DNA, 1389 bp, Salmonella enterica subsp. enterica serovar Paratyphi A str. ATCC
  CDS (1)..(1389): transl_table=11
atgacacgacaaaacgagaattataaccgttatctcttgagtgactggcgacccgaaaatccagccttctgggagaataaagggaaaggcatcgccagaagaaacttatggatttcagtaagttgtttgctcctggcattttgcgtctggatgttgtttagcgctgttgccgtcaacctcaataaaattggatttaattttaccaccgaccaactctttttattaaccgcattaccttctctttccggcgcaatattacgcgtcccctactcctttatggtgccactgtttggtggccgtaaatggaccgtattaagtaccgtaatattgattattccctgcgcctggctgggattcgccgtgcaaaatcccgccacccctttcggggtatttatgctcatcgctctgttgtgcggttttgcgggggcaaacttcgcgtccagtatgggcaacatcagttttttctttccaaaagccagacaaggtagcgcgttgggtattaacggcggactgggaaatcttggcgtcagtgtgatgcagttgcttgcgccgctggttatttttctgccgatatttacttttttaggcgtccggggcgtgccgcaacctgatggctccctgctcgccctcactaacgccgcctggatctgggtgccgttactggctgtcgcgacgcttgccgcctggtttggtatgaacggtatcggcagttcaaaagcgtctgtcgcctcgcaattgccggtgctaaaacgtctgcacctgtggctgcttagcctgctgtacctggcgacattcgggtcattcatcggcttttccgcaggtttcgccatgctcgccaaaacgcaatttcccgacgtaaacattctgcaactggcgttctttggcccctttatcggcgcgctggcgcgttcggcaggcggcgtgatctccgataaattcggcggcgttcgcgtcacgctcattaattttatctttatggcgctgtttaccgccctgctattcctcacgctgccaggctccggcgcaggcagctttagcgcgttctatcttgtttttatgggcctgtttttgacagcgggtctcggcagcggttctaccttccagatgattgcggtgatcttccgtcagatcacgctctacaacgtcaaactgcgcggcgggagcgatgagcaggcgcagcgcgaagcggtgacggataccgccgccgcactcggttttatctccgctattggcgctgtgggcggcttctttattccaaaagcgtttggcacctctttggccttgaccggctcgccggtgggcgccatgaaaatctttttgctgttttacatcgcttgcgtcctgctgacctggctggtctacgggcgtcgtaagcctaaacaacaataa

SEQ ID NO: 28433 - protein, 462 aa, Salmonella enterica subsp. enterica serovar Paratyphi A str. ATCC
MTRQNENYNRYLLSDWRPENPAFWENKGKGIARRNLWISVSCLLLAFCVWMLFSAVAVNLNKIGFNFTTDQLFLLTALPSLSGAILRVPYSFMVPLFGGRKWTVLSTVILIIPCAWLGFAVQNPATPFGVFMLIALLCGFAGANFASSMGNISFFFPKARQGSALGINGGLGNLGVSVMQLLAPLVIFLPIFTFLGVRGVPQPDGSLLALTNAAWIWVPLLAVATLAAWFGMNGIGSSKASVASQLPVLKRLHLWLLSLLYLATFGSFIGFSAGFAMLAKTQFPDVNILQLAFFGPFIGALARSAGGVISDKFGGVRVTLINFIFMALFTALLFLTLPGSGAGSFSAFYLVFMGLFLTAGLGSGSTFQMIAVIFRQITLYNVKLRGGSDEQAQREAVTDTAAALGFISAIGAVGGFFIPKAFGTSLALTGSPVGAMKIFLLFYIACVLLTWLVYGRRKPKQQ

SEQ ID NO: 28434 - DNA, 1332 bp, Idiomarina loihiensis L2TR
  CDS (1)..(1332): transl_table=11
atgggtaaagtttcgcaagcgaatacaatgagcgatgttcgtgattacctcggttctcgcgcgctttcccgtgggttaacgctgagtgtgttattgcttggtgtcacattttgggcaagctggagcgttatcgttgtattactggcaaaatcaaaccttaacttaagcccggttcagttgctgtcattagtcgctattgctggggcaagcggtgctgtgtccaagttgttaggaactttgctagtcaatatcctcggacgatggatgcctacagttattgccactcttatgctgttaatgagtattatcagttatgtgcaattttcagctgtgcagctgagctatcctatattggttgctttagctgcggggtcaggcatgggctgcatgatgtttgcgcctgcattcgacttaacccgccagtcaaaggtcatgatccccttgccgttgtccatgagcctggttatcggcatgatgatattctctctgtttttagctcagctggttgtgcctctgctggctacctggcagttagctgcggtagattccgctctcatactcgagcgcagcagtggtcattttttcgctcgcatcgaggccggccagactattttgctaaacaatttcagttttgtctgggctattctttttggcctgacagccattttgagcgccgcggctgctttattgtcaaaccacaaacagtcattacccaaagtcactttaagaaagctgctggctcacaatggtcacgtctggtattgcagtattctgtacaacatgacgtttggtagctttattggctttactatggcattgccactgatgctggaatttgtgtttggttacagcaccttaattctggtttggatggggccttttattgctctgttagccaggcctttcggacgttggctggcgactatttttggtggcgctctgataacgcaagtgagtctgttactgatgatgatatttggggctttggctggccgctacatgtattttgctcaacatggtgccactgaactctactttgagcctttcttcatcagcatgctgggactgatttttaccagcgccttggggaacggttcagtcgttgtcagtatgaccaaagtctttcccagaacttatactcacagagtgttaatttgggcgggcactatcgctatgctgggcgcggtttatttgcccttgcgctttgcctgggctttgcagtcgcaaaacatggacaccgtttatatcgacttcattgttttctatgttatcgggctcttgttaaacggttttgtctatttgcgccgacgcggccagttctataacccttaa

SEQ ID NO: 28435 - protein, 443 aa, Idiomarina loihiensis L2TR
MGKVSQANTMSDVRDYLGSRALSRGLTLSVLLLGVTFWASWSVIVVLLAKSNLNLSPVQLLSLVAIAGASGAVSKLLGTLLVNILGRWMPTVIATLMLLMSIISYVQFSAVQLSYPILVALAAGSGMGCMMFAPAFDLTRQSKVMIPLPLSMSLVIGMMIFSLFLAQLVVPLLATWQLAAVDSALILERSSGHFFARIEAGQTILLNNFSFVWAILFGLTAILSAAAALLSNHKQSLPKVTLRKLLAHNGHVWYCSILYNMTFGSFIGFTMALPLMLEFVFGYSTLILVWMGPFIALLARPFGRWLATIFGGALITQVSLLLMMIFGALAGRYMYFAQHGATELYFEPFFISMLGLIFTSALGNGSVVVSMTKVFPRTYTHRVLIWAGTIAMLGAVYLPLRFAWALQSQNMDTVYIDFIVFYVIGLLLNGFVYLRRRGQFYNP

SEQ ID NO: 28436 - DNA, 1692 bp, Azoarcus sp. EbN1
  CDS (1)..(1692): transl_table=11
atgtcacctgcaaaactgcgtccgattaccgcgactccgggagctgccggcgtaagtccgggagagcgtccgcgcggtccggacatcgccgaatggcatcccgaggatgcgcagttctgggcgcgcgaaggcagccgcattgcgaaccgcaacctgtggatctcgatccccagcctgctctgtggcttcgcggtgtggttgatgtggggcatcatcaccgtgcagatggccaatgcaggcttccccttcacgcctgaccagctgttctcgatagcggcaatttccggcctgtccggcgcgacgctgcgcatcccggcgtcgttcttcatccggctctgcggcggtcgcaacacggtgtggctgacgaccgtgctgctgatcatcccggccctcggcaccggcattgcgctgcaggacaagaacactccgctgtgggtcttccagctgatggcgctgctgtcgggcatcggcggcggcaacttcgcctgttcgatggcgaacatcagcaccttcttcccgaagcgcctgcagggcacggcgctggggctgaacgccggtctcggcaacttcggcgtcacgacctcgcagatcctgatccccgcagtgatgacgctgggcctgttcggcgcaatcggcggcgacgcgatcccgctcgcgaaggattcggcgacgctgatcgggaagatcgccgccggcaccccgactttcgtgcagaacgccggcttcgtgtggctgctgctgctcgtgccactcgccgtgatcggctggttcggcctgaacaacctcaaggtcgtatcgccgaacaccggctcgaccggcgtggcgatgggccgcatcctgctgatgtacggtatcgcgctcgccgtctccggcatcggcctgtacctctacctgccgacccccaacggctccggactgctcgccggcaacggcatgtggatcgtgttgccgctggtgatcttcggcacgctgttcgccctcaaggcggtcgcgaccggcgaaatgaagacgaacctgaacaagcagttcgccatcttcggcaacaagcacacctggtcgatgactgcgctctacgttgtgactttcggctcgttcatcggcttctcgatggcgctgccgctgtcgatcacggtgatcttcggcaacacgcacgtgttcgatccggcggcaaatgtctgggtgcatgcgaagaacccgaacgcgccctccgcgctgatgtacgcatggatcggccccttcgtcggcgccctgatccgaccggtcggtggctggatctccgacaagctcggcggctcgatcgtcactcaggtgatctcggtcgtgctggtcggcgcatcggcagtgaccggctacgtgatgcatctcgcctaccagtcggccacgcccgagagctacttcctcgccttcatgctgcttttcatcctgctgttcgccgcctcgggcatcggcaacggctcgaccttccgcaccgtcggcttcgtcttcgaccaggaccagcgcggcccggtgctcggctggacctcggcggtcgcggcctacggttccttcatcgcgccggtcgtcatcggcgggcagatcaaggccggcacgccggaaaacgcgatgtacggcttcgccgtgttctacgcggcgtgtctcgtcctcaactggtggttctatctgcggaagaacgcctacatccgcaacccctga

SEQ ID NO: 28437 - protein, 563 aa, Azoarcus sp. EbN1
MSPAKLRPITATPGAAGVSPGERPRGPDIAEWHPEDAQFWAREGSRIANRNLWISIPSLLCGFAVWLMWGIITVQMANAGFPFTPDQLFSIAAISGLSGATLRIPASFFIRLCGGRNTVWLTTVLLIIPALGTGIALQDKNTPLWVFQLMALLSGIGGGNFACSMANISTFFPKRLQGTALGLNAGLGNFGVTTSQILIPAVMTLGLFGAIGGDAIPLAKDSATLIGKIAAGTPTFVQNAGFVWLLLLVPLAVIGWFGLNNLKVVSPNTGSTGVAMGRILLMYGIALAVSGIGLYLYLPTPNGSGLLAGNGMWIVLPLVIFGTLFALKAVATGEMKTNLNKQFAIFGNKHTWSMTALYVVTFGSFIGFSMALPLSITVIFGNTHVFDPAANVWVHAKNPNAPSALMYAWIGPFVGALIRPVGGWISDKLGGSIVTQVISVVLVGASAVTGYVMHLAYQSATPESYFLAFMLLFILLFAASGIGNGSTFRTVGFVFDQDQRGPVLGWTSAVAAYGSFIAPVVIGGQIKAGTPENAMYGFAVFYAACLVLNWWFYLRKNAYIRNP

SEQ ID NO: 28438 - DNA, 1377 bp, Azoarcus sp. EbN1
  CDS (1)..(1377): transl_table=11
atgcttttggcgaatggcgggcagcttccgcaaggcatacgcttcgtcccggcctggagcgatctccgctccacattcgaggatggaaggaacatgccctcacaacgtcaaaagcagttctccgttctgctgatgagcaccacggcattcacaatgtgctttgccgcgtggatgctgttcgccgtgatcgggatcccgatcaaggcgcagttgggcctcaatgaaacccagttcggcctgctcgcggcgactcccgtgctgaccgggtcgctggtacgtctgccgttgggactgttgaccgacaagctcggcggccgggtggtgttcttcctgctgatgctggcggcggtcgtgccgatctacctgatcggcgaggcaacgcaatactggcagttcctggtcgccggcctcttcgtcggcctcatcggcggttcgttctcggtcggcatcgcatactgcgcgcgctggttcgagcgcaagaaccagggtttcgcaatgggcgtgttcggcgccggcaactcgggcgccgccctgacgaagttcgtcgccccggcgctggtcgttgcctacggctggcagttcgtgccgaaggcattcgcggtcgcgatgctgatcatcgcgatcgcgttctggttcttcacttacgacgatccgaagcaccgcgtctcgtcgagcgtgaagttctccgaccagttgcgcgtgctgaagaatccgcgcgtgtggaaatactgtcagtactactcgatcgttttcggcggctatgtcgcgctggcgctgtggatgacgaagtactacgtcgcggaattcggcctcggcctcgagacggcagcgctgctggcggcctgtttctcgttgcccggcggcgtgctgcgcgcggtcggcggctggttctcggaccgcttcggcgcccacaaggtcacctggtgggtgatgtgggtgtcctgggtgtgcctgttcctgctgtcgtacccgcacaccgaattcacgatcatgacggtagccggcccgaagactttcgcgatccatcacaacatctggttcttcaccgtgctgatgttcaccgtcggcgtcgcctgggcgttcggcaaggcctcggtgttcaagtacatctcggacgagttcccgcacgacatcggcgcggtgtcgggaatcgtcggcctcgtcggcgggctgggcggcttcctgctgccgatcatgttcggcgcgctcctcgacctgaccggcgtgcgctcgagcgcgttcatgctgctctacggcgtcacctgggtttcgctgatctggatgtactggaccgaagtgcgccgcaccgacgtgatgcacggcggcgaagcggatgtgctgcatggcggcaccgcgcccgtgaccgcaacgaagtga

SEQ ID NO: 28439 - protein, 458 aa, Azoarcus sp. EbN1
MLLANGGQLPQGIRFVPAWSDLRSTFEDGRNMPSQRQKQFSVLLMSTTAFTMCFAAWMLFAVIGIPIKAQLGLNETQFGLLAATPVLTGSLVRLPLGLLTDKLGGRVVFFLLMLAAVVPIYLIGEATQYWQFLVAGLFVGLIGGSFSVGIAYCARWFERKNQGFAMGVFGAGNSGAALTKFVAPALVVAYGWQFVPKAFAVAMLIIAIAFWFFTYDDPKHRVSSSVKFSDQLRVLKNPRVWKYCQYYSIVFGGYVALALWMTKYYVAEFGLGLETAALLAACFSLPGGVLRAVGGWFSDRFGAHKVTWWVMWVSWVCLFLLSYPHTEFTIMTVAGPKTFAIHHNIWFFTVLMFTVGVAWAFGKASVFKYISDEFPHDIGAVSGIVGLVGGLGGFLLPIMFGALLDLTGVRSSAFMLLYGVTWVSLIWMYWTEVRRTDVMHGGEADVLHGGTAPVTATK

SEQ ID NO: 28440 - DNA, 1509 bp, Bacillus clausii KSM-K16
  CDS (1)..(1509): transl_table=11
atgatcaataagctgcagctaccgctgcaaacgatgaatctagtactagggtttatggtgtgggtaatcatctcggcgctgttgccctttatacaggaagatattgcaattcccgccgatcgggttgctatcttaaccgcaatccctgttgttcttggatcggttctacggattcctctcggctattacgccaacgtcgtgggcgcgcgaatggtgtttatcactagttttattctgctattgtttccggtttactttatcagcatcgcgacaagttttacccatctcgtggtcgggggattgtttcttggtatcggaggagcggtgttttcggtgggggtcacttcgttacctaaataccatctgaaggaaaagctaggtctagtaaacggcatatatggaatgggcaatttggggacggcgatcacgacatttgcagcgccagtaattgctacgcagatcggctggtcagctaccgtccaactatacttaattttgctgctggtatttgttgccctaaacgccgtcttcggcgaccgcaaagaaacgaaagtcaaaaccccgattatggaacaggtcaagggtgtatataaaaacgacaaattatggtatttctcactcttttatttcattacgtttggctcttttgtggccttcactgtctatttgccgaattttttggtcagtcacttcgagctgccgaaagtggatgcagggctgcggaccgcaggctttatcttgattgcaacgtttctccgtcccgttggagggtggcttgccgataaattcaagcctttgtttttgctaatgggggtatttatcggtatgacattggcggcggtggtgctggctttttccccatcactcgctttgtatacggttggatgtctgacgatagccgtttgtgcaggtcttggcaacggcattatttttaagttggtgccgttttattttaataaacaagcaggcattgtcaatggaatcgtatcgatgatgggcggtttgggtggatttttcccgccgttgatgctctcgttcatccattcagtgacaggtcaatactcgattggattcatggctttatcgcaggttgcgctcgccagctttgtgctagtcgtatggatgtattatcaggacaaattgactgttgcttcccaagtgttcaactcgactgggcaaggcattttggtgactgatgctaaaaagcgcatacatgctgtgaatcccgcctttacgagattgacgggttacgaagaagaggaagtattgggcaggaatccaaacttgcttaaatcagggcggcaatcatcggcattttatcagatcatgtggacggaaattatggagaagggcagctggcagggtgaaatttggaaccgcagaaagaatggggaagagtatctcgaactgttaaccatcaatgctgtaaaggacgaaaccggggacatcgttcattatgtcggcaccttcagcgatattacagatcaccccccaaggaagcacgcctga

SEQ ID NO: 28441 - protein, 502 aa, Bacillus clausii KSM-K16
MINKLQLPLQTMNLVLGFMVWVIISALLPFIQEDIAIPADRVAILTAIPVVLGSVLRIPLGYYANVVGARMVFITSFILLLFPVYFISIATSFTHLVVGGLFLGIGGAVFSVGVTSLPKYHLKEKLGLVNGIYGMGNLGTAITTFAAPVIATQIGWSATVQLYLILLLVFVALNAVFGDRKETKVKTPIMEQVKGVYKNDKLWYFSLFYFITFGSFVAFTVYLPNFLVSHFELPKVDAGLRTAGFILIATFLRPVGGWLADKFKPLFLLMGVFIGMTLAAVVLAFSPSLALYTVGCLTIAVCAGLGNGIIFKLVPFYFNKQAGIVNGIVSMMGGLGGFFPPLMLSFIHSVTGQYSIGFMALSQVALASFVLVVWMYYQDKLTVASQVFNSTGQGILVTDAKKRIHAVNPAFTRLTGYEEEEVLGRNPNLLKSGRQSSAFYQIMWTEIMEKGSWQGEIWNRRKNGEEYLELLTINAVKDETGDIVHYVGTFSDITDHPPRKHA

SEQ ID NO: 28442 - DNA, 1206 bp, Bacillus clausii KSM-K16
  CDS (1)..(1206): transl_table=11
atgaaactttctgagttacgcaaaagcgggcatgcgccttcgttgttttccgcttttttatatttcgatgtaagctttatgatttgggtattgcttggtgcccttggcgcatacattactgctgattttggcttgagtgcttcacaaattgggttcattgtcgggattccgattttagcaggctctgttttccgcatccttgttggcattttgacagatcgttatgggccaaaaaagacgagcatagcaggcatggttgtaacgatggtaccgctgttgtggggctggctatttggtacgagcttgtcagaattgatcgcgatcgggctgctgcttggcgttgcgggtgctagtttttctgcttcgctgccaatggctagccggtggtacccccctcatttacaaggagtagcaatgggcatagcaggagccggaaatagtggtaccttatttgctacattgttcgggccaaggctggcagaaattgttggttggaatggggtgatgggactagcgcttattcctctttcccttgtgctcatctcttacatcctgatggcgaaggagccaccaaaccagccagctccaaagccgttaaaagcgtatttccgtgtattccaagagcgtgatacatggtacttttgcttgctttacagtgttacatttggtggatttgtaggcttgtcaagctttttaagctatttctttgtaaaccagtatgctgtttcaggggtcagagcaggggagtttgtcacacttgtcgttgctgccggcagcttattgcgcccaattggcgggttgattgcagacaaaattggcggtgctcgcttgcttactgtgctttttgttggcgtagccctttgtatgtttgccgttagttttctcccgccgattgcgtttgctcttactgtgttatttataggcatgggctgcctcggcatgggcaacggtgctgtgtttcaacttgtcccgcagcgtttccataaagaaatcggcatggtaactggcatcgttggagctgctggaggcgttggcggctttttcttgccaaatattctcggcttgtttaaggatataacggggacgtacgctagcggatttcttctgttcgccctttctgcctgtttcgcccttgggctgttactgtttgctcagcactcatggaagaaggcgtggacagagacaaagcagacgacgtctatttaa

SEQ ID NO: 28443 - protein, 401 aa, Bacillus clausii KSM-K16
MKLSELRKSGHAPSLFSAFLYFDVSFMIWVLLGALGAYITADFGLSASQIGFIVGIPILAGSVFRILVGILTDRYGPKKTSIAGMVVTMVPLLWGWLFGTSLSELIAIGLLLGVAGASFSASLPMASRWYPPHLQGVAMGIAGAGNSGTLFATLFGPRLAEIVGWNGVMGLALIPLSLVLISYILMAKEPPNQPAPKPLKAYFRVFQERDTWYFCLLYSVTFGGFVGLSSFLSYFFVNQYAVSGVRAGEFVTLVVAAGSLLRPIGGLIADKIGGARLLTVLFVGVALCMFAVSFLPPIAFALTVLFIGMGCLGMGNGAVFQLVPQRFHKEIGMVTGIVGAAGGVGGFFLPNILGLFKDITGTYASGFLLFALSACFALGLLLFAQHSWKKAWTETKQTTSI

SEQ ID NO: 28444 - DNA, 1164 bp, Staphylococcus epidermidis RP62A
  CDS (1)..(1164): transl_table=11
atgaacatgaaaaagggtgtttctcagcttacgttacagacattgagtttggtcgcaggctttatggcatggagtatcatttctccattaatgccatttatttcacaagatgttgatatttctccaggacaaatatctgtcattttagctattcctgttattttaggttctgtactacgtgtaccatttgggtacttaactaacattgtaggagcgaaatgggtgtttttctggagttttattgtactattacttccaatttttcttttaggtcaagctcaatcacccggtatgctaatgttatcaggattctttctaggaattggtggcgcaattttttcagtaggtgttacttcagtacctaaatacttttcaaaagacaaagttggtttagcaaatggtatatatggtgtaggtaatattggtactgcagtttcatcattttgtgccccagtgttagcaggtgcaattggctggcaaaatacagttcgtagttatttaattattctaagtatatttgcaattttaatgttttttttaggagataaaaatgagccgaaagtgaagattcctttgatggctcaagtcaaagacctatctaagaattataagttgtattatttaagtttgtggtattttattacttttggagcttttgtggcttttgggatttttttaccgaactttctagttgatcattttagtattgataaagtggatgcaggtattcgttcaggtatatttatagcactagcgacgttcttaagaccggttggtggtgttataggtgataaatttaatgcagtacaagcgcttatcatcgacttcgtgataatgattattggtgcgcttatattaagcttatctagtcatattgttctgtttacgataggctgtttagcaattagtatctgtgcaggtataggtaatggtttaatatttaaattagcaccttcatacttttctaaagaagcaggttcagcgaatggtattgtatccatgatgggaggactaggcggtttcttcccaccactggtgattacttttgtaacgagtatcactggttcaagtcatctcgctttcttcttcttggctatatttggtgtaattgctcttattacaatgattcatttaaataaaaaagagaaagctattcgtatataa

SEQ ID NO: 28445 - protein, 387 aa, Staphylococcus epidermidis RP62A
MNMKKGVSQLTLQTLSLVAGFMAWSIISPLMPFISQDVDISPGQISVILAIPVILGSVLRVPFGYLTNIVGAKWVFFWSFIVLLLPIFLLGQAQSPGMLMLSGFFLGIGGAIFSVGVTSVPKYFSKDKVGLANGIYGVGNIGTAVSSFCAPVLAGAIGWQNTVRSYLIILSIFAILMFFLGDKNEPKVKIPLMAQVKDLSKNYKLYYLSLWYFITFGAFVAFGIFLPNFLVDHFSIDKVDAGIRSGIFIALATFLRPVGGVIGDKFNAVQALIIDFVIMIIGALILSLSSHIVLFTIGCLAISICAGIGNGLIFKLAPSYFSKEAGSANGIVSMMGGLGGFFPPLVITFVTSITGSSHLAFFFLAIFGVIALITMIHLNKKEKAIRI

SEQ ID NO: 28446 - DNA, 1389 bp, Salmonella enterica subsp. enterica serovar Choleraesuis str
  CDS (1)..(1389): transl_table=11
atgacacgacaaaacgagaattataaccgttatctcttgagtgactggcgacccgaaaatccagccttctggaagaataaagggaaaggcatcgccagaagaaacttatgtatttcagtaagttgtttgctccttgcattttgcgtctggatgttgtttagcgctgttgccgtcaacctcaataaaattggatttaattttaccaccgaccaactctttttattaaccgcactaccttctctttccggcgcaatattacgcgttccctactcctttatggtaccactgtttggtggccgtaaatggaccgtattaagtaccgtaatattgattattccctgcgcctggctgggattcgccgtgcaaaatcctgccacccctttcggggtatttatgctcatcgctctgttgtgcggttttgcgggggcaaacttcgcgtccagtatgggcaacatcagttttttctttccaaaagccagacaaggtagcgcgttgggtattaacggcggactgggaaatcttggcgtcagtgtgatgcagttgattgcgccgctggttatttttctgccgatatttacttttttaggcgtccggagcgtgccgcaacctgatggctccctgctcgccctcactaacgcagcctggatctgggtgccgttactggctgtcgcgacgcttgccgcctggtttggtatgaacgatatcggcagttcaaaagcgtctgtcgcctcgcaattgccggtgctaaaacgtctgcacctgtggctgcttagcctgttgtacctggcgacattcgggtcattcatcggcttttccgcaggtttcgccatgctcgccaaaacgcaatttcccgacgtaaacattctgcaactggcgttctttggcccctttatcggcgcgctggcgcgatcggcaggcggcgtgatctccgataaattcggcggcgttcgcgtcacgctcattaattttatttttatggcgctgtttaccgccctgctattcctcacgctgccaggctccggcgcaggcagctttagcgcgttctatcttgtttttatgggcctgtttttgacagcgggtctcggcagcggttctaccttccagatgattgcggtgatcttccggcagatcacgctctacaacgtcaaactgcgcggcgggagcgatgagcaggcgcagcgcgaagcggtgacggataccgccgccgcgctcggttttatctccgctattggcgctgtgggcggcttctttattccaaaagcgtttggcacctctttggccttgaccggctcgccggtgggcgccatgaaaatctttttgctgttttacatcgcttgcgtcctgctgacctggctggtctacgggcgtcgtaagcctaaacaacaataa

SEQ ID NO: 28447 - protein, 462 aa, Salmonella enterica subsp. enterica serovar Choleraesuis str
MTRQNENYNRYLLSDWRPENPAFWKNKGKGIARRNLCISVSCLLLAFCVWMLFSAVAVNLNKIGFNFTTDQLFLLTALPSLSGAILRVPYSFMVPLFGGRKWTVLSTVILIIPCAWLGFAVQNPATPFGVFMLIALLCGFAGANFASSMGNISFFFPKARQGSALGINGGLGNLGVSVMQLIAPLVIFLPIFTFLGVRSVPQPDGSLLALTNAAWIWVPLLAVATLAAWFGMNDIGSSKASVASQLPVLKRLHLWLLSLLYLATFGSFIGFSAGFAMLAKTQFPDVNILQLAFFGPFIGALARSAGGVISDKFGGVRVTLINFIFMALFTALLFLTLPGSGAGSFSAFYLVFMGLFLTAGLGSGSTFQMIAVIFRQITLYNVKLRGGSDEQAQREAVTDTAAALGFISAIGAVGGFFIPKAFGTSLALTGSPVGAMKIFLLFYIACVLLTWLVYGRRKPKQQ

SEQ ID NO: 28448 - DNA, 1212 bp, Pseudomonas syringae pv. syringae B728a
  CDS (1)..(1212): transl_table=11
atggatacaagcttctggaaggcaggccacaaaccgaccctgttcgcggcctttctctatttcgacctgagtttcatggtctggtacctgcttggtccgctggcggtgcagattgccactgacctgcagctgaccactcagcaacgtggcctgatggtcgccacaccgattctggcgggtgcggtgctgcgcttcttcatgggcctgctggccgaccagctgtcgcccaagaccgccgggatcatcggccaggtgatcgtcatcggcgcgctgctggctgcctggcaactgggcattcacacctacggccaggtgctggtgctgggtgtgttcctcggtatggccggtgcttcgttcgccgtcgcgctgcccctggcgtcgcaatggtatccagcgcagcatcagggcaaggccatgggcatcgccggtgcgggcaattccggcactgtactggccgcgctgatcgcgccggtgctggccgccagtttcggttggagcaacgtcttcggcctggcgctgattccgctggtcctgaccctgatcgccttcaccctgatggcacgcaacgccccgcaacgcagcaaacccaaatccatggcggactacctcaaggcgctgggtgatcgtgacagctggtggttcatgtttttctacagcgtgacgttcggtggtttcattggcctggccagcgccctgcccggctatttcaacgaccaatacggtttgagcccgatcactgccggttactacaccgctgcctgcgtcttcggcggcagcctgatgcgtccgctgggtggcgcgctggccgaccgtttcggcgggattcgcacgctgaccgtgatgtatgcggttgccgccatcggcatcgccgccgtgggcttcaacctgccaagttcgtgggcagcactggcgctgttcgtggccgccatgctgggcctgggggccggcaacggcgcggtattccagctggtaccgcagcgcttccgcaaggaaatcggggtcatgaccggcctgatcggcatggcgggtggcatcggtggtttcctgctggcagccggcctgggcaccatcaaacagaacaccggcgactaccaactgggcctgtggctgttcgccggcttggcggtactggcctggttcggcctgctgaacgtcaagcgtcgctggagaaccacctggggttcggccgcagtcacggcggctcgggtctga

SEQ ID NO: 28449 - protein, 403 aa, Pseudomonas syringae pv. syringae B728a
MDTSFWKAGHKPTLFAAFLYFDLSFMVWYLLGPLAVQIATDLQLTTQQRGLMVATPILAGAVLRFFMGLLADQLSPKTAGIIGQVIVIGALLAAWQLGIHTYGQVLVLGVFLGMAGASFAVALPLASQWYPAQHQGKAMGIAGAGNSGTVLAALIAPVLAASFGWSNVFGLALIPLVLTLIAFTLMARNAPQRSKPKSMADYLKALGDRDSWWFMFFYSVTFGGFIGLASALPGYFNDQYGLSPITAGYYTAACVFGGSLMRPLGGALADRFGGIRTLTVMYAVAAIGIAAVGFNLPSSWAALALFVAAMLGLGAGNGAVFQLVPQRFRKEIGVMTGLIGMAGGIGGFLLAAGLGTIKQNTGDYQLGLWLFAGLAVLAWFGLLNVKRRWRTTWGSAAVTAARV

SEQ ID NO: 28450 - DNA, 1158 bp, Staphylococcus haemolyticus JCSC1435
  CDS (1)..(1158): transl_table=11
atgtataagacaaaaggtggctttcaacttaccttacaaacgttaagtcttgtagtgggtttcatggcatggagtattatatctccgttaatgccatatatctctcaagatgttaaagttaatcctggacagttatctattatattggcaattccagtaatattaggttcaattttacgtgtgccattcggttatttaactaatattattggtgcgaaatgggtattcttttgtagttttgttatattattatttcctatcttctttttagggcaagcacaaacaccaggaatgttaatgttatctggattctttttaggtgttggaggtgcgatattctctgtaggtgtgacatctgtacctaaatatttttcaaaagataaagtagggcttgctaatggaatttatggtatgggtaacatcggtacggcagtatcttcatttttagcaccacctattgcaggtattataggttggcaaacgacggtaagaagttatttaattatcattgctattttcgcaattttaatgttcatttttggtgataaaaatgaaccaaaagtgaaagtacctttagcatctcagtttaaaaaattatcatcaaattataagttatattacttaagtctttggtattttattacgtttggtgcttttgtagcatttggattattcttacctaactacttagtaaataactttggcattgataaagttgatgcaggtattcggtcaggtgtattcattgctttagcaactttcttaagaccaattggcggtatacttggagataaatttaatgctgtgaaagtactaatgatcgattttattattatgattgtaggtgctgttattttaggaatttcaagtcatattgctttatttactatcggttgtttaactatcagtatctgtgctggtttaggtaatggtttaatatttaaacttgtaccttcttacttcgcaaaagaatctggtgcagctaatggtattgtttctatgatgggtggtttaggaggattcttcccacctttagttattacttatgtaacaggtctaactggttcaagtcatttagcatttattcttttagcaatatttggtgtcttagcatttattaccatgggacacttatataaaaaagaatatgcaaaataa

SEQ ID NO: 28451 - protein, 385 aa, Staphylococcus haemolyticus JCSC1435
MYKTKGGFQLTLQTLSLVVGFMAWSIISPLMPYISQDVKVNPGQLSIILAIPVILGSILRVPFGYLTNIIGAKWVFFCSFVILLFPIFFLGQAQTPGMLMLSGFFLGVGGAIFSVGVTSVPKYFSKDKVGLANGIYGMGNIGTAVSSFLAPPIAGIIGWQTTVRSYLIIIAIFAILMFIFGDKNEPKVKVPLASQFKKLSSNYKLYYLSLWYFITFGAFVAFGLFLPNYLVNNFGIDKVDAGIRSGVFIALATFLRPIGGILGDKFNAVKVLMIDFIIMIVGAVILGISSHIALFTIGCLTISICAGLGNGLIFKLVPSYFAKESGAANGIVSMMGGLGGFFPPLVITYVTGLTGSSHLAFILLAIFGVLAFITMGHLYKKEYAK

SEQ ID NO: 28452 - DNA, 1380 bp, Psychrobacter arcticum 273-4
  CDS (1)..(1380): transl_table=11
atgggcagtaatgacaattttaaaggtggtaagctcatcactgactggcgtcctgaaatggaagagttttgggaaagtagcggcaaaaaagtcgcccgtcgcaatttatggatatctataccggccttactgctggcttttgcggtatggatggtatggagtgcggtcatcgttcgcttgccagagataggttttggatttgatagaggtcagcttttttggttggcggctctaccaggcctatcaggggcgacactgcggattttttattcttttatggtgcctatatttggtggacggcgctggacagctatctccactgcatcgttattgattccggcattatggatggggtttgccgttcaaaaccctgataccccgttcattatattcgccattattgcgctactttgcggcttcggcggcggcaattttgcctcttctatgtccaatatttcgttcttttatccaaaatctgaacaaggtaccgcactgggcctcaatgccggtcttggtaatctaggcgtgtccgttatgcagtttgtggtgccggtggtcatcctatttgcggcgttcggtagcttaggcggcgatccgcagatttccggttcaggccaacagttctatctacaaaatgcgggctttatttggataccttttattctgctattctcagtgttagcttggtttggaatgaatgatattgctacttccaaagcctcctttaaagatcaatctgttatctttaaacgtaagcacaactggatcatgtgcattctttacatggcaacctttggttcattcattggtttttctgccgcgtttcctatgttgattaagaactcgttccctgccatagacgccctgaaatttgcctttttaggtcccttggtaggcgcgcttttccggcctttaggaggttggatatctgataaagtaggcggcgctagagtcacgttttggaattacattgtgatggtgttggcagtactggctgtcatgtacttcttacccagtgagagcaatgaaggcagctttgtcggatacttcatctccttcatggtgctatttattactaccggcatcggtaacggctctacctttaccatgattccggttatttttagaacctttcatgagcgacgtgcaccggagaaggtgggagcagagtcactgttcgtagagatacgtaaagagtccgcagcggtggttggttttacctcggctatcgcggcttatggcgctttctttattcctaaaatgtttggatcgggcttaggagtctttggcacttttatcgctttaattattttttatatcatttgtatcgtattgacttggtggtattacagccgtggaaacgcagaatatccttgttag

SEQ ID NO: 28453 - protein, 459 aa, Psychrobacter arcticum 273-4
MGSNDNFKGGKLITDWRPEMEEFWESSGKKVARRNLWISIPALLLAFAVWMVWSAVIVRLPEIGFGFDRGQLFWLAALPGLSGATLRIFYSFMVPIFGGRRWTAISTASLLIPALWMGFAVQNPDTPFIIFAIIALLCGFGGGNFASSMSNISFFYPKSEQGTALGLNAGLGNLGVSVMQFVVPVVILFAAFGSLGGDPQISGSGQQFYLQNAGFIWIPFILLFSVLAWFGMNDIATSKASFKDQSVIFKRKHNWIMCILYMATFGSFIGFSAAFPMLIKNSFPAIDALKFAFLGPLVGALFRPLGGWISDKVGGARVTFWNYIVMVLAVLAVMYFLPSESNEGSFVGYFISFMVLFITTGIGNGSTFTMIPVIFRTFHERRAPEKVGAESLFVEIRKESAAVVGFTSAIAAYGAFFIPKMFGSGLGVFGTFIALIIFYIICIVLTWWYYSRGNAEYPC

SEQ ID NO: 28454 - DNA, 1212 bp, Pseudomonas syringae pv. phaseolicola 1448A
  CDS (1)..(1212): transl_table=11
atggatacaagcttctggaaggcaggccataaaccgaccctgtttgcggcgtttctctatttcgacctgagtttcatggtctggtacctgcttggcccgctggcggtgcagattgccactgacctgcacctgaccactcagcaacgtggcctgatggtcgccacgccgattctggcgggtgccgtgctgcgctttttcatgggcctgctggcggaccagctgtcgcccaagaccgcaggcatcattggccaggtgattgtcatcggcgcactgctggcggcctggcaactgggcattcacacctacggtcaggtactgctgctgggcctgttcctgggtatggccggtgcttcattcgccgtcgcgctgcccctggcgtcgcaatggtatccaccgcagcaccaaggcaaggcgatgggcatagccggtgcgggcaactcgggcaccgtactggcagcattgatcgcgccggtactggccgccagtttcggctggggcaacgtattcggcctggcgctgatcccgctggttctgaccctgatcgctttcacgcttatggcgcgcaacgccccggagcgcagcaagcccaaatccatggcggattacctaaaggcgctgggtgatcgtgacagctggtggttcatgtttttctacagcgtgacgttcggcggcttcatcggcctggccagcgccctgcccggctatttcaacgaccaatatggcttgagcccgattactgccggttactacaccgctgcctgtgtcttcggcggcagcctgatgcgccctctcggtggcgcgctggctgaccgctttggcgggattcgcacattgaccgtgatgtacgccgttgcggccatcggtatcgcggcggtgggtttcaacctgccaagttcgtgggcagcactggctctgttcgttgccgcgatgctgggcctgggtgccggtaatggcgcagtctttcagctggttccgcagcgtttccgcaaggaaatcggggtcatgaccggcctgatcggcatggctggcggcatcggtggcttcctgctggcagcgggtctgggcaccatcaaacagaacactggcgattaccagttgggcctgtggctgttcgcaggcctggcagtgctggcctggttcggtctgctgaacgtcaagcgtcgctggagaaccacctggggttcggcggctgtgaccgcggcgcgagtctga

SEQ ID NO: 28455 - protein, 403 aa, Pseudomonas syringae pv. phaseolicola 1448A
MDTSFWKAGHKPTLFAAFLYFDLSFMVWYLLGPLAVQIATDLHLTTQQRGLMVATPILAGAVLRFFMGLLADQLSPKTAGIIGQVIVIGALLAAWQLGIHTYGQVLLLGLFLGMAGASFAVALPLASQWYPPQHQGKAMGIAGAGNSGTVLAALIAPVLAASFGWGNVFGLALIPLVLTLIAFTLMARNAPERSKPKSMADYLKALGDRDSWWFMFFYSVTFGGFIGLASALPGYFNDQYGLSPITAGYYTAACVFGGSLMRPLGGALADRFGGIRTLTVMYAVAAIGIAAVGFNLPSSWAALALFVAAMLGLGAGNGAVFQLVPQRFRKEIGVMTGLIGMAGGIGGFLLAAGLGTIKQNTGDYQLGLWLFAGLAVLAWFGLLNVKRRWRTTWGSAAVTAARV

SEQ ID NO: 28456 - DNA, 1215 bp, Dechloromonas aromatica RCB
  CDS (1)..(1215): transl_table=11
atggacaagaaatcattcctgcaggccggccacacgccgactttgctcgcggccttcctctacttcgatctggctttcatggtctgggtgctgctcgggcccctcggtatcagtattgccaaggatctgggcctgtcgcatgccgaaaagggcatgatggtggcgacgccggtgctggccggtgcgctgctgcgcatcatcatgggcatcctggttgatcgcctgtcgccgaagaaggcggccatcatcgggcaggtcgtggtcatcgcgaccatgatctatgcctggcaggtcggcgtgcattcctacgctgaagtgctgatcctcggactcttcctcggtgttgctggcgcttccttcgctgccgcgctgccgctggcttcgcgctggtatccggccgagcatcagggcacagcgatggggattgccggagccggcaactccggaacggcgctcgctgccttgtttgccccggggctggcggccgccttcggctgggtcaatgtcttcggtgtcgtgctgattccattggtcattgtgctgatcgctttcatcttcatggccaaggatgcaccggatgcgccgccgcccaagacctttgccgagtacctgaaagtcctcaaggacaaggatgcctggtggttcatgttcttctactcggtgaccttcggcggctttgtcggcctggcttcgtcgctggtcatctacttcaacacccagtacggccttgatccgaagatggcgggctactttactgccggctgtgtctttgccggttcgctggttcgcccgattggcggcaacgtggctgatcgcatcggcggcgtgaagtcgctgaccgtgatgtacatgtttgcggctttgttcctgtccatcgtcagctttggcctgccggaggcctggatggcgctgctcgtcttcgtcggtgccatgctctcgctgggcatgggcaacggtgccgtgttccagttggtgccgcagcgcttccgcaaggaaatcggcgtgatgaccggtctggttggcatggccggcggtgtcggtggtttctacctggcctccagcctcggttattccaagcaactgaccggcagctaccaggctggcttcctgatctttgcctcgctggcagtgctggccttgcttggcctgaccggtgtcaagacccgctggcgtaccacctggggcgccagtcacctgacggcggccaagatctga

SEQ ID NO: 28457 - protein, 404 aa, Dechloromonas aromatica RCB
MDKKSFLQAGHTPTLLAAFLYFDLAFMVWVLLGPLGISIAKDLGLSHAEKGMMVATPVLAGALLRIIMGILVDRLSPKKAAIIGQVVVIATMIYAWQVGVHSYAEVLILGLFLGVAGASFAAALPLASRWYPAEHQGTAMGIAGAGNSGTALAALFAPGLAAAFGWVNVFGVVLIPLVIVLIAFIFMAKDAPDAPPPKTFAEYLKVLKDKDAWWFMFFYSVTFGGFVGLASSLVIYFNTQYGLDPKMAGYFTAGCVFAGSLVRPIGGNVADRIGGVKSLTVMYMFAALFLSIVSFGLPEAWMALLVFVGAMLSLGMGNGAVFQLVPQRFRKEIGVMTGLVGMAGGVGGFYLASSLGYSKQLTGSYQAGFLIFASLAVLALLGLTGVKTRWRTTWGASHLTAAKI

SEQ ID NO: 28458 - DNA, 1290 bp, Ralstonia eutropha JMP134
  CDS (1)..(1290): transl_table=11
atggccacccccacacgcgcggcgcgcatgccggagcccgtcccttccggggcatggacgacgctggcatccagcacgttcgccttcaccatctgctttgccgtctggatgctatttgccgtcctcggcatcccgctcaagaaggaactcgggctcaatgaaaccgagttcggcctgctcgccgctacgcccgtgctgagcggctcgctgatccgcgtgccgctaggcctgtggaccgaccgctacggcggccgtgtcgtgttcttcgtgctgatgctggctaccgtcatcccgatctggctgatctcgtacgcgcacacgctgtggcaactgctggtgctcggcctgttcgtcggtctggcgggcggttcgttttccgtcggcacgccttacgtggcacgctggttcccgcgttctcgccaagggctcgcgatggggatcttcggtgccggtaactccggtgccgcgctgaccaagtttgtcgcacccgcgctgatcctcgccgctggcacctgggaaatcgtgccgcgcgtgtattcggtggcgatgctggtgacggccatcgtgttctggctcgggtcgcgcagcaatcccgcccaccgggtgatgacgagtgccggctggcgcgagcagcttgccgtgatgcgcgacccgcgcgtgtggcgctactcgcagtactactcggtggtgttcggcggctatgtcggcctgtcgctgtggatgaccaagtactacatcggcgaatacggcttcgatatcaaggtggccgccttcctggccgcctgcttctcgctgcccggcggcgtgctgcgcgcgatcggcggctggatctccgaccgctacggcgcgcaccgcaccacgtggtgggtcatgtgggtgagctgggtcggcttcttcctgctgagctacccgcaaaccgacttcgtgatccacaccaccacgggcccgcagagcttccgcatcgcgctgacgccagcggtgttcaccttcctgctgttcgtggtcggcattgcgttcgccatcggcaaggcctcggtcttcaagttcatctcgaacgatttcacgcacaacatcggcgccgtctccggcgtagtcgggctcgcaggcgggctgggcggcttcgtgctgccgatcctgttcggcgcgctggccgacctcaccggcgtgcgcagcagctgcttcatgctgatgtacggcacggtgtgcgtaagcctggtctggatgcactacagccaacgcgccgaacgccggcgcaaggagcaagcagtcggcctgactcagaccgcctga

SEQ ID NO: 28459 - protein, 429 aa, Ralstonia eutropha JMP134
MATPTRAARMPEPVPSGAWTTLASSTFAFTICFAVWMLFAVLGIPLKKELGLNETEFGLLAATPVLSGSLIRVPLGLWTDRYGGRVVFFVLMLATVIPIWLISYAHTLWQLLVLGLFVGLAGGSFSVGTPYVARWFPRSRQGLAMGIFGAGNSGAALTKFVAPALILAAGTWEIVPRVYSVAMLVTAIVFWLGSRSNPAHRVMTSAGWREQLAVMRDPRVWRYSQYYSVVFGGYVGLSLWMTKYYIGEYGFDIKVAAFLAACFSLPGGVLRAIGGWISDRYGAHRTTWWVMWVSWVGFFLLSYPQTDFVIHTTTGPQSFRIALTPAVFTFLLFVVGIAFAIGKASVFKFISNDFTHNIGAVSGVVGLAGGLGGFVLPILFGALADLTGVRSSCFMLMYGTVCVSLVWMHYSQRAERRRKEQAVGLTQTA

SEQ ID NO: 28460 - DNA, 1386 bp, Ralstonia eutropha JMP134
  CDS (1)..(1386): transl_table=11
atgtccacttccgtactgacccgctgggagcccgagaacaaggccttctggcagaacaccggcgagcgcatcgcctaccgcaacctgtggatttcgatccccgcgctgatgctggccttcgtggtctggatgctgtggagcgtggtcgcggtcaatcttgatcgcgctggcttccagttcaccaagaaccaactgttctggctcaccgcactgcccgctttgtccggcgccacgctgcgcatcttctactcgttcctcgtcccggtgttcggcggtcgacgcttcaccgcgatctccacggcgctgctgctgattcctgcgctcggcatgggcttcgcgctgcgcgatccgtccacgggctacccgacgctgcttgcgctcgccttgctgtgcggcttcggcggcgccaacttcagttcgtcgatggccaatatcagcttcttcttcccgaaggcgaagaagggcctggctacaggcctcaatgcgggcatcggcaatctcggcgtgtcggtcgttcagttcgtcacgccgctcgtggtatcggtggccgtgttcggcacgcttggcggcgagccccagcagtaccaggccggcgacgccatgaagaacctgtggctgcagaacgcggggttcatctgggtgccgttcatcgtggtgtcgtcgcttgccgcatggttcggcatgcatgacatcgccgacgccaaggcgtccttcgctgaccaggccatcatcttcaagcgcaagcacaactggctgatgtgctggctctacgtgggcacgttcggctcgttcatcggcttctcggccggcctggcgctgctgaccaagtcgcagtttccgggcgtgaacccgaccgcgtatgcgttcctcgggccgctggtcggcgcactgacgcgtcccgtgggcggctggatctccgacaagcttggcggcgcgcgcgtcacgctgtggacgtttgtcggcatgatcgccgccgtgttcgccgtgctggccgcactgccgcatgacggcgcagcgggcagtttcccggcattcctcgcagccttcgtcgcgctgttcgcgctgactggtgtcggcaacggctccacgttccgcatgattccggtgatcttcctgaccgaacgccagcgtgccgccaagggcaagggcgacacggcgcagaagcaggcattgcaggaagcgggcaaggaatccgccgcggtgctcggcttctccggcgcgatcggtgcctacggcggcttcttcatccccaagagctttggcacgtcgctggaactgaccggctccgccgacgccgcgctgtattgcttcatcgcgttctacgtgagctgcgtgctggtgacgtggtggtgctacgcgcgccgcaacgcagccatgccttgctga

SEQ ID NO: 28461 - protein, 461 aa, Ralstonia eutropha JMP134
MSTSVLTRWEPENKAFWQNTGERIAYRNLWISIPALMLAFVVWMLWSVVAVNLDRAGFQFTKNQLFWLTALPALSGATLRIFYSFLVPVFGGRRFTAISTALLLIPALGMGFALRDPSTGYPTLLALALLCGFGGANFSSSMANISFFFPKAKKGLATGLNAGIGNLGVSVVQFVTPLVVSVAVFGTLGGEPQQYQAGDAMKNLWLQNAGFIWVPFIVVSSLAAWFGMHDIADAKASFADQAIIFKRKHNWLMCWLYVGTFGSFIGFSAGLALLTKSQFPGVNPTAYAFLGPLVGALTRPVGGWISDKLGGARVTLWTFVGMIAAVFAVLAALPHDGAAGSFPAFLAAFVALFALTGVGNGSTFRMIPVIFLTERQRAAKGKGDTAQKQALQEAGKESAAVLGFSGAIGAYGGFFIPKSFGTSLELTGSADAALYCFIAFYVSCVLVTWWCYARRNAAMPC

SEQ ID NO: 28462 - DNA, 1362 bp, Shigella sonnei Ss046
  CDS (1)..(1362): transl_table=11
gtggtacgccgtctgcgtttctccggccctaagacatcaatcatctgtactccaatgactagtctaaaaactagtattaagactatcacttatttaagtgatactggttgtctggagattcagggggccagtctagcagttaccgttaatctcaataaaatcggttttaattttactaccgatcaactctttttattaaccgcattaccctccgtttctggcgcattattgcgtgttccctactcctttatggtgcctatattcggtggacgccgatggacggtttttagtactgcaatcctgattattccttgcgtctggctcggaattgccgtgcaaaatccgaatactccttttgggatatttatcgttatcgctttgctatgcggttttgcaggtgcaaactttgcttcgagcatgggcaatatcagtttcttctttccaaaagccaaacaagggagcgctcttgggattaatggcggattaggaaacttaggtgtaagtgtaatgcagctggttgcaccgctggtcatttttgtacctgtatttgcctttctcggcgtcaatggcgtaccgcaggccgacggttcggtgatgtcgctggcgaatgccgcatggatttgggtaccgctactggcgattgccacgatcgccgcctggtcagggatgaatgatatcgccagttcacgcgcctcaattgacgaccagctccctgtcttacaacgcctgcatctctggctgctgagcctgctttaccttgccaccttcggttcgtttatcggtttttctgcgggttttgccatgctggcaaaaacccagttcccggatgtgaatattctgcgcctggcgttctttggcccatttatcggtgccatcgcgcggtcggttggtggtgctatttccgataaattcggcggcgtgcgggtgacgttgatcaactttatttttatggcgattttcagtgccctgctgttccttaccttaccgggcacaggctccggtaatttcatcgccttttacgccgtatttatggggctgtttctgactgcgggtctgggaagtggttctactttccagatgatcgccgtcatctttcgccagataaccatttatcgggtgaagatgaaaggcggtagtgatgagcaagctcagaaagaagccatcaccgaaacggcggcggctctgggctttatctcagccattggcgcagtgggcggcttttttattccgcaggcgtttggcatgtcgctcaatatgaccggctctccggtcggcgcgatgaaagtgtttttaatcttctacatcgtttgtgtgctgctgacctggctggtttatggtcggcggaagttcagccaaaaataa

SEQ ID NO: 28463 - protein, 453 aa, Shigella sonnei Ss046
MVRRLRFSGPKTSIICTPMTSLKTSIKTITYLSDTGCLEIQGASLAVTVNLNKIGFNFTTDQLFLLTALPSVSGALLRVPYSFMVPIFGGRRWTVFSTAILIIPCVWLGIAVQNPNTPFGIFIVIALLCGFAGANFASSMGNISFFFPKAKQGSALGINGGLGNLGVSVMQLVAPLVIFVPVFAFLGVNGVPQADGSVMSLANAAWIWVPLLAIATIAAWSGMNDIASSRASIDDQLPVLQRLHLWLLSLLYLATFGSFIGFSAGFAMLAKTQFPDVNILRLAFFGPFIGAIARSVGGAISDKFGGVRVTLINFIFMAIFSALLFLTLPGTGSGNFIAFYAVFMGLFLTAGLGSGSTFQMIAVIFRQITIYRVKMKGGSDEQAQKEAITETAAALGFISAIGAVGGFFIPQAFGMSLNMTGSPVGAMKVFLIFYIVCVLLTWLVYGRRKFSQK

SEQ ID NO: 28464 - DNA, 1269 bp, Thiobacillus denitrificans ATCC 25259
  CDS (1)..(1269): transl_table=11
atgcagagccaacaatacaaggcatggtcggtcgtcagcatgagcacgctggcgttcacggtctgcttcatgatctggatgatgttcgccgtcatcggcgttcccatcaaacagcaactcggcctcaacgagacgcagttcggcatcctcgtcgccaccccggtcctgaccgggtcgctgatccgcgtgccgctcggcatgtggacggacaaattcggcggccgcatcgtgttcttcgtcctgatgctgacgacggtcatcccgatctggctgatctcctacgcgaccgagttctggcagtttctgctggtcggcctgttcgtcggcctggccggcggctcgttcacggtcggcatcgcctactgcgcgcgctggttcccgcgtgagcgccaggggctggcgatgggcattttcggcgcgggcaataccggcgccgccgtcaccaagctgctcgcaccgatcatcgtcgtcggatacggctggacgatggtgcccaaggtctacgccggactcatgctcgtcaccgccatcgtcttctggttcttcacctacaccgagcccgcccacaaggtgagcaagtcggtcacgatccgcgagcagcttgcggccttcaaggatccgaaggtctggcgctacagccagtactactcgatcgtgttcggcggctacgtggcgctcgcgctgtggatgaccaagtactacgtgagccagtacggcttcgatctcaagaccgcggccttcctggcggccgccttcagcattcccggcggcgtgctgcgcgcggtcggcggctacttctccgacaagtacggcgcgcacacgatcacctggtgggtgctgtgggtctcgctgctgtgcctgttcttcctgtcctacccgcagagcagcatcacgatccacaccgtcgacggcctgcgcaccttccacttcggcctcggcccgacggcgttcacgatcgtgatgttcagcctcggcatcgcgttcgcgatcggcaaggcctctgtcttcaagtacatctccgacgactaccccgacaacatcggcgtgatctccggcgtggtcggcctcgccggcggtctcggcggcttcctgatgccgatcatgttcggcgccctggtcgacctgaccggcgtccgctcgtcggccttcatgctgatgttcggcgtcgtgtgggtgtcgctgatgtggatgtatttcaccgaagtacgcgagatggacgcggcggcgcggggcgcgaagcgcgtcatcgccgcggacgtcatggagtaa

SEQ ID NO: 28465 - protein, 422 aa, Thiobacillus denitrificans ATCC 25259
MQSQQYKAWSVVSMSTLAFTVCFMIWMMFAVIGVPIKQQLGLNETQFGILVATPVLTGSLIRVPLGMWTDKFGGRIVFFVLMLTTVIPIWLISYATEFWQFLLVGLFVGLAGGSFTVGIAYCARWFPRERQGLAMGIFGAGNTGAAVTKLLAPIIVVGYGWTMVPKVYAGLMLVTAIVFWFFTYTEPAHKVSKSVTIREQLAAFKDPKVWRYSQYYSIVFGGYVALALWMTKYYVSQYGFDLKTAAFLAAAFSIPGGVLRAVGGYFSDKYGAHTITWWVLWVSLLCLFFLSYPQSSITIHTVDGLRTFHFGLGPTAFTIVMFSLGIAFAIGKASVFKYISDDYPDNIGVISGVVGLAGGLGGFLMPIMFGALVDLTGVRSSAFMLMFGVVWVSLMWMYFTEVREMDAAARGAKRVIAADVME

SEQ ID NO: 28466 - DNA, 1677 bp, Thiobacillus denitrificans ATCC 25259
  CDS (1)..(1677): transl_table=11
atgagtctcagaaacaagcagcacggcgccgcgggcgtcgccgtcgggggacgcgagcgcgagcaggttcccgcgaccattcccgagtgggacgtcgagaacaatgtgttctgggaatcgacgggcaagcgcatcgccaaccgcaacctgtggatttcgatcccggccctgttgtgcggattcgcggtgtggggcatgtggggcatcatcaccgtacagatgctcaatctcgggttccccttctccaaggaggagctcttcacgctcaccgcgatcgccggcatctcgggcgccacgatgcggattccgtcgtcgttcttcattcgtctcgcgggcgggcgcaacgtcattttcctgaccacggcgatgctgctcgcgccggcgatcggcacgggcatcgtgctgcaacaccccgactggcccttgtggaccttccagctaatggcgctgtggtcgggcgtcggcggcggcaacttcgccagctcgatgtcgaacatcagcaccttcttccccaagcgtctccagggcacggcgctcggcctcaacgcgggcctgggcaacttcggcgtaaccacgatgcaggtcgtgattccgctggtcatgactctcggcatgctcggcagctacggcggcgaatcgatgacgctggtcaaggacagcggctggatcctcggcaagatcgccgcgggcaccgagacctacgtgcagaacgccggcttcgcctgggtgctgtcgctggtgccgctggccatcctggcctggttcgggatgaacaacctgaagccgatctcgccggacgcgcatcacacgatcgcgtccttcgccaaggtcacctacctctacacgctggccttcctgccggcgatcttcatgctctacctgtatctgccggcgccgaccgggctcggcgtactcaacatgtgggtcgccattccgctcgatatcctcgcggcgctgctggtgatgaagcttgcagcgttcggcaccatgaaggaaaacgtcgccaagcagttcgcaatcttcaagaacaagcacacctggtccctgaccgcgctgtacatcgtcaccttcggctcgttcatcggcttctcgatggcgctgccgttgtcgatcacggtcatcttcggcgactcgcacgtgctcgatgcggcaaccggcgtctggacccatagcaagaaccccaacgcgccctcggccttcacctatgcgtggatcggccccttcgtcggcgcggcgatgcgcccgatcggcggctggatttcggacaaggtcggcggatcgatcgtcacccagatcatctccgccgtgatggtcgccgcctcggcctacgcgggctggatcatgatgcaggccttccactcggccacgcccgaagtctatttcacccagttcctcgttaccttcatcgtgctctttgccgccaccggtgttggcaacggctcgaccttccgcaccgtcggcgtgatcttcgaccgcgtgcaggcggggccggtgctcggctggacgtcggcggtcgccgcctacggcgcgttcatcgccccggtggtgatcggcgatcagatcaaggccggctcgccggagaacgcgatgtacggcttcgccgccttctatgccgtgtgcctgttcgtgaactggtggttctacctgcgcaagcacgcctacatcaagaacccctga

SEQ ID NO: 28467 - protein, 558 aa, Thiobacillus denitrificans ATCC 25259
MSLRNKQHGAAGVAVGGREREQVPATIPEWDVENNVFWESTGKRIANRNLWISIPALLCGFAVWGMWGIITVQMLNLGFPFSKEELFTLTAIAGISGATMRIPSSFFIRLAGGRNVIFLTTAMLLAPAIGTGIVLQHPDWPLWTFQLMALWSGVGGGNFASSMSNISTFFPKRLQGTALGLNAGLGNFGVTTMQVVIPLVMTLGMLGSYGGESMTLVKDSGWILGKIAAGTETYVQNAGFAWVLSLVPLAILAWFGMNNLKPISPDAHHTIASFAKVTYLYTLAFLPAIFMLYLYLPAPTGLGVLNMWVAIPLDILAALLVMKLAAFGTMKENVAKQFAIFKNKHTWSLTALYIVTFGSFIGFSMALPLSITVIFGDSHVLDAATGVWTHSKNPNAPSAFTYAWIGPFVGAAMRPIGGWISDKVGGSIVTQIISAVMVAASAYAGWIMMQAFHSATPEVYFTQFLVTFIVLFAATGVGNGSTFRTVGVIFDRVQAGPVLGWTSAVAAYGAFIAPVVIGDQIKAGSPENAMYGFAAFYAVCLFVNWWFYLRKHAYIKNP

SEQ ID NO: 28468 - DNA, 1263 bp, Magnetospirillum magnetotacticum MS-1
  CDS (1)..(1263)
atggcttccttcaagaccgtcatgaagtcgggtcaccccccgacgctgttcgcagccttcctgtatttcgatttctgcttcgcgatctgggtgctcaacggcgccatgggcccgttcatcacggagacctacaagctcaccccggcccagaccggcttcatgatctcgctgccgatcctggccggcgcgatcatgcgctttcccctcggagtgctggctcagtatatcggccgcaagaacgcggcgctcaccgagatgagcgtcatcgtcctggcgatggcctacggcttcttcttcgtctcgtcctacaacgacgtgctcgccatgggcgtgctgctcggcatcgccggcgcctccttcggcgtggcgctctccctcggttcgggctggtttccgccggagcacaaggggctggccatgggcatcgccggcgccggcaattcgggcaccgtgcttgccgtgctgttcgcgccgccgctggcccaggcctatggctggcaggcggtctacggcttcgccggcctcgtcatgatcgtgccgctcgtcgtgatgatcctgctcgccaaggagccgccggattgccacggccagtccttcaaggagcatgtctcctgcctgttcaccaaggacggctgggccttctccctgatctacatcatcacctttggcggcttcatcggcctctcgaacttcctgccgaccttcttctacgagcagttcagcgtgacgaaggtcgaggccgggcggctgaccatgctcgccgcgctgatgggctcgggcatccggatcctcggcggctatttcgccgaccggatgggcggcatcctcgtgctctccctggtgctgctcgccgccatcggctcgttcctggccctcaccgccacgccgtcgctcgccgtcaccacgctgctgttcatgctctgcttcgccgcgctcggtgccggcaacggtgccctgttccagctcgtgccgctgcggtggccgaccaacacggcggtggccggctcgatgatcggcgaggtcggggccctcggcggcgcgatcctgcccaacgtcatgggcttctcgaagcaatataccggcggcttcgccacgggcttcgtggtttacgccctcttcaccggtctggttctcggctgcctgttcctctggcagcgcaaatgggtcggcacctgggtgggcccccgcggcaaggtgctggatcccgcgggcgagacgctcggcgaggcggaaggcgcgcgcgtcgcccctgcgaccgcctga

SEQ ID NO: 28469 - protein, 420 aa, Magnetospirillum magnetotacticum MS-1
MASFKTVMKSGHPPTLFAAFLYFDFCFAIWVLNGAMGPFITETYKLTPAQTGFMISLPILAGAIMRFPLGVLAQYIGRKNAALTEMSVIVLAMAYGFFFVSSYNDVLAMGVLLGIAGASFGVALSLGSGWFPPEHKGLAMGIAGAGNSGTVLAVLFAPPLAQAYGWQAVYGFAGLVMIVPLVVMILLAKEPPDCHGQSFKEHVSCLFTKDGWAFSLIYIITFGGFIGLSNFLPTFFYEQFSVTKVEAGRLTMLAALMGSGIRILGGYFADRMGGILVLSLVLLAAIGSFLALTATPSLAVTTLLFMLCFAALGAGNGALFQLVPLRWPTNTAVAGSMIGEVGALGGAILPNVMGFSKQYTGGFATGFVVYALFTGLVLGCLFLWQRKWVGTWVGPRGKVLDPAGETLGEAEGARVAPATA

SEQ ID NO: 28470 - DNA, 1407 bp, Pseudomonas aeruginosa UCBPP-PA14
  CDS (1)..(1407)
atgggcatgatcgccaatacccaactgaaagccgcacggggaccgctgctgctcgactggcgccccgaggaccccgagttctgggcgcgcaacggcaagcgcatcgccagccgcaacctgtggatctcgatccccgcgctgctgctcgccttcgccgtgtggatgatctggagcacggtgaccgtgcgcctgaacagcgccggcttcgccttcagcaacgaccagctgttcctgctcgcggcgctgccgtcgatctccggcgccaccctgcgggtgttctattcgttcatggtgccgatcttcggcggccgtcgctggaccgccctgagcaccgcctcgatgctgatcccgtgcatctggctgggcttcgccgtgcaggacccgagcaccccgtactgggtgttcgccctgatcgcgctgctctgcggcttcggcggcggcaacttcgcctcgagcatgtccaacatcagcttcttctatccgaagagccagcagggcaccgccctcggcctgaatgccgggctcggcaacctcggcgtctcggtgatgcagttcgccgtgccgctggcggtggccggcggcctgttcggcgccttcggcggcgagccgcagcagctcggcgacggcggtcgcctgtggctgcagaacgccggctggatctgggtgccgttcatcgccgtggtatcggtcgcggcctggttcgggatgaacgacatcgccgacgccaaggcctcgttccgcgaccaggcggtgatcttcaagcgcaagcacaactggctgatgtgctggctgtacgtggccaccttcggctcgttcatcggcttctcggccggcttcgcgatgctcagcaagacccagttccccgacatcaacccgctgcaatacgccttcctcggtccgctggtgggcgccctcagccggcccctgggcggctggctggcggacaagttcggcggcgcgcggatcaccctgtggaactacgcactgatgatcggcggggtgttcacggtgatcgccttcctgccgggcgacggcggccagggcaacttcttcggcttccttggcgccttcatcctgctgttcttcttcgccggcatcggcaacggttccaccttccgcatgatcccggtgatcttccgcaacgagtgggcccggcgggtgcgcgacggccaggccgacgaagccggcgcggcgcgcaacgcgagcatggagtcggccgcggtgatcggcttctccgccgccatcggcgccttcggcgggttcttcatcccgaaggcgttcggcacctcgctgcacatgaccggcagcgccgagggcgccctctacgtgttcatcgcctactacctgagctgcatcgtcgccacctggtggtggtacgcgcgcaagggtgcggagagtccctgttga

SEQ ID NO: 28471 - protein, 468 aa, Pseudomonas aeruginosa UCBPP-PA14
MGMIANTQLKAARGPLLLDWRPEDPEFWARNGKRIASRNLWISIPALLLAFAVWMIWSTVTVRLNSAGFAFSNDQLFLLAALPSISGATLRVFYSFMVPIFGGRRWTALSTASMLIPCIWLGFAVQDPSTPYWVFALIALLCGFGGGNFASSMSNISFFYPKSQQGTALGLNAGLGNLGVSVMQFAVPLAVAGGLFGAFGGEPQQLGDGGRLWLQNAGWIWVPFIAVVSVAAWFGMNDIADAKASFRDQAVIFKRKHNWLMCWLYVATFGSFIGFSAGFAMLSKTQFPDINPLQYAFLGPLVGALSRPLGGWLADKFGGARITLWNYALMIGGVFTVIAFLPGDGGQGNFFGFLGAFILLFFFAGIGNGSTFRMIPVIFRNEWARRVRDGQADEAGAARNASMESAAVIGFSAAIGAFGGFFIPKAFGTSLHMTGSAEGALYVFIAYYLSCIVATWWWYARKGAESPC

SEQ ID NO: 28472 - DNA, 1326 bp, Burkholderia cepacia R18194
  CDS (1)..(1326)
atgaccgacaaagctacccgtatcgatctcttcagcttccgcaccgcgccgatgcgcgcgttccacctgacgtggatggcgttcttcgtgtgcttctttgcgtggttcgcgtgcgcgccgctgatgccgctgatcgcacgcgaattccacctgaccgcggcacaggtcgccaacatcaacatcgcggccgtggccgcgacgatcgccgtgcggctgctggtcggcccgctgtgcgaccgcttcggcccgcgccgcgtgtacgtcggcctgttgctgctcggcgcgatccccgtgttcgcggtgtccttcacgcacgactacctgtcgttcctgatctgccggctcggcatcggcgcgatcggcgcgggcttcgtgatcacgcagtaccacacgtcggtgatgttcgcaccgaacgtggtcggcaccgcgaacgcgacgacggccggctggggcaacgccggtgccggcgccacgcaggcgctgatgccgctgctcgtcgccgccggcctgatgctcggcttcggcgaggattcgtcgtggcgcatcgcgctggtcgtgccgggcgtcgcgatgctcgtgatggcgtgggcgtactggcgcttcacgcaggattgcccgcaaggcgacatcgtcgcgctgcgcaaggcaggcgtgacggtcgacagcggcaagaagggcggttgggcgagcttcttcgcggcctgcggcaactatcgcgtgtggatgctgttcgtcacgtacggcgcgtgcttcggcgtcgaggtgttcatccacaacatcgccgcgctgtactacgtcgatcacttcagcctgtcgctgaaggacgccggtttcgcggtcggcctgttcgggctgctcgcgctgttcgcccgcgcgctcggcggctggctgtccgacaagatcgccgcgcgccgcagcctcgacgtgcgcgccacgttgctgtgcgcgctgatcgtcggcgaagggctcgggctgatctggttctcgcatgcgcaaagcatcggcgtcgcgctggtcgcgatgctcacgttcggcctcttcacgcacatggcctgcggcgcgacctacgcactggtgccgttcatcgaccgcaaggcgctcggcggcgtggcggggatcgtcggcgcgggcggcaacgtcggcgcggtggccgcgagcttcctgctgaagggcgtcggcgacgtacagcacacgctgagcctgctcgggctggccgtcaccgcaaccgcgctgtgcgcgatggccgtgcgcttcagcgaagaacacaaggctcgcgaagccgagctgcgcgaccgcgcgctggctgccagcagcgtcgcgaactga

SEQ ID NO: 28473 - protein, 441 aa, Burkholderia cepacia R18194
MTDKATRIDLFSFRTAPMRAFHLTWMAFFVCFFAWFACAPLMPLIAREFHLTAAQVANINIAAVAATIAVRLLVGPLCDRFGPRRVYVGLLLLGAIPVFAVSFTHDYLSFLICRLGIGAIGAGFVITQYHTSVMFAPNVVGTANATTAGWGNAGAGATQALMPLLVAAGLMLGFGEDSSWRIALVVPGVAMLVMAWAYWRFTQDCPQGDIVALRKAGVTVDSGKKGGWASFFAACGNYRVWMLFVTYGACFGVEVFIHNIAALYYVDHFSLSLKDAGFAVGLFGLLALFARALGGWLSDKIAARRSLDVRATLLCALIVGEGLGLIWFSHAQSIGVALVAMLTFGLFTHMACGATYALVPFIDRKALGGVAGIVGAGGNVGAVAASFLLKGVGDVQHTLSLLGLAVTATALCAMAVRFSEEHKAREAELRDRALAASSVAN

SEQ ID NO: 28474 - DNA, 1326 bp, Burkholderia cenocepacia AU 1054
  CDS (1)..(1326): transl_table=11
atgaccgacaaagctacccgtatcgatctcttcagcctccgcaccgcgccgatgcgcgcgttccatctgacgtggatggcgttcttcgtttgcttcttcgcgtggttcgcgtgcgcgccgctgatgccgctgatcgcgcgcgaattccatctcacggcggcgcaagtcgccaacatcaacatcgccgcggtggccgcgacgatcgccgtgcggctgctggtcggcccgctgtgcgaccgcttcggcccgcgccgcgtgtacgcgggcctgctgctgctcggcgcgatccccgtgttcgccgtgtcgttcacgcacgactacctgtggttcctgatctgccggctcggcatcggcgcgatcggtgcgggcttcgtgatcacgcaataccacacgtcggtgatgttcgcgccgaatgtggtcggcaccgcgaacgcgacgacggccggctggggcaatgccggcgcgggcgcgacgcaggcgctgatgccgttgctcgtcgccgccgggctgatgctcggcttcggcgaggattcgtcgtggcgcatcgcgctggtcgtgccgggcgtggcgatgctcgcgatggcatgggcgtactggcgcttcacgcaggactgcccgcaaggcgatttcgtcgcgttgcgcaagcagggcgtgacggtcgacagcggcaagaagggcggctgggcgagcttcttcagggcctgcggcaactaccgcgtatggatgctgttcgtcacgtacggcgcgtgcttcggcgtcgaggtgttcatccacaacatcgccgcgctgtactacgtcgatcacttcaagctgtcgctgaaggacgccggtttcgcggtcgggatgttcgggctgctcgccctgttcgcgcgcgcgctcggcggctggctgtccgacaagatcgctgcccgccgcagcctcgacgtgcgcgcgacgctgctgtgcgcgctgatcatcggcgaagggctcgggctgatctggttctcgcacgcgcaaggcatcggcatggccctcgtcgcgatgctgaccttcggcctgttcacgcacatggcgtgcggcgcgacctacgcgctcgtgccgttcatcgaccgcaaggcgctcggcggcgtcgcggggatcgtcggcgcgggcggcaacgtcggcgcggtggccgcggctttcctgctgaagggtgtcggcgacgtgcagcagacgctgagcctgctcggcctcgcggtgaccgcgaccgcgttgtgcgcgatggccgtgcgcttcagcgaagaacacaaggcgcgcgaagccgagctgcgcgatcgcgcgctggccgccgccggcgccgcgaactga

SEQ ID NO: 28475 - protein, 441 aa, Burkholderia cenocepacia AU 1054
MTDKATRIDLFSLRTAPMRAFHLTWMAFFVCFFAWFACAPLMPLIAREFHLTAAQVANINIAAVAATIAVRLLVGPLCDRFGPRRVYAGLLLLGAIPVFAVSFTHDYLWFLICRLGIGAIGAGFVITQYHTSVMFAPNVVGTANATTAGWGNAGAGATQALMPLLVAAGLMLGFGEDSSWRIALVVPGVAMLAMAWAYWRFTQDCPQGDFVALRKQGVTVDSGKKGGWASFFRACGNYRVWMLFVTYGACFGVEVFIHNIAALYYVDHFKLSLKDAGFAVGMFGLLALFARALGGWLSDKIAARRSLDVRATLLCALIIGEGLGLIWFSHAQGIGMALVAMLTFGLFTHMACGATYALVPFIDRKALGGVAGIVGAGGNVGAVAAAFLLKGVGDVQQTLSLLGLAVTATALCAMAVRFSEEHKAREAELRDRALAAAGAAN

SEQ ID NO: 28476 - DNA, 1407 bp, Burkholderia pseudomallei S13
  CDS (1)..(1407)
atggatactctgcgcacctccctccgaagcggcaactggcgctcgcttctcgcgtgtttcctttatttcgatacgggcttcaccgtctgggtgctgtacgggccgctcgcgccgttcatcagcaaggacatcgcgatgacggccgcgcagcaaggctttctcgtcgcggtgccggtgctcgcggcggccatcctgcgcgtgacgctcggcaacctttaccagtccgccgacggccggcgcatcgcgctgatgggcgtactgctgtccgcgctgcccgccgccgtgctgccgttcgtgcccggcacgccgtcgtacacgctgctcctcgtgctcggcgtgttcctcgggatcggcggcgcgagcttcgcggtcgcgctgccgatggcgggcagcagctatccgccgaaggtgcagggcctcgtgctcggcctcgccgccgcgggcaacatcggcgcggtgctcgacggcttcatgttcccgcacatcgcggccgcgctcgactggaagttctcgacggccgccgcgctgccgctgctcgcgatcgcgggcttcgcgctcttcgcgtgggccgacgaccgcgcagagaaatcgggcagcgcggcgcgcgcgttcggcgcgttcgtgatcacgctcggcggtctcgtcgcgctcgtgctcgccgtgcacgcgggcctgttcggcgcgggcaaggcaggcgtgctgctgctgcccgtgatgggcgcgctgctcgcgatcgccgtgctgcccggccgctatcgcgcggtgctcgccgagcgcgacacgtgggtcatcatgctgatctacagcatcacgttcggcggcttcgtcggcatgtcgtcgtacgtgacgctgctgctgacgacgctctaccagatgccgaagatcgaagcgggcctgttcatgtcgctgctcgcgtttctcggcgcgatcgtgcgcccgttcggcggccacctcgccgaccgcatcaccggcgtgcgcgcgctcatggcgatcctcgccgcgatcgccgcggccgacttcgcgttcgcggccgtgatgccgccgctcgcgggcggcatcgcgctgctcgtgtgcctgtacgtcgcgttcggcctcggcaacggctcgacgttccagctcgtcccgcaccgctggcagggcaagacgggcctgctgtccggcatcgtcggcgcggcgggcggcatcggcggcttctatctgcccgtcgtgatgggcatcgcgaaggaaagcacgggcagctatcagctcggcttcgcgacgttcggcgcgctcgcgacctgcgcgctcgtcgcgctcgcgatgctgcgcgcgcagtggctgcgctgggcggcgcccgagctcgccgcggccgagccgtcggcgggcgccgggatgccgatcggcggcgcggcgcgcgtcggcgactga

SEQ ID NO: 28477 - protein, 468 aa, Burkholderia pseudomallei S13
MDTLRTSLRSGNWRSLLACFLYFDTGFTVWVLYGPLAPFISKDIAMTAAQQGFLVAVPVLAAAILRVTLGNLYQSADGRRIALMGVLLSALPAAVLPFVPGTPSYTLLLVLGVFLGIGGASFAVALPMAGSSYPPKVQGLVLGLAAAGNIGAVLDGFMFPHIAAALDWKFSTAAALPLLAIAGFALFAWADDRAEKSGSAARAFGAFVITLGGLVALVLAVHAGLFGAGKAGVLLLPVMGALLAIAVLPGRYRAVLAERDTWVIMLIYSITFGGFVGMSSYVTLLLTTLYQMPKIEAGLFMSLLAFLGAIVRPFGGHLADRITGVRALMAILAAIAAADFAFAAVMPPLAGGIALLVCLYVAFGLGNGSTFQLVPHRWQGKTGLLSGIVGAAGGIGGFYLPVVMGIAKESTGSYQLGFATFGALATCALVALAMLRAQWLRWAAPELAAAEPSAGAGMPIGGAARVGD

SEQ ID NO: 28478 - DNA, 1212 bp, Polaromonas sp. JS666
  CDS (1)..(1212): transl_table=11
atggcgggattccgcacctttctcaaatcgggccatgctccgaccttgttcgccgccttcctgtacttcgatttctgctttgcggtctgggtattgaatggggccatggcgccgttcatcagcgagacctttcatctgacggcggcgcagaagggcttcatgatttcggtgcccattctggcgggcgccctcatgcgctttccgctgggcattctggcgcaatacatcggccgcaaaaatgctgcgctggtcgaaatgggcatgattattctggcgctggcctacggctacttcttcatcagcgcgtacgaccatgtgctagccatgggcgtgctgctgggcatcgccggcgcgagcttcggcgtggcgctgtcgctgggttcgggctggttcccgcccaagtacaagggcctggccatgggcattgccggcgccggcaactccggcaccgtgctagccgtgctgttcgcaccgccactggccatggtctatggctggcagacggtttacggcctggcggccttcttcatgctgatcccgatggtggtaatggtcgtcttcgcgaaagagccgcccgacatcgagcaccagaccttccgccagcacatcgcctgcctgttcgagaaggacggctgggcgttcagcctgatctacatcatcactttcggcggcttcatcggcctggccagcttcctgcccacctacttctacgaccagttcggcgtcaccaaggtgcaggcaggccagctcaccatgctggcagcactcatgggctcagccgtgcgcgtggtcggcggctacatctctgaccgcgtgggcggcatcaacaccctgagcggcgtgctggtggtggtcgccttcaccctggtgctgtgcggcctggccggcaattcgctcaccgtcaccaccctgctcttcatggtctgctttgcagcgctcggtgccggcaacggcgcgctgttccagctggtgccgctgcgctggccgctggccacggcggtggcgggctccatgattggcgaggtgggcgctcttgggggcggcttcattcccaacgccatgggcctgagcaagcagtacaccaatacctacctctggggctttgtggctttcgccatcctggccgtcgtcatgctggtgatgctgcgggtgatgcaaatccgctggacccggacctgggctgaaaagggaggtcgcgcgcggagcgcgtga

SEQ ID NO: 28479 - protein, 403 aa, Polaromonas sp. JS666
MAGFRTFLKSGHAPTLFAAFLYFDFCFAVWVLNGAMAPFISETFHLTAAQKGFMISVPILAGALMRFPLGILAQYIGRKNAALVEMGMIILALAYGYFFISAYDHVLAMGVLLGIAGASFGVALSLGSGWFPPKYKGLAMGIAGAGNSGTVLAVLFAPPLAMVYGWQTVYGLAAFFMLIPMVVMVVFAKEPPDIEHQTFRQHIACLFEKDGWAFSLIYIITFGGFIGLASFLPTYFYDQFGVTKVQAGQLTMLAALMGSAVRVVGGYISDRVGGINTLSGVLVVVAFTLVLCGLAGNSLTVTTLLFMVCFAALGAGNGALFQLVPLRWPLATAVAGSMIGEVGALGGGFIPNAMGLSKQYTNTYLWGFVAFAILAVVMLVMLRVMQIRWTRTWAEKGGRARSA

SEQ ID NO: 28480 - DNA, 1320 bp, Geobacter metallireducens GS-15
  CDS (1)..(1320): transl_table=11
atggaaaggcacgagcagaagacggcaacggcggcaacgtgggggacccaggtcaggacgcgcaccatggcgacccacaggtacaagcagatctcggtcctgacgatgaacaccttcgccttcactgtctgcttcgcggtctgggtgatgttctccatcatcggcatcccgatcaagggcgccctaggcctgaacgagacccagttcggcatcctggccgcaacccccattctctccggctcattgattcggctgccgctcgggatgtggaccgacaagtacggcggacgcattgtcttcttcattctgatgctctgcaccatcgtccccatctacctggtgagcgccgccacggcgtactggcactttctcctcctggggctcttcatcggtcttgccggcggcgccttctcggtggggatcagctacaccgcccgctggttcaccaaggcccgtcagggattcgccatggggatctttggcgccgggaacgcgggggccgcggtcaccaagttcctggccccctccctggtggtggcctacggctggcagatggtccccaaggtctatgccgtggccatgctcgtgacggccatcctgttttgggcattcaccttcaccgagcacagccacaaagtgagctccaccgtgaccatcaaagaccagctggcggccctcagggacccgaaggtctggcgctactgccagtactacgccatcgtcttcgggggctacgtggggctctccctctggatgaccaagtactacatcaacgagtacggcttcgacatccggaccgcggccctggtggccgccatcttcgtgctaccctccggcgtgatccgcgccctgggagggtggctgtcggaccgtttcggcgcccacaccgtcacctgctgggtcatgtgggtctccggcgggtgcctcctgctcctctcgatcccccacttcgatgtggttgtcaccacggtgaacggtcccgtcgcgcgccacgtggggctcaacgtatgggtgttcacctcccttctcttcgttgtcggcattgcgtggggattcggcaaggcatcggtgttcaagcacatctccgatgaatacccccacaacatcggcgtgatctccggcatcgtggggctcattggcgggctcggcgggtttgtcctccccatcatgttcggcgccctggtggacctgaccggtgtccggagcaccgctttcatgctcctgtacggttccacgtgcgtttccctgttctggatgtacctggccctgaagaaagaaaacgttcatcgcaagctgaagaccgccgacattctcgaataa

SEQ ID NO: 28481 - protein, 439 aa, Geobacter metallireducens GS-15
MERHEQKTATAATWGTQVRTRTMATHRYKQISVLTMNTFAFTVCFAVWVMFSIIGIPIKGALGLNETQFGILAATPILSGSLIRLPLGMWTDKYGGRIVFFILMLCTIVPIYLVSAATAYWHFLLLGLFIGLAGGAFSVGISYTARWFTKARQGFAMGIFGAGNAGAAVTKFLAPSLVVAYGWQMVPKVYAVAMLVTAILFWAFTFTEHSHKVSSTVTIKDQLAALRDPKVWRYCQYYAIVFGGYVGLSLWMTKYYINEYGFDIRTAALVAAIFVLPSGVIRALGGWLSDRFGAHTVTCWVMWVSGGCLLLLSIPHFDVVVTTVNGPVARHVGLNVWVFTSLLFVVGIAWGFGKASVFKHISDEYPHNIGVISGIVGLIGGLGGFVLPIMFGALVDLTGVRSTAFMLLYGSTCVSLFWMYLALKKENVHRKLKTADILE

SEQ ID NO: 28482 - DNA, 1230 bp, Nitrobacter hamburgensis X14
  CDS (1)..(1230): transl_table=11
atggcgagagctggcagcctgtccgtcctgctcatcaccacctgggccttcacggtctgcttcgccgtctggatgatgttcagcgtgatcggcattccgatccgcgcagagcttgggcttggttcgactgagttcggtctcctcacagcgacgcccgtcctcaccggcgcgttgtttcgtttgccgctgggcatctggaccgaccgcttcggcggacggatcatcatgctgctgctgctgatcggctgcgcgatcccgctctggctgtcgtcctatgcgaccgcgctgtggcagttcctgctgctcgggctggcgctcggtcttgtcggcgcctcgttttcggtcggcacgccctacgtcgcgcgcttctttccaaaagagcgccggggtttcgcgatgggcttcttcggcgcaggcacgatcggtgcggcgctcaacatgttcgtcgctccgtggctgatcgaggcctatggctggcagatggtgccgaaggtctatgccgtcgcgctgctggtcactgctttgcttttttgggtgttgtccaggcccgatcccggcgtcggcggtccggtgtcgtcaatgtggcaacaactgtccgtgctgcgcaatccgcgcgtctggaaatactgccaatactactcgatcgtgttcggtggcttcaccgcgctgtcgatctggatgccgcaatatttcaagacggagtacggcttcaccatcgcgcaggcgtcgctgctggccgcgtgcttctcgctccccgggggcgcctttcgtgctctcggcggctggttgtcggaccgcttcggagcccacaacgtcacctggtgggtgctgtgggccgcctgggtttgcctgtttctgctgtcctatcccaagaccgacctgatcgtgcacacgatccgcgacccgctgagcttccgcatcgccttgccgtcgtggttcttcacaatgctcctcttcacgctcggcatcgcctttgcctgcggcatggcttcgacgttcaaatacataggcgacgacttccccgacagcatgggagcggtatccggcattgtcggcatggcgggcggccttggcggcttcctgctgccgatcacgttcggcgcgctcctggactggatcggcttcaactcaagctgcttcatgctgctctacggcatcatctgggtgtcgctgaccctcaattatctgaccgaagtccggcgggcaccggtcatgggcgaagaaacctga

SEQ ID NO: 28483 - protein, 409 aa, Nitrobacter hamburgensis X14
MARAGSLSVLLITTWAFTVCFAVWMMFSVIGIPIRAELGLGSTEFGLLTATPVLTGALFRLPLGIWTDRFGGRIIMLLLLIGCAIPLWLSSYATALWQFLLLGLALGLVGASFSVGTPYVARFFPKERRGFAMGFFGAGTIGAALNMFVAPWLIEAYGWQMVPKVYAVALLVTALLFWVLSRPDPGVGGPVSSMWQQLSVLRNPRVWKYCQYYSIVFGGFTALSIWMPQYFKTEYGFTIAQASLLAACFSLPGGAFRALGGWLSDRFGAHNVTWWVLWAAWVCLFLLSYPKTDLIVHTIRDPLSFRIALPSWFFTMLLFTLGIAFACGMASTFKYIGDDFPDSMGAVSGIVGMAGGLGGFLLPITFGALLDWIGFNSSCFMLLYGIIWVSLTLNYLTEVRRAPVMGEET

SEQ ID NO: 28484 - DNA, 1209 bp, Paracoccus denitrificans PD1222
  CDS (1)..(1209): transl_table=11
atgcccgccgttccccccgttccgccatccgaggccagccgcgcgctgggcctctcgaccttcgcctttaccatctgcttcgccgtctggacgatcttctcgatcatcggcctgcagatccgcgagcagctttccctgaccgaaacccagttcggcctgctgatcggcctgccgatcctgaccggatcgctggtgcgcatcgggctgggcgtgctgaccgaccggctgggcgggcggctggtctatacgatgaccatgctttccgccgccgtcgcgacgttccttttgtcccttgctacgacctggccgcagatgctgctggcggcgctgggcgtcgggctggccggcggttcctttgccgtcggcgtggcctatgtctcgcgcttctatgccgaggggcggcagggcacggcgttgggcatcttcggcaccggcaatgtcggggccgccgtgaccaagttcgccgcgcccttcgtcatgctggcgctgggctggcaggcgaccgcgcagatctgggccgccgcgctggtgctgaccgccgtgctgttctggctgctcagcaaggacgatcccgtcaccgccgcaggggccggccgcaaggcgccgctgcgtgccgagttcgcgccgctgggtcaggtgcgggtctggcgcttctcggcctattacttcttcagcttcggcgggttcgtggcgctggcgctgtggctgccgcattacctgacgcaggtctatggtttcggtgtcgggaccgccggcatgatcggcgcggcctattccatccccggctcgatcttccgcgcctatggcggggtgctgtccgaccggatcggggcgcgggcggtgatgtatgcgaccttcatcgtctcgctggccgcgaccgccatcctgtcgatcccggcgggggtgccggtgccggtcttcctggcggtgattttcgtcctgggcttcttcatgagcctgggcaaggcggccgtctacaagcacatccccagctattaccccggccatgtcggcgcggtcggcgggctggtcggcatgatcggcggtctgggcggctttgccttgccgctgctcttcggctggctgcgcgaccagaccgggctgtggtccagctgcttcatggcgctgttcctgctggtcgggctttgcgcgctgtggatgcacgcctcgatccgccagatgggccgcgcgcccctgcaagccgcctga

SEQ ID NO: 28485 - protein, 402 aa, Paracoccus denitrificans PD1222
MPAVPPVPPSEASRALGLSTFAFTICFAVWTIFSIIGLQIREQLSLTETQFGLLIGLPILTGSLVRIGLGVLTDRLGGRLVYTMTMLSAAVATFLLSLATTWPQMLLAALGVGLAGGSFAVGVAYVSRFYAEGRQGTALGIFGTGNVGAAVTKFAAPFVMLALGWQATAQIWAAALVLTAVLFWLLSKDDPVTAAGAGRKAPLRAEFAPLGQVRVWRFSAYYFFSFGGFVALALWLPHYLTQVYGFGVGTAGMIGAAYSIPGSIFRAYGGVLSDRIGARAVMYATFIVSLAATAILSIPAGVPVPVFLAVIFVLGFFMSLGKAAVYKHIPSYYPGHVGAVGGLVGMIGGLGGFALPLLFGWLRDQTGLWSSCFMALFLLVGLCALWMHASIRQMGRAPLQAA

SEQ ID NO: 28486 - DNA, 1401 bp, Pseudomonas aeruginosa
  CDS (1)..(1401): transl_table=11
atgatcgccaatacccaactgaaagccgcacggggaccgctgctgctcgactggcgccccgaggaccccgagttctgggcgcgcaacggcaagcgcatcgccagccgcaacctgtggatctcgatccccgcgctgctgctcgccttcgccgtgtggatgatctggagcacggtgactgtgcgcctgaacagcgccggcttcgccttcagcaacgaccagctgttcctgctcgcggcgctgccgtcgatctccggcgccaccctgcgggtgttctattcgttcatggtgccgatcttcggcggtcgtcgctggaccgccctgagcaccgcctcgatgctgatcccgtgcatctggctgggcttcgccgtgcaggacccgagtaccccgtactgggtgttcgccctgatcgcgctgctctgcggcttcggcggcggcaacttcgcctcgagcatgtccaatatcagcttcttctatccgaagagccagcagggcaccgccctcggcctgaatgccgggctcggcaacctcggcgtctcggtgatgcagttcgccgtgccgctggcggtggccggcggcctgttcggcgccttcggcggcgagccgcagcagctcggcgacggcggtcgcctgtggctgcagaacgccggctggatctgggtgccgttcatcgccgtggtatcggtcgcggcctggttcgggatgaacgacatcgccgacgccaaggcctcgttccgcgaccaggcggtgatcttcaagcgcaagcacaactggctgatgtgctggctgtacgtggccaccttcggctcgttcatcggcttctcggccggcttcgcgatgctcagcaagacccagttccccgacgtcaacccgctgcaatacgccttcctcggtccgctggtgggcgccctcagccggcctctgggcggctggctggcggacaagttcggcggcgcgcggatcaccctgtggaactacgcgctgatgatcggcggggtgttcgcggtgatcgccttcctgccgggcgacggcggccagggcaacttcttcggcttccttggcgccttcatcctgctgttcttcttcgccggcatcggcaacggctccaccttccgcatgatcccggtgatcttccgcaacgagtgggcccggcgggtgcgcgacggccaggccgacgaagccggcgcggcgcgcaacgcgagcatggagtcggccgcggtgatcggcttctccgccgccatcggcgccttcggcgggttcttcatcccgaaggcgttcggcacctcgctgcacatgaccggcagcgccgagggcgccctctacgtgttcatcgcctactacctgagctgcatcgtcgccacctggtggtggtacgcgcgcaagggtgcggagagtccctgttga

SEQ ID NO: 28487 - protein, 466 aa, Pseudomonas aeruginosa
MIANTQLKAARGPLLLDWRPEDPEFWARNGKRIASRNLWISIPALLLAFAVWMIWSTVTVRLNSAGFAFSNDQLFLLAALPSISGATLRVFYSFMVPIFGGRRWTALSTASMLIPCIWLGFAVQDPSTPYWVFALIALLCGFGGGNFASSMSNISFFYPKSQQGTALGLNAGLGNLGVSVMQFAVPLAVAGGLFGAFGGEPQQLGDGGRLWLQNAGWIWVPFIAVVSVAAWFGMNDIADAKASFRDQAVIFKRKHNWLMCWLYVATFGSFIGFSAGFAMLSKTQFPDVNPLQYAFLGPLVGALSRPLGGWLADKFGGARITLWNYALMIGGVFAVIAFLPGDGGQGNFFGFLGAFILLFFFAGIGNGSTFRMIPVIFRNEWARRVRDGQADEAGAARNASMESAAVIGFSAAIGAFGGFFIPKAFGTSLHMTGSAEGALYVFIAYYLSCIVATWWWYARKGAESPC

SEQ ID NO: 28488 - DNA, 1416 bp, Mycobacterium fortuitum
  CDS (1)..(1416): transl_table=11
atgcccactctgctgaagtcgaatcgcgtcaccaactgggaccccgaggacacactcgcctgggaagccggcaacaaatacatcgcgcgtcggaacctgatctggtcggtgttcgccgaacacgtcggattctcgatctggtccatctggtcggtgatggtcctgttcatgcccgaagccgtgtacggcttctccgccggggacaagttcctgctgggcgccaccgccacgctggtggggggatgcctgcgtatcccctacacgcttgccaccgccacattcggcggccgtaactggaccgtgttctccgccttcgtgctgctgatccccacggtggggaccatgttgctgctggccaatcccggcctgccactgtggccgtacctgctgtgcgcggcgctggccggcttcggcggcggcaacttcgcctcctcgatgaccaacatcaacgccttctacccgcagcggctcaagggctgggcgttgggactcaacgccggcggcggaaacatcggggtgccgatgatccagctggtcggcctgctggtcatcgccacggcaggcaaccgggccccgtactgggtctgcgccgtctacctcgtcgccctggccgtcgccggtatcggtgccgcgctctacatggacaacctcgaacagcacaagatcgacctgggcgcgatgaaagcaattctggcagaacgtgatacctgggtgatctcgttgctctacatcggcaccttcggctcgttcatcggcttcgccttcgcattcggccaggtgcttcagatcaacttcgccgccggcggccagaccgcggcacaggcctctctgcatgccgcgcagatcgcgttcatcggcccgctgctcggctcgctgtcgcgggtctacggcggcaagctggccgaccggatcggtggtgggcgcgtgaccctcgcagtcttcggcggcatgatcctggcggccggacttctcgtggcgatcagcatgaccgacgatcacaccgcaggtgcggccaacggactgatgatggtcggatacgtcatcggtttcatcgccctgttcctgctcagcggcctgggcaatggctcggtgtacaagatgatcccgtccatcttcgaggcccgcagtcactccctgcaggtcagtgagcaggagcggcagcggtggtcgctgtcgatgtcgggcgccctgatcggattcgccggagcgatcggagccctgggcggtgtcggtatcaacctggcgctccggcagtcctacctgtccagcggttcggcgaccaccgcgttctggatcttcctggccttctacctggtggcctcggcgtgcacctggttccgttacgtgcgcaggtcggttgcggtgggcgtcacaacgatcaccgaagaccgacacgactcggcaatggccgggtaa

SEQ ID NO: 28489 - protein, 471 aa, Mycobacterium fortuitum
MPTLLKSNRVTNWDPEDTLAWEAGNKYIARRNLIWSVFAEHVGFSIWSIWSVMVLFMPEAVYGFSAGDKFLLGATATLVGGCLRIPYTLATATFGGRNWTVFSAFVLLIPTVGTMLLLANPGLPLWPYLLCAALAGFGGGNFASSMTNINAFYPQRLKGWALGLNAGGGNIGVPMIQLVGLLVIATAGNRAPYWVCAVYLVALAVAGIGAALYMDNLEQHKIDLGAMKAILAERDTWVISLLYIGTFGSFIGFAFAFGQVLQINFAAGGQTAAQASLHAAQIAFIGPLLGSLSRVYGGKLADRIGGGRVTLAVFGGMILAAGLLVAISMTDDHTAGAANGLMMVGYVIGFIALFLLSGLGNGSVYKMIPSIFEARSHSLQVSEQERQRWSLSMSGALIGFAGAIGALGGVGINLALRQSYLSSGSATTAFWIFLAFYLVASACTWFRYVRRSVAVGVTTITEDRHDSAMAG

SEQ ID NO: 28490 - DNA, 1527 bp, Populus tremula x Populus tremuloides
  CDS (1)..(1527)
atggagatagaagggcaagccactgtcaaggaatctcagcctccaaaattcgctcttccagtggattcagaacacaaggcaactgagttccggttgttctcagtagctgcccctcacatgcgggcattccatctttcttgggtttctttctttgcctgttttgtctcttcttttgctgctccaccccttcttcctatcatacgtgacaacctcaacctcactgcctctgacattggtaatgcgggcattgcatcagtgtcaggtgcagtttttgctcgagttgctatggggactgcttgtgaccttttcggaccccgtctagcctctgcctcattgatcctcctcactgcacctgcagtttacttcacttccatggcctcatcttctacttcttttctcctggttcgttttttcactggcttctctctggccacttttgtctccactcaattctggatgagctctatgttttcagcaccggtagttggaacggctaatggcgttgcgggaggttggggtaaccttggcggtggggcaacgcaactaatcatgccccttgtgtttggcctcatccgtgacattggagccatcaaatttacagcttggagaattgcgtttttcattcctgccctgtttcagacactatcggcatttgcagtcttgatctttggcaaggacttgccggacggaaactttaggcggctgcagaaagcaggggataaaacaaaagataaattctcaaatgtcttctatcatggaataaaaaattacagagggtggatcctggcactcagttatgggtactgttttggggtagagctgacaatagacaacattgtcgcagaatacttctatgacagatttgacctcaaactccatacagcaggaatgattgcagcaagctttggtctagcaaacattgtttctcgaccaggtggtggaatgatctcagatgcagtagggaagaggtttggaatgagggggaagttgtgggctctgtgggtagtgcagaccttgggaggtgttttctgcatcatacttggacgagttggatctttaggcgcgtccattgtggtgatgattgtgttcttcttattctgccaagcagcatgtggactaacatttggggtggtgccttttgtctcacgaaggtcattggggctcatatctggtatgactggaggtggtggaaacgtgggggcagttctaactcaactaattttcttcagaggatcgaaatactcaaaagagagagggataatgctcatgggtgtcatgattatatgctgcactcttccaatttgtcttatacacttcccacaatggggtggaatgttttgcggtccatcatctacaaagatcgctacagaagaagactactacttgtccgaatggaattcagaggagaaggagaaaggcctgcatctatcaagcttaaagtttgcagataacagcagaagtgaaagaggtagaaaagaagattctgaaaccaggccagtagatgaaaccctatcaacaaaagtctag

SEQ ID NO: 28491 - protein, 508 aa, Populus tremula x Populus tremuloides
MEIEGQATVKESQPPKFALPVDSEHKATEFRLFSVAAPHMRAFHLSWVSFFACFVSSFAAPPLLPIIRDNLNLTASDIGNAGIASVSGAVFARVAMGTACDLFGPRLASASLILLTAPAVYFTSMASSSTSFLLVRFFTGFSLATFVSTQFWMSSMFSAPVVGTANGVAGGWGNLGGGATQLIMPLVFGLIRDIGAIKFTAWRIAFFIPALFQTLSAFAVLIFGKDLPDGNFRRLQKAGDKTKDKFSNVFYHGIKNYRGWILALSYGYCFGVELTIDNIVAEYFYDRFDLKLHTAGMIAASFGLANIVSRPGGGMISDAVGKRFGMRGKLWALWVVQTLGGVFCIILGRVGSLGASIVVMIVFFLFCQAACGLTFGVVPFVSRRSLGLISGMTGGGGNVGAVLTQLIFFRGSKYSKERGIMLMGVMIICCTLPICLIHFPQWGGMFCGPSSTKIATEEDYYLSEWNSEEKEKGLHLSSLKFADNSRSERGRKEDSETRPVDETLSTKV

SEQ ID NO: 28492 - DNA, 1602 bp, Pseudomonas sp
  CDS (1)..(1602): transl_table=11
atgagcaatatcgaaaagtgggacgtggaggaccagatcttctgggacaccactggcaagcgggtcgccaatcgcaatctgtggatctccatcccgagtctgctgatgggcttcgccatctggctgatgtggggcatcgtcacggtgcagatgctcaacctgggctttccgttcgcgcccgccgagttgttcaccctgaccgccatcgccggcctcaccggcgccaccctgcgcattccagcgtcgttcatgatccgcatcgctggcgggcgcaacaccatcttcctgaccaccgcactgctgatgattcctgccgccggcgcgggcattgccctgcagagtcaggacacaccgctgtgggtctttcagctgctgggcttcctctccggtatcggtggcggcaacttcgcctgctcgatgagcaacatcagcaccttcttcccgaagaaccagcagggattggccctgggcctcaacgccggcctcggtaacttcggtgtcaccaccatgcagatcctgatcccgctggtgatgactgccggtgtgttcggctttatcgccggcgacccgatgacactggtcaaggacagcggcaccttgatcggcggcattactgccggaaccgatacctggattcagaatggcggttgggtctggctgctgttcctggtgccgctggccttcgccggctggttcggcatgaacaacctgctggtgatctcgccgacgccgggttacccgctgaacgcgttcggcaagattcttggtctctacgccgtggccttttttgccgccgccgtcggcctgtacctgtacctgcctgcgccgaccggcctcggcgtgctgaatatgtggggcgtgatgctgctgaccatcggcgcgacgctcggcatgctgcgcctgctgccgggcagcatcagcccgaacatcaagcgccagtttgcgatcttccgcgacaagcacacctggtcgatgagcgttctctacatcctgaccttcggctcgttcatcggcttctccatggcgctgccgctgtcgatcacggtgatcttcggtttcatgaatgaggtcggcgctgatggcgtggtgacccgcgtcgccaaccccaacgcaccgagtgcgctgacctacgcctggatcgggccgttcattggcgccctgatccgcccgctgggcggctggatttccgacaagggcggcggctccatcgtcacccaagtgatctcggtggtcatggttggtgcctcggtcgcggccggctacgtgatgcagcaggcctacagctcggcccagcctgaagagtacttcttcctgttcctggtgctgttcctggtgctgttcgccgccagcggcatcggcaacggctcgaccttccgcaccatcggcgtcatctacgaccgcgagaaggccggcccggtactcggctggacctccgctgtcgccgcctacggctccttcgtcgcgccgatcgtgatcggcgagcaggtcaaggcgggcaccccggaagtagccatgtacggcttcgcggtgttctacgcgctgtgcctgatcctcaactggtggttctacctgcgccccaacgcctacgtgaagaacccctaa

SEQ ID NO: 28493 - protein, 533 aa, Pseudomonas sp
MSNIEKWDVEDQIFWDTTGKRVANRNLWISIPSLLMGFAIWLMWGIVTVQMLNLGFPFAPAELFTLTAIAGLTGATLRIPASFMIRIAGGRNTIFLTTALLMIPAAGAGIALQSQDTPLWVFQLLGFLSGIGGGNFACSMSNISTFFPKNQQGLALGLNAGLGNFGVTTMQILIPLVMTAGVFGFIAGDPMTLVKDSGTLIGGITAGTDTWIQNGGWVWLLFLVPLAFAGWFGMNNLLVISPTPGYPLNAFGKILGLYAVAFFAAAVGLYLYLPAPTGLGVLNMWGVMLLTIGATLGMLRLLPGSISPNIKRQFAIFRDKHTWSMSVLYILTFGSFIGFSMALPLSITVIFGFMNEVGADGVVTRVANPNAPSALTYAWIGPFIGALIRPLGGWISDKGGGSIVTQVISVVMVGASVAAGYVMQQAYSSAQPEEYFFLFLVLFLVLFAASGIGNGSTFRTIGVIYDREKAGPVLGWTSAVAAYGSFVAPIVIGEQVKAGTPEVAMYGFAVFYALCLILNWWFYLRPNAYVKNP

SEQ ID NO: 28494 - DNA, 1302 bp, Halomonas maura
  CDS (1)..(1302): transl_table=11
atgacgcctgccgactccctcgtttcccccagcggcccgcccgaggaggccccgttggccgagccgactccaccgctgggctatcgcgccctggtggtggtggtgctctcgccactggccttcgcgctggtcttcgcctgctggaccctgttcgccgtgctgggcctcgagctcaggcgcgaactggcgctgagccccctggccttcgccatcctgctggcgatgccgctgctggccggggggctggccagcctgcccgcggcgctgctggcccgacgcctgggggggcgccgggtcatgctcggctgcctgctgtggatctgtcccttcctgtggtggatcggccatgccgaccactatccggagtacctgctcgcgggcctgggactcggtgtcggggccggcgctctggccgccggcctggtccatgtggccacgctgggcccggcgcggcacgtcggcctggcgctggggctctacggggccggcatggtcggggcggggctcggctacctgttgctgccgctggtcagccaggcctatggctggcgcctggccccgttgctctacctgctgccggtggccctggtcgcgggattgctgtggctgttcgccgacgacgccggcacgccggcggaggccccgcgccgccgcccgtcgggccgcctggccgcggggctgcgacggctgcgggactggacgctgtggcggctggccatcacctacggcttcttcttcggtgccttcgtcggcctggcgctgtggttgccgggtgagctgacggcgcgctacggcctcgcgcaacaggccgcggccttgtgggggctgcccttcccgctggtggtgggaatcggtcaggtggtgggcggggccctggccgaccgccacgacttccgcagcctgcgctggtgggtcagcgccttcgtgctggcctgcctgttcctgctctcctatccgcccttcacgatgcagatccatggcgtgcatggggccctggcgctgcactacgacgcgcccctgtggggcttcgagctgctgatgggcctgatggggctggccatgggcctggggctcggcagcctgatgcggctgatccatcgcgaccacggcgaggacatggtgctggtgggcggcctggcgctgaccctcggtgggctcttcgccgccctgctgccgccggtgttcgtgctcggcagcctctggaccggcctcgataccgccggcttcatgttcctctacgccgccctggtgctctgcatgctggtgatgctggccgaccacgtccgcggcgctcgccgctga

SEQ ID NO: 28495 - protein, 433 aa, Halomonas maura
MTPADSLVSPSGPPEEAPLAEPTPPLGYRALVVVVLSPLAFALVFACWTLFAVLGLELRRELALSPLAFAILLAMPLLAGGLASLPAALLARRLGGRRVMLGCLLWICPFLWWIGHADHYPEYLLAGLGLGVGAGALAAGLVHVATLGPARHVGLALGLYGAGMVGAGLGYLLLPLVSQAYGWRLAPLLYLLPVALVAGLLWLFADDAGTPAEAPRRRPSGRLAAGLRRLRDWTLWRLAITYGFFFGAFVGLALWLPGELTARYGLAQQAAALWGLPFPLVVGIGQVVGGALADRHDFRSLRWWVSAFVLACLFLLSYPPFTMQIHGVHGALALHYDAPLWGFELLMGLMGLAMGLGLGSLMRLIHRDHGEDMVLVGGLALTLGGLFAALLPPVFVLGSLWTGLDTAGFMFLYAALVLCMLVMLADHVRGARR

SEQ ID NO: 28496 - DNA, 1254 bp, Rhizobium sp
  CDS (1)..(1254): transl_table=11
atgtccactgttcaccagacaaagaatatcagcgcaacagaacagggccgcgccctgtggatctcgacggccgccttcaccatctgtttcgccgtctggacgatcttttccatcatcggcgtgcgcatcaagcaggagcttggcctaagcgaagcgcagttcgggcttctgatcggtatgccgatcctcaccggctcgctgatccgtatcgtgctcggcatctggacgaaccgctatggcggcaggctcgtctatacggtcaccatgctggcggccgcactttcgaccttcctccttgcccatgcgacgacctatcccgagatgctgctcgccggcctcggcgtcggcttggccggcggctccttcgccgtcggagtcgcctatgtctcgccgttcttcccgccggaaaagcagggtacggcgctcggcatcttcggtgccggcaatgtcggcgcggcggtgaccaagttcctcgcgccgttcgtgctcgtcgcctatggctggcagatggttgcgcaggtctgggccgccggacttttgcacaccgccgtcgtcttctggttcacgaccgaagacgacccgaagttccgcgcccgtcgcgagacaagccagccgcgcaagagcttcctcagtgaattcgccccgctcaggaacgtccaggtctggcgcttctcgctttactacttcttcgccttcggcggcttcgtcgccctggcgctgtggctgccgcgctacctcgttggcgtctatggtttcagcatcgagacggcgggcatgatcgcagccgcctattccattcccggcagcattttccgcgcctatggcggcgcgctttccgacaggatcggcgcgcgcaagatcatgcatgcgatgttcgccgtgtccgccgtggcaacgctcattctctccgtgccggagggcggcgccgtgctgcacatcactccggttgttttcgtcggtgcaactttcgtgctcggcttcgtgatgagcctcggcaaggcggccgtctacaagcacattccggcctactatccggagcatgtcggcgcagtcggcggcgttgtcggcatgatgggtggccttggcggcttcatcctgcccgtcgccttcggtttcctcaaggactggaccggcctctggtcgagctgtttcatgctgctcttcgcgatcgttgcgatctcgatgatctggatgaacgcgtcgatccgccagtacaagcggcgtgccgttgagagtgcgccggccggtgcctaa

SEQ ID NO: 28497 - protein, 417 aa, Rhizobium sp
MSTVHQTKNISATEQGRALWISTAAFTICFAVWTIFSIIGVRIKQELGLSEAQFGLLIGMPILTGSLIRIVLGIWTNRYGGRLVYTVTMLAAALSTFLLAHATTYPEMLLAGLGVGLAGGSFAVGVAYVSPFFPPEKQGTALGIFGAGNVGAAVTKFLAPFVLVAYGWQMVAQVWAAGLLHTAVVFWFTTEDDPKFRARRETSQPRKSFLSEFAPLRNVQVWRFSLYYFFAFGGFVALALWLPRYLVGVYGFSIETAGMIAAAYSIPGSIFRAYGGALSDRIGARKIMHAMFAVSAVATLILSVPEGGAVLHITPVVFVGATFVLGFVMSLGKAAVYKHIPAYYPEHVGAVGGVVGMMGGLGGFILPVAFGFLKDWTGLWSSCFMLLFAIVAISMIWMNASIRQYKRRAVESAPAGA

SEQ ID NO: 28498 - DNA, 1311 bp, Halobacterium mediterranei
  CDS (1)..(1311): transl_table=11
atgggtctcgtcaagatgactcggtggcggacgctcgtcctcgccaccgcggcgttcaacctctcgtttctcatctggttctcgttcgccccgttcacggggcaaatcgccgcggagttcggactctcgctcaccgacctcggcattctcgccagcgcgcatctggtcggcccgccggggcgtattctcactggctggctctcggaccgcttcggcgcttcgacggtgttcggtatcgtcctcgcctacgtcggcatattcagcatggccagcgcgttcgcgacctcgtacgaggtgttcttcgtcgaacgggtcgtcgtcgcctcggcgggtatcaccttcgtcgtcggtatccagcacgtctcccagtggttccccgaggaggaactcgggactgccgagggcatctacgcgggtatcggcaatgccggtgccgcggggggtgcgctcatcctcccgcgggcgttcgggaactggagcggcccgctgttttcgaccgggtggcgcgcggcgttcttctacaccggtgtcgtcgccatcctgatggccatcgtctacgtcgttttcggacaggacgccgccacgaaagcccgtgcagcggccaccagcgagtcggcgacgctctcgacgtgggtccacacagcgacccgctacggcgtcgtcgcgctcgcactcggctacgtgatgagcttcgggctcgaaatctcgatgaacggctggcttccgacgtacttccgcgaaggattcggttcgaacctcgtcatcgccagcaccttcgcggcgacgttctcgctcgctgccgggttgcttcggccaatcggcggctacgtctccgaccgcctcgttcgcgaccagcgcgacattctcccgttcttcgcgggtcgctaccgggagcagtggactgtcctctgcatgacgttcatcgtcgtctcgatgaccggactcaccttcgcagggcagactggaaacgtcctcctgaccgtcgcagctggcttcctcgtcgggatgagttgcgcgttcacggagggtgcgatattcgcgcaagtccctgccatgttcccgaaccggtcgggcgctgccgccggtatcgtgggcggaatcggaaccttcggcggcatcggattcccgctcgtctactcgttcgccgccgcggaagggatgattcacacgggctacgtcatcgtggcggcgctcatgattccgatactcgcgttgaacgcgttcatctcgcgtccgcatatcgcgagtcgcgcccacgtggacggcttcttcgacgggagtcgcttcgagtccagtcagagcgacgactga

SEQ ID NO: 28499 - protein, 436 aa, Halobacterium mediterranei
MGLVKMTRWRTLVLATAAFNLSFLIWFSFAPFTGQIAAEFGLSLTDLGILASAHLVGPPGRILTGWLSDRFGASTVFGIVLAYVGIFSMASAFATSYEVFFVERVVVASAGITFVVGIQHVSQWFPEEELGTAEGIYAGIGNAGAAGGALILPRAFGNWSGPLFSTGWRAAFFYTGVVAILMAIVYVVFGQDAATKARAAATSESATLSTWVHTATRYGVVALALGYVMSFGLEISMNGWLPTYFREGFGSNLVIASTFAATFSLAAGLLRPIGGYVSDRLVRDQRDILPFFAGRYREQWTVLCMTFIVVSMTGLTFAGQTGNVLLTVAAGFLVGMSCAFTEGAIFAQVPAMFPNRSGAAAGIVGGIGTFGGIGFPLVYSFAAAEGMIHTGYVIVAALMIPILALNAFISRPHIASRAHVDGFFDGSRFESSQSDD

SEQ ID NO: 28500 - DNA, 1650 bp, Physcomitrella patens
  CDS (1)..(1650)
atggcagaccagacaacatcggcggtgggacatgggggaaggactgttcccggcatgtccatgcacggtgtgacaggaaaagagcctgtgtatgcattctcagtgattcaaggaactgtagaggaccccgacgctgagaagtttgcgctcccggtggactctgagcacaaggcgaaaacaatccgagtttacagtttcgcaaagccacacatgcgcgcctttcatctcgcttgggtgtctttctttacatgtttcttggcaaccttcgcgtcgccgcccctgatgccgatcatccgtgacaacttgaatttgaccaaaaccgacgttggacatgctgccatcgcctcagtatctggttctatcctgtctcgtctgctgatgggaaccgtgtgcgacgtggttggaccccgatatggctgtgcattcctgattatgataatttcgccagccgtgtactcaatggctcttgtttcagatgccgcgagctttataatagtccgattctttaccggtttcgctctagccaccttcgtctcttgccaattttggatgagctccatgttcaacagcaagatcgtcggcacagctaatgggctggccgcgggttggggcaacctcggtggtggcgctactcagctcatcatgcctctggttttcgcgttaatccgagacagcttcaactctacaccgttcgttgcatggcgcctggcctttttcttacccggagcgatgcagacaattatggggctcctcgttctatttctcggccaagatcttcccgacggcaactattctcagttgcagaaacaaggcgtcaaagtgaaagatagctttctaaaggtcttgatgtacgcaattacaaattacagaacatgggtgttctttctgttgtatggattcaccttcggcgttgagctgacagtcaacaacaacatcgctgagtacttctatgaccgcttcgatttgaatctctccacagctggaataatcgcttcattattcggcttgatgaactttttcgctcgtccaagtggtggaatcatctccgatactgttgcgcgccgttttggaatgaaaggtcgcctgtgcacgctgtggatatgccattcacttggggcagtcttctgcattgtgcttgggaggatggacagtttgactgccgccatagccgtcttgatcgtcttcgcggttttcatccaggcttctagcggggctgtttttggcataatcccttttatctcacggagatcacttggtgtgatttcgggattcactggcgcaggagggaatgtaggctccgtggtactgcaaacagtattcttcacatcgggttcgtatcgaaccgaagaaggcatccagttcatgggtgtgatggtcatctgtgtcgccgcgctaacagtatttatctatttcccccagtggggagggatcttctttcctccatccaaaagcaccgaagaagattactacgcctccgagtggagtgccgaggagcaggagcaagggaagcatgcaacaagcatgaaattcgcctctaatgcgagaagcgagcgtggaaagagaggtctgaattctcccgatttgaccatccatcccgttactgattccaaggccaccccagtttctgacgttgagctcaacaaagtgtaa

SEQ ID NO: 28501 - protein, 549 aa, Physcomitrella patens
MADQTTSAVGHGGRTVPGMSMHGVTGKEPVYAFSVIQGTVEDPDAEKFALPVDSEHKAKTIRVYSFAKPHMRAFHLAWVSFFTCFLATFASPPLMPIIRDNLNLTKTDVGHAAIASVSGSILSRLLMGTVCDVVGPRYGCAFLIMIISPAVYSMALVSDAASFIIVRFFTGFALATFVSCQFWMSSMFNSKIVGTANGLAAGWGNLGGGATQLIMPLVFALIRDSFNSTPFVAWRLAFFLPGAMQTIMGLLVLFLGQDLPDGNYSQLQKQGVKVKDSFLKVLMYAITNYRTWVFFLLYGFTFGVELTVNNNIAEYFYDRFDLNLSTAGIIASLFGLMNFFARPSGGIISDTVARRFGMKGRLCTLWICHSLGAVFCIVLGRMDSLTAAIAVLIVFAVFIQASSGAVFGIIPFISRRSLGVISGFTGAGGNVGSVVLQTVFFTSGSYRTEEGIQFMGVMVICVAALTVFIYFPQWGGIFFPPSKSTEEDYYASEWSAEEQEQGKHATSMKFASNARSERGKRGLNSPDLTIHPVTDSKATPVSDVELNKV

SEQ ID NO: 28502 - DNA, 1353 bp, Corynebacterium glutamicum
  CDS (1)..(1353): transl_table=11
atgaagaggcatcacgtgacacaactcaacaccaaaggcgttgttctgcaagggtgggatccagaagatcctgaacattgggactcgaaaattgcatggcgaaccctgtggattaccaccttctccatgattattgggttctgcgtgtggtatttggtttctgccatcgctcccctactcaatcgaattggatttgatctctcagcaggtcagctttattggctcgcatctatccccggtttggccggcggattaatccgattgatttacatgttccttccaccgattcttggaacccgcaaattggtcggaatttcctccggtctatttttgatccccatgtttgggtggttcctggctgtccaagattcaagcactccctactggtggcttctcacactcgctgcactcactggcattggtggtggcgtgttctctggatatatgccgtccacgggatacttcttccccaaggcaaaatcgggcactgcgctgggcattcaggcaggtatcggcaacctcggcgtctcgataattcagttcatgggcccatgggtcatgggtttcggtctgctgggcattggtttcctcaccccgcagcgcaccattgaaggcaccacggtgtttgtgcacaatgctgcgattgtgttggtcccgtggactattctcgcggccgttttatccttcctgtttcttaaagatgtcccagtcaccgcaaatttccggcaacagatcgatatctttggcaacaagaacacatggattttgtccattatctacttgatgacattcggtgccttcgccggtttcgccgcgcagttcggtctgatcatcaacaacaacttcggcatcgcttccccgatggcagagacttatccagctgagatgcttcacgccggtgctacgttcgcgtttcttggacctttgattggtgctttggtgcgtgctgcatggggtccactgtgtgacagattcggtggagctatctggacctttgtcggtggcatcggaatgactatcgccactgcagctgccgcaatcttcctaagcagagcggagacacctgatgatttctggccattcctgtggtccatgcttgccctgttcttcttcaccggtctgggcaatgctggcaccttcaaacaaatgcccatgattttgcctaaacgccaagcaggtggcgtgatcggctggaccggtgccattggtgccttcggccccttcattgtcggtgtcttgctctccttcactccaactgtcgcgttcttctggggctgcgtggtgttcttcatcatcgccaccgctttgacctggatctactacgcccgcccgaacgctccattcccgggataa

SEQ ID NO: 28503 - protein, 450 aa, Corynebacterium glutamicum
MKRHHVTQLNTKGVVLQGWDPEDPEHWDSKIAWRTLWITTFSMIIGFCVWYLVSAIAPLLNRIGFDLSAGQLYWLASIPGLAGGLIRLIYMFLPPILGTRKLVGISSGLFLIPMFGWFLAVQDSSTPYWWLLTLAALTGIGGGVFSGYMPSTGYFFPKAKSGTALGIQAGIGNLGVSIIQFMGPWVMGFGLLGIGFLTPQRTIEGTTVFVHNAAIVLVPWTILAAVLSFLFLKDVPVTANFRQQIDIFGNKNTWILSIIYLMTFGAFAGFAAQFGLIINNNFGIASPMAETYPAEMLHAGATFAFLGPLIGALVRAAWGPLCDRFGGAIWTFVGGIGMTIATAAAAIFLSRAETPDDFWPFLWSMLALFFFTGLGNAGTFKQMPMILPKRQAGGVIGWTGAIGAFGPFIVGVLLSFTPTVAFFWGCVVFFIIATALTWIYYARPNAPFPG

SEQ ID NO: 28504 - DNA, 1284 bp, Paracoccus halodenitrificans
  CDS (1)..(1284): transl_table=11
atgccacacctccccgaccgccgcgatcctgtcgtcgtcggctaccgcccgctggtggtggtattgctgtcgccgctggtctttgcgctggtgttcgccagctggaccatcttcgcggtgctggggctggagctgcgcgagccgctgggtctggatgaactcggcttcgccttcatgctggccacgcccatgctcaccggggccctggcggcgctacccatggcggcactggcccggcgtcatggcgggcgccgcgtgatgatcgcctgcctgttgctgatctgtcccttcctgtgggcgatcgcccgctccagcagctattcacacttcctgctgtccggcgccggcctggggctgggggccgggtctctggcggcggggctggtctatgtcggcgagctctcgccccggcggcatgttggcctcgccctgggcctctacggggccggcatgatgggggccggactgagctatctgctgctgcccctggtcagccaggcctatggctggcgcagcgcccccctgctctatctgctgccggtgctgacggtcgcgacgctgttgtggctgtttgccgatgacccggacctctccgtcgactctggcctcgccggcgtcgccgccggtacccggccgcgcctctcggggtggctgagggccttgcgacactggcgcccctggcgcctggccgtggtctacagcttcttctatggcgccttcgtggcgctgtcgctatggctgccggcctacctcgaggcccagtacgacctgggcatccgctacgccgccctgctggcgctgccctttccgctggcggtgggcttggggcaggtggccggcggcgtctggggcgatgtgcacgactttcgtgccttgcgctggtgggtcagcgcctgggtgctggtctgcctgtttctgctctcttatccccccttcgacatgcgggtcgagggcgtggaggggatgctgatgctgcgttattccgcgccgctgtggggctttctgacgctgctggtcgccatgggtctggtcatgggggtcgggcagggcagcctgatgcgcatgatccatcgtgatcacggccagcagctggccctggtgggtgggctggcgctgaccctgggcgggctgtttggcgccctgctgccggtgatgttcgccctgggcaaccactgggtgggcatccgcaccgcagggttcatgttcctctatgcctcgctggtgctgtgcatgctggtgatggtgtgggaccacgccagccaggcagggcagacgaggccctga

SEQ ID NO: 28505 - protein, 427 aa, Paracoccus halodenitrificans
MPHLPDRRDPVVVGYRPLVVVLLSPLVFALVFASWTIFAVLGLELREPLGLDELGFAFMLATPMLTGALAALPMAALARRHGGRRVMIACLLLICPFLWAIARSSSYSHFLLSGAGLGLGAGSLAAGLVYVGELSPRRHVGLALGLYGAGMMGAGLSYLLLPLVSQAYGWRSAPLLYLLPVLTVATLLWLFADDPDLSVDSGLAGVAAGTRPRLSGWLRALRHWRPWRLAVVYSFFYGAFVALSLWLPAYLEAQYDLGIRYAALLALPFPLAVGLGQVAGGVWGDVHDFRALRWWVSAWVLVCLFLLSYPPFDMRVEGVEGMLMLRYSAPLWGFLTLLVAMGLVMGVGQGSLMRMIHRDHGQQLALVGGLALTLGGLFGALLPVMFALGNHWVGIRTAGFMFLYASLVLCMLVMVWDHASQAGQTRP

SEQ ID NO: 28506 - DNA, 1593 bp, Paracoccus halodenitrificans
  CDS (1)..(1593): transl_table=11
atgaccaggaagaatgccgacatcgaaaggtgggatgtcgagaacgaggagttctgggaatcggagggcaagcgagtcgccaaccgcaacctctggatctccattcccagcctcctgctgggcttcgccgtctggctgatgtggggcatgatcaccacccagatgcagaacctgggcttcccgttctcggtggatcagctgttcacactgaccgcgatcgccggcctcgccggcgccaccctgcgtatccccgcatcgttcatgatccgcatcgccggcggtcgcaacaccatcttcctgacgaccgccctgctgatggtccctgccctggggaccggcatcgcgctgatgaccccccagacgcccttctgggtgttccaggtgctggcactgctctcgggcatcggcggcggcaacttcgccaactcgatgagcaatatctccaacttcttccccaagaagcagcagggctatgccctgggcatgaatgccgggctgggcaacttcggcgtcaccaccatgcagatcctgattcccctggtgatgaccgtgggcctgttcggtgccttcggcggcgatgccatggagcttgagaaggccagcggcacgctgatcggtcgcatcgaggcgggcaccgacacctggatccagaacgccggtctcgtgtggatgctgctattgatcccgctggccttcgccggctggttcggcatgaacaacctgcgcaccatcacgcccaactccggctcgcccctgcaggccttcggcaagattctcggcctctacggggtcggcgtcgtgacctccatcgtcggcgtggtagcgctgggctatctcaacatgtgggtcgccctgccgctgaccatcgtgctgaccgtggtgctgctgcgcctgatccccggggatatcaagcccgccatcaagaagcagttcgagatcttctccaacaagcacacctggtcgatgacggtgctctatatcgccaccttcggctcctttatcggcttctccgcggccctgcccctctccatctccgtgatcttcggcaacatgatggaagtggccgccgatggcagcatggtccgggtcgccaaccccgacgcccccagcgccctgacctgggcctggatgggccccttcgtgggcgccctgatccgcccggtgggcggctggatctccgataagctgggtggctccatcgtgacccaggtcatcaccgccatcatggtggtgggctccgtggccgccggctacgtcatgatgctggcctacaactccaccgaccccaaccagtatttctggatgtttctgctgctgttcatcctgttgttcgccgccagcgggatcggcaacggctccaccttccgcagcatcggcttcatcttcgacccacagcagaagggcccggcgctgggctggacctctgccgtggccgcctatggctcctttatcgccccccgggtcatgggcgagcagatcaaggccggcacgccggaactcgccatgtacggcttcgcggttttctatgccgtctgcctgctcgtcaactggtggttctacctgcgccccggcgcctatgtgaagaacccctga

SEQ ID NO: 28507 - protein, 530 aa, Paracoccus halodenitrificans
MTRKNADIERWDVENEEFWESEGKRVANRNLWISIPSLLLGFAVWLMWGMITTQMQNLGFPFSVDQLFTLTAIAGLAGATLRIPASFMIRIAGGRNTIFLTTALLMVPALGTGIALMTPQTPFWVFQVLALLSGIGGGNFANSMSNISNFFPKKQQGYALGMNAGLGNFGVTTMQILIPLVMTVGLFGAFGGDAMELEKASGTLIGRIEAGTDTWIQNAGLVWMLLLIPLAFAGWFGMNNLRTITPNSGSPLQAFGKILGLYGVGVVTSIVGVVALGYLNMWVALPLTIVLTVVLLRLIPGDIKPAIKKQFEIFSNKHTWSMTVLYIATFGSFIGFSAALPLSISVIFGNMMEVAADGSMVRVANPDAPSALTWAWMGPFVGALIRPVGGWISDKLGGSIVTQVITAIMVVGSVAAGYVMMLAYNSTDPNQYFWMFLLLFILLFAASGIGNGSTFRSIGFIFDPQQKGPALGWTSAVAAYGSFIAPRVMGEQIKAGTPELAMYGFAVFYAVCLLVNWWFYLRPGAYVKNP

SEQ ID NO: 28508 - DNA, 2718 bp, Paracoccus pantotrophus
  CDS (1)..(2718): transl_table=11
atgccggacccaagttccttttccccgatgcagcagcaaaaggcgctgtggctcagcaccaccgccttcacgctgtgctttgccgtctggacgatcttttccatcatcggcatcaccatcaaggaggagctcggcctgaccgagttcgaatatggggtgctgatcgccacgcccatcctgaccggatcgctggtccggctgatcctgggcgtctggaccgaacgctatggcggccgcctggtgttctcgttgcagatgctgttcaccggccttgccacctgggcgctgacctgggccgacagctatgccggcttcctgctggcggctttgggcgtgggcatggcgggcggcagcttcatcatcggcgtcgcctatgtctcgaaatggttcccggcccagcgccagggcactgcgcttggcatcttcggcatgggcaacgtgggcgccgcggtcacgaagttcatcgcgcccttcatcctggtcgcctggggttggcaggccgtggcgcagatctgggcggtgggcatcgcgctgatgggcgtggtcttcctgctggtcgcccgcgacgatcccgatttcgaggcgcgccgtgcccagggcatcgccgggccgacactggccgagcagttcgcgccgctcaagaagctccaggtctggcgcttcgcgctttactatttcttcgtcttcggcggcttcgtcgccctggcgctgtggctgccgcattacctgacgcaggtctatggcgtcgatctgcgggtcgcgggcatggcggcggcggccttcagcctgtcggccagcatcttccgcgcctatggcggcatcctgtccgaccgtttcggcgcgcgcacggtgatgtactggaccttcggcttcagcgcgctgttcctgttcatgctgtcctatccgccgaccgattacaccatccgcggcaaggacgggctgatctcgttctcgaccgagatggggctctggcccttcgtggtcacgttgtttgcgctgggcttcttcatgagcctgggcaaggccgccatcttcaagcacatcccggtctattatccgaaccatgtcggggcggtcggcgggcttgtcggcatgatcggcggcctgggcggctttgtgctgcccatcgtcttcggtgcggcgctggacctgaccgggatctggacctcgtgctttgccctgcttttgctgatcgtcgtcgtctcgatggcctggatgcacctgtcgatccgcgccatggagcgccgtgcccagggccgggccctggaccggctgccgaactttcccgaactggccgaggtgcatgaccctgagcgcacggtgatgccgcgcgtgctggacgactggcgccccgagaacccgaccttctgggccgagcagggccgcaggatcgccaggcgcaacctgtggatctcgatccccgccctgacgctggccttcgcggtctggatggtctggtcggtggtggtggccaagctgccgctgatcggcttcggcttcacccaggaccagctgttctggctggcggcgctgccggccctgtcgggcgccaccgtgcgcatcttctacagcttcatggtgccgatcttcggcgggcggctgtggacgacgctgtccaccgcctcgctgctgatcccggccatgggcatcggctatgcggtgcaggatcccgcgacgccttatgtgatcttcgtggcgctggcgctgctgtgcgggctggggggcgcgaacttcgcctcgtccatggccaatatcagcttcttcttcccgaaatcggaaaagggcaacgccctggggctgaacgcgggcctgggcaacctgggcgtatcgctgatgcagttcctggtgcccatcgtcatcaccatgggcgtctttggcgccatgggcggcgcggcgcaggagctttcggacggcagccggctgtggatgcagaacgcgggcttcatctgggtgcccttcatcatcgcctcgaccattgcggcctggctggggatgaacgacatcaccgatgcccgcgccagcttccgcgaacaggcggtgatctttacccggctgcacaactgggtgatgtgcctgctttacatcggcaccttcggcagcttcatcggctattctgccggcttcccgctgctcatcaagctggccttcccggacgtcaacgcgctgcaattcgtgttcctgggcccgctggtcggcgcgctcagccgcgcgggcacgggctggctttccgaccgggtcggcggcgggcgcgtgaccttctgggtcttcgccggcatgatcgcctcggtcgggctggtgatcgtctcgctgcaggcgctgtccttctggggcttcttcgcgggcttcatggcgctgttcttctttaccggggtcggcaattcctcgaccttccagatgatcccggtgatcatgcgcaaggaagtcgcccggcttgagccgcagctgtcccccgaggatcgccgccgccagtccgaccgcgaatccgccgcgatcatcgcattcaccagcgcgatcggtgcctatggcggcttcttcatccccaaggcctatggcagttcgatcgccctgaccggatcggcgatcggcgcgctctgggccttcctgggcttctacgtgctctgccttgccgtgacctgggtgttctacacccgtccgggcggccttctgcacgacatcgaacgcggccgcgcctctgccggcgccgcctcccctgcctga

SEQ ID NO: 28509 - protein, 905 aa, Paracoccus pantotrophus
MPDPSSFSPMQQQKALWLSTTAFTLCFAVWTIFSIIGITIKEELGLTEFEYGVLIATPILTGSLVRLILGVWTERYGGRLVFSLQMLFTGLATWALTWADSYAGFLLAALGVGMAGGSFIIGVAYVSKWFPAQRQGTALGIFGMGNVGAAVTKFIAPFILVAWGWQAVAQIWAVGIALMGVVFLLVARDDPDFEARRAQGIAGPTLAEQFAPLKKLQVWRFALYYFFVFGGFVALALWLPHYLTQVYGVDLRVAGMAAAAFSLSASIFRAYGGILSDRFGARTVMYWTFGFSALFLFMLSYPPTDYTIRGKDGLISFSTEMGLWPFVVTLFALGFFMSLGKAAIFKHIPVYYPNHVGAVGGLVGMIGGLGGFVLPIVFGAALDLTGIWTSCFALLLLIVVVSMAWMHLSIRAMERRAQGRALDRLPNFPELAEVHDPERTVMPRVLDDWRPENPTFWAEQGRRIARRNLWISIPALTLAFAVWMVWSVVVAKLPLIGFGFTQDQLFWLAALPALSGATVRIFYSFMVPIFGGRLWTTLSTASLLIPAMGIGYAVQDPATPYVIFVALALLCGLGGANFASSMANISFFFPKSEKGNALGLNAGLGNLGVSLMQFLVPIVITMGVFGAMGGAAQELSDGSRLWMQNAGFIWVPFIIASTIAAWLGMNDITDARASFREQAVIFTRLHNWVMCLLYIGTFGSFIGYSAGFPLLIKLAFPDVNALQFVFLGPLVGALSRAGTGWLSDRVGGGRVTFWVFAGMIASVGLVIVSLQALSFWGFFAGFMALFFFTGVGNSSTFQMIPVIMRKEVARLEPQLSPEDRRRQSDRESAAIIAFTSAIGAYGGFFIPKAYGSSIALTGSAIGALWAFLGFYVLCLAVTWVFYTRPGGLLHDIERGRASAGAASPA

SEQ ID NO: 28510 - DNA, 1266 bp, Pseudomonas fluorescens
  CDS (1)..(1266): transl_table=11
atgcgagcacaagtgcaacaagggctggtactagggatgagtaccttggccttcaccgtgtgcttcatggtctggatgatgtttgccgtgctcggcgttccgatcaaggaattgctggccctcaacgaaacccaatttggcctgttggccgccacgccggtactcaccggttctctggtacgtttgcccctggggcttctgaccgaccgctttggcggacggatcgtgttcttcctgctgatgctcgcctgcgtgttgccgctgtacctgatcaccctcgccacggcctattggcagttcctggtgctgggcctgttcgtcggcctggccggcggctcgttctcggtgggcatcgcctacgtcgccaaatggttcgataagcagaaccagggtttcgccatgggcgtgttcggtgcgggcaacgccggtgcggcggtgaccaagttcctcgccccggcgctgatcgcgttcggaacctggcacctggtgccgaaggtgttcagcgcgatcctgttcatcacggcattactgttctggtttctcaccgccgagaaaaaagaacaccgcaatgccggcggcgccacgttgcgtgagcaactcaagtcactgaaagatcctgcggtgtggcgctactgccagtactactcgatcgtgttcggcggctacgtggccttggcgttgtggatgaccaagtactacgtgcaggaatacggcttcagcctgcaaagcgcggcgctgttggcggcgtgtttttccttgcccggtggcgtgctgcgggccgtcggtggctggatgtccgaccgttggggcgcccagagcgtgacctggtgggtgctgtgggtgagttggatctgcctgttcctgctgtcctatccgcaaacccagctgcaagtgcaaaccgtcaacggcatcgttgattttcacatcggcctcaacgccacgctgttccctgtgatcctgttcgtgatgggcatcgccttcgcgttcggcaaggcctcggtcttcaagtacatcgccaacaactacccgcagaacatgggcgcggtgtccggcatcgtcggcctggccggcggcctgggtggtttcgtgctaccgatcatgtttggcgccctggtggacctcaccggcgtgcgctcgtcctgcttcatgttgctgtacggcgtggtctgggtctcgttgatctggatgtacctgagcaaagtgcacaagcgcccgctgctgggtaaacaaccgccggccagccaatccccgttttccagcatttga

SEQ ID NO: 28511 - protein, 421 aa, Pseudomonas fluorescens
MRAQVQQGLVLGMSTLAFTVCFMVWMMFAVLGVPIKELLALNETQFGLLAATPVLTGSLVRLPLGLLTDRFGGRIVFFLLMLACVLPLYLITLATAYWQFLVLGLFVGLAGGSFSVGIAYVAKWFDKQNQGFAMGVFGAGNAGAAVTKFLAPALIAFGTWHLVPKVFSAILFITALLFWFLTAEKKEHRNAGGATLREQLKSLKDPAVWRYCQYYSIVFGGYVALALWMTKYYVQEYGFSLQSAALLAACFSLPGGVLRAVGGWMSDRWGAQSVTWWVLWVSWICLFLLSYPQTQLQVQTVNGIVDFHIGLNATLFPVILFVMGIAFAFGKASVFKYIANNYPQNMGAVSGIVGLAGGLGGFVLPIMFGALVDLTGVRSSCFMLLYGVVWVSLIWMYLSKVHKRPLLGKQPPASQSPFSSI

SEQ ID NO: 28512 - DNA, 1332 bp, Thermus thermophilus
  CDS (1)..(1332): transl_table=11
atgctgaagtccgccaagggaacctggattacggattggaaccccgaggaccccaagcgttgggacccggccctggcttggcgcaccctctggatcaccaccttcaacctcaccctgtccttcatcacctggtacgtggtgagcgccctggtggtgcgcctacccaaggtggggtttgagctctccaccacccagctcttctggctcacggccatgccggggctggccgggggcaccctgcgcatcatctggaccttcttgccccccatcttgggcacccgccacctggtcaccttttccaccctcctccttctcatcccgcttctgggctggggcttcgccgtgcagaacaccgggaccccttactgggttctcctgctcctggccttcttggcgggcatcgggggagggcacttctcggggtacatgccctccaccagctatttctttcccaagcgcctccaggggacggccttgggcttgcaggcggggatcggcaactttggggtttccatcgtccagttcgtgaccccctggatcatcggcttcgccctcttcggctccctcctgggtgggccccagaccttcacccccaagcccggggttgtcccagcccatctggctccagaacgccaccttcgcctgggtgcccttgtcctcttgggggcgctcttggcctgggtctatctgaaaagcgtgcccatccgggccaacttccgcgagcagtttgacatcttccgcgacaatcacacctggatcatgaccaccctttacatcatcaccttcgggtccttttccgggttctccgccatcttccccctcctcatccgcgaggtctacgggaagtttgaaggggctcccgatcccttgcggtacgccttcctggggcctttggtgggttccttggcccgggtgatcgccggggccatctccgaccgcctgggcggggccatcgtcacccaggtttccgccatcggcatcttcctctccgcccttctggtcaccctctacacccggcccacctccttggaccagttccccatgttcgtggtggccatgctcctgatcttcttcttcagcggggtggggaatgccagcaccttcaagcagatgcccatgatctttccgccccgccaggcggggggagttatcggctggaccgcggccgtcgccgcctacgggcctttcctcttctccaccctggctgcctatacccagcaggccacgggaggcttcaccgccttcttctacgggctcatggtcttctacgccttcaacttcttcctgaactggtactactacgcccgcaagggggcggagaagccctgctaa

SEQ ID NO: 28513 - protein, 443 aa, Thermus thermophilus
MLKSAKGTWITDWNPEDPKRWDPALAWRTLWITTFNLTLSFITWYVVSALVVRLPKVGFELSTTQLFWLTAMPGLAGGTLRIIWTFLPPILGTRHLVTFSTLLLLIPLLGWGFAVQNTGTPYWVLLLLAFLAGIGGGHFSGYMPSTSYFFPKRLQGTALGLQAGIGNFGVSIVQFVTPWIIGFALFGSLLGGPQTFTPKPGVVPAHLAPERHLRLGALVLLGALLAWVYLKSVPIRANFREQFDIFRDNHTWIMTTLYIITFGSFSGFSAIFPLLIREVYGKFEGAPDPLRYAFLGPLVGSLARVIAGAISDRLGGAIVTQVSAIGIFLSALLVTLYTRPTSLDQFPMFVVAMLLIFFFSGVGNASTFKQMPMIFPPRQAGGVIGWTAAVAAYGPFLFSTLAAYTQQATGGFTAFFYGLMVFYAFNFFLNWYYYARKGAEKPC

SEQ ID NO: 28514 - DNA, 1308 bp, Thermus thermophilus
  CDS (1)..(1308): transl_table=11
atgatccacgatcctgcccaactggaaaaggagcgccccgaccgcttgagggtcctctggctttccaccttggccttcaccctcatgttcgccgcttggctcatgttcggcgtgctgggggtacccatccgcaaggagttcggcctctccgacgtgcagctttcctggatctccgccctggccatcctcaatggctccctttggcgcctcctagcgggcattctcgccgaccgctacggggggcggctggtcttcaccctcatgctcttcttcaccgccatccccgcctacctggtttcccgggcggggagctacgaggagctcctcctctacgccttcttggtgggctttgcggggaacagcttcagcgtgggcatcgcctggaactccgcctggttccccaaggaccagcagggctttgccctgggggtgttcggggcgggcaacgtgggggccagcgtcaccaagttcatcggcccggccctcatcgccagcgttcccgcctcggggtatttgggggggctcattcccggggggtggcgcttcatccccttcctctacgcggtgctcctggtgctgatgggcttcgtcctgtggttcggcactccccggaaggacaagcgcccggggcagggaaggcccttcctggacatgctaaagcccctccgctacgtgcgggtgtggcgcttcagcctctactacgtggtggtctttggggcctacgtggcccttagcgcctggcttcctaagtactacgtggacgtcttcggcctgcccctgcacgaggcggctctgctcaccgccctcttcatcttccccgcgagcctccttaggccggtggggggctacctttccgaccgcttcggggcgcggcgcatcatgtactggaccttcggcatcatcctcctggcctcgggggtgctgatgatgcccgaagggcacatcgtcctctacaccaagcaaggggccaaggaggtgatgcagttcaccatgggcgtggagctcttcaccctcctggtcttcctcatcggcgtggggatggggatcggcaaggccgcggtctacaagcacatccccacctacttcccccaggacgtgggggcggtgggcggcctcgtggggatgctgggggccctggggggcttcttcctcccgccccttttcgcctacgcccaggcctggaccggtctgccccagatgaccttcttcgtcctcttccttctcgccgccatcagcttcctctggatgcacctcaccgtcctaaagctcttgcagcaggaggcccagcacctcaagaaacgactttga

SEQ ID NO: 28515 - protein, 435 aa, Thermus thermophilus
MIHDPAQLEKERPDRLRVLWLSTLAFTLMFAAWLMFGVLGVPIRKEFGLSDVQLSWISALAILNGSLWRLLAGILADRYGGRLVFTLMLFFTAIPAYLVSRAGSYEELLLYAFLVGFAGNSFSVGIAWNSAWFPKDQQGFALGVFGAGNVGASVTKFIGPALIASVPASGYLGGLIPGGWRFIPFLYAVLLVLMGFVLWFGTPRKDKRPGQGRPFLDMLKPLRYVRVWRFSLYYVVVFGAYVALSAWLPKYYVDVFGLPLHEAALLTALFIFPASLLRPVGGYLSDRFGARRIMYWTFGIILLASGVLMMPEGHIVLYTKQGAKEVMQFTMGVELFTLLVFLIGVGMGIGKAAVYKHIPTYFPQDVGAVGGLVGMLGALGGFFLPPLFAYAQAWTGLPQMTFFVLFLLAAISFLWMHLTVLKLLQQEAQHLKKRL

SEQ ID NO: 28516 - DNA, 1449 bp, Cylindrotheca fusiformis
  CDS (1)..(1449)
atgagtggaactgatgttgcaactggtgctcctgccgaatggaagaagtaccaagagtactcccttgacgtcgatcccgatcaagacgaccgggccactgagatcaagctatgtaacttctctcggccccatatgagagctttccatttctcatggattggattcttcattgccttcttcatctggttcgccatcgctccccttctcagtgagatccaagatactcttgacttggacaagaaggaagtctggacttcatctattgtcggtgtcggaggtacaattttcatgcgtttccttctaggaccgttctgcgacaagatcgggccccgagtcctcttcacctttgtcctttgcttcgcttctattcccactgcctgtaccggatttgtcaactctgccacttcccttgccgtcctccgattgttcattggaactgctggaggtactttcgtcatgtgccaatattggactagccgaatgttcacaaagcaagtggtcggaactgccaatgctcttgtcggtggatggggaaatcttggaggaggtgtcacgcagcttgtcatgggatcagcgttgtttccactgttcaaggaaatcttcaagaacgagcctgaccccgctgagactgcgtggcgatgggtttctatcgttcccgccgtcgttgcattcgcaattggtctcctaattttcttctattccgacgatgcgcccaagggaaactaccacgagatgaagaagaatggggccatggccgatgtttccgccgccgcttccttccgcaccggagcactcaacctcaatacttggtttttgttcatccaatacgcatgctgcttcggtgtggaactgaccatgaacaacgccgccgttctgtacttcaaggagaagttctcgctgaccactgaagaagcggccgccattgcctccatcttcggatggatgaatcttttcgcccgtggcgctggtggattccttagtgacaaggccaacgccaggatgggaatgcgtggacgcctttggactcagaccatcttgctggcttgtgagggtgctcttgtcttggtttttgccaacacaggatcgttgacgggagccattgtcgttatggtcttcttttctctattcgtccaagccgctgaagggtcctcttatggaatcgtcccctacgttgacccacccgccactggagctattgccggtatcattggagctggaggaaacactggagccgtcgcttttggaatgggattccgtcagttggactacaaagatgctttcatcatcatgggagccgtcatctgtgcgtcttctgtcttgtcagtcttcatctgcatccccggatcgtctagaatgattggaggagaagcggatgatgtcggtgccaaggaccccactttgtcggttcccgaacctgatacccagaagactcaggatgtcaatgcctaa

SEQ ID NO: 28517 - protein, 482 aa, Cylindrotheca fusiformis
MSGTDVATGAPAEWKKYQEYSLDVDPDQDDRATEIKLCNFSRPHMRAFHFSWIGFFIAFFIWFAIAPLLSEIQDTLDLDKKEVWTSSIVGVGGTIFMRFLLGPFCDKIGPRVLFTFVLCFASIPTACTGFVNSATSLAVLRLFIGTAGGTFVMCQYWTSRMFTKQVVGTANALVGGWGNLGGGVTQLVMGSALFPLFKEIFKNEPDPAETAWRWVSIVPAVVAFAIGLLIFFYSDDAPKGNYHEMKKNGAMADVSAAASFRTGALNLNTWFLFIQYACCFGVELTMNNAAVLYFKEKFSLTTEEAAAIASIFGWMNLFARGAGGFLSDKANARMGMRGRLWTQTILLACEGALVLVFANTGSLTGAIVVMVFFSLFVQAAEGSSYGIVPYVDPPATGAIAGIIGAGGNTGAVAFGMGFRQLDYKDAFIIMGAVICASSVLSVFICIPGSSRMIGGEADDVGAKDPTLSVPEPDTQKTQDVNA

SEQ ID NO: 28518 - DNA, 1449 bp, Cylindrotheca fusiformis
  CDS (1)..(1449)
atgagtggaactgatgttgcaactggtgctcctgccgaatggaagaagtaccaagagtactcccttgacgtcgatcccgatcaagacgaccgggccactgagatcaagctgtgtaacttctctcgtccccatatgagagctttccatttctcatggattggattcttcattgccttcttcatctggttcgccatcgctccccttctcagtgagatccaagatactcttgacttggacaagaaggaagtctggacttcttctattgtcggtgtcggaggtacaattttcatgcgtttccttctaggaccgttctgcgacaagatcgggccccgagtcctcttcacctttgtcctttgcttcgcttctatccccactgcctgtaccggatttgtcaactctgccacttcccttgccgttctccgattgttcattggaactgctggaggtactttcgtcatgtgccaatattggactagccgaatgttcacaaagcaagtggtcggaactgccaatgctcttgtcggtggatggggaaatcttggaggaggtgtcacgcagcttgtcatgggatcagcgttgtttccactgttcaaggaaatcttcaagaacgagcctgaccccgctgagactgcgtggcgatgggtttctatcgttcccgccgtcgttgcattcgcaattggtctcctaattttcttctattccgacgatgcgcccaagggaaactacaacgagatgaagaagaatggggccatggccgatgtttccgccgccgcttccttccgcaccggagcactcaacctcaatacttggtttttgttcattcaatacgcatgctgcttcggtgtggaactgaccatgaacaacgccgccgctctgtacttcaaggagaagttctcgctgaccactgaagaagcggccgccattgcctccatcttcggatggatgaatcttttcgcccgtggcgctggtggattccttagtgacaaggccaacgccaggatgggaatgcgtggacgcctttggactcacaccatcttgctggcttgtgagggtgctcttgtcttggtttttgccaacacaggatcgttgacgggagccattgtcgttatggtcttcttttctctattcgtccaagccgctgaagggtcctcttatggaatcgtcccctacgttgacccacccgccactggagctattgccggtatcattggagctggaggaaacactggagccgtcgcttttggaatgggattccgtcagttggactacaaagatgctttcatcatcatgggagccgtcatctgtgcgtcttctgtcttgtcagtcttcatctgcatccccggatcgtctagaatgattggaggagaagcggatgatgtcggtgccaaggaccccactttgtcggttccccaacctgataccgagaagactcaagatgtcaatgcctaa

SEQ ID NO: 28519 - protein, 482 aa, Cylindrotheca fusiformis
MSGTDVATGAPAEWKKYQEYSLDVDPDQDDRATEIKLCNFSRPHMRAFHFSWIGFFIAFFIWFAIAPLLSEIQDTLDLDKKEVWTSSIVGVGGTIFMRFLLGPFCDKIGPRVLFTFVLCFASIPTACTGFVNSATSLAVLRLFIGTAGGTFVMCQYWTSRMFTKQVVGTANALVGGWGNLGGGVTQLVMGSALFPLFKEIFKNEPDPAETAWRWVSIVPAVVAFAIGLLIFFYSDDAPKGNYNEMKKNGAMADVSAAASFRTGALNLNTWFLFIQYACCFGVELTMNNAAALYFKEKFSLTTEEAAAIASIFGWMNLFARGAGGFLSDKANARMGMRGRLWTHTILLACEGALVLVFANTGSLTGAIVVMVFFSLFVQAAEGSSYGIVPYVDPPATGAIAGIIGAGGNTGAVAFGMGFRQLDYKDAFIIMGAVICASSVLSVFICIPGSSRMIGGEADDVGAKDPTLSVPQPDTEKTQDVNA

SEQ ID NO: 28520 - DNA, 1449 bp, Cylindrotheca fusiformis
  CDS (1)..(1449)
atgagtggaactgatgttgcaactggtgctcctgccgaatggaagaagtaccaagagtactcccttgacgtcgatcccgatcaagacgaccgggccactgagatcaagctatgtaacttctctcggccccatatgagagctttccatttctcatggattggattcttcattgccttcttcatctggttcgccatcgctccccttctcagtgagatccaagatactcttgacttggacaagaaggaagtctggacttcatctattgtcggtgtcggaggtacaattttcatgcgtttccttctaggaccgttctgcgacaagatcgggccccgagtcctcttcacctttgtcctttgcttcgcttctattcccactgtctgtaccggatttgtcaactctgccacttcccttgccgtcctccgattgttcattggaactgctggaggtactttcgtcatgtgccaatattggaccagccgaatgttcacaaagcaagtggtcggaactgccaatgctcttgtcggtggatggggaaatcttggaggaggtgtcacgcagcttgtcatgggatcagcgttgtttccactgttcaaggaaatcttcaagaacgagcctgaccccgctgagactgcgtggcgatgggtttctatcgttcccgccgtcgttgcattcgcaattggtctcctaattttcttctattccgacgatgcgcccaagggaaactacaacgagatgaagaagaatggggccatgtccgatgtttccgccgccgcttccttccgcaccggagcactcaacctcaatacatggtttttgttcaaacaatacgcatgctgcttcggtgtggaactgaccatgaacaacaccgccgctctgtacttcaaggagaagttctcgctgaccactgaagaagcggccgccattgcctccatcttcggatggatgaatcttttcgcccgtggcgctggtggattccttagtgacaaggccaacgccaggatgggaatgcgtggacgcctttggactcagaccatcttgctggcttgtgagggtgctcttgtcttggtttttgccaacacaggatcgttgacgggagccattgtcgttatggtcttcttttctctattcgtccaagccgctgaagggtcctcttatggaatcgtcccctacgttgacccacccgccactggagctattgccggtatcattggagctggaggaaacactggagccgtcgcttttggaatgggattccgtcagttggactacaaagatgctttcatcatcatgggagccgtcatctgtgcgtcttctgtcttgtcagtcttcatctgcatccccggatcgtctagaatgattggaggagaagcggatgatgtcggtgccaaggaccccactttgtcggttccccaacctgataccgagaagactcaagatgtcaatgcctaa

SEQ ID NO: 28521 - protein, 482 aa, Cylindrotheca fusiformis
MSGTDVATGAPAEWKKYQEYSLDVDPDQDDRATEIKLCNFSRPHMRAFHFSWIGFFIAFFIWFAIAPLLSEIQDTLDLDKKEVWTSSIVGVGGTIFMRFLLGPFCDKIGPRVLFTFVLCFASIPTVCTGFVNSATSLAVLRLFIGTAGGTFVMCQYWTSRMFTKQVVGTANALVGGWGNLGGGVTQLVMGSALFPLFKEIFKNEPDPAETAWRWVSIVPAVVAFAIGLLIFFYSDDAPKGNYNEMKKNGAMSDVSAAASFRTGALNLNTWFLFKQYACCFGVELTMNNTAALYFKEKFSLTTEEAAAIASIFGWMNLFARGAGGFLSDKANARMGMRGRLWTQTILLACEGALVLVFANTGSLTGAIVVMVFFSLFVQAAEGSSYGIVPYVDPPATGAIAGIIGAGGNTGAVAFGMGFRQLDYKDAFIIMGAVICASSVLSVFICIPGSSRMIGGEADDVGAKDPTLSVPQPDTEKTQDVNA

SEQ ID NO: 28522 - DNA, 1212 bp, Pseudomonas aeruginosa
  CDS (1)..(1212): transl_table=11
atgaacaacagcttctggaaggccggccatgcgccgaccctgttcgcggcgtttctctatttcgacctgagtctcatggtctggtacgtgctcggcccgctgggggtgcagattgccggcgacctgcaactgagcacccagcagcgcgcgatgatggtcgccacgccgatcctcgccggcgccgtactgcgcttcctgctcggcctgctggccgatcgctggtcgccgaagagctccggcatcctcgcccaggtcatcgtcatcgccgccctcgcggccgcctggctgctgggcgtgaacagctatgagcaggcactgctgctggggttgttcctcggcttcgccggggcatccttcgccgtggccctgccgctcgcatcgcaatggtacccgccgcaacaccagggcaaggccatgggcatcgccggcgcgggcaactccggcaccgtgctcgccgccctcttcgcccccggcctggccgccgcgttcggctggaacaacgtgttcggcttcgccctgctgccgctcgtcctgaccctcctggtgttcgccatggtcgcgcgcaacgccccgcagcggccggcgcccaaggccatgggcgattacctgaaagccttcggcgaccgcgacagctggtggttcatgttcttctacagcgtcaccttcggcggcttcctcggcctggccagcaccctgcccggctatttccacgaccagtacggcctgaacccggtgaccgccggctactacaccgccgcctgcgtcttcgccggcagcctgatgcgcccgctcggtggcgccctcgccgatcgcatcggcggcatccgcagcctgctgatggtgtacaccctggccgccatctgcatcgccgcggtcggtttccacttgtccagcgcgatggccgccctcggcctgttcgtggtcgccatgctcagtctcggtgccggcaatggcgcggtgttccagttggtaccgcagcgcttccacaaggaaatcggcgtgatgaccgggctgatcggcatggccggcggcatcggcggcttctgcctgactgccggcctcggcgcgatcaagcaaagcaccggcgactaccagctcggcctgtggctgttcgccagtctcggcgtgctggcctggttcggcctccacggggtgaagcggcgctggcgcaccacctggggctcggccgcggtcaccgccgcgcgggtctga

SEQ ID NO: 28523 - protein, 403 aa, Pseudomonas aeruginosa
MNNSFWKAGHAPTLFAAFLYFDLSLMVWYVLGPLGVQIAGDLQLSTQQRAMMVATPILAGAVLRFLLGLLADRWSPKSSGILAQVIVIAALAAAWLLGVNSYEQALLLGLFLGFAGASFAVALPLASQWYPPQHQGKAMGIAGAGNSGTVLAALFAPGLAAAFGWNNVFGFALLPLVLTLLVFAMVARNAPQRPAPKAMGDYLKAFGDRDSWWFMFFYSVTFGGFLGLASTLPGYFHDQYGLNPVTAGYYTAACVFAGSLMRPLGGALADRIGGIRSLLMVYTLAAICIAAVGFHLSSAMAALGLFVVAMLSLGAGNGAVFQLVPQRFHKEIGVMTGLIGMAGGIGGFCLTAGLGAIKQSTGDYQLGLWLFASLGVLAWFGLHGVKRRWRTTWGSAAVTAARV

SEQ ID NO: 28524 - DNA, 1389 bp, Escherichia coli
  CDS (1)..(1389): transl_table=11
atggcactgcaaaatgagaaaaatagtcgttatcttttgcgcgactggaaaccagaaaatccggccttctgggaaaataaaggaaaacatattgctcgaagaaatctctggatatcagtcagttgtctacttcttgccttctgtgtctggatgctatttagcgcagttaccgttaatctcaataaaatcggttttaattttactaccgatcaactctttttattaaccgcattaccctccgtttctggcgcattattgcgtgttccctactcctttatggtgcctatattcggtggacgccgatggacggtttttagtactgcaatcctgattattccttgcgtctggctcggaattgccgtgcaaaatccgaatactccttttgggatatttatcgttatcgctttgctatgcggttttgcaggtgcaaactttgcttcgagcatgggcaatatcagtttcttctttccaaaagccaaacaagggagcgctcttgggattaatggcggattaggaaacttaggtgtaagtgtaatgcagctggttgcaccgctggtcatttttgtacctgtatttgcctttctcggcgtcaatggcgtaccgcaggccgacggttcggtgatgtcgctggcgaatgccgcatggatttgggtaccgctactggcgattgccacgatcgccgcatggtcagggatgaatgatatcgccagttcacgcgcctcaattgccgaccagctccctgtcttacaacgcctgcatctctggctgctgagcctgctttaccttgccaccttcggttcgtttatcggtttttctgcgggttttgccatgctggcaaaaacccagttcccggatgtgaatattctgcgcctggcgttctttggcccatttatcggtgccatcgcgcggtcggttggtggtgctatttccgataagttcggcggcgtgcgggtgacgttgatcaactttatttttatggcgattttcagtgccctgctgttccttaccttaccgggcacaggctccggtaatttcatcgccttttacgccgtatttatggggctgtttctgactgcgggtctgggaagtggttctactttccagatgatcgccgtcatctttcgccagataaccatttatcgggtaaagatgaaaggcggtagtgatgagcaagctcataaagaagccgtcaccgaaacggcggcggctctgggctttatctcagccattggcgcagtgggcggcttttttattccgcaggcgtttggcatgtcgctcaatatgaccggctctccggtcggcgcgatgaaagtgtttttaatcttctacatcgtttgtgtgctgctgacctggctggtttatggtcggcggaagttcagccaaaaataa

SEQ ID NO: 28525 - protein, 462 aa, Escherichia coli
MALQNEKNSRYLLRDWKPENPAFWENKGKHIARRNLWISVSCLLLAFCVWMLFSAVTVNLNKIGFNFTTDQLFLLTALPSVSGALLRVPYSFMVPIFGGRRWTVFSTAILIIPCVWLGIAVQNPNTPFGIFIVIALLCGFAGANFASSMGNISFFFPKAKQGSALGINGGLGNLGVSVMQLVAPLVIFVPVFAFLGVNGVPQADGSVMSLANAAWIWVPLLAIATIAAWSGMNDIASSRASIADQLPVLQRLHLWLLSLLYLATFGSFIGFSAGFAMLAKTQFPDVNILRLAFFGPFIGAIARSVGGAISDKFGGVRVTLINFIFMAIFSALLFLTLPGTGSGNFIAFYAVFMGLFLTAGLGSGSTFQMIAVIFRQITIYRVKMKGGSDEQAHKEAVTETAAALGFISAIGAVGGFFIPQAFGMSLNMTGSPVGAMKVFLIFYIVCVLLTWLVYGRRKFSQK

SEQ ID NO: 28526 - DNA, 1389 bp, Salmonella typhimurium
  CDS (1)..(1389): transl_table=11
atgacacgacaaaacgagaattataaccgttatctcttgagtgactggcgacccgaaaatccagccttctgggagaataaagggaaaggcatcgccagaagaaacttatggatttcagtaagttgtttgctcctggcattttgcgtctggatgttgtttagcgctgttgccgtcaacctcaataaaattggatttaattttaccaccgaccaactctttttattaaccgcattaccttctctttccggcgcaatattacgcgttccctactcctttatggtgccactgtttggtggtcgtaaatggaccgtattaagcaccgtaatattgattattccctgcgcctggctgggattcgccgtacaaaatcccgccacccctttcggggtatttatgctcatcgctctgttgtgcggttttgcgggggcaaacttcgcgtccagtatgggcaacatcagttttttctttccaaaagccagacaaggtagcgcgttgggtattaacggcggactgggaaatcttggcgtcagtgtgatgcagttgattgcgccgctggttatttttctgccgatatttacttttttaggcgtccagggcgtgccgcaacctgatggctccctgctcgccctcactaacgccgcctggatctgggtgccgttactggctgtcgcgacgcttgccgcctggtttggtatgaacgatatcggcagttcaaaagcgtctgtcgcctcgcaattgccggtgctaaaacgtctgcacctgtggctgcttagcctgctgtacctggcgacattcgggtcattcatcggcttttccgcaggtttcgccatgctcgccaaaacgcaatttcccgacgtaaacattctgcaactggcgttctttggcccctttatcggcgcgctggcgcgatcggcaggcggcgtgatctccgataaattcggcggcgttcgcgtaacgctcattaattttatctttatggcgctgtttaccgccttgctattcctcacgctgccaggctccggcgcaggcagctttagcgcgttctatcttgtttttatgggcctgtttttgacagcgggtctcggcagcggttctaccttccagatgattgcggtgatcttccggcagatcacgctctacaacgtcaaactgcgcggcgggagcgatgagcaggcgcagcgcgaagcggtgacggataccgccgccgcgctcggttttatctccgctattggcgctgtgggcggcttctttattccaaaagcgtttggcacctctttggccttgaccggctcgccggtgggcgccatgaaaatctttttgctgttttacctcgcttgcgtcctgctgacctggctggtctacgggcgtcgtaagcctaaacaacaataa

SEQ ID NO: 28527 - protein, 462 aa, Salmonella typhimurium
MTRQNENYNRYLLSDWRPENPAFWENKGKGIARRNLWISVSCLLLAFCVWMLFSAVAVNLNKIGFNFTTDQLFLLTALPSLSGAILRVPYSFMVPLFGGRKWTVLSTVILIIPCAWLGFAVQNPATPFGVFMLIALLCGFAGANFASSMGNISFFFPKARQGSALGINGGLGNLGVSVMQLIAPLVIFLPIFTFLGVQGVPQPDGSLLALTNAAWIWVPLLAVATLAAWFGMNDIGSSKASVASQLPVLKRLHLWLLSLLYLATFGSFIGFSAGFAMLAKTQFPDVNILQLAFFGPFIGALARSAGGVISDKFGGVRVTLINFIFMALFTALLFLTLPGSGAGSFSAFYLVFMGLFLTAGLGSGSTFQMIAVIFRQITLYNVKLRGGSDEQAQREAVTDTAAALGFISAIGAVGGFFIPKAFGTSLALTGSPVGAMKIFLLFYLACVLLTWLVYGRRKPKQQ

SEQ ID NO: 28528 - DNA, 1266 bp, Bacillus subtilis
  CDS (1)..(1266): transl_table=11
atgaagctgtcggaactgaaaactagcggtcatccactcactttgctctgttcctttttatactttgatgtcagttttatgatatgggttatgcttggggcgctgggtgtttatatttctcaggattttggcctgtctccttttgagaaagggcttgtcgtagctgtgccgattttatctggatctgtgtttcgtatcattcttggtattttaacggacagaatcggaccgaaaaaaacggcagtgatcgggatgctggtgacgatgattccgctgctttgggggacattcggcggccgttccctgactgagctgtatgccatcgggattctgcttggcgtggcgggagcaagctttgctgtagcgctgcctatggccagccgctggtatccgcctcatttgcagggacttgcgatggggattgccggagcggggaacagcggcacgttgtttgcaaccctgtttggccctcgtctggcagagcagttcggctggcacattgtcatgggaattgcgctaattccattattgatcgtctttattctttttgtatccatggcaaaggattcccctgcacagccgtctccccagccgctcaaaagctatctgcatgtgtttgggcaaaaggaaacatggtttttctgcctgctgtacagcgtcacatttggcggatttgtcgggctctcaagctttttatctattttctttgttgatcaataccagctgtcaaaaattcacgcaggggacttcgttacattatgtgtggcggcggggagctttttccggcctgtcgggggcttgatttcagatcgtgtcggcggcacgaaagttctttctgtattgtttgtcatcgtggcactgtgtatggccggagtcagtagcctgccatctctctcaatgggttatggtcctattgtttgtcggaatgatggggctcggaatgggaaacggcgcagtattccagctcgtgccgcagcgcttccgcaaagaaatcggcatggtgacgggaatcgtcggtgcggccggaggaatcggagggtttttcttgccgaacatcttaggatctctcaaacagatgacaggcacatatgctatcggtttatcacgtttcctgtatcgcgctgctggcgtttgcacttgtgcttgccgcaggctattactggcggaaaagctggagcgcggaaagcagcccggcggatgtttaggattttgacggacacgcgtttgtgcgtgtcttttttattttctcttgattttcaacagtga

SEQ ID NO: 28529 - protein, 421 aa, Bacillus subtilis
MKLSELKTSGHPLTLLCSFLYFDVSFMIWVMLGALGVYISQDFGLSPFEKGLVVAVPILSGSVFRIILGILTDRIGPKKTAVIGMLVTMIPLLWGTFGGRSLTELYAIGILLGVAGASFAVALPMASRWYPPHLQGLAMGIAGAGNSGTLFATLFGPRLAEQFGWHIVMGIALIPLLIVFILFVSMAKDSPAQPSPQPLKSYLHVFGQKETWFFCLLYSVTFGGFVGLSSFLSIFFVDQYQLSKIHAGDFVTLCVAAGSFFRPVGGLISDRVGGTKVLSVLFVIVALCMAGVSSLPSLSMGYGPIVCRNDGARNGKRRSIPARAAALPQRNRHGDGNRRCGRRNRRVFLAEHLRISQTDDRHICYRFITFPVSRCWRLHLCLPQAITGGKAGARKAARRMFRILTDTRLCVSFLFSLDFQQ

SEQ ID NO: 28530 - DNA, 21 bp, Artificial sequence
  (1)..(21): primer
atgagtcactcatccgccccc

SEQ ID NO: 28531 - DNA, 27 bp, Artificial sequence
  (1)..(27): primer
ttattttttagaatgccgaccatatac

SEQ ID NO: 28532 - protein, 512 aa, Artificial sequence
  Variant (2)..(9): xaa in position 2 to 9 is any amino acid
  Variant (11)..(11): xaa in position 11 is any amino acid
  Variant (13)..(13): xaa in position 13 is any amino acid
  Variant (16)..(16): xaa in position 16 is any amino acid
  Variant (18)..(22): xaa in position 18 to 22 is any amino acid
  Variant (23)..(24): xaa in position 23 to 24 is any or no amino acid
  Variant (26)..(38): xaa in position 26 to 38 is any amino acid
  Variant (39)..(49): xaa in position 39 to 49 is any or no amino acid
  Variant (51)..(51): xaa in position 51 is any amino acid
  Variant (53)..(54): xaa in position 53 to 54 is any amino acid
  Variant (55)..(55): xaa in position 55 is any or no amino acid
  Variant (57)..(57): xaa in position 57 is any amino acid
  Variant (60)..(60): xaa in position 60 is any amino acid
  Variant (64)..(72): xaa in position 64 to 72 is any amino acid
  Variant (74)..(74): xaa in position 74 is any amino acid
  Variant (76)..(86): xaa in position 76 to 86 is any amino acid
  Variant (88)..(101): xaa in position 88 to 101 is any amino acid
  Variant (102)..(110): xaa in position 102 to 110 is any or no amino acid
  Variant (112)..(112): xaa in position 112 is any amino acid
  Variant (113)..(113): xaa in position 113 is any or no amino acid
  Variant (115)..(117): xaa in position 115 to 117 is any amino acid
  Variant (119)..(119): xaa in position 119 is any amino acid
  Variant (123)..(123): xaa in position 123 is any amino acid
  Variant (126)..(127): xaa in position 126 to 127 is any amino acid
  Variant (129)..(133): xaa in position 129 to 133 is any amino acid
  Variant (137)..(140): xaa in position 137 to 140 is any amino acid
  Variant (142)..(142): xaa in position 142 is any amino acid
  Variant (144)..(144): xaa in position 144 is any amino acid
  Variant (147)..(147): xaa in position 147 is any amino acid
  Variant (150)..(150): xaa in position 150 is any amino acid
  Variant (151)..(151): xaa in position 151 is any or no amino acid
  Variant (153)..(153): xaa in position 153 is any amino acid
  Variant (155)..(156): xaa in position 155 to 156 is any amino acid
  Variant (158)..(162): xaa in position 158 to 162 is any amino acid
  Variant (164)..(164): xaa in position 164 is any or no amino acid
  Variant (166)..(181): xaa in position 166 to 181 is any amino acid
  Variant (182)..(210): xaa in position 182 to 210 is any or no amino acid
  Variant (212)..(212): xaa in position 212 is any amino acid
  Variant (214)..(215): xaa in position 214 to 215 is any amino acid
  Variant (217)..(243): xaa in position 217 to 243 is any amino acid
  Variant (244)..(314): xaa in position 244 to 314 is any or no amino acid
  Variant (316)..(320): xaa in position 316 to 320 is any amino acid
  Variant (322)..(324): xaa in position 322 to 324 is any amino acid
  Variant (327)..(327): xaa in position 327 is any amino acid
  Variant (331)..(342): xaa in position 331 to 342 is any amino acid
  Variant (344)..(357): xaa in position 344 to 357 is any amino acid
  Variant (358)..(377): xaa in position 358 to 377 is any or no amino acid
  Variant (379)..(381): xaa in position 379 to 381 is any amino acid
  Variant (383)..(384): xaa in position 383 to 384 is any amino acid
  Variant (387)..(387): xaa in position 387 is any amino acid
  Variant (392)..(392): xaa in position 392 is any amino acid
  Variant (395)..(432): xaa in position 395 to 432 is any amino acid
  Variant (433)..(455): xaa in position 433 to 455 is any or no amino acid
  Variant (457)..(457): xaa in position 457 is any amino acid
  Variant (459)..(459): xaa in position 459 is any amino acid
  Variant (462)..(462): xaa in position 462 is any amino acid
  Variant (464)..(465): xaa in position 464 to 465 is any amino acid
  Variant (467)..(469): xaa in position 467 to 469 is any amino acid
  Variant (471)..(474): xaa in position 471 to 474 is any amino acid
  Variant (475)..(497): xaa in position 475 to 497 is any or no amino acid
  Variant (499)..(501): xaa in position 499 to 501 is any amino acid
  Variant (503)..(507): xaa in position 503 to 507 is any amino acid
  Variant (510)..(510): xaa in position 510 is any amino acid
LXXXXXXXXLXFXVWXLXXXXXXXIXXXXXXXXXXXXXXXXXXXXXXXXLXAXXXLXGAXLRVXXXXXXXXXGXRXXXXXXXXXXXIXXXXXXXXXXXXXXXXXXXXXXXLXXGXXXGXAGAXFAXXMXXXXXFFPXXXXGXAXGIXGGXXNXGXXVXXXXXPXVXXXXXXXXXXXXXXXXXXXXXXXXXXXXXXXXXXXXXXXXXXXXXLXLXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXXXXYXXXFGXFVGXXXXXXXXXXXXFXXXXXXXXXXXXXXXXXXXXXXXXXXXXXXXXXXGXXXRXXGGXLSDRXGGXXXXXXXXXXXXXXXXXXXXXXXXXXXXXXXXXXXXXXXXXXXXXXXXXXXXXXXXXXXXXGXGXGSXFXXIXXXFXXXXXXXXXXXXXXXXXXXXXXXXXXXGXXXGXXXXXGGXGG

SEQ ID NO: 28533 - protein, 19 aa, Artificial sequence
  Variant (2)..(10): xaa in position 2 to 10 is any amino acid
  Variant (11)..(11): xaa in position 11 is any or no amino acid
  Variant (13)..(13): xaa in position 13 is any amino acid
  Variant (14)..(14): xaa in position 14 is Ala, Ile or Val
  Variant (16)..(16): xaa in position 16 is any amino acid
  Variant (17)..(17): xaa in position 17 is Ile, Leu, Met or Val
  Variant (18)..(18): xaa in position 18 is any amino acid
  Variant (19)..(19): xaa in position 19 is Ala, Gly or Ser
LXXXXXXXXXXFXXWXXXX

SEQ ID NO: 28534 - protein, 45 aa, Artificial sequence
  Variant (2)..(3): xaa in position 2 to 3 is any amino acid
  Variant (4)..(4): xaa in position 4 is any or no amino acid
  Variant (6)..(6): xaa in position 6 is Ala, Gly or Thr
  Variant (7)..(7): xaa in position 7 is any amino acid
  Variant (9)..(9): xaa in position 9 is Ala, Gly or Ser
  Variant (10)..(12): xaa in position 10 to 12 is any amino acid
  Variant (13)..(13): xaa in position 13 is Ala, Gly, Pro, Ser or Thr
  Variant (14)..(15): xaa in position 14 to 15 is any amino acid
  Variant (16)..(16): xaa in position 16 is Ala, Gly, Asn, Pro or Ser
  Variant (17)..(18): xaa in position 17 to 18 is any amino acid
  Variant (19)..(19): xaa in position 19 is Phe, His or Tyr
  Variant (20)..(24): xaa in position 20 to 24 is any amino acid
  Variant (26)..(26): xaa in position 26 is any amino acid
  Variant (27)..(27): xaa in position 27 is Ala, Ser or Val
  Variant (28)..(28): xaa in position 28 is any amino acid
  Variant (30)..(31): xaa in position 30 to 31 is any amino acid
  Variant (32)..(33): xaa in position 32 to 33 is any or no amino acid
  Variant (35)..(38): xaa in position 35 to 38 is any amino acid
  Variant (39)..(39): xaa in position 39 is Ala, Gly or Val
  Variant (40)..(44): xaa in position 40 to 44 is any amino acid
  Variant (45)..(45): xaa in position 45 is Phe, Ile, Leu or Val
GXXXGXXFXXXXXXXXXXXXXXXXGXXXGXXXXGXXXXXXXXXXX

SEQ ID NO: 28535 - protein, 24 aa, Artificial sequence
  Variant (2)..(3): xaa in position 2 to 3 is any amino acid
  Variant (4)..(4): xaa in position 4 is any or no amino acid
  Variant (6)..(6): xaa in position 6 is any or no amino acid
  Variant (8)..(8): xaa in position 8 is Ala, Gly or Ser
  Variant (9)..(9): xaa in position 9 is Phe or Tyr
  Variant (10)..(10): xaa in position 10 is Ala, Ile or Val
  Variant (11)..(11): xaa in position 11 is Ala or Gly
  Variant (12)..(12): xaa in position 12 is any amino acid
  Variant (13)..(13): xaa in position 13 is Ala, Gly, Ser or Thr
  Variant (14)..(15): xaa in position 14 to 15 is any amino acid
  Variant (16)..(16): xaa in position 16 is Phe, Leu, Met or Val
  Variant (17)..(17): xaa in position 17 is Ala, Gly, Pro, Ser or Thr
  Variant (18)..(23): xaa in position 18 to 23 is any amino acid
  Variant (24)..(24): xaa in position 24 is Phe or Tyr
YXXXFXGXXXXXXXXXXXXXXXXX

SEQ ID NO: 28536 - protein, 33 aa, Artificial sequence
  Variant (2)..(19): xaa in position 2 to 19 is any amino acid
  Variant (20)..(22): xaa in position 20 to 22 is any or no amino acid
  Variant (24)..(24): xaa in position 24 is Phe, Ile, Leu, Met or Val
  Variant (25)..(25): xaa in position 25 is any amino acid
  Variant (26)..(26): xaa in position 26 is Ala, Gly or Ser
  Variant (27)..(28): xaa in position 27 to 28 is any amino acid
  Variant (30)..(30): xaa in position 30 is Ala, Cys, Gly, Asn, Ser or Thr
  Variant (31)..(31): xaa in position 31 is any amino acid
  Variant (33)..(33): xaa in position 33 is Ala, Gly, Pro or Ser
GXXXXXXXXXXXXXXXXXXXXXGXXXXXGXXGX

SEQ ID NO: 28537 - DNA, 1563 bp, Escherichia coli K12; identical to SEQ ID NO: 3241
  CDS (1)..(1563)

SEQ ID NO: 28538 - protein, 520 aa, Escherichia coli K12; identical to SEQ ID NO: 3242

SEQ ID NO: 28539 - DNA, 2984 bp, Rhizobium meliloti; identical to SEQ ID NO: 3243
  CDS (638)..(2827)

SEQ ID NO: 28540 - protein, 729 aa, Rhizobium meliloti; identical to SEQ ID NO: 3244

SEQ ID NO: 28541 - DNA, 1365 bp, Salmonella typhimurium; identical to SEQ ID NO: 3245
  CDS (1)..(1365)

SEQ ID NO: 28542 - protein, 454 aa, Salmonella typhimurium; identical to SEQ ID NO: 3246

SEQ ID NO: 28543 - DNA, 1413 bp, Bacillus subtilis; identical to SEQ ID NO: 3247
  CDS (1)..(1413)

SEQ ID NO: 28544 - protein, 470 aa, Bacillus subtilis; identical to SEQ ID NO: 3248

SEQ ID NO: 28545 - DNA, 1449 bp, Spirochaeta aurantia; identical to SEQ ID NO: 3249
  CDS (1)..(1449)

SEQ ID NO: 28546 - protein, 482 aa, Spirochaeta aurantia; identical to SEQ ID NO: 3250

SEQ ID NO: 28547 - DNA, 1389 bp, Methanobacterium thermoautotrophicum; identical to SEQ ID NO: 3251
  CDS (1)..(1389)

SEQ ID NO: 28548 - protein, 462 aa, Methanobacterium thermoautotrophicum; identical to SEQ ID NO: 3252

SEQ ID NO: 28549 - DNA, 1572 bp, Haloferax volcanii; identical to SEQ ID NO: 3253
  CDS (1)..(1572)

SEQ ID NO: 28550 - protein, 523 aa, Haloferax volcanii; identical to SEQ ID NO: 3254

SEQ ID NO: 28551 - DNA, 1305 bp, Pyrococcus abyssi; identical to SEQ ID NO: 3255
  CDS (1)..(1305)

SEQ ID NO: 28552 - protein, 434 aa, Pyrococcus abyssi; identical to SEQ ID NO: 3256

SEQ ID NO: 28553 - DNA, 1572 bp, Vibrio cholerae; identical to SEQ ID NO: 3257
  CDS (1)..(1572)

SEQ ID NO: 28554 - protein, 523 aa, Vibrio cholerae; identical to SEQ ID NO: 3258

SEQ ID NO: 28555 - DNA, 1359 bp, Xylella fastidiosa; identical to SEQ ID NO: 3259
  CDS (1)..(1359)

SEQ ID NO: 28556 - protein, 452 aa, Xylella fastidiosa; identical to SEQ ID NO: 3260

SEQ ID NO: 28557 - DNA, 1464 bp, Xylella fastidiosa; identical to SEQ ID NO: 3261
  CDS (1)..(1464)

SEQ ID NO: 28558 - protein, 487 aa, Xylella fastidiosa; identical to SEQ ID NO: 3262

SEQ ID NO: 28559 - DNA, 2760 bp, Arabidopsis thaliana (mouse-ear cress); identical to SEQ ID NO: 3263
  CDS (7)..(2760)

SEQ ID NO: 28560 - protein, 917 aa, Arabidopsis thaliana (mouse-ear cress); identical to SEQ ID NO: 3264

SEQ ID NO: 28561 - DNA, 1722 bp, Streptococcus pneumoniae; identical to SEQ ID NO: 3265
  CDS (1)..(1722)

SEQ ID NO: 28562 - protein, 573 aa, Streptococcus pneumoniae; identical to SEQ ID NO: 3266

SEQ ID NO: 28563 - DNA, 1362 bp, Streptococcus pneumoniae; identical to SEQ ID NO: 3267
  CDS (1)..(1362)

SEQ ID NO: 28564 - protein, 453 aa, Streptococcus pneumoniae; identical to SEQ ID NO: 3268

SEQ ID NO: 28565 - DNA, 1428 bp, Clostridium acetobutylicum; identical to SEQ ID NO: 3269
  CDS (1)..(1428)

SEQ ID NO: 28566 - protein, 475 aa, Clostridium acetobutylicum; identical to SEQ ID NO: 3270

SEQ ID NO: 28567 - DNA, 1566 bp, Yersinia pestis; identical to SEQ ID NO: 3271
  CDS (1)..(1566)

SEQ ID NO: 28568 - protein, 521 aa, Yersinia pestis; identical to SEQ ID NO: 3272

SEQ ID NO: 28569 - DNA, 2148 bp, Nostoc sp. PCC 7120; identical to SEQ ID NO: 3273
  CDS (1)..(2148)

SEQ ID NO: 28570 - protein, 715 aa, Nostoc sp. PCC 7120; identical to SEQ ID NO: 3274

SEQ ID NO: 28571 - DNA, 1377 bp, Yersinia pestis; identical to SEQ ID NO: 3275
  CDS (1)..(1377)

SEQ ID NO: 28572 - protein, 458 aa, Yersinia pestis; identical to SEQ ID NO: 3276

SEQ ID NO: 28573 - DNA, 2145 bp, Nostoc sp. PCC 7120; identical to SEQ ID NO: 3277
  CDS (1)..(2145)

SEQ ID NO: 28574 - protein, 714 aa, Nostoc sp. PCC 7120; identical to SEQ ID NO: 3278

SEQ ID NO: 28575 - DNA, 2208 bp, Nostoc sp. PCC 7120; identical to SEQ ID NO: 3279
  CDS (1)..(2208)

SEQ ID NO: 28576 - protein, 735 aa, Nostoc sp. PCC 7120; identical to SEQ ID NO: 3280

SEQ ID NO: 28577 - DNA, 1515 bp, Nostoc sp. PCC 7120; identical to SEQ ID NO: 3281
  CDS (1)..(1515)

SEQ ID NO: 28578 - protein, 504 aa, Nostoc sp. PCC 7120; identical to SEQ ID NO: 3282

SEQ ID NO: 28579 - DNA, 1362 bp, Escherichia coli; identical to SEQ ID NO: 3283
  CDS (1)..(1362)

SEQ ID NO: 28580 - protein, 453 aa, Escherichia coli; identical to SEQ ID NO: 3284

SEQ ID NO: 28581 - DNA, 2190 bp, Agrobacterium tumefaciens; identical to SEQ ID NO: 3285
  CDS (1)..(2190)

SEQ ID NO: 28582 - protein, 729 aa, Agrobacterium tumefaciens; identical to SEQ ID NO: 3286

SEQ ID NO: 28583 - DNA, 1365 bp, Listeria monocytogenes; identical to SEQ ID NO: 3287
  CDS (1)..(1365)

SEQ ID NO: 28584 - protein, 454 aa, Listeria monocytogenes; identical to SEQ ID NO: 3288

SEQ ID NO: 28585 - DNA, 1365 bp, Listeria innocua; identical to SEQ ID NO: 3289
  CDS (1)..(1365)

SEQ ID NO: 28586 - protein, 454 aa, Listeria innocua; identical to SEQ ID NO: 3290

SEQ ID NO: 28587 - DNA, 1869 bp, Klebsiella pneumoniae; identical to SEQ ID NO: 3291
  CDS (151)..(1506)

SEQ ID NO: 28588 - protein, 451 aa, Klebsiella pneumoniae; identical to SEQ ID NO: 3292

SEQ ID NO: 28589 - DNA, 1389 bp, Leptospira biflexa; identical to SEQ ID NO: 3293
  CDS (1)..(1389)

SEQ ID NO: 28590 - protein, 462 aa, Leptospira biflexa; identical to SEQ ID NO: 3294

SEQ ID NO: 28591 - DNA, 1425 bp, Methanococcus jannaschii; identical to SEQ ID NO: 3295
  CDS (1)..(1425)

SEQ ID NO: 28592 - protein, 474 aa, Methanococcus jannaschii; identical to SEQ ID NO: 3296

SEQ ID NO: 28593 - DNA, 1503 bp, Helicobacter pylori; identical to SEQ ID NO: 3297
  CDS (1)..(1503)

SEQ ID NO: 28594 - protein, 500 aa, Helicobacter pylori; identical to SEQ ID NO: 3298

SEQ ID NO: 28595 - DNA, 1236 bp, Archaeoglobus fulgidus; identical to SEQ ID NO: 3299
  CDS (1)..(1236)

SEQ ID NO: 28596 - protein, 411 aa, Archaeoglobus fulgidus; identical to SEQ ID NO: 3300

SEQ ID NO: 28597 - DNA, 954 bp, Aeropyrum pernix; identical to SEQ ID NO: 3301
  CDS (1)..(954)

SEQ ID NO: 28598 - protein, 317 aa, Aeropyrum pernix; identical to SEQ ID NO: 3302

SEQ ID NO: 28599 - DNA, 1377 bp, Vibrio cholerae; identical to SEQ ID NO: 3303
  CDS (1)..(1377)

SEQ ID NO: 28600 - protein, 458 aa, Vibrio cholerae; identical to SEQ ID NO: 3304

SEQ ID NO: 28601 - DNA, 1497 bp, Xylella fastidiosa; identical to SEQ ID NO: 3305
  CDS (1)..(1497)

SEQ ID NO: 28602 - protein, 498 aa, Xylella fastidiosa; identical to SEQ ID NO: 3306

SEQ ID NO: 28603 - DNA, 1362 bp, Pseudomonas aeruginosa; identical to SEQ ID NO: 3307
  CDS (1)..(1362)

SEQ ID NO: 28604 - protein, 453 aa, Pseudomonas aeruginosa; identical to SEQ ID NO: 3308

SEQ ID NO: 28605 - DNA, 1461 bp, Bacillus halodurans; identical to SEQ ID NO: 3309
  CDS (1)..(1461)

SEQ ID NO: 28606 - protein, 486 aa, Bacillus halodurans; identical to SEQ ID NO: 3310

SEQ ID NO: 28607 - DNA, 1467 bp, Halobacterium sp. NRC-1; identical to SEQ ID NO: 3311
  CDS (1)..(1467)

SEQ ID NO: 28608 - protein, 488 aa, Halobacterium sp. NRC-1; identical to SEQ ID NO: 3312

SEQ ID NO: 28609 - DNA, 1584 bp, Halobacterium sp. NRC-1; identical to SEQ ID NO: 3313
  CDS (1)..(1584)

SEQ ID NO: 28610 - protein, 527 aa, Halobacterium sp. NRC-1; identical to SEQ ID NO: 3314

SEQ ID NO: 28611 - DNA, 1542 bp, Caulobacter crescentus; identical to SEQ ID NO: 3315
  CDS (1)..(1542)

SEQ ID NO: 28612 - protein, 513 aa, Caulobacter crescentus; identical to SEQ ID NO: 3316

SEQ ID NO: 28613 - DNA, 1557 bp, Haemophilus influenzae; identical to SEQ ID NO: 3317
  CDS (1)..(1557)

SEQ ID NO: 28614 - protein, 518 aa, Haemophilus influenzae; identical to SEQ ID NO: 3318

SEQ ID NO: 28615 - DNA, 1395 bp, Methanobacterium thermoautotrophicum; identical to SEQ ID NO: 3319
  CDS (1)..(1395)

SEQ ID NO: 28616 - protein, 464 aa, Methanobacterium thermoautotrophicum; identical to SEQ ID NO: 3320

SEQ ID NO: 28617 - DNA, 1509 bp, Bacillus halodurans; identical to SEQ ID NO: 3321
  CDS (1)..(1509)

SEQ ID NO: 28618 - protein, 502 aa, Bacillus halodurans; identical to SEQ ID NO: 3322

SEQ ID NO: 28619 - DNA, 1464 bp, Streptococcus pneumoniae; identical to SEQ ID NO: 3323
  CDS (1)..(1464)

SEQ ID NO: 28620 - protein, 487 aa, Streptococcus pneumoniae; identical to SEQ ID NO: 3324

SEQ ID NO: 28621 - DNA, 1479 bp, Pseudomonas aeruginosa; identical to SEQ ID NO: 3325
  CDS (1)..(1479)

SEQ ID NO: 28622 - protein, 492 aa, Pseudomonas aeruginosa; identical to SEQ ID NO: 3326

SEQ ID NO: 28623 - DNA, 1386 bp, Thermotoga maritima; identical to SEQ ID NO: 3327
  CDS (1)..(1386)

SEQ ID NO: 28624 - protein, 461 aa, Thermotoga maritima; identical to SEQ ID NO: 3328

SEQ ID NO: 28625 - DNA, 1482 bp, Pseudomonas putida; identical to SEQ ID NO: 3329
  CDS (1)..(1482)

SEQ ID NO: 28626 - protein, 493 aa, Pseudomonas putida; identical to SEQ ID NO: 3330

SEQ ID NO: 28627 - DNA, 3065 bp, Pseudomonas aeruginosa; identical to SEQ ID NO: 3331
  CDS (401)..(1993)

SEQ ID NO: 28628 - protein, 530 aa, Pseudomonas aeruginosa; identical to SEQ ID NO: 3332

SEQ ID NO: 28629 - DNA, 1485 bp, Aquifex aeolicus; identical to SEQ ID NO: 3333
  CDS (1)..(1485)

SEQ ID NO: 28630 - protein, 494 aa, Aquifex aeolicus; identical to SEQ ID NO: 3334

SEQ ID NO: 28631 - DNA, 1422 bp, Deinococcus radiodurans; identical to SEQ ID NO: 3335
  CDS (1)..(1422)

SEQ ID NO: 28632 - protein, 473 aa, Deinococcus radiodurans; identical to SEQ ID NO: 3336

SEQ ID NO: 28633 - DNA, 1917 bp, Deinococcus radiodurans; identical to SEQ ID NO: 3337
  CDS (1)..(1917)

SEQ ID NO: 28634 - protein, 638 aa, Deinococcus radiodurans; identical to SEQ ID NO: 3338

SEQ ID NO: 28635 - DNA, 1551 bp, Mycobacterium tuberculosis; identical to SEQ ID NO: 3339
  CDS (1)..(1551)

SEQ ID NO: 28636 - protein, 516 aa, Mycobacterium tuberculosis; identical to SEQ ID NO: 3340

SEQ ID NO: 28637 - DNA, 1503 bp, Helicobacter pylori; identical to SEQ ID NO: 3341
  CDS (1)..(1503)

SEQ ID NO: 28638 - protein, 500 aa, Helicobacter pylori; identical to SEQ ID NO: 3342

SEQ ID NO: 28639 - DNA, 1476 bp, Neisseria meningitidis; identical to SEQ ID NO: 3343
  CDS (1)..(1476)

SEQ ID NO: 28640 - protein, 491 aa, Neisseria meningitidis; identical to SEQ ID NO: 3344

SEQ ID NO: 28641 - DNA, 1575 bp, Caulobacter crescentus; identical to SEQ ID NO: 3345
  CDS (1)..(1575)

SEQ ID NO: 28642 - protein, 524 aa, Caulobacter crescentus; identical to SEQ ID NO: 3346

SEQ ID NO: 28643 - DNA, 1251 bp, Campylobacter jejuni; identical to SEQ ID NO: 3347
  CDS (1)..(1251)

SEQ ID NO: 28644 - protein, 416 aa, Campylobacter jejuni; identical to SEQ ID NO: 3348

SEQ ID NO: 28645 - DNA, 1266 bp, Sulfolobus solfataricus; identical to SEQ ID NO: 3349
  CDS (1)..(1266)

SEQ ID NO: 28646 - protein, 421 aa, Sulfolobus solfataricus; identical to SEQ ID NO: 3350

SEQ ID NO: 28647 - DNA, 1548 bp, Buchnera aphidicola; identical to SEQ ID NO: 3351
  CDS (1)..(1548)

SEQ ID NO: 28648 - protein, 515 aa, Buchnera aphidicola; identical to SEQ ID NO: 3352

SEQ ID NO: 28649 - DNA, 2172 bp, Streptomyces griseus; identical to SEQ ID NO: 3353
  CDS (1)..(2172)

SEQ ID NO: 28650 - protein, 723 aa, Streptomyces griseus; identical to SEQ ID NO: 3354

SEQ ID NO: 28651 - DNA, 2712 bp, Streptomyces lividans; identical to SEQ ID NO: 3355
  CDS (119)..(1546)

SEQ ID NO: 28652 - protein, 475 aa, Streptomyces lividans; identical to SEQ ID NO: 3356

SEQ ID NO: 28653 - DNA, 2115 bp, Clostridium thermocellum; identical to SEQ ID NO: 3357
  CDS (361)..(1845)

SEQ ID NO: 28654 - protein, 494 aa, Clostridium thermocellum; identical to SEQ ID NO: 3358

SEQ ID NO: 28655 - DNA, 1548 bp, Bacillus subtilis; identical to SEQ ID NO: 3359
  CDS (1)..(1548)

SEQ ID NO: 28656 - protein, 515 aa, Bacillus subtilis; identical to SEQ ID NO: 3360

SEQ ID NO: 28657 - DNA, 1524 bp, Saccharomyces cerevisiae; identical to SEQ ID NO: 3361
  CDS (1)..(1524)

SEQ ID NO: 28658 - protein, 507 aa, Saccharomyces cerevisiae; identical to SEQ ID NO: 3362

SEQ ID NO: 28659 - DNA, 2340 bp, Thermus aquaticus; identical to SEQ ID NO: 3363
  CDS (169)..(1557)

SEQ ID NO: 28660 - protein, 462 aa, Thermus aquaticus; identical to SEQ ID NO: 3364

SEQ ID NO: 28661 - DNA, 2558 bp, Bacillus caldotenax; identical to SEQ ID NO: 3365
  CDS (312)..(1838)

SEQ ID NO: 28662 - protein, 508 aa, Bacillus caldotenax; identical to SEQ ID NO: 3366

SEQ ID NO: 28663 - DNA, 2068 bp, Arabidopsis thaliana (mouse-ear cress); identical to SEQ ID NO: 3367
  CDS (29)..(1894)

SEQ ID NO: 28664 - protein, 621 aa, Arabidopsis thaliana (mouse-ear cress); identical to SEQ ID NO: 3368

SEQ ID NO: 28665 - DNA, 1371 bp, Lactococcus lactis subsp. lactis; identical to SEQ ID NO: 3369
  CDS (1)..(1371)

SEQ ID NO: 28666 - protein, 456 aa, Lactococcus lactis subsp. lactis; identical to SEQ ID NO: 3370

SEQ ID NO: 28667 - DNA, 1527 bp, Synechocystis sp; identical to SEQ ID NO: 3371
  CDS (1)..(1527)

SEQ ID NO: 28668 - protein, 508 aa, Synechocystis sp; identical to SEQ ID NO: 3372

SEQ ID NO: 28669 - DNA, 1458 bp, Synechocystis sp; identical to SEQ ID NO: 3373
  CDS (1)..(1458)

SEQ ID NO: 28670 - protein, 485 aa, Synechocystis sp; identical to SEQ ID NO: 3374

SEQ ID NO: 28671 - DNA, 2144 bp, Nicotiana tabacum (common tobacco); identical to SEQ ID NO: 3375
  CDS (90)..(1940)

SEQ ID NO: 28672 - protein, 616 aa, Nicotiana tabacum (common tobacco); identical to SEQ ID NO: 3376

SEQ ID NO: 28673 - DNA, 1509 bp, Streptomyces coelicolor; identical to SEQ ID NO: 3377
  CDS (1)..(1509)

SEQ ID NO: 28674 - protein, 502 aa, Streptomyces coelicolor; identical to SEQ ID NO: 3378

SEQ ID NO: 28675 - DNA, 1470 bp, Schizosaccharomyces pombe; identical to SEQ ID NO: 3379
  CDS (1)..(1470)

SEQ ID NO: 28676 - protein, 489 aa, Schizosaccharomyces pombe; identical to SEQ ID NO: 3380

SEQ ID NO: 28677 - DNA, 1302 bp, Pyrococcus kodakaraensis; identical to SEQ ID NO: 3381
  CDS (1)..(1302)

SEQ ID NO: 28678 - protein, 433 aa, Pyrococcus kodakaraensis; identical to SEQ ID NO: 3382

SEQ ID NO: 28679 - DNA, 1590 bp, Mycobacterium leprae; identical to SEQ ID NO: 3383
  CDS (1)..(1590)

SEQ ID NO: 28680 - protein, 529 aa, Mycobacterium leprae; identical to SEQ ID NO: 3384

SEQ ID NO: 28681 - DNA, 1512 bp, Rhodobacter sphaeroides; identical to SEQ ID NO: 3385
  CDS (1)..(1512)

SEQ ID NO: 28682 - protein, 503 aa, Rhodobacter sphaeroides; identical to SEQ ID NO: 3386

SEQ ID NO: 28683 - DNA, 1993 bp, Ruta graveolens; identical to SEQ ID NO: 3387
  CDS (94)..(1935)

SEQ ID NO: 28684 - protein, 613 aa, Ruta graveolens; identical to SEQ ID NO: 3388

SEQ ID NO: 28685 - DNA, 1983 bp, Corynebacterium glutamicum; identical to SEQ ID NO: 3389
  CDS (86)..(1963)

SEQ ID NO: 28686 - protein, 625 aa, Corynebacterium glutamicum; identical to SEQ ID NO: 3390

SEQ ID NO: 28687 - DNA, 2220 bp, Streptomyces pristinaespiralis; identical to SEQ ID NO: 3391
  CDS (61)..(2220)

SEQ ID NO: 28688 - protein, 719 aa, Streptomyces pristinaespiralis; identical to SEQ ID NO: 3392

SEQ ID NO: 28689 - DNA, 2051 bp, Ruta graveolens; identical to SEQ ID NO: 3393
  CDS (43)..(1869)

SEQ ID NO: 28690 - protein, 608 aa, Ruta graveolens; identical to SEQ ID NO: 3394

SEQ ID NO: 28691 - DNA, 2660 bp, Streptomyces venezuelae; identical to SEQ ID NO: 3395
  CDS (651)..(2660)

SEQ ID NO: 28692 - protein, 669 aa, Streptomyces venezuelae; identical to SEQ ID NO: 3396

SEQ ID NO: 28693 - DNA, 1518 bp, Symbiobacterium thermophilum; identical to SEQ ID NO: 3397
  CDS (1)..(1518)

SEQ ID NO: 28694 - protein, 505 aa, Symbiobacterium thermophilum; identical to SEQ ID NO: 3398

SEQ ID NO: 28695 - DNA, 1476 bp, Symbiobacterium thermophilum; identical to SEQ ID NO: 3399
  CDS (1)..(1476)

SEQ ID NO: 28696 - protein, 491 aa, Symbiobacterium thermophilum; identical to SEQ ID NO: 3400

SEQ ID NO: 28697 - DNA, 2088 bp, Propionibacterium acnes; identical to SEQ ID NO: 3401
  CDS (1)..(2088)

SEQ ID NO: 28698 - protein, 695 aa, Propionibacterium acnes; identical to SEQ ID NO: 3402

SEQ ID NO: 28699 - DNA, 1458 bp, Leifsonia xyli; identical to SEQ ID NO: 3403
  CDS (1)..(1458)

SEQ ID NO: 28700 - protein, 485 aa, Leifsonia xyli; identical to SEQ ID NO: 3404

SEQ ID NO: 28701 - DNA, 1560 bp, Leifsonia xyli; identical to SEQ ID NO: 3405
  CDS (1)..(1560)

SEQ ID NO: 28702 - protein, 519 aa, Leifsonia xyli; identical to SEQ ID NO: 3406

SEQ ID NO: 28703 - DNA, 1545 bp, Debaryomyces hansenii CBS767; identical to SEQ ID NO: 3407
  CDS (1)..(1545)

SEQ ID NO: 28704 - protein, 514 aa, Debaryomyces hansenii CBS767; identical to SEQ ID NO: 3408

SEQ ID NO: 28705 - DNA, 1524 bp, Yarrowia lipolytica CLIB99; identical to SEQ ID NO: 3409
  CDS (1)..(1524)

SEQ ID NO: 28706 - protein, 507 aa, Yarrowia lipolytica CLIB99; identical to SEQ ID NO: 3410

SEQ ID NO: 28707 - DNA, 1527 bp, Kluyveromyces lactis NRRL Y; identical to SEQ ID NO: 3411
  CDS (1)..(1527)

SEQ ID NO: 28708 - protein, 508 aa, Kluyveromyces lactis NRRL Y; identical to SEQ ID NO: 3412

SEQ ID NO: 28709 - DNA, 1455 bp, Erwinia carotovora; identical to SEQ ID NO: 3413
  CDS (1)..(1455)

SEQ ID NO: 28710 - protein, 484 aa, Erwinia carotovora; identical to SEQ ID NO: 3414

SEQ ID NO: 28711 - DNA, 1563 bp, Erwinia carotovora; identical to SEQ ID NO: 3415
  CDS (1)..(1563)

SEQ ID NO: 28712 - protein, 520 aa, Erwinia carotovora; identical to SEQ ID NO: 3416

SEQ ID NO: 28713 - DNA, 1311 bp, Acinetobacter sp; identical to SEQ ID NO: 3417
  CDS (1)..(1311)

SEQ ID NO: 28714 - protein, 436 aa, Acinetobacter sp; identical to SEQ ID NO: 3418

SEQ ID NO: 28715 - DNA, 1521 bp, Candida glabrata CBS138; identical to SEQ ID NO: 3419
  CDS (1)..(1521)

SEQ ID NO: 28716 - protein, 506 aa, Candida glabrata CBS138; identical to SEQ ID NO: 3420

SEQ ID NO: 28717 - DNA, 1407 bp, Staphylococcus aureus; identical to SEQ ID NO: 3421
  CDS (1)..(1407)

SEQ ID NO: 28718 - protein, 468 aa, Staphylococcus aureus; identical to SEQ ID NO: 3422

SEQ ID NO: 28719 - DNA, 1407 bp, Staphylococcus aureus; identical to SEQ ID NO: 3423
  CDS (1)..(1407)

SEQ ID NO: 28720 - protein, 468 aa, Staphylococcus aureus; identical to SEQ ID NO: 3424

SEQ ID NO: 28721 - DNA, 1428 bp, Bacillus thuringiensis; identical to SEQ ID NO: 3425
  CDS (1)..(1428)

SEQ ID NO: 28722 - protein, 475 aa, Bacillus thuringiensis; identical to SEQ ID NO: 3426

SEQ ID NO: 28723 - DNA, 1443 bp, Bacillus thuringiensis; identical to SEQ ID NO: 3427
  CDS (46)..(1443)

SEQ ID NO: 28724 - protein, 465 aa, Bacillus thuringiensis; identical to SEQ ID NO: 3428

SEQ ID NO: 28725 - DNA, 2061 bp, Streptomyces venezuelae; identical to SEQ ID NO: 3429
  CDS (1)..(2061)

SEQ ID NO: 28726 - protein, 686 aa, Streptomyces venezuelae; identical to SEQ ID NO: 3430

SEQ ID NO: 28727 - DNA, 1593 bp, Photobacterium profundum; identical to SEQ ID NO: 3431
  CDS (1)..(1593)

SEQ ID NO: 28728 - protein, 530 aa, Photobacterium profundum; identical to SEQ ID NO: 3432

SEQ ID NO: 28729 - DNA, 1404 bp, Photobacterium profundum; identical to SEQ ID NO: 3433
  CDS (1)..(1404)

SEQ ID NO: 28730 - protein, 467 aa, Photobacterium profundum; identical to SEQ ID NO: 3434

SEQ ID NO: 28731 - DNA, 1404 bp, Photobacterium profundum; identical to SEQ ID NO: 3435
  CDS (1)..(1404)

SEQ ID NO: 28732 - protein, 467 aa, Photobacterium profundum; identical to SEQ ID NO: 3436

SEQ ID NO: 28733 - DNA, 1320 bp, Methanococcus maripaludis; identical to SEQ ID NO: 3437
  CDS (1)..(1320)

SEQ ID NO: 28734 - protein, 439 aa, Methanococcus maripaludis; identical to SEQ ID NO: 3438

SEQ ID NO: 28735 - DNA, 1305 bp, Parachlamydia sp; identical to SEQ ID NO: 3439
  CDS (1)..(1305)

SEQ ID NO: 28736 - protein, 434 aa, Parachlamydia sp; identical to SEQ ID NO: 3440

SEQ ID NO: 28737 - DNA, 2160 bp, Rhodopseudomonas palustris; identical to SEQ ID NO: 3441
  CDS (1)..(2160)

SEQ ID NO: 28738 - protein, 719 aa, Rhodopseudomonas palustris; identical to SEQ ID NO: 3442

SEQ ID NO: 28739 - DNA, 1554 bp, Corynebacterium diphtheriae; identical to SEQ ID NO: 3443
  CDS (1)..(1554)

SEQ ID NO: 28740 - protein, 517 aa, Corynebacterium diphtheriae; identical to SEQ ID NO: 3444

SEQ ID NO: 28741 - DNA, 3174 bp, Lycopersicon esculentum; identical to SEQ ID NO: 3445
  CDS (121)..(2829)

SEQ ID NO: 28742 - protein, 902 aa, Lycopersicon esculentum; identical to SEQ ID NO: 3446

SEQ ID NO: 28743 - DNA, 1848 bp, uncultured bacterium; identical to SEQ ID NO: 3447
  CDS (1)..(1848)

SEQ ID NO: 28744 - protein, 615 aa, uncultured bacterium; identical to SEQ ID NO: 3448

SEQ ID NO: 28745 - DNA, 2151 bp, Xanthomonas albilineans; identical to SEQ ID NO: 3449
  CDS (1)..(2151)

SEQ ID NO: 28746 - protein, 716 aa, Xanthomonas albilineans; identical to SEQ ID NO: 3450

SEQ ID NO: 28747 - DNA, 2088 bp, Streptomyces thioluteus; identical to SEQ ID NO: 3451
  CDS (1)..(2088): n means a or g or c or t/u, s means g or c

SEQ ID NO: 28748 - protein, 695 aa, Streptomyces thioluteus; identical to SEQ ID NO: 3452
  Xaa in positions 11 and 12

SEQ ID NO: 28749 - DNA, 1707 bp, Listeria monocytogenes; identical to SEQ ID NO: 3453
  CDS (1)..(1707)

SEQ ID NO: 28750 - protein, 568 aa, Listeria monocytogenes; identical to SEQ ID NO: 3454

SEQ ID NO: 28751 - DNA, 1374 bp, Listeria monocytogenes; identical to SEQ ID NO: 3455
  CDS (1)..(1374)

SEQ ID NO: 28752 - protein, 457 aa, Listeria monocytogenes; identical to SEQ ID NO: 3456

SEQ ID NO: 28753 - DNA, 1599 bp, Desulfovibrio vulgaris; identical to SEQ ID NO: 3457
  CDS (1)..(1599)

SEQ ID NO: 28754 - protein, 532 aa, Desulfovibrio vulgaris; identical to SEQ ID NO: 3458

SEQ ID NO: 28755 - DNA, 1899 bp, Thermus thermophilus; identical to SEQ ID NO: 3459
  CDS (1)..(1899)

SEQ ID NO: 28756 - protein, 632 aa, Thermus thermophilus; identical to SEQ ID NO: 3460

SEQ ID NO: 28757 - DNA, 1422 bp, Leptospira interrogans; identical to SEQ ID NO: 3461
  CDS (1)..(1422)

SEQ ID NO: 28758 - protein, 473 aa, Leptospira interrogans; identical to SEQ ID NO: 3462

SEQ ID NO: 28759 - DNA, 1413 bp, Bacillus cereus; identical to SEQ ID NO: 3463
  CDS (1)..(1413)

SEQ ID NO: 28760 - protein, 470 aa, Bacillus cereus; identical to SEQ ID NO: 3464

SEQ ID NO: 28761 - DNA, 1443 bp, Bacillus cereus; identical to SEQ ID NO: 3465
  CDS (1)..(1443)

SEQ ID NO: 28762 - protein, 480 aa, Bacillus cereus; identical to SEQ ID NO: 3466

SEQ ID NO: 28763 - DNA, 1476 bp, Geobacter sulfurreducens; identical to SEQ ID NO: 3467
  CDS (1)..(1476)

SEQ ID NO: 28764 - protein, 491 aa, Geobacter sulfurreducens; identical to SEQ ID NO: 3468

SEQ ID NO: 28765 - DNA, 1506 bp, Ashbya gossypii; identical to SEQ ID NO: 3469
  CDS (1)..(1506)

SEQ ID NO: 28766 - protein, 501 aa, Ashbya gossypii; identical to SEQ ID NO: 3470

SEQ ID NO: 28767 - DNA, 1362 bp, Shigella flexneri; identical to SEQ ID NO: 3471
  CDS (1)..(1362)

SEQ ID NO: 28768 - protein, 453 aa, Shigella flexneri; identical to SEQ ID NO: 3472

SEQ ID NO: 28769 - DNA, 1419 bp, Wolinella succinogenes; identical to SEQ ID NO: 3473
  CDS (1)..(1419)

SEQ ID NO: 28770 - protein, 472 aa, Wolinella succinogenes; identical to SEQ ID NO: 3474

SEQ ID NO: 28771 - DNA, 1401 bp, Vibrio vulnificus; identical to SEQ ID NO: 3475
  CDS (1)..(1401)

SEQ ID NO: 28772 - protein, 466 aa, Vibrio vulnificus; identical to SEQ ID NO: 3476

SEQ ID NO: 28773 - DNA, 2076 bp, Photorhabdus luminescens; identical to SEQ ID NO: 3477
  CDS (1)..(2076)

SEQ ID NO: 28774 - protein, 691 aa, Photorhabdus luminescens; identical to SEQ ID NO: 3478

SEQ ID NO: 28775 - DNA, 1371 bp, Photorhabdus luminescens; identical to SEQ ID NO: 3479
  CDS (1)..(1371)

SEQ ID NO: 28776 - protein, 456 aa, Photorhabdus luminescens; identical to SEQ ID NO: 3480

SEQ ID NO: 28777 - DNA, 1575 bp, Photorhabdus luminescens; identical to SEQ ID NO: 3481
  CDS (1)..(1575)

SEQ ID NO: 28778 - protein, 524 aa, Photorhabdus luminescens; identical to SEQ ID NO: 3482

SEQ ID NO: 28779 - DNA, 2934 bp, Photorhabdus luminescens; identical to SEQ ID NO: 3483
  CDS (1)..(2934)

SEQ ID NO: 28780 - protein, 977 aa, Photorhabdus luminescens; identical to SEQ ID NO: 3484

SEQ ID NO: 28781 - DNA, 1527 bp, Gloeobacter violaceus; identical to SEQ ID NO: 3485
  CDS (1)..(1527)

SEQ ID NO: 28782 - protein, 508 aa, Gloeobacter violaceus; identical to SEQ ID NO: 3486

SEQ ID NO: 28783 - DNA, 1359 bp, Gloeobacter violaceus; identical to SEQ ID NO: 3487
  CDS (1)..(1359)

SEQ ID NO: 28784 - protein, 452 aa, Gloeobacter violaceus; identical to SEQ ID NO: 3488

SEQ ID NO: 28785 - DNA, 1293 bp, Chromobacterium violaceum; identical to SEQ ID NO: 3489
  CDS (1)..(1293)

SEQ ID NO: 28786 - protein, 430 aa, Chromobacterium violaceum; identical to SEQ ID NO: 3490

SEQ ID NO: 28787 - DNA, 1467 bp, Chromobacterium violaceum; identical to SEQ ID NO: 3491
  CDS (1)..(1467)

SEQ ID NO: 28788 - protein, 488 aa, Chromobacterium violaceum; identical to SEQ ID NO: 3492

SEQ ID NO: 28789 - DNA, 1287 bp, Synechococcus sp; identical to SEQ ID NO: 3493
  CDS (1)..(1287)

SEQ ID NO: 28790 - protein, 428 aa, Synechococcus sp; identical to SEQ ID NO: 3494

SEQ ID NO: 28791 - DNA, 1521 bp, Synechococcus sp; identical to SEQ ID NO: 3495
  CDS (1)..(1521)

SEQ ID NO: 28792 - protein, 506 aa, Synechococcus sp; identical to SEQ ID NO: 3496

SEQ ID NO: 28793 - DNA, 1644 bp, Rhodopirellula baltica; identical to SEQ ID NO: 3497
  CDS (1)..(1644)

SEQ ID NO: 28794 - protein, 547 aa, Rhodopirellula baltica; identical to SEQ ID NO: 3498

SEQ ID NO: 28795 - DNA, 1554 bp, Rhodopirellula baltica; identical to SEQ ID NO: 3499
  CDS (1)..(1554)

SEQ ID NO: 28796 - protein, 517 aa, Rhodopirellula baltica; identical to SEQ ID NO: 3500

SEQ ID NO: 28797 - DNA, 1521 bp, Prochlorococcus marinus subsp; identical to SEQ ID NO: 3501
  CDS (1)..(1521)

SEQ ID NO: 28798 - protein, 506 aa, Prochlorococcus marinus subsp; identical to SEQ ID NO: 3502

SEQ ID NO: 28799 - DNA, 1341 bp, Prochlorococcus marinus; identical to SEQ ID NO: 3503
  CDS (1)..(1341)

SEQ ID NO: 28800 - protein, 446 aa, Prochlorococcus marinus; identical to SEQ ID NO: 3504

SEQ ID NO: 28801 - DNA, 1521 bp, Prochlorococcus marinus; identical to SEQ ID NO: 3505
  CDS (1)..(1521)

SEQ ID NO: 28802 - protein, 506 aa, Prochlorococcus marinus; identical to SEQ ID NO: 3506

SEQ ID NO: 28803 - DNA, 1518 bp, Prochlorococcus marinus; identical to SEQ ID NO: 3507
  CDS (1)..(1518)

SEQ ID NO: 28804 - protein, 505 aa, Prochlorococcus marinus; identical to SEQ ID NO: 3508

SEQ ID NO: 28805 - DNA, 1497 bp, Helicobacter hepaticus; identical to SEQ ID NO: 3509
  CDS (1)..(1497)

SEQ ID NO: 28806 - protein, 498 aa, Helicobacter hepaticus; identical to SEQ ID NO: 3510

SEQ ID NO: 28807 - DNA, 1386 bp, Candidatus Blochmannia floridanus; identical to SEQ ID NO: 3511
  CDS (1)..(1386)

SEQ ID NO: 28808 - protein, 461 aa, Candidatus Blochmannia floridanus; identical to SEQ ID NO: 3512

SEQ ID NO: 28809 - DNA, 1566 bp, Candidatus Blochmannia floridanus; identical to SEQ ID NO: 3513
  CDS (1)..(1566)

SEQ ID NO: 28810 - protein, 521 aa, Candidatus Blochmannia floridanus; identical to SEQ ID NO: 3514

SEQ ID NO: 28811 - DNA, 1428 bp, Bacillus cereus; identical to SEQ ID NO: 3515
  CDS (1)..(1428)

SEQ ID NO: 28812 - protein, 475 aa, Bacillus cereus; identical to SEQ ID NO: 3516

SEQ ID NO: 28813 - DNA, 1398 bp, Bacillus cereus; identical to SEQ ID NO: 3517
  CDS (1)..(1398)

SEQ ID NO: 28814 - protein, 465 aa, Bacillus cereus; identical to SEQ ID NO: 3518

SEQ ID NO: 28815 - DNA, 1416 bp, Bacillus anthracis; identical to SEQ ID NO: 3519
  CDS (1)..(1416)

SEQ ID NO: 28816 - protein, 471 aa, Bacillus anthracis; identical to SEQ ID NO: 3520

SEQ ID NO: 28817 - DNA, 1482 bp, Streptomyces avermitilis; identical to SEQ ID NO: 3521
  CDS (1)..(1482)

SEQ ID NO: 28818 - protein, 493 aa, Streptomyces avermitilis; identical to SEQ ID NO: 3522

SEQ ID NO: 28819 - DNA, 2199 bp, Streptomyces avermitilis; identical to SEQ ID NO: 3523
  CDS (1)..(2199)

SEQ ID NO: 28820 - protein, 732 aa, Streptomyces avermitilis; identical to SEQ ID NO: 3524

SEQ ID NO: 28821 - DNA, 1488 bp, Nitrosomonas europaea; identical to SEQ ID NO: 3525
  CDS (1)..(1488)

SEQ ID NO: 28822 - protein, 495 aa, Nitrosomonas europaea; identical to SEQ ID NO: 3526

SEQ ID NO: 28823 - DNA, 1293 bp, Coxiella burnetii; identical to SEQ ID NO: 3527
  CDS (1)..(1293)

SEQ ID NO: 28824 - protein, 430 aa, Coxiella burnetii; identical to SEQ ID NO: 3528

SEQ ID NO: 28825 - DNA, 1392 bp, Coxiella burnetii; identical to SEQ ID NO: 3529
  CDS (1)..(1392)

SEQ ID NO: 28826 - protein, 463 aa, Coxiella burnetii; identical to SEQ ID NO: 3530

SEQ ID NO: 28827 - DNA, 1443 bp, Tropheryma whipplei; identical to SEQ ID NO: 3531
  CDS (1)..(1443)

SEQ ID NO: 28828 - protein, 480 aa, Tropheryma whipplei; identical to SEQ ID NO: 3532

SEQ ID NO: 28829 - DNA, 1494 bp, Burkholderia multivorans; identical to SEQ ID NO: 3533
  CDS (1)..(1494)

SEQ ID NO: 28830 - protein, 497 aa, Burkholderia multivorans; identical to SEQ ID NO: 3534

SEQ ID NO: 28831 - DNA, 1851 bp, Oryza sativa; identical to SEQ ID NO: 3535
  CDS (1)..(1851)

SEQ ID NO: 28832 - protein, 616 aa, Oryza sativa; identical to SEQ ID NO: 3536

SEQ ID NO: 28833 - DNA, 2241 bp, Neurospora crassa; identical to SEQ ID NO: 3537
  CDS (493)..(2241)

SEQ ID NO: 28834 - protein, 582 aa, Neurospora crassa; identical to SEQ ID NO: 3538

SEQ ID NO: 28835 - DNA, 1359 bp, Xylella fastidiosa; identical to SEQ ID NO: 3539
  CDS (1)..(1359)

SEQ ID NO: 28836 - protein, 452 aa, Xylella fastidiosa; identical to SEQ ID NO: 3540

SEQ ID NO: 28837 - DNA, 1476 bp, Xylella fastidiosa; identical to SEQ ID NO: 3541
  CDS (1)..(1476)

SEQ ID NO: 28838 - protein, 491 aa, Xylella fastidiosa; identical to SEQ ID NO: 3542

SEQ ID NO: 28839 - DNA, 1365 bp, Vibrio parahaemolyticus; identical to SEQ ID NO: 3543
  CDS (1)..(1365)

SEQ ID NO: 28840 - protein, 454 aa, Vibrio parahaemolyticus; identical to SEQ ID NO: 3544

SEQ ID NO: 28841 - DNA, 1344 bp, Pseudomonas syringae; identical to SEQ ID NO: 3545
  CDS (1)..(1344)

SEQ ID NO: 28842 - protein, 447 aa, Pseudomonas syringae; identical to SEQ ID NO: 3546

SEQ ID NO: 28843 - DNA, 1482 bp, Pseudomonas syringae; identical to SEQ ID NO: 3547
  CDS (1)..(1482)

SEQ ID NO: 28844 - protein, 493 aa, Pseudomonas syringae; identical to SEQ ID NO: 3548

SEQ ID NO: 28845 - DNA, 1341 bp, Pseudomonas putida; identical to SEQ ID NO: 3549
  CDS (1)..(1341)

SEQ ID NO: 28846 - protein, 446 aa, Pseudomonas putida; identical to SEQ ID NO: 3550

SEQ ID NO: 28847 - DNA, 1482 bp, Pseudomonas putida; identical to SEQ ID NO: 3551
  CDS (1)..(1482)

SEQ ID NO: 28848 - protein, 493 aa, Pseudomonas putida; identical to SEQ ID NO: 3552

SEQ ID NO: 28849 - DNA, 1437 bp, Lactobacillus plantarum; identical to SEQ ID NO: 3553
  CDS (1)..(1437)

SEQ ID NO: 28850 - protein, 478 aa, Lactobacillus plantarum; identical to SEQ ID NO: 3554

SEQ ID NO: 28851 - DNA, 2166 bp, Bradyrhizobium japonicum; identical to SEQ ID NO: 3555
  CDS (1)..(2166)

SEQ ID NO: 28852 - protein, 721 aa, Bradyrhizobium japonicum; identical to SEQ ID NO: 3556

SEQ ID NO: 28853 - DNA, 1407 bp, Bacteroides thetaiotaomicron; identical to SEQ ID NO: 3557
  CDS (1)..(1407)

SEQ ID NO: 28854 - protein, 468 aa, Bacteroides thetaiotaomicron; identical to SEQ ID NO: 3558

SEQ ID NO: 28855 - DNA, 1407 bp, Staphylococcus epidermidis; identical to SEQ ID NO: 3559
  CDS (1)..(1407)

SEQ ID NO: 28856 - protein, 468 aa, Staphylococcus epidermidis; identical to SEQ ID NO: 3560

SEQ ID NO: 28857 - DNA, 1161 bp, Staphylococcus epidermidis; identical to SEQ ID NO: 3561
  CDS (10)..(1161)

SEQ ID NO: 28858 - protein, 383 aa, Staphylococcus epidermidis; identical to SEQ ID NO: 3562

SEQ ID NO: 28859 - DNA, 1401 bp, Vibrio vulnificus; identical to SEQ ID NO: 3563
  CDS (1)..(1401)

SEQ ID NO: 28860 - protein, 466 aa, Vibrio vulnificus; identical to SEQ ID NO: 3564

SEQ ID NO: 28861 - DNA, 1566 bp, Vibrio vulnificus; identical to SEQ ID NO: 3565
  CDS (1)..(1566)

SEQ ID NO: 28862 - protein, 521 aa, Vibrio vulnificus; identical to SEQ ID NO: 3566

SEQ ID NO: 28863 - DNA, 1521 bp, Synechococcus elongatus; identical to SEQ ID NO: 3567
  CDS (1)..(1521)

SEQ ID NO: 28864 - protein, 506 aa, Synechococcus elongatus; identical to SEQ ID NO: 3568

SEQ ID NO: 28865 - DNA, 1377 bp, Synechococcus elongatus; identical to SEQ ID NO: 3569
  CDS (1)..(1377)

SEQ ID NO: 28866 - protein, 458 aa, Synechococcus elongatus; identical to SEQ ID NO: 3570

SEQ ID NO: 28867 - DNA, 1362 bp, Streptococcus mutans; identical to SEQ ID NO: 3571
  CDS (1)..(1362)

SEQ ID NO: 28868 - protein, 453 aa, Streptococcus mutans; identical to SEQ ID NO: 3572

SEQ ID NO: 28869 - DNA, 1725 bp, Shewanella oneidensis; identical to SEQ ID NO: 3573
  CDS (1)..(1725)

SEQ ID NO: 28870 - protein, 574 aa, Shewanella oneidensis; identical to SEQ ID NO: 3574

SEQ ID NO: 28871 - DNA, 1404 bp, Shewanella oneidensis; identical to SEQ ID NO: 3575
  CDS (1)..(1404)

SEQ ID NO: 28872 - protein, 467 aa, Shewanella oneidensis; identical to SEQ ID NO: 3576

SEQ ID NO: 28873 - DNA, 1407 bp, Oceanobacillus iheyensis; identical to SEQ ID NO: 3577
  CDS (1)..(1407)

SEQ ID NO: 28874 - protein, 468 aa, Oceanobacillus iheyensis; identical to SEQ ID NO: 3578

SEQ ID NO: 28875 - DNA, 1362 bp, Escherichia coli O6; identical to SEQ ID NO: 3579
  CDS (1)..(1362)

SEQ ID NO: 28876 - protein, 453 aa, Escherichia coli O6; identical to SEQ ID NO: 3580

SEQ ID NO: 28877 - DNA, 1668 bp, Corynebacterium efficiens; identical to SEQ ID NO: 3581
  CDS (1)..(1668)

SEQ ID NO: 28878 - protein, 555 aa, Corynebacterium efficiens; identical to SEQ ID NO: 3582

SEQ ID NO: 28879 - DNA, 1869 bp, Corynebacterium efficiens; identical to SEQ ID NO: 3583
  CDS (1)..(1869)

SEQ ID NO: 28880 - protein, 622 aa, Corynebacterium efficiens; identical to SEQ ID NO: 3584

SEQ ID NO: 28881 - DNA, 1557 bp, Bifidobacterium longum; identical to SEQ ID NO: 3585
  CDS (1)..(1557)

SEQ ID NO: 28882 - protein, 518 aa, Bifidobacterium longum; identical to SEQ ID NO: 3586

SEQ ID NO: 28883 - DNA, 1482 bp, Streptomyces globisporus; identical to SEQ ID NO: 3587
  CDS (1)..(1482)

SEQ ID NO: 28884 - protein, 493 aa, Streptomyces globisporus; identical to SEQ ID NO: 3588

SEQ ID NO: 28885 - DNA, 1686 bp, Streptococcus pyogenes; identical to SEQ ID NO: 3589
  CDS (1)..(1686)

SEQ ID NO: 28886 - protein, 561 aa, Streptococcus pyogenes; identical to SEQ ID NO: 3590

SEQ ID NO: 28887 - DNA, 1887 bp, Chlorobium tepidum; identical to SEQ ID NO: 3591
  CDS (1)..(1887)

SEQ ID NO: 28888 - protein, 628 aa, Chlorobium tepidum; identical to SEQ ID NO: 3592

SEQ ID NO: 28889 - DNA, 1515 bp, Chlorobium tepidum; identical to SEQ ID NO: 3593
  CDS (1)..(1515)

SEQ ID NO: 28890 - protein, 504 aa, Chlorobium tepidum; identical to SEQ ID NO: 3594

SEQ ID NO: 28891 - DNA, 1832 bp, Acinetobacter baumannii; identical to SEQ ID NO: 3595
  CDS (321)..(1637)

SEQ ID NO: 28892 - protein, 438 aa, Acinetobacter baumannii; identical to SEQ ID NO: 3596

SEQ ID NO: 28893 - DNA, 1356 bp, Xanthomonas campestris; identical to SEQ ID NO: 3597
  CDS (1)..(1356)

SEQ ID NO: 28894 - protein, 451 aa, Xanthomonas campestris; identical to SEQ ID NO: 3598

SEQ ID NO: 28895 - DNA, 1356 bp, Xanthomonas axonopodis; identical to SEQ ID NO: 3599
  CDS (1)..(1356)

SEQ ID NO: 28896 - protein, 451 aa, Xanthomonas axonopodis; identical to SEQ ID NO: 3600

SEQ ID NO: 28897 - DNA, 1476 bp, Xanthomonas axonopodis; identical to SEQ ID NO: 3601
  CDS (1)..(1476)

SEQ ID NO: 28898 - protein, 491 aa, Xanthomonas axonopodis; identical to SEQ ID NO: 3602

SEQ ID NO: 28899 - DNA, 1839 bp, Methanosarcina mazei; identical to SEQ ID NO: 3603
  CDS (1)..(1839)

SEQ ID NO: 28900 - protein, 612 aa, Methanosarcina mazei; identical to SEQ ID NO: 3604

SEQ ID NO: 28901 - DNA, 1362 bp, Fusobacterium nucleatum; identical to SEQ ID NO: 3605
  CDS (1)..(1362)

SEQ ID NO: 28902 - protein, 453 aa, Fusobacterium nucleatum; identical to SEQ ID NO: 3606

SEQ ID NO: 28903 - DNA, 1431 bp, Thermoanaerobacter tengcongensis; identical to SEQ ID NO: 3607
  CDS (1)..(1431)

SEQ ID NO: 28904 - protein, 476 aa, Thermoanaerobacter tengcongensis; identical to SEQ ID NO: 3608

SEQ ID NO: 28905 - DNA, 1683 bp, Methanosarcina acetivorans; identical to SEQ ID NO: 3609
  CDS (1)..(1683)

SEQ ID NO: 28906 - protein, 560 aa, Methanosarcina acetivorans; identical to SEQ ID NO: 3610

SEQ ID NO: 28907 - DNA, 1407 bp, Methanopyrus kandleri; identical to SEQ ID NO: 3611
  CDS (1)..(1407)

SEQ ID NO: 28908 - protein, 468 aa, Methanopyrus kandleri; identical to SEQ ID NO: 3612

SEQ ID NO: 28909 - DNA, 1299 bp, Pyrococcus furiosus; identical to SEQ ID NO: 3613
  CDS (1)..(1299)

SEQ ID NO: 28910 - protein, 432 aa, Pyrococcus furiosus; identical to SEQ ID NO: 3614

SEQ ID NO: 28911 - DNA, 1347 bp, Clostridium perfringens; identical to SEQ ID NO: 3615
  CDS (1)..(1347)

SEQ ID NO: 28912 - protein, 448 aa, Clostridium perfringens; identical to SEQ ID NO: 3616

SEQ ID NO: 28913 - DNA, 1530 bp, Ralstonia solanacearum; identical to SEQ ID NO: 3617
  CDS (1)..(1530)

SEQ ID NO: 28914 - protein, 509 aa, Ralstonia solanacearum; identical to SEQ ID NO: 3618

SEQ ID NO: 28915 - DNA, 1269 bp, Pyrobaculum aerophilum; identical to SEQ ID NO: 3619
  CDS (1)..(1269)

SEQ ID NO: 28916 - protein, 422 aa, Pyrobaculum aerophilum; identical to SEQ ID NO: 3620

SEQ ID NO: 28917 - DNA, 1479 bp, Arabidopsis thaliana; identical to SEQ ID NO: 3621
  CDS (1)..(1479)

SEQ ID NO: 28918 - protein, 492 aa, Arabidopsis thaliana; identical to SEQ ID NO: 3622

SEQ ID NO: 28919 - DNA, 1302 bp, Sulfolobus tokodaii; identical to SEQ ID NO: 3623
  CDS (1)..(1302)

SEQ ID NO: 28920 - protein, 433 aa, Sulfolobus tokodaii; identical to SEQ ID NO: 3624

SEQ ID NO: 28921 - DNA, 1056 bp, Thermoplasma volcanium; identical to SEQ ID NO: 3625
  CDS (1)..(1056)

SEQ ID NO: 28922 - protein, 351 aa, Thermoplasma volcanium; identical to SEQ ID NO: 3626

SEQ ID NO: 28923 - DNA, 2202 bp, Rhizobium loti; identical to SEQ ID NO: 3627
  CDS (1)..(2202)

SEQ ID NO: 28924 - protein, 733 aa, Rhizobium loti; identical to SEQ ID NO: 3628

SEQ ID NO: 28925 - DNA, 3859 bp, Brucella abortus; identical to SEQ ID NO: 3629
  CDS (341)..(2536): n means a or g or c or t/u, s means g or c

SEQ ID NO: 28926 - protein, 731 aa, Brucella abortus; identical to SEQ ID NO: 3630
  Xaa in positions 323 and 602

SEQ ID NO: 28927 - DNA, 1410 bp, Bradyrhizobium japonicum; identical to SEQ ID NO: 3631
  CDS (1)..(1410)

SEQ ID NO: 28928 - protein, 469 aa, Bradyrhizobium japonicum; identical to SEQ ID NO: 3632

SEQ ID NO: 28929 - DNA, 2145 bp, Catharanthus roseus; identical to SEQ ID NO: 3633
  CDS (53)..(1879)

SEQ ID NO: 28930 - protein, 608 aa, Catharanthus roseus; identical to SEQ ID NO: 3634

SEQ ID NO: 28931 - DNA, 1551 bp, Pasteurella multocida; identical to SEQ ID NO: 3635
  CDS (1)..(1551)

SEQ ID NO: 28932 - protein, 516 aa, Pasteurella multocida; identical to SEQ ID NO: 3636

SEQ ID NO: 28933 - DNA, 1416 bp, Streptomyces coelicolor; identical to SEQ ID NO: 3637
  CDS (1)..(1416)

SEQ ID NO: 28934 - protein, 471 aa, Streptomyces coelicolor; identical to SEQ ID NO: 3638

SEQ ID NO: 28935 - DNA, 1350 bp, Xanthomonas albilineans; identical to SEQ ID NO: 3639
  CDS (1)..(1350)

SEQ ID NO: 28936 - protein, 449 aa, Xanthomonas albilineans; identical to SEQ ID NO: 3640

SEQ ID NO: 28937 - DNA, 1071 bp, Thermoplasma acidophilum; identical to SEQ ID NO: 3641
  CDS (1)..(1071)

SEQ ID NO: 28938 - protein, 356 aa, Thermoplasma acidophilum; identical to SEQ ID NO: 3642

SEQ ID NO: 28939 - DNA, 2986 bp, Buchnera aphidicola; identical to SEQ ID NO: 3643
  CDS (1)..(1566)

SEQ ID NO: 28940 - protein, 521 aa, Buchnera aphidicola; identical to SEQ ID NO: 3644

SEQ ID NO: 28941 - DNA, 2630 bp, Buchnera aphidicola; identical to SEQ ID NO: 3645
  CDS (1)..(1566)

SEQ ID NO: 28942 - protein, 521 aa, Buchnera aphidicola; identical to SEQ ID NO: 3646

SEQ ID NO: 28943 - DNA, 2591 bp, Buchnera aphidicola; identical to SEQ ID NO: 3647
  CDS (1)..(1560)

SEQ ID NO: 28944 - protein, 519 aa, Buchnera aphidicola; identical to SEQ ID NO: 3648

SEQ ID NO: 28945 - DNA, 1706 bp, Bordetella bronchiseptica; identical to SEQ ID NO: 3649
  CDS (75)..(1595)

SEQ ID NO: 28946 - protein, 506 aa, Bordetella bronchiseptica; identical to SEQ ID NO: 3650

SEQ ID NO: 28947 - DNA, 2027 bp, Buchnera aphidicola; identical to SEQ ID NO: 3651
  CDS (1)..(1587)

SEQ ID NO: 28948 - protein, 528 aa, Buchnera aphidicola; identical to SEQ ID NO: 3652

SEQ ID NO: 28949 - DNA, 1569 bp, Buchnera aphidicola; identical to SEQ ID NO: 3653
  CDS (1)..(1569)

SEQ ID NO: 28950 - protein, 522 aa, Buchnera aphidicola; identical to SEQ ID NO: 3654

SEQ ID NO: 28951 - DNA, 2124 bp, Oryza sativa; identical to SEQ ID NO: 3655
  CDS (19)..(1839)

SEQ ID NO: 28952 - protein, 606 aa, Oryza sativa; identical to SEQ ID NO: 3656

SEQ ID NO: 28953 - DNA, 1734 bp, Oryza sativa; identical to SEQ ID NO: 3657
  CDS (1)..(1734)

SEQ ID NO: 28954 - protein, 577 aa, Oryza sativa; identical to SEQ ID NO: 3658

SEQ ID NO: 28955 - DNA, 1888 bp, Lactococcus lactis; identical to SEQ ID NO: 3659
  CDS (147)..(1559)

SEQ ID NO: 28956 - protein, 470 aa, Lactococcus lactis; identical to SEQ ID NO: 3660

SEQ ID NO: 28957 - DNA, 1317 bp, Aeropyrum pernix; identical to SEQ ID NO: 3661
  CDS (1)..(1317)

SEQ ID NO: 28958 - protein, 438 aa, Aeropyrum pernix; identical to SEQ ID NO: 3662

SEQ ID NO: 28959 - DNA, 1788 bp, Arabidopsis thaliana; identical to SEQ ID NO: 3663
  CDS (1)..(1788)

SEQ ID NO: 28960 - protein, 595 aa, Arabidopsis thaliana; identical to SEQ ID NO: 3664

SEQ ID NO: 28961 - DNA, 2017 bp, Arthrobacter globiformis; identical to SEQ ID NO: 3665
  CDS (402)..(1997): n means a or g or c or t/u, s means g or c

SEQ ID NO: 28962 - protein, 531 aa, Arthrobacter globiformis; identical to SEQ ID NO: 3666

SEQ ID NO: 28963 - DNA, 2199 bp, Azospirillum brasilense; identical to SEQ ID NO: 3667
  CDS (1)..(2199)

SEQ ID NO: 28964 - protein, 732 aa, Azospirillum brasilense; identical to SEQ ID NO: 3668

SEQ ID NO: 28965 - DNA, 1542 bp, Bacillus pumilus; identical to SEQ ID NO: 3669
  CDS (1)..(1542)

SEQ ID NO: 28966 - protein, 513 aa, Bacillus pumilus; identical to SEQ ID NO: 3670

SEQ ID NO: 28967 - DNA, 1527 bp, Bacillus stearothermophilus; identical to SEQ ID NO: 3671
  CDS (1)..(1527)

SEQ ID NO: 28968 - protein, 508 aa, Bacillus stearothermophilus; identical to SEQ ID NO: 3672

SEQ ID NO: 28969 - DNA, 1545 bp, Buchnera aphidicola; identical to SEQ ID NO: 3673
  CDS (1)..(1545)

SEQ ID NO: 28970 - protein, 514 aa, Buchnera aphidicola; identical to SEQ ID NO: 3674

SEQ ID NO: 28971 - DNA, 1593 bp, Buchnera aphidicola; identical to SEQ ID NO: 3675
  CDS (1)..(1593)

SEQ ID NO: 28972 - protein, 530 aa, Buchnera aphidicola; identical to SEQ ID NO: 3676

SEQ ID NO: 28973 - DNA, 3037 bp, Buchnera aphidicola; identical to SEQ ID NO: 3677
  CDS (1)..(1581)

SEQ ID NO: 28974 - protein, 526 aa, Buchnera aphidicola; identical to SEQ ID NO: 3678

SEQ ID NO: 28975 - DNA, 1557 bp, Corynebacterium glutamicum; identical to SEQ ID NO: 3679
  CDS (1)..(1557)

SEQ ID NO: 28976 - protein, 518 aa, Corynebacterium glutamicum; identical to SEQ ID NO: 3680

SEQ ID NO: 28977 - DNA, 1476 bp, Neisseria gonorrhoeae; identical to SEQ ID NO: 3681
  CDS (1)..(1476)

SEQ ID NO: 28978 - protein, 491 aa, Neisseria gonorrhoeae; identical to SEQ ID NO: 3682

SEQ ID NO: 28979 - DNA, 1476 bp, Neisseria meningitidis; identical to SEQ ID NO: 3683
  CDS (1)..(1476)

SEQ ID NO: 28980 - protein, 491 aa, Neisseria meningitidis; identical to SEQ ID NO: 3684

SEQ ID NO: 28981 - DNA, 1563 bp, Salmonella typhimurium; identical to SEQ ID NO: 3685
  CDS (1)..(1563)

SEQ ID NO: 28982 - protein, 520 aa, Salmonella typhimurium; identical to SEQ ID NO: 3686

SEQ ID NO: 28983 - DNA, 2502 bp, Serratia marcescens; identical to SEQ ID NO: 3687
  CDS (280)..(1839)

SEQ ID NO: 28984 - protein, 519 aa, Serratia marcescens; identical to SEQ ID NO: 3688

SEQ ID NO: 28985 - DNA, 1626 bp, Vibrio parahaemolyticus; identical to SEQ ID NO: 3689
  CDS (1)..(1626)

SEQ ID NO: 28986 - protein, 541 aa, Vibrio parahaemolyticus; identical to SEQ ID NO: 3690

SEQ ID NO: 28987 - DNA, 24 bp, Artificial sequence
  (1)..(24): primer
atgcaaacacaaaaaccgactctc

SEQ ID NO: 28988 - DNA, 25 bp, Artificial sequence
  (1)..(25): primer
ttagaaagtctcctgtgcatgatgc

SEQ ID NO: 28989 - protein, 810 aa, Artificial sequence
  Variant (2)..(2): xaa in position 2 is any amino acid
  Variant (3)..(63): xaa in position 3 to 63 is any or no amino acid
  Variant (65)..(93): xaa in position 65 to 93 is any amino acid
  Variant (94)..(243): xaa in position 94 to 243 is any or no amino acid
  Variant (245)..(247): xaa in position 245 to 247 is any or no amino acid
  Variant (250)..(254): xaa in position 250 to 254 is any or no amino acid
  Variant (256)..(262): xaa in position 256 to 262 is any amino acid
  Variant (263)..(290): xaa in position 263 to 290 is any or no amino acid
  Variant (293)..(300): xaa in position 293 to 300 is any amino acid
  Variant (301)..(301): xaa in position 301 is any or no amino acid
  Variant (303)..(304): xaa in position 303 to 304 is any amino acid
  Variant (306)..(312): xaa in position 306 to 312 is any amino acid
  Variant (314)..(324): xaa in position 314 to 324 is any amino acid
  Variant (325)..(447): xaa in position 325 to 447 is any or no amino acid
  Variant (449)..(451): xaa in position 449 to 451 is any amino acid
  Variant (453)..(458): xaa in position 453 to 458 is any amino acid
  Variant (460)..(461): xaa in position 460 to 461 is any amino acid
  Variant (464)..(464): xaa in position 464 is any amino acid
  Variant (468)..(469): xaa in position 468 to 469 is any amino acid
  Variant (471)..(482): xaa in position 471 to 482 is any amino acid
  Variant (483)..(490): xaa in position 483 to 490 is any or no amino acid
  Variant (492)..(493): xaa in position 492 to 493 is any amino acid
  Variant (496)..(497): xaa in position 496 to 497 is any amino acid
  Variant (503)..(504): xaa in position 503 to 504 is any amino acid
  Variant (507)..(510): xaa in position 507 to 510 is any amino acid
  Variant (511)..(525): xaa in position 511 to 525 is any or no amino acid
  Variant (528)..(528): xaa in position 528 is any amino acid
  Variant (533)..(534): xaa in position 533 to 534 is any amino acid
  Variant (536)..(541): xaa in position 536 to 541 is any amino acid
  Variant (542)..(561): xaa in position 542 to 561 is any or no amino acid
  Variant (563)..(565): xaa in position 563 to 565 is any amino acid
  Variant (571)..(572): xaa in position 571 to 572 is any amino acid
  Variant (575)..(585): xaa in position 575 to 585 is any or no amino acid
  Variant (587)..(589): xaa in position 587 to 589 is any amino acid
  Variant (590)..(592): xaa in position 590 to 592 is any or no amino acid
  Variant (594)..(597): xaa in position 594 to 597 is any amino acid
  Variant (600)..(600): xaa in position 600 is any amino acid
  Variant (601)..(601): xaa in position 601 is any or no amino acid
  Variant (604)..(604): xaa in position 604 is any amino acid
  Variant (611)..(611): xaa in position 611 is any amino acid
  Variant (619)..(620): xaa in position 619 to 620 is any amino acid
  Variant (621)..(638): xaa in position 621 to 638 is any or no amino acid
  Variant (641)..(641): xaa in position 641 is any amino acid
  Variant (643)..(647): xaa in position 643 to 647 is any amino acid
  Variant (650)..(650): xaa in position 650 is any amino acid
  Variant (653)..(653): xaa in position 653 is any amino acid
  Variant (655)..(655): xaa in position 655 is any amino acid
  Variant (660)..(660): xaa in position 660 is any amino acid
  Variant (662)..(662): xaa in position 662 is any amino acid
  Variant (664)..(664): xaa in position 664 is any amino acid
  Variant (666)..(670): xaa in position 666 to 670 is any amino acid
  Variant (671)..(673): xaa in position 671 to 673 is any or no amino acid
  Variant (675)..(677): xaa in position 675 to 677 is any amino acid
  Variant (679)..(680): xaa in position 679 to 680 is any amino acid
  Variant (695)..(696): xaa in position 695 to 696 is any or no amino acid
  Variant (699)..(700): xaa in position 699 to 700 is any amino acid
  Variant (703)..(705): xaa in position 703 to 705 is any amino acid
  Variant (708)..(708): xaa in position 708 is any amino acid
  Variant (709)..(709): xaa in position 709 is any or no amino acid
  Variant (711)..(711): xaa in position 711 is any amino acid
  Variant (717)..(720): xaa in position 717 to 720 is any amino acid
  Variant (722)..(722): xaa in position 722 is any amino acid
  Variant (723)..(742): xaa in position 723 to 742 is any or no amino acid
  Variant (744)..(745): xaa in position 744 to 745 is any amino acid
  Variant (747)..(747): xaa in position 747 is any amino acid
  Variant (751)..(760): xaa in position 751 to 760 is any amino acid
  Variant (761)..(780): xaa in position 761 to 780 is any or no amino acid
  Variant (787)..(787): xaa in position 787 is any amino acid
  Variant (788)..(788): xaa in position 788 is any or no amino acid
  Variant (791)..(791): xaa in position 791 is any amino acid
  Variant (793)..(794): xaa in position 793 to 794 is any amino acid
  Variant (796)..(797): xaa in position 796 to 797 is any amino acid
  Variant (800)..(801): xaa in position 800 to 801 is any amino acid
  Variant (803)..(805): xaa in position 803 to 805 is any amino acid
  Variant (807)..(809): xaa in position 807 to 809 is any amino acid
SXXXXXXXXXXXXXXXXXXXXXXXXXXXXXXXXXXXXXXXXXXXXXXXXXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXYDXXXXXEXXXXXXXXXXXXXXXXXXXXXXXXXXXXXXXXXXXPDXXXXXXXXXLXXDXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXXVXXXXXXIXXGDXFQVXXSXXXXXXXXXXXXXXXXXXXXYXXLRXXNPSPYXXYLXXXXXXXXXXXXXXXXXXXLVXSSPEXXVXXXXXXXXXXXXXXXXXXXXXXXXXXVXXXPIAGTXXRGXXXXXXXXXXXDXXXXXXLXXXXKEXXAEXLMLVDLXRNDLGRVXXXXXXXXXXXXXXXXXXXXSVXVXXXXXVEXYSXVXHLVSXVXGXLXXXXXXXXDXXXAXXPAGTVTGAPKVRAMXXIIXXLEXXXRGXXYXGAVGYXXXXGXXXXXXXXXXXXXXXXXXXXXDXXIXIRTXXXXXXXXXXXXXXXXXXXXXXXXXXXXXXAGAGIVXXDSXPXXEXXETXXKXXXLXXXI

SEQ ID NO: 28990 - protein, 55 aa, Artificial sequence; identical to SEQ ID NO: 6162
  Variant (1)..(1): xaa in position 1 is Ser, Ala, Thr, Pro or Val
  Variant (2)..(2): xaa in position 2 is Pro, Ala, Asn, Ser or Gly
  Variant (3)..(3): xaa in position 3 is Tyr, Phe, His or Arg
  Variant (4)..(13): xaa in position 4 to 13 is any amino acid
  Variant (14)..(22): xaa in position 14 to 22 is any or no amino acid
  Variant (23)..(23): xaa in position 23 is Leu, Ile or Val
  Variant (24)..(24): xaa in position 24 is any amino acid
  Variant (25)..(25): xaa in position 25 is Gly, Ser, Ala or Cys
  Variant (26)..(26): xaa in position 26 is any amino acid
  Variant (30)..(38): xaa in position 30 to 38 is any amino acid
  Variant (39)..(46): xaa in position 39 to 46 is any or no amino acid
  Variant (47)..(47): xaa in position 47 is Val, Ile, Ala, Leu or Phe
  Variant (48)..(50): xaa in position 48 to 50 is any amino acid
  Variant (52)..(52): xaa in position 52 is Ile, Leu or Met
  Variant (53)..(53): xaa in position 53 is Ala, Lys or Ser
  Variant (55)..(55): xaa in position 55 is Thr or Ser

SEQ ID NO: 28991 - protein, 49 aa, Artificial sequence; identical to SEQ ID NO: 6163
  Variant (2)..(2): xaa in position 2 is Glu, Asp, Gln or Asn
  Variant (3)..(3): xaa in position 3 is any amino acid
  Variant (4)..(4): xaa in position 4 is Ala or Ser
  Variant (6)..(6): xaa in position 6 is His, Asn or Leu
  Variant (7)..(7): xaa in position 7 is any amino acid
  Variant (8)..(8): xaa in position 8 is Met or Val
  Variant (9)..(9): xaa in position 9 is Leu, Ile, Cys or Ser
  Variant (10)..(10): xaa in position 10 is Val, Ile, Leu, Thr or Ser
  Variant (12)..(12): xaa in position 12 is Leu or Val
  Variant (13)..(13): xaa in position 13 is any amino acid
  Variant (15)..(15): xaa in position 15 is Asn, His or Glu
  Variant (16)..(16): xaa in position 16 is Asp or Glu
  Variant (17)..(17): xaa in position 17 is Leu, Ile, Val, Lys or Met
  Variant (18)..(20): xaa in position 18 to 20 is any amino acid
  Variant (21)..(21): xaa in position 21 is Cys, Ser or Ala
  Variant (22)..(23): xaa in position 22 to 23 is any amino acid
  Variant (24)..(24): xaa in position 24 is any or no amino acid
  Variant (25)..(25): xaa in position 25 is Ser, Thr, Glu or Lys
  Variant (26)..(27): xaa in position 26 to 27 is any amino acid
  Variant (28)..(28): xaa in position 28 is Val, Ile, Leu, Thr or Ala
  Variant (29)..(33): xaa in position 29 to 33 is any amino acid
  Variant (34)..(34): xaa in position 34 is Val, Ile, Leu or Thr
  Variant (35)..(36): xaa in position 35 to 36 is any amino acid
  Variant (37)..(37): xaa in position 37 is Tyr, Phe or Arg
  Variant (38)..(39): xaa in position 38 to 39 is any amino acid
  Variant (40)..(40): xaa in position 40 is Val, Leu or Ile
  Variant (41)..(41): xaa in position 41 is any amino acid
  Variant (42)..(42): xaa in position 42 is His or Gln
  Variant (43)..(43): xaa in position 43 is Leu, Ile, Met or Thr
  Variant (44)..(44): xaa in position 44 is any amino acid
  Variant (45)..(45): xaa in position 45 is Ser, Asp or Thr
  Variant (46)..(46): xaa in position 46 is any amino acid
  Variant (47)..(47): xaa in position 47 is Val or Ile
  Variant (48)..(48): xaa in position 48 is any amino acid
  Variant (49)..(49): xaa in position 49 is Gly or Ala

SEQ ID NO: 28992 - protein, 52 aa, Artificial sequence; identical to SEQ ID NO: 6164
  Variant (1)..(1): xaa in position 1 is Gly or Val
  Variant (2)..(2): xaa in position 2 is Thr or Ser
  Variant (3)..(3): xaa in position 3 is Val, Leu, Ile, Met or Ala
  Variant (4)..(4): xaa in position 4 is Thr or Ser
  Variant (6)..(6): xaa in position 6 is Ala, Cys, Ser or Ile
  Variant (9)..(10): xaa in position 9 to 10 is any amino acid
  Variant (11)..(11): xaa in position 11 is Ala, Thr, Ser or Cys
  Variant (12)..(12): xaa in position 12 is Met, Ile, Leu or Val
  Variant (13)..(13): xaa in position 13 is any amino acid
  Variant (14)..(14): xaa in position 14 is any or no amino acid
  Variant (15)..(15): xaa in position 15 is Ile, Leu or Val
  Variant (16)..(17): xaa in position 16 to 17 is any amino acid
  Variant (18)..(18): xaa in position 18 is any or no amino acid
  Variant (19)..(19): xaa in position 19 is Glu or Tyr
  Variant (20)..(22): xaa in position 20 to 22 is any amino acid
  Variant (24)..(25): xaa in position 24 to 25 is any amino acid
  Variant (26)..(26): xaa in position 26 is Tyr, Phe or Trp
  Variant (27)..(27): xaa in position 27 is Gly, Ala, Ser, Cys, Thr or Tyr
  Variant (29)..(30): xaa in position 29 to 30 is any amino acid
  Variant (31)..(31): xaa in position 31 is Gly, Ala, Leu, Phe or Ile
  Variant (32)..(41): xaa in position 32 to 41 is any amino acid
  Variant (42)..(47): xaa in position 42 to 47 is any or no amino acid
  Variant (48)..(48): xaa in position 48 is Ile, Leu, Val or Met
  Variant (49)..(49): xaa in position 49 is any amino acid
  Variant (50)..(50): xaa in position 50 is Ile or Leu
  Variant (52)..(52): xaa in position 52 is Thr, Ser, Met or Ala

SEQ ID NO: 28993 - protein, 20 aa, Artificial sequence
  Variant (1)..(1): xaa in position 1 is Gly or Ala
  Variant (2)..(2): xaa in position 2 is Ala, Gly, Cys or Ser
  Variant (3)..(3): xaa in position 3 is Gly, Ala or Thr
  Variant (4)..(4): xaa in position 4 is Ile, Val or Leu
  Variant (5)..(5): xaa in position 5 is Val, Thr, Leu or Ile
  Variant (6)..(7): xaa in position 6 to 7 is any amino acid
  Variant (9)..(12): xaa in position 9 to 12 is any amino acid
  Variant (14)..(15): xaa in position 14 to 15 is any amino acid
  Variant (17)..(19): xaa in position 17 to 19 is any amino acid
XXXXXXXSXXXXEXXEXXXK

SEQ ID NO: 28994 - DNA, 291 bp, Escherichia coli K12; identical to SEQ ID NO: 18608
  CDS (1)..(291): transl_table=11

SEQ ID NO: 28995 - protein, 96 aa, Escherichia coli K12; identical to SEQ ID NO: 18609

SEQ ID NO: 28996 - DNA, 216 bp, Bacteriophage 933W; identical to SEQ ID NO: 18610
  CDS (1)..(216): transl_table=11

SEQ ID NO: 28997 - protein, 71 aa, Bacteriophage 933W; identical to SEQ ID NO: 18611

SEQ ID NO: 28998 - DNA, 291 bp, Bacteriophage VT2-Sa; identical to SEQ ID NO: 18612
  CDS (1)..(291): transl_table=11

SEQ ID NO: 28999 - protein, 96 aa, Bacteriophage VT2-Sa; identical to SEQ ID NO: 18613

SEQ ID NO: 29000 - DNA, 315 bp, Escherichia coli O157:H7 EDL933; identical to SEQ ID NO: 18614
  CDS (1)..(315): transl_table=11

SEQ ID NO: 29001 - protein, 104 aa, Escherichia coli O157:H7 EDL933; identical to SEQ ID NO: 18615

SEQ ID NO: 29002 - DNA, 315 bp, Escherichia coli O157:H7 EDL933; identical to SEQ ID NO: 18616
  CDS (1)..(315): transl_table=11

SEQ ID NO: 29003 - protein, 104 aa, Escherichia coli O157:H7 EDL933; identical to SEQ ID NO: 18617

SEQ ID NO: 29004 - DNA, 273 bp, Escherichia coli O157:H7 EDL933; identical to SEQ ID NO: 18618
  CDS (1)..(273): transl_table=11

SEQ ID NO: 29005 - protein, 90 aa, Escherichia coli O157:H7 EDL933; identical to SEQ ID NO: 18619

SEQ ID NO: 29006 - DNA, 216 bp, Escherichia coli O157:H7; identical to SEQ ID NO: 18620
  CDS (1)..(216): transl_table=11

SEQ ID NO: 29007 - protein, 71 aa, Escherichia coli O157:H7; identical to SEQ ID NO: 18621

SEQ ID NO: 29008 - DNA, 207 bp, Escherichia coli O157:H7; identical to SEQ ID NO: 18622
  CDS (1)..(207): transl_table=11

SEQ ID NO: 29009 - protein, 68 aa, Escherichia coli O157:H7; identical to SEQ ID NO: 18623

SEQ ID NO: 29010 - DNA, 216 bp, Escherichia coli O157:H7; identical to SEQ ID NO: 18624
  CDS (1)..(216): transl_table=11

SEQ ID NO: 29011 - protein, 71 aa, Escherichia coli O157:H7; identical to SEQ ID NO: 18625

SEQ ID NO: 29012 - DNA, 216 bp, Escherichia coli O157:H7; identical to SEQ ID NO: 18626
  CDS (1)..(216): transl_table=11

SEQ ID NO: 29013 - protein, 71 aa, Escherichia coli O157:H7; identical to SEQ ID NO: 18627

SEQ ID NO: 29014 - DNA, 216 bp, Escherichia coli O157:H7; identical to SEQ ID NO: 18628
  CDS (1)..(216): transl_table=11

SEQ ID NO: 29015 - protein, 71 aa, Escherichia coli O157:H7; identical to SEQ ID NO: 18629

SEQ ID NO: 29016 - DNA, 207 bp, Escherichia coli O157:H7; identical to SEQ ID NO: 18630
  CDS (1)..(207): transl_table=11

SEQ ID NO: 29017 - protein, 68 aa, Escherichia coli O157:H7; identical to SEQ ID NO: 18631

SEQ ID NO: 29018 - DNA, 207 bp, Escherichia coli O157:H7; identical to SEQ ID NO: 18632
  CDS (1)..(207): transl_table=11

SEQ ID NO: 29019 - protein, 68 aa, Escherichia coli O157:H7; identical to SEQ ID NO: 18633

SEQ ID NO: 29020 - DNA, 216 bp, Shigella flexneri 2a str. 301; identical to SEQ ID NO: 18634
  CDS (1)..(216): transl_table=11

SEQ ID NO: 29021 - protein, 71 aa, Shigella flexneri 2a str. 301; identical to SEQ ID NO: 18635

SEQ ID NO: 29022 - DNA, 216 bp, Shigella flexneri 2a str. 301; identical to SEQ ID NO: 18636
  CDS (1)..(216): transl_table=11

SEQ ID NO: 29023 - protein, 71 aa, Shigella flexneri 2a str. 301; identical to SEQ ID NO: 18637

SEQ ID NO: 29024 - DNA, 321 bp, Escherichia coli CFT073; identical to SEQ ID NO: 18638
  CDS (1)..(321): transl_table=11

SEQ ID NO: 29025 - protein, 106 aa, Escherichia coli CFT073; identical to SEQ ID NO: 18639

SEQ ID NO: 29026 - DNA, 216 bp, Escherichia coli CFT073; identical to SEQ ID NO: 18640
  CDS (1)..(216): transl_table=11

SEQ ID NO: 29027 - protein, 71 aa, Escherichia coli CFT073; identical to SEQ ID NO: 18641

SEQ ID NO: 29028 - DNA, 216 bp, Shigella flexneri 2a str. 2457T; identical to SEQ ID NO: 18642
  CDS (1)..(216): transl_table=11

SEQ ID NO: 29029 - protein, 71 aa, Shigella flexneri 2a str. 2457T; identical to SEQ ID NO: 18643

SEQ ID NO: 29030 - DNA, 180 bp, Shigella flexneri 2a str. 2457T; identical to SEQ ID NO: 18644
  CDS (1)..(180): transl_table=11

SEQ ID NO: 29031 - protein, 59 aa, Shigella flexneri 2a str. 2457T; identical to SEQ ID NO: 18645

SEQ ID NO: 29032 - DNA, 213 bp, Yersinia pseudotuberculosis IP 32953; identical to SEQ ID NO: 18646
  CDS (1)..(213): transl_table=11

SEQ ID NO: 29033 - protein, 70 aa, Yersinia pseudotuberculosis IP 32953; identical to SEQ ID NO: 18647

SEQ ID NO: 29034 - DNA, 216 bp, Shigella sonnei Ss046; identical to SEQ ID NO: 18648
  CDS (1)..(216): transl_table=11

SEQ ID NO: 29035 - protein, 71 aa, Shigella sonnei Ss046; identical to SEQ ID NO: 18649

SEQ ID NO: 29036 - DNA, 216 bp, Shigella sonnei Ss046; identical to SEQ ID NO: 18650
  CDS (1)..(216): transl_table=11

SEQ ID NO: 29037 - protein, 71 aa, Shigella sonnei Ss046; identical to SEQ ID NO: 18651

SEQ ID NO: 29038 - DNA, 207 bp, Bacteriophage H19B; identical to SEQ ID NO: 18652
  CDS (1)..(207): transl_table=11

SEQ ID NO: 29039 - protein, 68 aa, Bacteriophage H19B; identical to SEQ ID NO: 18653

SEQ ID NO: 29040 - DNA, 291 bp, Stx1; identical to SEQ ID NO: 18654
  CDS (1)..(291): transl_table=11

SEQ ID NO: 29041 - protein, 96 aa, Stx1; identical to SEQ ID NO: 18655

SEQ ID NO: 29042 - DNA, 150 bp, Escherichia coli; identical to SEQ ID NO: 18656
  CDS (1)..(150): transl_table=11

SEQ ID NO: 29043 - protein, 49 aa, Escherichia coli; identical to SEQ ID NO: 18657

SEQ ID NO: 29044 - DNA, 216 bp, Escherichia coli; identical to SEQ ID NO: 18658
  CDS (1)..(216): transl_table=11

SEQ ID NO: 29045 - protein, 71 aa, Escherichia coli; identical to SEQ ID NO: 18659

SEQ ID NO: 29046 - DNA, 216 bp, Shigella dysenteriae; identical to SEQ ID NO: 18660
  CDS (1)..(216): transl_table=11

SEQ ID NO: 29047 - protein, 71 aa, Shigella dysenteriae; identical to SEQ ID NO: 18661

SEQ ID NO: 29048 - DNA, 216 bp, Escherichia coli O6; identical to SEQ ID NO: 18662
  CDS (1)..(216): transl_table=11

SEQ ID NO: 29049 - protein, 71 aa, Escherichia coli O6; identical to SEQ ID NO: 18663

SEQ ID NO: 29050 - DNA, 216 bp, Bacteriophage P21; identical to SEQ ID NO: 18664
  CDS (1)..(216): transl_table=11

SEQ ID NO: 29051 - protein, 71 aa, Bacteriophage P21; identical to SEQ ID NO: 18665

SEQ ID NO: 29052 - DNA, 24 bp, Artificial sequence
  (1)..(24): primer
atgctgtcaaaactaccccgtaga

SEQ ID NO: 29053 - DNA, 23 bp, Artificial sequence
  (1)..(23): primer
ttactctcctctcgcagccttac

SEQ ID NO: 29054 - protein, 71 aa, Artificial sequence; identical to SEQ ID NO: 18668
  Variant (2)..(3): xaa in position 2 to 3 is any amino acid
  Variant (14)..(14): xaa in position 14 is any amino acid
  Variant (18)..(20): xaa in position 18 to 20 is any amino acid
  Variant (24)..(24): xaa in position 24 is any amino acid
  Variant (27)..(27): xaa in position 27 is any amino acid
  Variant (30)..(30): xaa in position 30 is any amino acid
  Variant (37)..(37): xaa in position 37 is any amino acid
  Variant (47)..(47): xaa in position 47 is any amino acid
  Variant (49)..(49): xaa in position 49 is any amino acid
  Variant (67)..(67): xaa in position 67 is any amino acid

SEQ ID NO: 29055 - protein, 10 aa, Artificial sequence
  Variant (2)..(2): xaa in position 2 is Asp or Glu
  Variant (5)..(5): xaa in position 5 is Ser or Thr
  Variant (7)..(7): xaa in position 7 is Gly or Ser
  Variant (8)..(8): xaa in position 8 is Ile or Val
  Variant (9)..(9): xaa in position 9 is Ala or Ser
MXKIXTXXXY

SEQ ID NO: 29056 - protein, 6 aa, Artificial sequence
  Variant (2)..(2): xaa in position 2 is Phe or Leu
  Variant (5)..(5): xaa in position 5 is any amino acid
WXLQXL

SEQ ID NO: 29057 - protein, 14 aa, Artificial sequence
  Variant (5)..(5): xaa in position 5 is any or no amino acid
  Variant (7)..(7): xaa in position 7 is any or no amino acid
PSQWXAXIGVLGSL

SEQ ID NO: 29058 - DNA, 2250 bp, Escherichia coli K12
  CDS (163)..(1566)
aatgcacccgctgtgtgaaataaacagagcgccttcggggcgtttttttacatggcacgaaagaccaaacatttgttatcaaatggtaaataataagtgagctaaaagttgcttaacgaaagcaaaacagaaagaaaaaattaatcaggtgaggagcaggtcatgaatacagtacgcagcgaaaaagattcgatgggggcgattgatgtcccggcagataagctgtggggcgcacaaactcaacgctcgctggagcatttccgcatttcgacggagaaaatgcccacctcactgattcatgcgctggcgctaaccaagcgtgcagcggcaaaagttaatgaagatttaggcttgttgtctgaagagaaagcgagcgccattcgtcaggcggcggatgaagtactggcaggacagcatgacgacgaattcccgctggctatctggcagaccggctccggcacgcaaagtaacatgaacatgaacgaagtgctggctaaccgggccagtgaattactcggcggtgtgcgcgggatggaacgtaaagttcaccctaacgacgacgtgaacaaaagccaaagttccaacgatgtctttccgacggcgatgcacgttgcggcgctgctggcgctgcgcaagcaactcattcctcagcttaaaaccctgacacagacactgaatgagaaatcccgtgcttttgccgatatcgtcaaaattggtcgtactcacttgcaggatgccacgccgttaacgctggggcaggagatttccggctgggtagcgatgctcgagcataatctcaaacatatcgaatacagcctgcctcacgtagcggaactggctcttggcggtacagcggtgggtactggactaaatacccatccggagtatgcgcgtcgcgtagcagatgaactggcagtcattacctgtgcaccgtttgttaccgcgccgaacaaatttgaagcgctggcgacctgtgatgccctggttcaggcgcacggcgcgttgaaagggttggctgcgtcactgatgaaaatcgccaatgatgtccgctggctggcctctggcccgcgctgcggaattggtgaaatctcaatcccggaaaatgagccgggcagctcaatcatgccggggaaagtgaacccaacacagtgtgaggcattaaccatgctctgctgtcaggtgatggggaacgacgtggcgatcaacatggggggcgcttccggtaactttgaactgaacgtcttccgtccaatggtgatccacaatttcctgcaatcggtgcgcttgctggcagatggcatggaaagttttaacaaacactgcgcagtgggtattgaaccgaatcgtgagcgaatcaatcaattactcaatgaatcgctgatgctggtgactgcgcttaacacccacattggttatgacaaagccgccgagatcgccaaaaaagcgcataaagaagggctgaccttaaaagctgcggcccttgcgctggggtatcttagcgaagccgagtttgacagctgggtacggccagaacagatggtcggcagtatgaaagccgggcgttaatctgcaacatacaggtgcagccgtggaatgatcaaacgaagcggctgcgcctgaggtttataacggtgctgcacattgtcggcatcgtaatttaacaactcaccaacgtccggcacgcccgcgccattatcccgattaatcagtgcaatcagtggtgtagggcaggcgtgttggacttgtttttgatctcctttgtaccagacgcgggcaatcggctgcaccttcaccggacgtttgatttttaacttcgcgttctgtggcagggcagcgatatcctgatactctcgctccagttttctttgccactcctcgcgcgtccacggtgcgacactgcgtggtgatttcaggcttttttccagctgtgccaggacttcatcacgatgtaaattcttaatgatatgtttattagcccaaccaaagcgtaaagtggcggggtcgtgcagaacggtgagcgtgcggtaagcattaagggtgatcacgcccggcaaatgacgatgcacccattcaaaacgtgccgcggtggggatttctgattcaaccgtgacgatatgctcgaacgtggcttcgagtttattgatgtgctgaatatgactgaccaacgctgcttgcgaaaggttatccgaaccggaacacaacagccaggcagacggacagtggccttgctgctgcgattcggactgttgt

SEQ ID NO: 29059 - protein, 467 aa, Escherichia coli K12
MNTVRSEKDSMGAIDVPADKLWGAQTQRSLEHFRISTEKMPTSLIHALALTKRAAAKVNEDLGLLSEEKASAIRQAADEVLAGQHDDEFPLAIWQTGSGTQSNMNMNEVLANRASELLGGVRGMERKVHPNDDVNKSQSSNDVFPTAMHVAALLALRKQLIPQLKTLTQTLNEKSRAFADIVKIGRTHLQDATPLTLGQEISGWVAMLEHNLKHIEYSLPHVAELALGGTAVGTGLNTHPEYARRVADELAVITCAPFVTAPNKFEALATCDALVQAHGALKGLAASLMKIANDVRWLASGPRCGIGEISIPENEPGSSIMPGKVNPTQCEALTMLCCQVMGNDVAINMGGASGNFELNVFRPMVIHNFLQSVRLLADGMESFNKHCAVGIEPNRERINQLLNESLMLVTALNTHIGYDKAAEIAKKAHKEGLTLKAAALALGYLSEAEFDSWVRPEQMVGSMKAGR

SEQ ID NO: 29060 - DNA, 1770 bp, Arabidopsis thaliana; identical to SEQ ID NO: 11020
  CDS (84)..(1559)

SEQ ID NO: 29061 - protein, 491 aa, Arabidopsis thaliana; identical to SEQ ID NO: 11021

SEQ ID NO: 29062 - DNA, 1512 bp, Arabidopsis thaliana; identical to SEQ ID NO: 11022
  CDS (1)..(1479)

SEQ ID NO: 29063 - protein, 492 aa, Arabidopsis thaliana; identical to SEQ ID NO: 11023

SEQ ID NO: 29064 - DNA, 1500 bp, Arabidopsis thaliana; identical to SEQ ID NO: 11024
  CDS (1)..(1500)

SEQ ID NO: 29065 - protein, 499 aa, Arabidopsis thaliana; identical to SEQ ID NO: 11025

SEQ ID NO: 29066 - DNA, 1865 bp, Solanum tuberosum; identical to SEQ ID NO: 11026
  CDS (66)..(1547)

SEQ ID NO: 29067 - protein, 493 aa, Solanum tuberosum; identical to SEQ ID NO: 11027

SEQ ID NO: 29068 - DNA, 1616 bp, Arabidopsis thaliana; identical to SEQ ID NO: 11028
  CDS (44)..(1576)

SEQ ID NO: 29069 - protein, 510 aa, Arabidopsis thaliana; identical to SEQ ID NO: 11029

SEQ ID NO: 29070 - DNA, 1647 bp, Bradyrhizobium japonicum
  CDS (22)..(1485)
actgcctatatagaggagcacatgaagaggccgcgcggcatttcgcgcggcggaatggatgtgctcatggccaaatctgcacgcacgaagaccgctcgccccgcgacccgcaccgagaccgacagtttcggtcccatcgaggtcccctccgatcgctattggggcgcgcagaccgaacgttcgcggcagaatttccgcatcggcacggatcgcatgccgatctcgctcgtgcatgcgctcggcatcgtcaagctcgccgcggcgcagtccaaccgcgagctcggcctgctcgaccagcgccgcgccagtgccatcatccgcgccgcgcgcgaggtatcgacggcagacctcgacgatcatttcccgctcgtcgtgtggcagaccggctcgggcacgcagaccaacatgaacctcaacgaggtgatcgccaaccgcgccaatgagctgctcggcggcgagctcggcgccaagaagccggtgcatccgaacgatcacgtcaacatgagccagtcgtcgaacgactcttttcccaccgcaatgcatatcgcggcggctagccgcatcaccgccgatctcgttcctgcccttggcgaactgctccgcgcgctgcgcaagaaggagaaggagttcgccaagatcgtcaagatcggccgcacccacacccaggacgcgacgccgctgacgctcggccaggaattctccggctatgccgcgcaggtcgaacgcgggatcgcgcgactgaaggtcgcggtgaaggagctctatccgctggcgcagggcggcaccgccgtcggcaccggcctcaacgcgaagccgcgctttgcaagactgttcgcaaagcacgttgccggaatcaccaaactgcccttcaccagcgccgccaacaaattcgaggcgctggcctcgaacgatgcttatgtgctggcgcacggcgccatcagttcggtcgcgacaggcctgttcaagatcgccaacgacatccgcctgctcggatcgggtccgcgctcagggctcggcgagctgatcctgccggagaacgaaccgggctcgtcgatcatgccgggcaaggtcaatccgacgcagtgcgaggcgatgaccatggtgtgctgccaggtgttcggcaatcacaccgcgatcacggtcgccggcagccagggccatttcgagctcaacgtctacaagcccgtgctggcctacaacatgctgcactcgatccgcctgatggccgatgccgcgcgctccttcaccgaacattgcgtcagcggcatccgcgccgacgaaaagcgcataagtgagctgatgcagcgctcgctgatgctggtgaccgcgctcgcaccgaagatcggctacgacaacgccgccaaggtcgcgaagacggcgcatgccaacggcaccacgctgaaggaggaagcgctgcggctcggcttcgtcacagcggacgagttcgaccgtttggtgcagccggagaagatgacgaaaccgtagtaattcctaattccgatagtcatccgtaatgatacggagccaaaaagctcataattgtaaggcttaaaggagaggatttgattaccgtcaatgttccggaaagacggcgtgctacgaagctattctgcccttggcggggcgaaattcatcgtttgatggcca

SEQ ID NO: 29071 - protein, 487 aa, Bradyrhizobium japonicum
MKRPRGISRGGMDVLMAKSARTKTARPATRTETDSFGPIEVPSDRYWGAQTERSRQNFRIGTDRMPISLVHALGIVKLAAAQSNRELGLLDQRRASAIIRAAREVSTADLDDHFPLVVWQTGSGTQTNMNLNEVIANRANELLGGELGAKKPVHPNDHVNMSQSSNDSFPTAMHIAAASRITADLVPALGELLRALRKKEKEFAKIVKIGRTHTQDATPLTLGQEFSGYAAQVERGIARLKVAVKELYPLAQGGTAVGTGLNAKPRFARLFAKHVAGITKLPFTSAANKFEALASNDAYVLAHGAISSVATGLFKIANDIRLLGSGPRSGLGELILPENEPGSSIMPGKVNPTQCEAMTMVCCQVFGNHTAITVAGSQGHFELNVYKPVLAYNMLHSIRLMADAARSFTEHCVSGIRADEKRISELMQRSLMLVTALAPKIGYDNAAKVAKTAHANGTTLKEEALRLGFVTADEFDRLVQPEKMTKP

SEQ ID NO: 29072 - DNA, 1383 bp, Chlamydophila pneumoniae, Chlamydia pneumoniae
  CDS (1)..(1383)
atgcgacaagaaaaggatagtttaggaatcgtagaagttcctgaggataagttatatggagctcaaactatgcgttctaggaattttttttcttggggacctgagttgatgccttatgaggtaatacgagctctcgtatggattaaaaaatgtgctgctcaggcgaatcaagatttaggatttttggattccaagcattgcgatatgattgttgctgctgccgatgagattttagagggaggttttgaagagcatttccctttaaaagtttggcagacagggagcggcacacaatctaatatgaatgtgaatgaggtgattgcgaatcttgccattcgtcatcacggaggggtgttaggcagtaaggatcctatccatcctaatgatcatgtgaataagtcccaatcgtccaatgatgttttccctacagcaatgcatatcgctgctgtgattagtttaaaaaataagttaattccagctttagatcatatgattcgggtgttagatgctaaagtggaagaatttcgtcatgatgtaaagataggacggacccatcttatggatgcggtgcctatgacgttgggtcaggaattttctggttatagcagtcaattgcgtcactgcttagagagtatagcattttctttagctcatttatatgaacttgcgattggagctactgctgtagggactgggttgaatgttcctgaagggttcgtggaaaagatcatccattatttaaggaaggaaacagatgaaccgtttattccagcttccaattatttttcagcactgtcttgtcacgatgctttagtagatgcccatgggtctttagcaactttagcatgtgctttaactaagatagctacggatttgagctttttaggttcaggacccaggtgtgggttgggtgagttatttttccctgaaaatgaaccaggatcttctatcatgcctggtaaagtcaatcctacgcagtgtgaagctctccaaatggtttgtgctcaagttcttgggaataatcaaacagtgattattggaggaagtcgaggaaattttgagcttaatgtgatgaagcctgtgatcatctataatttcctgcagtctgtggatctcctttctgaggggatgagggctttctctgaattctttgtgaaaggattaaaagtaaataaagctcgtttacaagataatatcaataattctttgatgttggttacagctttagctcctgtattaggttacgacaagtgttcgaaagcagcactgaaagcatttcatgaatctatatctttgaaggaggcgtgtctagctttgggatatctttctgagaaggaatttgatcgtttagtggttcctgagaatatggtgggaaaccattag

SEQ ID NO: 29073 - protein, 460 aa, Chlamydophila pneumoniae, Chlamydia pneumoniae
MRQEKDSLGIVEVPEDKLYGAQTMRSRNFFSWGPELMPYEVIRALVWIKKCAAQANQDLGFLDSKHCDMIVAAADEILEGGFEEHFPLKVWQTGSGTQSNMNVNEVIANLAIRHHGGVLGSKDPIHPNDHVNKSQSSNDVFPTAMHIAAVISLKNKLIPALDHMIRVLDAKVEEFRHDVKIGRTHLMDAVPMTLGQEFSGYSSQLRHCLESIAFSLAHLYELAIGATAVGTGLNVPEGFVEKIIHYLRKETDEPFIPASNYFSALSCHDALVDAHGSLATLACALTKIATDLSFLGSGPRCGLGELFFPENEPGSSIMPGKVNPTQCEALQMVCAQVLGNNQTVIIGGSRGNFELNVMKPVIIYNFLQSVDLLSEGMRAFSEFFVKGLKVNKARLQDNINNSLMLVTALAPVLGYDKCSKAALKAFHESISLKEACLALGYLSEKEFDRLVVPENMVGNH

SEQ ID NO: 29074 - DNA, 1392 bp, Campylobacter jejuni
  CDS (1)..(1392)
atggaatacagagttgaacatgataccatgggtgaagttaaggttccaaatgacaaatattggggagctcaaactgaaagaagttttgaaaatttcaaaatcggttgtgagaaaatgccaaaggttttaatctatgcttttgcaaatcttaaaaaatctttagctttggtcaataacaaacttggcaaacttgatgatgctaagaaaaatgctatagttcaagcttgcgatgagattatcgcaggtaaatttgatgataattttccacttgcgatttggcaaacaggttcaggcacacaaagcaatatgaatatgaatgaagttattgcaaatcgtgccactgaaatcatgggcggggattttcgcaaagaaaagcttgtacatccaaatgatcatgttaatatgagtcaaagttcaaatgatacttttccaacagctatgagtatcgttgcggttgagcaagtagagaaaaagcttatccctgcgcttgatgagcttattgcaacttttgaaaaaaaagtaaaagaatttgatggtattatcaagataggacgcacgcatttacaagatgctactccacttactctagcgcaagaatttagtggatatctttctatgcttttacattcaaaagagcaaatcatcgcttctttaccaactttaagagaacttgccataggaggaaccgcagtgggaacagggcttaatgcacatccagaattaagccaaaaagtaagtgaagagctaactcaacttataggtacaaaatttatttcaagtccaaataaatttcatgctttaacaagtcatgatgcgattaattttactcatggagctatgaaaggtttggctgcaaatttaatgaaaattgcaaatgatataagatggttagcttcaggcccaagatgcggtcttggtgagcttatcatccctgaaaatgagccaggaagttcgattatgccaggtaaggtaaatcctacccagtgtgaagctgttactatggttgctgtacaagtgatgggaaatgatgtagctatcggatttgcagcaagtcaaggaaattttgaacttaatgtgtttaagcctgtgattatttataatttcttgcaaagtcttgatttgttggctgattctatgcattcattcaatatccattgtgctgtaggcatagaaccaaatcgtgcaaaaatcgatcataatcttcataattctttaatgctagttaccgctctaaatccacacataggttatgaaaacgctgctaaagtagccaaaaatgcccataaaaaaggtatttctttaaaagaaagcacaatggagcttggtttggttagcgaagaagatttcaataaatttgttgatcctactaaaatgataggcccaaaagcctag

SEQ ID NO: 29075 - protein, 463 aa, Campylobacter jejuni
MEYRVEHDTMGEVKVPNDKYWGAQTERSFENFKIGCEKMPKVLIYAFANLKKSLALVNNKLGKLDDAKKNAIVQACDEIIAGKFDDNFPLAIWQTGSGTQSNMNMNEVIANRATEIMGGDFRKEKLVHPNDHVNMSQSSNDTFPTAMSIVAVEQVEKKLIPALDELIATFEKKVKEFDGIIKIGRTHLQDATPLTLAQEFSGYLSMLLHSKEQIIASLPTLRELAIGGTAVGTGLNAHPELSQKVSEELTQLIGTKFISSPNKFHALTSHDAINFTHGAMKGLAANLMKIANDIRWLASGPRCGLGELIIPENEPGSSIMPGKVNPTQCEAVTMVAVQVMGNDVAIGFAASQGNFELNVFKPVIIYNFLQSLDLLADSMHSFNIHCAVGIEPNRAKIDHNLHNSLMLVTALNPHIGYENAAKVAKNAHKKGISLKESTMELGLVSEEDFNKFVDPTKMIGPKA

SEQ ID NO: 29076 - DNA, 1398 bp, Yersinia pestis
  CDS (1)..(1398)
atggcaactacccgcagtgaaaaggattctatggggtctatcgatgtacctgcaaaccaattatggggggcgcaaactcaacgttcattggcgcattttcgaatttcacaagaaaaaatgccaacagagctaattcatgcattggctctgaccaaacgagcggcagctcaagtgaatatggacctaggcttgctgccagccgagcgtgcaaaagcgattatgcgggccgcagatgaagttctggatggcgctcatccaaccgagttccctctcgccatctggcaaaccgggtcgggtactcagacgaatatgaatatgaatgaggtactggcaaaccgtgcgagtgagttgctcgggggggcgcgggggaataaccgtttggttcatcccaatgatgatgtcaataaaagccaaagttcaaatgatgtcttcccaacggcgatgcatgtcgctgcagtgatgggggtgagtgaacatcttcttcctgaactgaaggtgttacagaaaaccttggccgacaaagcagaagcttatcgcgatattgtaaaaattggccgtacacatttacaagatgcgacccctttaacgttggggcaggaaatttccgggtgggcggcaatgttatctcacagtgtgcggcatattgaggcgacccttcctcacctgtgtgaattagcgcttgggggaacagcggtggggactggcctcaatacgcatcctgaatatgctgtacgagtagctaatgaaatagccacactgacacgccaaccgtttatcactgccccgaataaatttgaatcattgggaacctgcgatgcattggttcatggtcacggtgcgctaaaaggcttagcggcatccctgatgaaaattgccaatgatgtccgttggttatcatcaggccctcgctgtggtattggcgaaatatctattccggaaaatgagccaggcagttctatcatgccaggcaaagtgaatccaacacagtgtgaagcgatgaccatgctatgtgctcaagttatgggtaatgatgtggctatcaatatcggtggggcgtccggcaactttgaattaaacgtgttccgtccattggtcatccataacttcctgcaatctgttcgtttgttggctgatggaatgcgtggttttaatgagcactgcgctttgggaattgaacccaaccgcgaccgtattacgcaattgctcaatgaatcgctgatgttagttaccgcgctcaatacccatattggctacgataaagcagctgaaatcgccaaaaaggcgcataaagaggggctaacactgaaagcagcagctatggcattgggttatcttaccgatgcagagtttgatgaatgggttcgaccggaagatatggtcggcagtatgaagaaatag

SEQ ID NO: 29077 - protein, 465 aa, Yersinia pestis
MATTRSEKDSMGSIDVPANQLWGAQTQRSLAHFRISQEKMPTELIHALALTKRAAAQVNMDLGLLPAERAKAIMRAADEVLDGAHPTEFPLAIWQTGSGTQTNMNMNEVLANRASELLGGARGNNRLVHPNDDVNKSQSSNDVFPTAMHVAAVMGVSEHLLPELKVLQKTLADKAEAYRDIVKIGRTHLQDATPLTLGQEISGWAAMLSHSVRHIEATLPHLCELALGGTAVGTGLNTHPEYAVRVANEIATLTRQPFITAPNKFESLGTCDALVHGHGALKGLAASLMKIANDVRWLSSGPRCGIGEISIPENEPGSSIMPGKVNPTQCEAMTMLCAQVMGNDVAINIGGASGNFELNVFRPLVIHNFLQSVRLLADGMRGFNEHCALGIEPNRDRITQLLNESLMLVTALNTHIGYDKAAEIAKKAHKEGLTLKAAAMALGYLTDAEFDEWVRPEDMVGSMKK

SEQ ID NO: 29078 - DNA, 1368 bp, Listeria monocytogenes
  CDS (1)..(1368)
atggaacgaatagagcgagatacgcttggagaaatttctgtagatgcgacgaaatattggggagcgcaaacagaacgaagtaaaaggaattttgctattggtgataatcctatgccgatagaaattatatatgcttttgctcagttaaagaaagccactgcaaaagtgaacgcagcagaaggaaaactagccgaagaaaaagcgatagcgattggccaggtttgtgatcaaatcattcaaggagaactagatgagcattttcctttagtcgtttggcaaacaggaagcggaacgcagagcaacatgaatgtcaatgaagttatcgcacacgttgccaacttaactttaggcgaaggacaaattcatccaaatgatgatgttaacatgtcacaaagctcgaacgacacatttccaacagcgatgcacattgccgcatacggggctttagtaacaaaacttttaccagaaataactaaaatggaagctgttttgacagagaagaaaaataaatatatgcatctcgttaaaattggtagaacgcatttacaagatgcaactcctttaacacttggtcaagaaattagtggctgggaagcatgtcttacaaataataaaaactatcttgaaacaagtatgaaagcaattttgccacttgcaattggcgggactgcagttggaacgggcttaaatgcctcacgtgattttggtgataaggttgccgaagaattgatgaaacaaacgggatatccttttacttctgattccaataagtattttgctttaactagtcatagtccgattaattttgttcatggcgccattcgtagccttgcttcggatctaatgaaaattgctaatgatatccgtttattagcaagtggaccacgtagcggcataggtgagctagagataccagctaatgaaccaggaagctctattatgcccgggaaagtaaaccctacccaatgtgaagcaattacgatggtagcggctcaagtcatgggaaatgatgtgacaattaatgttgccgcaagccaagggaactttgagttaaatgtctacaagccggttatcatttttaatttcctagaatctatcaaacttcttgcagatagcatgcgttcgttccgagtgcattgtttggaaggacttactgcgaatgaaaaagttattgaaacaaaagtaaatgactccctaatgcttgttacagcattgaatccgcatatcggctatgaaaaagctgctaaaattgccaaactggcttttgatgaaaatacgacattaaaagaagcggcaatcaaaaccggctttgtgacagaaaaagaatttgatttgtggataaatccattgaaaatgactaatttgtaa

SEQ ID NO: 29079 - protein, 455 aa, Listeria monocytogenes
MERIERDTLGEISVDATKYWGAQTERSKRNFAIGDNPMPIEIIYAFAQLKKATAKVNAAEGKLAEEKAIAIGQVCDQIIQGELDEHFPLVVWQTGSGTQSNMNVNEVIAHVANLTLGEGQIHPNDDVNMSQSSNDTFPTAMHIAAYGALVTKLLPEITKMEAVLTEKKNKYMHLVKIGRTHLQDATPLTLGQEISGWEACLTNNKNYLETSMKAILPLAIGGTAVGTGLNASRDFGDKVAEELMKQTGYPFTSDSNKYFALTSHSPINFVHGAIRSLASDLMKIANDIRLLASGPRSGIGELEIPANEPGSSIMPGKVNPTQCEAITMVAAQVMGNDVTINVAASQGNFELNVYKPVIIFNFLESIKLLADSMRSFRVHCLEGLTANEKVIETKVNDSLMLVTALNPHIGYEKAAKIAKLAFDENTTLKEAAIKTGFVTEKEFDLWINPLKMTNL

SEQ ID NO: 29080 - DNA, 1395 bp, Deinococcus radiodurans
  CDS (1)..(1395)
atgaccaaaacccgccaagaaaccgacacgatgggcaagatggacgtggacgccagccgctactggggcgcacagaccgagcgcagcatccacaacttcccgattgggcgcgacaccttcgtgtggggccgccccgtcatccgggcgctgggcatcctgaaaaagggcgcggcgcaggccaacgccgaactcggtgaactgcccgccgacgtggccgacctcatcgtgaaggccgccgacgaagtgattgccggcaaactcgacgaacactttccgctggtagtgttccagaccggctcgggcacccagagcaacatgaacgccaacgaggtgatttccaaccgcgccatcgaactcgccggcggcgaaatgggcagcaagaagccggtccaccccaacgaccacgtgaaccgcggccagagctccaacgacaccttccccactgccatgcacatcgcggtggtgctggaactcaacgagcggctgtacggcgcggtcggcaagctgcgcgacaccctgcacgccaaggccgagcagtacaaggacctcgtgaaagtgggccgcacccacctgcaagacgccacgcccatcacgctggggcaggaaatcggcggctgggtggcgcaactcgactacgcgctgtccgaagtcaagcacgcgggcgaaggcctgctcgacctcgccatcggcggcaccgccgtgggcaccggcctgaacgcgcaccccaaattcggtgatctggccgccaagaagtacgaagaagaaaccggctaccacttccgcagcgccgagaacaagttcgccgccctgagcgcccacgacgcgctggtgcagacctcggcggccctgcgtaccctggccggcgccctgatgaagatggcgaacgacgtgcgctggctggcgagcggcccgcgcaacggcatcggcgaaatcaccattcccgagaacgagcccggctccagcatcatgcccggcaaggtgaaccccacccagagtgaggccatgacgatggtcgccacccgcgtgttcggcaacgacgccaccgtcgcttttgccggcagccagggcaacttccagctgaacgtgttcaagccagtgatggttcacgccgtgctggaaagcattcgcctgatttccgacgcctgcctggccttcaacgaccactgcgcggtgggcatccagcccaacgaggccaagatcaaggaaaacctcgacaagaacctgatgcaggtgaccgccctcaatcgccacatcggctacgacaaggctgccgcgattgccaagaaggcccacaaggaaggcaccagcctcaaggacgccgcgctggccctgggctacgtgaccgaggacgaattcgcccagtgggtcgtgccgctgggcatgactcacaactga

SEQ ID NO: 29081 - protein, 464 aa, Deinococcus radiodurans
MTKTRQETDTMGKMDVDASRYWGAQTERSIHNFPIGRDTFVWGRPVIRALGILKKGAAQANAELGELPADVADLIVKAADEVIAGKLDEHFPLVVFQTGSGTQSNMNANEVISNRAIELAGGEMGSKKPVHPNDHVNRGQSSNDTFPTAMHIAVVLELNERLYGAVGKLRDTLHAKAEQYKDLVKVGRTHLQDATPITLGQEIGGWVAQLDYALSEVKHAGEGLLDLAIGGTAVGTGLNAHPKFGDLAAKKYEEETGYHFRSAENKFAALSAHDALVQTSAALRTLAGALMKMANDVRWLASGPRNGIGEITIPENEPGSSIMPGKVNPTQSEAMTMVATRVFGNDATVAFAGSQGNFQLNVFKPVMVHAVLESIRLISDACLAFNDHCAVGIQPNEAKIKENLDKNLMQVTALNRHIGYDKAAAIAKKAHKEGTSLKDAALALGYVTEDEFAQWVVPLGMTHN

SEQ ID NO: 29082 - DNA, 1389 bp, Neisseria meningitidis
  CDS (1)..(1389)
atgagcacccgtaccgaacacgacacgatgggcaatgtcgaagtcccatccgaagcctattggggcgcgcagacccagcgcagccgcaacaatttcaaaatcggtggcgaaaccctgccgcagccgttgatttatgctttggcattggtgaaaaaagccgccgctgccaccaatgtttccctcggtaggattaagcctgaacaggcggatttgattacgcaggcggcggatgatgtgttgagcggcaagctcgacgggcagttcccattggtagtgtggcagaccggttccggcacgcagtccaatatgaacatgaacgaagtgctggcaaaccgcgccaacgaaatcgccggtacgggtttggcggcttatcagcccgtccatcccaacgaccatgtgaaccacgcgcaatcgaccaacgacgcattcccgaccgctatccacgttgccgccgcgattgaaatcaaccgccacctcatccccgccgtaaaagccctgcgcgacacgttggacaaaaaagcccaagctttcgcccctatcgtcaaaatcggccgcacccacttgcaagacgcgacgccgctgactttgggacaggaattttccggctacgtttcccagcttgatcacggtttaggccgtctgaacgatgcgcttaaagacttgtatgaacttgctttgggcggtacggcggtcggcacgggtttgaacagccatcccgaatacgccgaaaaagccgccgccaaactcgccgaattgtccggcttgccgtttgtcagcgcgccgaacaaatttgaagccctgggcggacgcgatgccgccgttgccgcttcgggcgcattgaaaacgctggcggcaagcctgaacaaaattgccaacgacatccgttggctggcaagcggcccgcgttgcggtttgggcgaaatcaaaatccccgaaaacgagccgggttcgtccattatgccgggcaaagtcaacccgacccaatgcgaagcaatgacgatggtgtgctgccaagtgttcggcaacgacgttaccatcggtatggcgggcgcgtcgggcaatttcgagctgaacgtctatatgcccgttatcgcctacaacctcttgcaatccatccacctgttgggcgacgcgtgcaacagcttcaacgaacactgcgccatcggcatcgaacccgtgccggaaaaaatcgactatttcctgcaccattccctgatgctggttaccgcattaaaccgtaaaatcggttacgaaaacgccgccaaagtcgccaaaaccgcctacaaaaacaacaaatcgttgcgcgaaaccgccgttgagttgggcttgctgacgggcgaagaatttgacgaactggtcgttcctgccgatatggttcatccgcgctaa

SEQ ID NO: 29083 - protein, 462 aa, Neisseria meningitidis
MSTRTEHDTMGNVEVPSEAYWGAQTQRSRNNFKIGGETLPQPLIYALALVKKAAAATNVSLGRIKPEQADLITQAADDVLSGKLDGQFPLVVWQTGSGTQSNMNMNEVLANRANEIAGTGLAAYQPVHPNDHVNHAQSTNDAFPTAIHVAAAIEINRHLIPAVKALRDTLDKKAQAFAPIVKIGRTHLQDATPLTLGQEFSGYVSQLDHGLGRLNDALKDLYELALGGTAVGTGLNSHPEYAEKAAAKLAELSGLPFVSAPNKFEALGGRDAAVAASGALKTLAASLNKIANDIRWLASGPRCGLGEIKIPENEPGSSIMPGKVNPTQCEAMTMVCCQVFGNDVTIGMAGASGNFELNVYMPVIAYNLLQSIHLLGDACNSFNEHCAIGIEPVPEKIDYFLHHSLMLVTALNRKIGYENAAKVAKTAYKNNKSLRETAVELGLLTGEEFDELVVPADMVHPR

SEQ ID NO: 29084 - DNA, 1506 bp, Caenorhabditis elegans
  CDS (1)..(1506)
atgtctgcagtctctatgttacagggagaaatgcttgctcgtggaggcgccgtcattgcccgcggagcgtctcttgccactgcccgcaatttttcgcgcaccactgttccaatggctaagattcgtaaggaacgagatactttcggagagctcgaggttccagccgacaaatactatggagcccagaccgcccgttcccagatgaacttcaagattggaggaccagaagagcgtatgccaatcccagttatccacgctttcggaatcttgaagaaggccgccgcccttgtcaacaccgagttcggattagacaaaaaactggctgacgcgatttcccaagctgctgatgaggttgttgacggcaagctcgacgagcacttcccacttgttacatggcagactggttcaggaactcagtccaacatgaatgtcaatgaggttatctcgaatcgtgctatcgagatcctcggaggagagctcggatcgaagaagccagttcatccaaatgatcatgtgaatatgtcccaatcatcaaatgacacattcccaactgctatgcacattgccgtcggacgtgaagtcaactctcgtcttcttccagctctcaagaagcttcgcactgcccttcacaacaaggctgaagagttcaaagatatcatcaagattggacgtactcacacccaagatgctgttccactcactcttggacaagagttctcagcttacgtcacacagcttgataactctattgctcgtgttgaatcgactcttccacgactttatcaattggctgccggtggaaccgctgttggaactggactcaacacgcgcaagggattcgctgagaaggttgccgccactgtttctgaacttaccggattgccattcgttaccgctccaaacaaatttgaagccctcgccgcccatgatgctctcgttgaggttcacggagccctgaacacagtcgcagtttccttcatgaagattggaaacgatatcagatttttgggatctggaccaagatgcggactcggagagttatcactcccagaaaacgaaccaggaagctccatcatgccaggaaaggtcaacccaactcaatgtgaagccatcacaatggttgccgctcaagttatgggaaatcaagttgcagtcagtgtaggaggatctaatggacatttcgagttgaatgttttcaagccacttatcgttcgtaatgttcttcaatcaacacgtcttcttgctgacagcgctgtgagcttcactgatcattgtgtcgacggaatcgttgctaacaaagacaatattgccaagattatgcgtgaatcacttatgcttgtcactgctctcaacccacacattggctacgacaacgccgccaagattgctaagactgctcacaagaacggcaccacccttgtccaggaagccgtgaagctgggaatccttaccgaggagcagttcgctcaatgggtcaagccagaaaacatgctcggacctaagtaa

SEQ ID NO: 29085 - protein, 501 aa, Caenorhabditis elegans
MSAVSMLQGEMLARGGAVIARGASLATARNFSRTTVPMAKIRKERDTFGELEVPADKYYGAQTARSQMNFKIGGPEERMPIPVIHAFGILKKAAALVNTEFGLDKKLADAISQAADEVVDGKLDEHFPLVTWQTGSGTQSNMNVNEVISNRAIEILGGELGSKKPVHPNDHVNMSQSSNDTFPTAMHIAVGREVNSRLLPALKKLRTALHNKAEEFKDIIKIGRTHTQDAVPLTLGQEFSAYVTQLDNSIARVESTLPRLYQLAAGGTAVGTGLNTRKGFAEKVAATVSELTGLPFVTAPNKFEALAAHDALVEVHGALNTVAVSFMKIGNDIRFLGSGPRCGLGELSLPENEPGSSIMPGKVNPTQCEAITMVAAQVMGNQVAVSVGGSNGHFELNVFKPLIVRNVLQSTRLLADSAVSFTDHCVDGIVANKDNIAKIMRESLMLVTALNPHIGYDNAAKIAKTAHKNGTTLVQEAVKLGILTEEQFAQWVKPENMLGPK

SEQ ID NO: 29086 - DNA, 1413 bp, Halobacterium sp. NRC-1
  CDS (1)..(1413)
atgagcgaggattaccgcacggagcaggacagcctcggcgagatgcaggttcccgctgacgcctactggggggcacagacccagcgcgcgatcgagaacttcccgatctcggggatcgcgttcgggcggcggttcgtgcgcgcgctcggcgtcgtcaagaaggccgccgcgcaggcgaaccgcgacctcggcctcgttgacgacgagcgcgccgacgccatcgtcgcggccgccgacgaggtcatcgccggcgagcacgacgaccagttcccggtcgacgtcttccagaccgggtccgggacgtcctcgaacatgaacgccaacgaggtcatcgcgaaccgcgccgcggagctcctcggcgaggagatcggggatcgcgtcgtgcaccccaacgaccacgtgaactatggccagtccagcaacgacgtgatcccgaccgcgatgcacgtggcgagcctcgacgcgctcgtcaacgacgtcaaacccggcctggagacgctggcagcggaactcgacgacaaagcggacgcgttcgacggcgtcgtgaagaccgggcgcacgcacttgcaggacgccacgccggtgcggttgggccaggagttcggcggctaccgcacccaagtcgagaagggcatcgaccgcatcgaggccgttgccccgcgcctctcggagctcgcgctcggcggcaccgccgtcggcaccgggctgaacacccaccccgagttcccggagacggcggccggctacatcagcgaggagaccggcgttacgttccgtgaggcggacaaccacttcgaggcgcaggccgcccacgacgccatgaacgaggcccacggcgcgctgcgcacggtcgcggggtcgctgaacaagatcgccaacgacctccggctgcttgcctccggcccccgcaacgggctgggggagatcgagcagcccgagaaccagcccggctcctcgatcatgcccgggaagatcaaccccgtggtggcggaggcggtcaaccaggtccacaagcaggtcgtgggcaacgacgccgccatcgccgcgggggccgcggaggggcagatcgacttgaacctctacaagcccgtgctggcgcacaacttcctgcagtccgcggacatgctcgccaacgcgagcgctgccttcggcgagaagttcgtcgccaagctcgaagccaacgaggccgcctgcgaggcgcaggtcgagcgctcgatggcgctggcgaccgcgctcaaccccacgatcggctacgacaaggccagcgaggtcgcgaaggccgcgctgaaggaggggaaaacagtcacggaggtcgtcgtcgagaagggatacctctcggaggcggaggccgctgacgtgctcgaccccgaggggatgacccaccggggcatcctctccggcgacgacacgtag

SEQ ID NO: 29087 - protein, 470 aa, Halobacterium sp. NRC-1
MSEDYRTEQDSLGEMQVPADAYWGAQTQRAIENFPISGIAFGRRFVRALGVVKKAAAQANRDLGLVDDERADAIVAAADEVIAGEHDDQFPVDVFQTGSGTSSNMNANEVIANRAAELLGEEIGDRVVHPNDHVNYGQSSNDVIPTAMHVASLDALVNDVKPGLETLAAELDDKADAFDGVVKTGRTHLQDATPVRLGQEFGGYRTQVEKGIDRIEAVAPRLSELALGGTAVGTGLNTHPEFPETAAGYISEETGVTFREADNHFEAQAAHDAMNEAHGALRTVAGSLNKIANDLRLLASGPRNGLGEIEQPENQPGSSIMPGKINPVVAEAVNQVHKQVVGNDAAIAAGAAEGQIDLNLYKPVLAHNFLQSADMLANASAAFGEKFVAKLEANEAACEAQVERSMALATALNPTIGYDKASEVAKAALKEGKTVTEVVVEKGYLSEAEAADVLDPEGMTHRGILSGDDT

SEQ ID NO: 29088 - DNA, 1392 bp, Caulobacter crescentus
  CDS (1)..(1392)
atgaccgccacgcgtatcgagaccgacacctttggcccgatcgaagtcgccgccgaccgctactggggcgcgcaagctcagcgcagcctgggcaacttcaagatcggctgggaaaagcagcccctgcccgtcgtccgcgccctgggcatcgtcaagcgcgccgccgccgaggccaacctcgccttgggcaagctggacccgaagatcgccgagacgatcatcgccgccgccaacgaagtgatcgagggcaagctgaacgaccacttcccgctggtggtctggcagaccggctcgggcacccagtcgaacatgaacgccaacgaggtgatctcgaaccgcgccatcgagatgctgggcggtgagatgggcagcaagaagcccgtccaccccaacgaccacgtcaatatgagccagtcgtcgaacgacaccttcccgacggccatgcacatcgcctgcgccgaacaggtggtccacgacctgctgcccgcgctgaagcacctgcacaaggccctggccgccaaggccgccgagtggaaggacatcatcaagatcggccgcacccacacccaggacgccaccccgctgacgctgggccaggagttcggcggctacgctcagcagatcgagaacggcatcgctcgtatcgagatgaccctgccgatgctgatgcaactggcccagggcggcaccgccgtcggcaccggcctgaacgcccccgtgggcttcgccgagctggtcgccgagcagatcgccggcatcacgggcctaggcttcaccacggccccgaacaagttcgaggccctggccgcccacgacgccatggtcttcacccacggcgccatcaacacggtggccgccagcctgttcaagatcgccaacgacatccgcttcctgggctctggcccgcgcgccggtctcggcgagctttccctgccggaaaatgagccgggcagctcgatcatgccgggcaaggtcaatccgacccagtccgaagccctgacccaggtctgcgcccaggtgttcggcaaccactcgaccctgaccttcgccggcagccagggccatttcgagctgaacgtcttcaacccggtgatggcctataacttcctgcagtcggtccgtctggtcgccgacgcggcgatcagcttcaccgacaactgcgtggtcggcatcgagccgcgtgtcgacaacatcaagaagggcgtcgagaacagcctgatgctggtcacggccctgaacggcaagctcggctacgacgcctgcgccaagatcgccaagaccgcgcacaagaacggcaccaccctgcgcgaggaggccgtcggcggcggctatctgacgaacgaagagttcgaacagtacgtccgccccgaaaagatgatctcgccgggctga

SEQ ID NO: 29089 - protein, 463 aa, Caulobacter crescentus
MTATRIETDTFGPIEVAADRYWGAQAQRSLGNFKIGWEKQPLPVVRALGIVKRAAAEANLALGKLDPKIAETIIAAANEVIEGKLNDHFPLVVWQTGSGTQSNMNANEVISNRAIEMLGGEMGSKKPVHPNDHVNMSQSSNDTFPTAMHIACAEQVVHDLLPALKHLHKALAAKAAEWKDIIKIGRTHTQDATPLTLGQEFGGYAQQIENGIARIEMTLPMLMQLAQGGTAVGTGLNAPVGFAELVAEQIAGITGLGFTTAPNKFEALAAHDAMVFTHGAINTVAASLFKIANDIRFLGSGPRAGLGELSLPENEPGSSIMPGKVNPTQSEALTQVCAQVFGNHSTLTFAGSQGHFELNVFNPVMAYNFLQSVRLVADAAISFTDNCVVGIEPRVDNIKKGVENSLMLVTALNGKLGYDACAKIAKTAHKNGTTLREEAVGGGYLTNEEFEQYVRPEKMISPG

SEQ ID NO: 29090 - DNA, 1392 bp, Rickettsia conorii
  CDS (1)..(1392)
atgaaaaattacagaaccgaaagtgattcttttggagaaattcaaatagaagaaaaattttattggggggctcaaactcaaagatctttagaaaattttaaaataggcaagcaaaaaatgcctgaaattttaattcgtgctcttgctattttaaaaaaatgtgcagcacaggttaatcatgagtttggtgatttagaagctaaaatcgctataagtatagataaagcaacggatagaatcttagaaggcgaatttgaggataattttcctttagtagtttggcaaacaggttcaggaacgcaaacaaacatgaatatgaacgaggttattgcctctattgccaacgaagaattaacaggcaagaaaggcggcaaatctccggtacatcctaacgatcatgttaataaaggacaatcatccaacgactcttttccaaccgctatgcatatagcaaccgtacttgcaactaaacagcaactgataccagctttgaataatatactgacctctttgcaggataagtcaaaagattgggacaaaatcataaaaataggacgtacccacttgcaggatgcaactcctttaactcttaaacaggaattctccggatatattacacaaatagagtatgctttagaacgcatagaaaatgcactacaaaaagtttatctacttgcccaaggaggcacagcagtcggtacaggtattaactcaaaaataggctttgatataaaatttgccgagaaagtggcagagtttactaaacaaccctttaagacggctcctaataaatttgaaagtctagctgctcacgacgcactagtagaattttcaggaactcttaatactatagcagttagcttaatgaaaatagcaaatgatataagactgctcggctccggtccaagatgcggtcttggtgagctacatttacctgaaaatgaacctggttcttctattatgcccggtaaagtaaaccctacacaagtcgaagctttaacaatggtgtgcagtcaggtgatggggaatcatgttacggttactattgccggctcaaacggacatcttgaacttaacgtatttaaacccgtaataatatacaatatcctacaatctatagagctgttatccgatagcgtaaatagctttgttactcactgtgttaaaggattagaacccaatatagcacgcattaatgatttacgtgataaatctctaatgcttgttacagctcttaatccacatataggctatgataatgctgcaaaaattgctaaagaagcacataagcacggaatcactttaaaagaagcagctaaaaaactcaatcttctatcggaagcaaaatttgataaaatagtagtacctgaaaaaatggttagtcaatcttag

SEQ ID NO: 29091 - protein, 463 aa, Rickettsia conorii
MKNYRTESDSFGEIQIEEKFYWGAQTQRSLENFKIGKQKMPEILIRALAILKKCAAQVNHEFGDLEAKIAISIDKATDRILEGEFEDNFPLVVWQTGSGTQTNMNMNEVIASIANEELTGKKGGKSPVHPNDHVNKGQSSNDSFPTAMHIATVLATKQQLIPALNNILTSLQDKSKDWDKIIKIGRTHLQDATPLTLKQEFSGYITQIEYALERIENALQKVYLLAQGGTAVGTGINSKIGFDIKFAEKVAEFTKQPFKTAPNKFESLAAHDALVEFSGTLNTIAVSLMKIANDIRLLGSGPRCGLGELHLPENEPGSSIMPGKVNPTQVEALTMVCSQVMGNHVTVTIAGSNGHLELNVFKPVIIYNILQSIELLSDSVNSFVTHCVKGLEPNIARINDLRDKSLMLVTALNPHIGYDNAAKIAKEAHKHGITLKEAAKKLNLLSEAKFDKIVVPEKMVSQS

SEQ ID NO: 29092 - DNA, 1422 bp, Xylella fastidiosa
  CDS (1)..(1422)
atggagatgcagatgagcaacagtgatcgttacagaattgaacacgacagtatgggtgatctacgggtgccgatcgatgcgttgtggggtgcgcagacgcaacgtgctatcgagaactttccgatttccgggcggtcaatgcctcagggatttatccacgcattggggtttatcaaggcggctgcggcgaaggttaacgctgagctggggttgttaccaaagccaatggccaaggagattgaggccgctgcattggatgtcgctgcgggccgttatgatgcggattttccagtcgatatttaccagactggctcaggaacctcgtcgaatatgaacgctaatgaggtgattgcgacgctggccatgcgtgccaccaaggagcctatccaccccaacgaccatgtcaaccttggccaaagttctaatgatgtggttccaacagcgattcggatttccgcaacgttggcggttcagggacgattattaccggcgctcaagcatttacggaaaatgattaacaagcgtgcccgtggtttgggcagtgtggtgaagaccggccgtacccacctgatggatgcgatgccgctgacgttcgctcaagaattcggtgcctggtcggcacaaattgtctctgcggaggcgcgcttgaatgacaccctgaaacggttgcatcggctgccattgggagggacagcaattggtaccggtatcaatacggatccacatttcggccgcaatgcggtgaaggtactgtcagcattaacagggattcactttgagagtgcgaacaataagttcgagggattggcagcgcaagatgatttggttgagttatccggccagttcaatgcgttagcagtggcgttgatgaagattgctaatgatctacgctggatgaacgctggaccacttgctggcttgggagagattgagttgcccgcgttgcagccgggaagttcgatcatgccaggtaaggtaaatccggtgattccggaagctgtggtgatggtcgcctcgcaagtgattggccatcacactgcagtgaccgtggctgggcagagtggcaattttcagttgaatgtgacgttaccgctgattgcttacaacctattggagtctgcgacgttgcttggaaatgtggtgatgctgttggctgataaagtcatcgttggtctgaaggtgcgtcaggatcgagtgcaggaggtgctggagcggaatccgattttggtgacagcgttgaatccgatcattggctatgagaaagctgcggtgattgctaagcgtgcttataaggagcaccggccagtgcttgaggtcgcctgcgaggagagcaacctaaaccctgtggagttggcgcgcttactggatccgactgcgttgactgagggtgggatttatgtcgtcgggggaggtggtggataa

SEQ ID NO: 29093 - protein, 473 aa, Xylella fastidiosa
MEMQMSNSDRYRIEHDSMGDLRVPIDALWGAQTQRAIENFPISGRSMPQGFIHALGFIKAAAAKVNAELGLLPKPMAKEIEAAALDVAAGRYDADFPVDIYQTGSGTSSNMNANEVIATLAMRATKEPIHPNDHVNLGQSSNDVVPTAIRISATLAVQGRLLPALKHLRKMINKRARGLGSVVKTGRTHLMDAMPLTFAQEFGAWSAQIVSAEARLNDTLKRLHRLPLGGTAIGTGINTDPHFGRNAVKVLSALTGIHFESANNKFEGLAAQDDLVELSGQFNALAVALMKIANDLRWMNAGPLAGLGEIELPALQPGSSIMPGKVNPVIPEAVVMVASQVIGHHTAVTVAGQSGNFQLNVTLPLIAYNLLESATLLGNVVMLLADKVIVGLKVRQDRVQEVLERNPILVTALNPIIGYEKAAVIAKRAYKEHRPVLEVACEESNLNPVELARLLDPTALTEGGIYVVGGGGG

SEQ ID NO: 29094 - DNA, 1389 bp, Bacillus halodurans
  CDS (1)..(1389)
atgaacacacgaattgagcgagatacgctaggagaaatgcacgttccacaagacaaattatggggggcacaaacgcagcgaagctatgagaatttccatattgggacagaaaaaatgccgatggaaattatttatgcctttgccttgctaaaaaaagcagcagcaaacgtcaacaaaaagcttggacaactgtctgccgaaaaagcagatgccattacctgggctgcaaatgaagtgctagctggcaaacacgatgatcatttcccgcttttcgtttggcaaaccggtagcggcacgcagtcgaacatgaacatgaatgaagtccttgcccgcaggggaaaccagcttctgcaagaaaaagggctagatgttacaattcacccgaacgatgacgtgaaccgatcgcaaagctccaacgacacatttcctaccgccatgcatattgcggcttataataaactggacgatcacttactgcctacactccaaatgttcaaacaaacactccaccaaaaagcaaagcaatttgatgatgtgattaaattaggacgaacacacttacaggatgcgacccccttaaccctcggccaagaaattagtggctgggctcggatgctcgaaaagaccgagcaaatgatccgtgagagcatgatttatttgcaggaattagctatcggtggtacggctgtcggtacaggggttaacgcccatcccaagttcggagaaatggtggccgccgatatcgcaaatgaaaccgggaaacctttcaaatcagccgctaataaatttcacgcgctcacaagtcatgacgaactagtacacactcacggcgccctaaaagcgcttgctgccgatttgtttaaaattgcgaatgatattcgttggcttgcaagtgggcctaggggcggactaggagaactgatcattcctgctaatgagccgggaagctcaattatgccaggaaaggtcaatccaacacagagcgaggcattaacaatgatcacgtcgcaagtaatcggaaatgatgccacgatcgcttttgctgcaagtcaagggaactttgaactgaacgtatttaagccggtcattatttacaatttccttcagtccacaacgctgttaactgatggactccggacgttccatgacaaatgcttaatcggccttgaggcaaacgaaacgatcattaaaaagcatttaaatgagtcactcatgctcgtgacagcactcaaccctcacatcggttatgagaacgcagcaaaaattgcgaaaaaagcacatgccgaaggcttaactcttaaagaagccgcgatgcaaagcggcttgctaaccgaagaggagtttgaaaaaatggtcgatccggcaaaaatggttcacccacaaggctaa

SEQ ID NO: 29095 - protein, 462 aa, Bacillus halodurans
MNTRIERDTLGEMHVPQDKLWGAQTQRSYENFHIGTEKMPMEIIYAFALLKKAAANVNKKLGQLSAEKADAITWAANEVLAGKHDDHFPLFVWQTGSGTQSNMNMNEVLARRGNQLLQEKGLDVTIHPNDDVNRSQSSNDTFPTAMHIAAYNKLDDHLLPTLQMFKQTLHQKAKQFDDVIKLGRTHLQDATPLTLGQEISGWARMLEKTEQMIRESMIYLQELAIGGTAVGTGVNAHPKFGEMVAADIANETGKPFKSAANKFHALTSHDELVHTHGALKALAADLFKIANDIRWLASGPRGGLGELIIPANEPGSSIMPGKVNPTQSEALTMITSQVIGNDATIAFAASQGNFELNVFKPVIIYNFLQSTTLLTDGLRTFHDKCLIGLEANETIIKKHLNESLMLVTALNPHIGYENAAKIAKKAHAEGLTLKEAAMQSGLLTEEEFEKMVDPAKMVHPQG

SEQ ID NO: 29096 - DNA, 1386 bp, Vibrio cholerae
  CDS (1)..(1386)
atgactcgcgaataccgaattgaaaaagacagcatgggtgaggtcaaagtccctgctgatgcgctttatcaagcacaaactcaacgtgccgtagataactttacgttaagccgctacaccatgcctagcgcgtttattgctgccctcgcctacattaaacaagcggcggcgatgaccaatgcgcagttaggtcatttagaaggggacatcgcccaagcgattgccaatgcatcgcaagcggtgattgatggccagtatgcaaaacagttcccgattgatgttttccagacaggttcaggcaccagctccaatatgaacgccaatgaggtgattgccaccctcgcctcgcgtgaattgggctatgcggtgagtccaaacgatcatgtcaacatgggacaaagcagtaatgatgtgatcccaacagcaatccaagtcagtgcggccatcaatattgagcagcaactgctccccgccttggcgcatttaagtcaaactctcgcggataaacagtcagagctggctgatgtggtcaaaactggccgcacccatttgatggatgcgatgcccgtgactttcgcacaagaactgggtggatggaaaagccaaatcgaccacgccgcgcaaggcatcagccatgcgctttcccccatcaaagccttggcgcaaggcggcacagcggtcggcacaggcattaatgcggatccgcgttttgcacgtatttttgccgataacctcagtcaattgagtcatgttgcttttcagcccagcgacaattttttctataacctaagcagccaagactgcgtggtcggcctttctggtcagttgaaaaccgccgcggtcgcgctgatgaaaatcgctaacgatttgcgctggatgaactctggccctttggcggggttaggggaaattgagctgcaaggcttacaaccgggctcctcgatcatgccgggaaaagttaaccctgtgatcccggaagccgtgactatggtcgctgcgcaagtgattggcaatgacactaccattaccgtggctggccaatccggtaatttccagcttaatgtgatgctgcctgtgatcgcgcacaacctactggaatcaatagaattattgacaaatgcctgccatgcgctcgccgataaagccatcgcaacctttaaagttcgtcatgacaatctggaaaaagccttggctaaaaacccgattctcgtcaccgccttgaatcctgtcattggttatctcaaagcggctgatattgccaaaaaagcctaccagcaaggtcgcgcgattttggatgtcgctgcggaagagacggaccttgatcgcgccacgcttgaagcgctgcttgacccgaaaaagctcacacaaggtgggattgcccattaa

SEQ ID NO: 29097 - protein, 461 aa, Vibrio cholerae
MTREYRIEKDSMGEVKVPADALYQAQTQRAVDNFTLSRYTMPSAFIAALAYIKQAAAMTNAQLGHLEGDIAQAIANASQAVIDGQYAKQFPIDVFQTGSGTSSNMNANEVIATLASRELGYAVSPNDHVNMGQSSNDVIPTAIQVSAAINIEQQLLPALAHLSQTLADKQSELADVVKTGRTHLMDAMPVTFAQELGGWKSQIDHAAQGISHALSPIKALAQGGTAVGTGINADPRFARIFADNLSQLSHVAFQPSDNFFYNLSSQDCVVGLSGQLKTAAVALMKIANDLRWMNSGPLAGLGEIELQGLQPGSSIMPGKVNPVIPEAVTMVAAQVIGNDTTITVAGQSGNFQLNVMLPVIAHNLLESIELLTNACHALADKAIATFKVRHDNLEKALAKNPILVTALNPVIGYLKAADIAKKAYQQGRAILDVAAEETDLDRATLEALLDPKKLTQGGIAH

SEQ ID NO: 29098 - DNA, 1809 bp, Pseudomonas aeruginosa
  CDS (433)..(1809)
gaagaaaacaataatcaatctcattatcgtctggtgaggttgccatgtccttcgaggcgcacgacccgcaagcattggatcactggtactggctgggcacgcagatccgctgcgcgctcgatcccgacgaaccgcgcctgctcgaccagtacctcggcgaggcgcgctatctcgccggttgggaaggtgtggccgcctggccgctgttcgagaaagcctacaacctcctgctcgataccggtcgcgatccgatattgccctggcactggcgcagcctctgcctcgactacgcctaccggcccctctgcgaacttcagcgactgaccaccaacggcagccagcgacgccggctgcgccagctctccgtacgaatggccaggcaggacctggcgccgtcgatgagcttcgatcacccgcaacaaggaaaccaagatgactgacacccgcatcgaacgcgacagcatgggcgaactggcggtcccggcgaccgccctctatggcgcccagacccagcgcgcggtgaacaacttcccggtcagcggccaacgcatgccccaggccttcgtccgcgccctgctgctggccaaggccgcggcggcgcgggcgaacgtctccctgcagcaactggatgcaccgatgggcgaggcgatcgccgacacctgcctgcaactgctgcaggaggacttcatgcagcatttcccggtggatgtgttccagaccggctccggcaccagttccaacatgaacgccaacgaagtggtggcgaccctggccagtcgtcgcctgggcggcaaggtcaatccgaacgaccatgtgaactgcgggcagagcagcaacgacatcattccctcgaccatccacatcagtgccgccctcgagatcagcgaacgcctgctgccggcgctgcgccacctggagcagactatccagagcaaggccggcgaagtgcatgcctatgtgaagaccggccgcacccacctgatggatgcgatgccggtacgcatgagccaggtgctcggtggctgggcgcagcaggtgcgacaggccggcgtgcacatcgagagcgtacttcctgccttgcagcagttggcacagggcggcaccgcggtgggcaccgggatcaacgcccatcctcggttcgccgaacgtttcagccaggagctgaacgacctgaccgggctggcgttccgccccggcgacgacttcttcgccctgatcggttcgcaggacaccgcggtcgctgcgtccggccagttgaagaccctggcggtgaccctgatgaagctggccaacgacctgcgctggatgaactccgggccgcttgccgggctcggcgagatcgagctggaagcgctgcaaccaggctcctcgatcatgcccggcaaggtcaacccggtgatcccggaggccaccgcgatggtcgccgcccaggtgatcggcaatgacgctgccattgccgtcgccggccaatcgggcaacttcgaactgaacgtgatgctgccgctggtggcggacaacctgttgcacagcatccagttgctggccaacgtcagccggctgctggcggacaaggccatcgccagcttcaaggtcaaccagggcaagctcagcgaggcgttggcgcgcaacccgatcctggtcactgcgctgaacccgatcattggctaccagaaggctgcggaaatcgccaagcaggcctatcgcgagggacggccgatcatcgatgtggcgctggaaaacaccgatctggaccgtgcgcgcctggaggtgttgctggatccggaaaaactcacggctggcggcctctga

SEQ ID NO: 29099 - protein, 458 aa, Pseudomonas aeruginosa
MTDTRIERDSMGELAVPATALYGAQTQRAVNNFPVSGQRMPQAFVRALLLAKAAAARANVSLQQLDAPMGEAIADTCLQLLQEDFMQHFPVDVFQTGSGTSSNMNANEVVATLASRRLGGKVNPNDHVNCGQSSNDIIPSTIHISAALEISERLLPALRHLEQTIQSKAGEVHAYVKTGRTHLMDAMPVRMSQVLGGWAQQVRQAGVHIESVLPALQQLAQGGTAVGTGINAHPRFAERFSQELNDLTGLAFRPGDDFFALIGSQDTAVAASGQLKTLAVTLMKLANDLRWMNSGPLAGLGEIELEALQPGSSIMPGKVNPVIPEATAMVAAQVIGNDAAIAVAGQSGNFELNVMLPLVADNLLHSIQLLANVSRLLADKAIASFKVNQGKLSEALARNPILVTALNPIIGYQKAAEIAKQAYREGRPIIDVALENTDLDRARLEVLLDPEKLTAGGL

SEQ ID NO: 29100 - DNA, 1425 bp, Mycobacterium tuberculosis
  CDS (1)..(1425)
atggccgttgacgccgacagcgccaattaccgcatcgagcacgacaccatgggcgaagtccgggtgccggcaaaagcgttgtggcgcgcgcaaacccagcgcgcggtggagaacttcccgatatccggccgcgggttggagcgcacccagatccgcgcgctaggcctgctgaaaggcgcctgcgcgcaggtgaactccgacctcgggttgctggcgccggagaaagccgacgccatcatcgccgcggccgccgagatcgccgacggtcaacacgacgaccagtttcccatcgacgtcttccagaccggctcgggcaccagctccaacatgaacaccaacgaggtgattgcgtccatcgcggccaagggcggggtcacgttgcatcccaacgacgacgtgaacatgtcgcagtcgtccaacgacaccttcccgacggccacccacatcgcggccaccgaggccgcggtcgctcatctcatcccagcgctgcagcagctgcacgacgcattggccgccaaggctcttgattggcacacggtggtgaagtcgggccgaacgcatctgatggacgccgttccggtgacactcggccaggagttcagcggatatgcccgccagatcgaggccggcatcgagcgggtgcgcgcgtgtctgcccaggctgggcgagctggcgatcggcggcaccgcggtgggtaccggcctcaacgctcccgacgacttcggcgtcagagtggtcgcggtgctggtcgcgcagaccggtctgtcggaattgcgtacggcggctaattctttcgaagctcaggctgcccgcgacgggctggtggaggcgtccggggcgctgcgcacgatcgcggtatcgctgaccaagatcgccaacgacatccgctggatgggatcgggcccattgaccggcctggccgagatccaactgccagatctgcagccgggcagctcgatcatgccgggaaaggtgaatccggttctgccggaggcggttacgcaggtcgccgcgcaggtgatcggaaacgacgccgccatcgcctggggtggggccaacggcgcattcgaactcaacgtctacatcccgatgatggcccgcaacatcctcgagtccttcaagctgctgaccaatgtgtcacggctgttcgcccagcgctgcatagcagggctgaccgccaacgtcgagcacctgcggcggctggccgagtcctcaccgtcgatcgtgacaccgttgaattcggccatcggctacgaggaggcggccgccgtcgccaagcaagcactcaaggaacgcaaaacgattcgccaaaccgtgatcgaccgtggcctgatcggcgacaggctgtcgatcgaggatctggaccgccgtctggacgtgctggcaatggccaaggccgagcagctcgacagcgatcggctatga

SEQ ID NO: 29101 - protein, 474 aa, Mycobacterium tuberculosis
MAVDADSANYRIEHDTMGEVRVPAKALWRAQTQRAVENFPISGRGLERTQIRALGLLKGACAQVNSDLGLLAPEKADAIIAAAAEIADGQHDDQFPIDVFQTGSGTSSNMNTNEVIASIAAKGGVTLHPNDDVNMSQSSNDTFPTATHIAATEAAVAHLIPALQQLHDALAAKALDWHTVVKSGRTHLMDAVPVTLGQEFSGYARQIEAGIERVRACLPRLGELAIGGTAVGTGLNAPDDFGVRVVAVLVAQTGLSELRTAANSFEAQAARDGLVEASGALRTIAVSLTKIANDIRWMGSGPLTGLAEIQLPDLQPGSSIMPGKVNPVLPEAVTQVAAQVIGNDAAIAWGGANGAFELNVYIPMMARNILESFKLLTNVSRLFAQRCIAGLTANVEHLRRLAESSPSIVTPLNSAIGYEEAAAVAKQALKERKTIRQTVIDRGLIGDRLSIEDLDRRLDVLAMAKAEQLDSDRL

SEQ ID NO: 29102 - DNA, 1392 bp, Helicobacter pylori
  CDS (1)..(1392)
atgcaatttagaattgaacatgacacgatgggcgaaatcaaagtagatgacagccaatattggggggctcaaacgcaacgcagtcttgaaaactttaagatcggcactgaaaaaatgcctaaagaactcattggcgcgttcgccaaactcaaaaggagtttagcggttgtcaatcacaagttagggaaattaagcctggaaaaatcgcaagccattatcaaagcgtgcgattgcattttaaaaggcgagttgtgcggcgaattccccctagcgatatggcaaacagggagcgggactcaaacgaacatgaacctcaatgaagtcattgccaataaggctaccgaaattttagggggtaattttagggagaaaaaactcatccaccctaacgatgatgtgaacatgtctcaaagctccaacgacactttccctaccgcaatgcacgttgtgagcgtgctagaaatcacgcataaactgctgcctagtttagagaatctgttaaaaacctttaaagaaaaaagccaacaatttaaagagattgtcaaaatcgggcgcacgcatttacaagacgctacgcctttaactttggggcaagaatttagcgggtatgcgagcatgctagagcattctaaacaacaaattttagagagtttggagcatttaagggaattagccataggcgggactgccgtaggcacagggctaaacgctcataaggaattgagcgaaaaagtggctgaagaattgagccagtttagcggcgtgaaattcatctctgcacccaataaattccacgcgctcactagccatgacgctatcgcttatgcgcatggggcttttaaggctttagcggcgaatttaatgaaaatcgctaacgatattagatggcttgcgagcgggccgcgctgtggtttgggcgagcttaatatccctgaaaacgagccgggcagttctattatgcccggtaaagtcaatcccacgcaatgcgaagcgatgacaatggtagccgtgcaagtgatggggaatgataccgctattggcattgcggccagtcagggtaattttgaattgaatgtgttcaagccggtgattatttataacttcttgcaaagtttaaggctattgagcgacagcatggaaagtttcaatatccattgcgcgagcggtattgagcctaataaagaaaaaattgattattacttgcaccattctttaatgctagtaaccgcccttaatccgcatgtaggctatgaaaacgccgctaaaatcgctaaaaacgcccacaaaaaaggcatttctttaaaagaaagcgcgctggaactgaaactcttgagcgctgaagactttgaccaattcgtggtgcctgaaaagatgatcggacctaaggcttga

SEQ ID NO: 29103 - protein, 463 aa, Helicobacter pylori
MQFRIEHDTMGEIKVDDSQYWGAQTQRSLENFKIGTEKMPKELIGAFAKLKRSLAVVNHKLGKLSLEKSQAIIKACDCILKGELCGEFPLAIWQTGSGTQTNMNLNEVIANKATEILGGNFREKKLIHPNDDVNMSQSSNDTFPTAMHVVSVLEITHKLLPSLENLLKTFKEKSQQFKEIVKIGRTHLQDATPLTLGQEFSGYASMLEHSKQQILESLEHLRELAIGGTAVGTGLNAHKELSEKVAEELSQFSGVKFISAPNKFHALTSHDAIAYAHGAFKALAANLMKIANDIRWLASGPRCGLGELNIPENEPGSSIMPGKVNPTQCEAMTMVAVQVMGNDTAIGIAASQGNFELNVFKPVIIYNFLQSLRLLSDSMESFNIHCASGIEPNKEKIDYYLHHSLMLVTALNPHVGYENAAKIAKNAHKKGISLKESALELKLLSAEDFDQFVVPEKMIGPKA

SEQ ID NO: 29104 - DNA, 1395 bp, Pseudomonas aeruginosa
  CDS (1)..(1395)
atgagccggaccgaaaccgatagcctgggcaccatcgaggtgcccgacgacgcctactggggcgcccagacccagcgttcgctggagaacttcgccatcggcggccagcgcatgccgctcgccgtgatccacgccctggcgctgatcaagaaagccgccgcgcgggtcaacgaccacctcggcgaactgccgccggaagtcgcccggctgatcgaacaggccgccgacgaagtcctcgcaggccgccacgacgaacacttcccgctggtggtctggcagaccggcagcggcacccagaccaacatgaacgtcaacgaggtgatcgctggccgcgccaacgaactggccggcaatccgcgtggcggcaagtcgccggtgcatcccaacgaccacgtcaaccgcgcgcagagttccaacgacagcttccccaccgccatgcacatcgccgccgccaaggccgtgcacgaacaattgctgccggccatcgccgagctttccggcggtctcgccgaacagtcggcgcggcacgccagcctggtcaagaccgggcgcacccacctgatggacgccacgccgatcaccttcggccaggaactctcggccttcgtcgcccagctcgactacgccgagcgcgccatccgcgcggcgctgccggcggtctaccagttggcccagggcggcaccgcggtgggcaccgggctcaacgcgccgaagggcttcgccgacgccatcgccgcggaaatcgccgccgaatcgggcctgcccttcgtcgccgcgccgaacaagttcgccgccctggccggccacgagccgctggtcatcctctccggcgccctgaagagcctggcggtggccctgatgaagatcgccaacgacctgcgcctgctcggttccggcccacgcgccggcttcgccgaggtgaagctgccggccaacgagccgggcagctcgatcatgcccggcaaggtcaacccgacccagtgcgaggcgctgtcgatgctggcctgccaggtcatgggcaacgacagcacgatttccttcgccgccagccagggccatctgcaactcaacgtgttcaagccggtgatcgtctacaacctgctggagtccatccgcctgctcgccgacggctgccgcaacttcaacaagcattgcgtcgccggcctggagccggacgcccagcgcatggccgacctgctggagcgcggcctgatgctggtcaccgcactgaacccgcacatcggctacgacaaggccgccgaaatcgccaagaaggcctacgccgaaggcaccaccctgcgcgccgcggcgctgcagctgggctacctggacgaagcgcagttcgacgaatgggtacggccggagcagatgctggaggccggccaccatggttga

SEQ ID NO: 29105 - protein, 464 aa, Pseudomonas aeruginosa
MSRTETDSLGTIEVPDDAYWGAQTQRSLENFAIGGQRMPLAVIHALALIKKAAARVNDHLGELPPEVARLIEQAADEVLAGRHDEHFPLVVWQTGSGTQTNMNVNEVIAGRANELAGNPRGGKSPVHPNDHVNRAQSSNDSFPTAMHIAAAKAVHEQLLPAIAELSGGLAEQSARHASLVKTGRTHLMDATPITFGQELSAFVAQLDYAERAIRAALPAVYQLAQGGTAVGTGLNAPKGFADAIAAEIAAESGLPFVAAPNKFAALAGHEPLVILSGALKSLAVALMKIANDLRLLGSGPRAGFAEVKLPANEPGSSIMPGKVNPTQCEALSMLACQVMGNDSTISFAASQGHLQLNVFKPVIVYNLLESIRLLADGCRNFNKHCVAGLEPDAQRMADLLERGLMLVTALNPHIGYDKAAEIAKKAYAEGTTLRAAALQLGYLDEAQFDEWVRPEQMLEAGHHG

SEQ ID NO: 29106 - DNA, 1374 bp, Pseudomonas aeruginosa
  CDS (1)..(1374)
atgactgacacccgcatcgaacgcgacagcatgggcgaactggcggtcccggcgaccgccctctatggcgcccagacccagcgcgcggtgaacaacttcccggtcagcggccaacgcatgccccaggccttcgtccgcgccctgctgctggccaaggccgcggcggcgcgggcgaacgtctccctgcagcaactggatgcaccgatgggcgaggcgatcgccgacacctgcctgcaactgctgcaggaggacttcatgcagcatttcccggtggatgtgttccagaccggctccggcaccagttccaacatgaacgccaacgaagtggtggcgaccctggccagtcgtcgcctgggcggcaaggtcaatccgaacgaccatgtgaactgcgggcagagcagcaacgacatcattccctcgaccatccacatcagtgccgccctcgagatcagcgaacgcctgctgtcggcgctgcgccacctggagcagactatccagagcaaggccggcgaagtgcatgcctatgtgaagaccggccgcacccacctgatggatgcgatgccggtacgcatgagccaggtgctcggtggctgggcgcagcaggtgcgacaggccggcgtgcacatcgagagcgtacttcctgccttgcagcagttggcacaggccggcaccgcggtgggcaccgggatcaacgcccatccgcggttcgccgaacgtttcagccaggagctgaacgacctgaccgggctggcgttccgccccggcgacgacttcttcgccctgatcggttcgcaggacaccgcggtcgctgcgtccggccagttgaagaccctggccgtgaccctgatgaagctggccaacgacctgcgctggatgaactccgggccgcttgccgggctcggcgagatcgagctggaagcgctgcaaccaggctcctcgatcatgcccggcaaggtcaacccggtgatcccggaggccaccgcgatggtcggcgcccaggtgatcggcaatgacgccattgccgtcgctggccaatcgggcaacttcgaactgaacgtgatgctgccgctggtggcggacaccctgttgcacagcatccagttgctggccaacgtcagccggctgctggcggacaaggccatcgccagcttcaaggtcaaccagggcaagctcagcgaggcgttggcgcgcaacccgatcctggtcactgcgctgaacccgatcatcggttaccagaaggctgcggaaatcgccaagcaggcctatcgcgagggacggccgatcatcgatgtggcgctggaaaacaccgatctggaccgtgctcgcctggaggtgttgctggatccggaaaaactcacggctggcggcctctga

SEQ ID NO: 29107 - protein, 457 aa, Pseudomonas aeruginosa
MTDTRIERDSMGELAVPATALYGAQTQRAVNNFPVSGQRMPQAFVRALLLAKAAAARANVSLQQLDAPMGEAIADTCLQLLQEDFMQHFPVDVFQTGSGTSSNMNANEVVATLASRRLGGKVNPNDHVNCGQSSNDIIPSTIHISAALEISERLLSALRHLEQTIQSKAGEVHAYVKTGRTHLMDAMPVRMSQVLGGWAQQVRQAGVHIESVLPALQQLAQAGTAVGTGINAHPRFAERFSQELNDLTGLAFRPGDDFFALIGSQDTAVAASGQLKTLAVTLMKLANDLRWMNSGPLAGLGEIELEALQPGSSIMPGKVNPVIPEATAMVGAQVIGNDAIAVAGQSGNFELNVMLPLVADTLLHSIQLLANVSRLLADKAIASFKVNQGKLSEALARNPILVTALNPIIGYQKAAEIAKQAYREGRPIIDVALENTDLDRARLEVLLDPEKLTAGGL

SEQ ID NO: 29108 - DNA, 1317 bp, Sulfolobus solfataricus
  CDS (1)..(1317)
atgaaatataccgatactgcgcccaagctttttatgaatactggaaccaaatttcctagaagaattatctggtctatgggagttttaaagaagtcctgtgctaaagtcaacgcagatcttggattattagataaaaaaattgcggattcaattattaaggcatctgacgatttaattgatggaaaattagatgataagatagtgcttgatgtatttcaaacgggttcagggaccggacttaatatgaacgtaaatgaggttatagcagaagtagcttctagctattctaatcttaaagtacatccaaatgatcatgtaaattttggtcagtcctcaaacgatactgtgccaacagctataagaattgcagcagtagctgaggtaacaaataggctactgcctgcattacagcaaataatatcctctttaaataagaaggctgaggagtacaaggatgttataaaggctggtagaacccatttaagagacgcattaccagtaactttaggtcaagaactttcagcctacgcagacgctttccagcatgaacatgaacaagttatgaatattttggaatatgtgaaggaattgccaattggaggtactgcgactggtactgggctaaatagccacccagaattccaagaaagagttataaacgaaataaacagaattaccggtttaggatttaagccagctaataggtttagagcaatgagattgctcaccgatctcttattattaagcggagcactgaggaatattgcagtagacctatatagattagggcaagatataaggttaatgttttccggtcccttaactgggttaaatgaaattgatttacctacacaagaggagatagctggtagctcaataatgcctggtaaaactaatccagttacggttgaggctactttactaatctcagcacaagttgtgggattagatcatgcaaaccaattcgcatcaatgttaggcgaatttgagttatcaatgggaattccattagttggttataatatcgtaacccaagttaatttcatctcagaggctttagagaagatgtcaagattagtgattgatggaatggtagcaaatgtagagaagatgaagagatatgctgaatcctctccttcacttataaccatagtatctccagtaataggctatgataaagcaacagaaataggaaagaagttaaataagggaatgtccatacgtgaagcattaagggaattaggatatagcgataatgagataaataaaatattagacttaagcaaactagttaaaccagggttcacagctaaatga

SEQ ID NO: 29109 - protein, 438 aa, Sulfolobus solfataricus
MKYTDTAPKLFMNTGTKFPRRIIWSMGVLKKSCAKVNADLGLLDKKIADSIIKASDDLIDGKLDDKIVLDVFQTGSGTGLNMNVNEVIAEVASSYSNLKVHPNDHVNFGQSSNDTVPTAIRIAAVAEVTNRLLPALQQIISSLNKKAEEYKDVIKAGRTHLRDALPVTLGQELSAYADAFQHEHEQVMNILEYVKELPIGGTATGTGLNSHPEFQERVINEINRITGLGFKPANRFRAMRLLTDLLLLSGALRNIAVDLYRLGQDIRLMFSGPLTGLNEIDLPTQEEIAGSSIMPGKTNPVTVEATLLISAQVVGLDHANQFASMLGEFELSMGIPLVGYNIVTQVNFISEALEKMSRLVIDGMVANVEKMKRYAESSPSLITIVSPVIGYDKATEIGKKLNKGMSIREALRELGYSDNEINKILDLSKLVKPGFTAK

SEQ ID NO: 29110 - DNA, 1401 bp, Synechocystis sp
  CDS (1)..(1401)
atggtaaattcccaccgccttgaaaccgacagtatggggtccctggaagtccaagccgatcgcctgtggggagcgcaaacccaacgttccctgatgttttttgacattggtagcgatgtgatgccgccggatttaattcgggcctttgccatactcaaaaaggcagccgccattaccaatcaggatttgggtaaattaccagcggacaaggcagagttaatcattacggcagcggacgaaatcattgccgggcagtggttagaccatttccctctaaggatttggcaaacgggcagtggcactcaaaccaacatgaacgtgaacgaagtgattgccaatcgggcgatcgccatttgtgggggagaattgggcagtaaaaatcccatccatcccaatgaccacgtcaacatgtcccagtcgtctaacgatacttttcctacggcgatgcacattgcggcggtggcaggtttacaaaccaagttgattcccagtttgcaagctctgagagatagcctgaatgaaaaagcggaatgttttgcaggcatcactaaaattggccgcacccatttgatggacgcagtgcccctaacgttagggcaggaattttccggttacgtggcccagttagaccaagggctgacccaaattaattattgtttacccggtcttttggaattggccctggggggaacggcggtgggtacagggttaaatagtcatccccaatttgctaaaaaagtggccgaagaaattgcccagttaactggttataccttcatttctgcccccaacaaattcgccgccctagctggccacgaggcgatcgcctttgccagtggcgtgctgaaaagtattgccgcttccctgatgaaaattgccaatgatttgcgctggatggggtctgggccccgctgcggcttgggggaattagccttaccagccaatgaaccaggttcttcgatcatgcccgggaaagtaaaccccacccaatgcgaagccatgaccatggtttgtgtgcaggtaatggggaacgatgccaccattggttttgcggccagccaaggtaattttgagctcaatgtttttaagccagtgattattcataatttcctccattcgttacatttactcagcgatgcttgtgctagttttcgccaacatttagtggtgggattacaagtaaacgaaagcaaggttaaagactttttggacacctctttaatgttagtcaccgccctcaatccccacattggctacgacaatgcggccctcgtggctaaaactgcctttgcccaaggcattaccctcaaacaagccgcggtggatttaggtttactcaccccagcccagttcgacgcttgggtcgttccagagcagatgattgccccgattgctgactag

SEQ ID NO: 29111 - protein, 466 aa, Synechocystis sp
MVNSHRLETDSMGSLEVQADRLWGAQTQRSLMFFDIGSDVMPPDLIRAFAILKKAAAITNQDLGKLPADKAELIITAADEIIAGQWLDHFPLRIWQTGSGTQTNMNVNEVIANRAIAICGGELGSKNPIHPNDHVNMSQSSNDTFPTAMHIAAVAGLQTKLIPSLQALRDSLNEKAECFAGITKIGRTHLMDAVPLTLGQEFSGYVAQLDQGLTQINYCLPGLLELALGGTAVGTGLNSHPQFAKKVAEEIAQLTGYTFISAPNKFAALAGHEAIAFASGVLKSIAASLMKIANDLRWMGSGPRCGLGELALPANEPGSSIMPGKVNPTQCEAMTMVCVQVMGNDATIGFAASQGNFELNVFKPVIIHNFLHSLHLLSDACASFRQHLVVGLQVNESKVKDFLDTSLMLVTALNPHIGYDNAALVAKTAFAQGITLKQAAVDLGLLTPAQFDAWVVPEQMIAPIAD

SEQ ID NO: 29112 - DNA, 1401 bp, Thermus aquaticus
  CDS (1)..(1401)
atggaataccgggttgagcgggacaccatgggagaggtcaaggttccggcggaccgctactggggggcccagacccaacgctctctggagcacttccggatcggggcctggcgcttccggatgccgctggagatcatccgggcctacgggatgctgaagaaggccgccgccagagccaacctggagctgggggagctacccgaggagatcgccagggccatcatccaggcggccgaggaggtcatcgccgggaagctggacgaccacttccccctggtggtcttccagaccgggtccggaacccagaccaacatgaacgtcaacgaggtcatcgccaaccgggcctcggagatcctgggcaagcccctggggagcaagtacgtccaccccaatgaccacgtgaaccggggccagagctccaacgacaccttccccaccgccatgtacgtggccaccgtcttggctcttcaccagcacctttacccggcggtggagggcctcatcgccacctttgaggaaaaagccagggcctttgacggcatcgtcaaggtgggccgcacccacctcatggacgccgtccccatcaccctgggccaggaggtggggagctgggccgcccagcttaggaacaccctggccatggtcaaggaggcggaaaagggcctctacaacctggccatcggcggcaccgccgtgggcacgggcctcaacgcccacccccgcttcggggagctggtggcccggtatctggcggaggagaccggcctccccttccgggtggcggaaaaccgcttcgccgccctggccgcccacgacgagctggtccacgtcatgggggctctaaggaccctggccggggccctgatgaagatcggcaacgacatccgctggctggcctcggggccctacgggggtatcggcgagatcttcatccctgccaacgagcccgggagctccatcatgccgggcaaggtgaaccccacccaggtggaggccctaccatgggtggtggtgcgggtctttggcaacgaccaggccgtggccttcgccgggagccagggcaacttccagctcaacgtctacaagccggtcatggtggacgccgccttggagtccatcaagcttctgggcgacgctgtggcctcctttgaccagcacctggcccaggggattgagcccaacctggagcgcatagaggagcacctcaacaagaaccccatgctggccaccgccctcaacaaggccatcggctacgacaaggcggcggagatcgtcaagaaggccatcaaggagaagaagtccctgaagcaggcggccctggagctgggttacctcaccgaggaggagtttgaccggatcgtggtgcccatgcgcctggccaagccccacgaaaacgcttag

SEQ ID NO: 29113 - protein, 466 aa, Thermus aquaticus
MEYRVERDTMGEVKVPADRYWGAQTQRSLEHFRIGAWRFRMPLEIIRAYGMLKKAAARANLELGELPEEIARAIIQAAEEVIAGKLDDHFPLVVFQTGSGTQTNMNVNEVIANRASEILGKPLGSKYVHPNDHVNRGQSSNDTFPTAMYVATVLALHQHLYPAVEGLIATFEEKARAFDGIVKVGRTHLMDAVPITLGQEVGSWAAQLRNTLAMVKEAEKGLYNLAIGGTAVGTGLNAHPRFGELVARYLAEETGLPFRVAENRFAALAAHDELVHVMGALRTLAGALMKIGNDIRWLASGPYGGIGEIFIPANEPGSSIMPGKVNPTQVEALPWVVVRVFGNDQAVAFAGSQGNFQLNVYKPVMVDAALESIKLLGDAVASFDQHLAQGIEPNLERIEEHLNKNPMLATALNKAIGYDKAAEIVKKAIKEKKSLKQAALELGYLTEEEFDRIVVPMRLAKPHENA

SEQ ID NO: 29114 - DNA, 2489 bp, Saccharomyces cerevisiae
  CDS (830)..(2296)
taatcacttctacgagtctagtagatctcttctccttcctataagtggttaatgtattcttcgagaagctcatcatttttttttttcattttttttttttttttcagttttctacaatttcatcaaatcaatggttaaaccgggcagaaaaactaccaagcgttacttttactgatgttagtactactaccgcagttattgcgactactacattaactataactatacaagaaaaaaagtaaagagggctcgtaaagcaaagcttggtatctcctacatagtcaatacatagtagtgagtcgcctatagccattctgtaatgccatttgttaagacgtgtccttaaacccttccgaatcgccgcgggcgacatcataatgtcagtacctaataatggttattattcgtaccctgtggttagagagctatggaagctagcagtaaatgtctctagttcttgctatcactaccatattggagaggcttcaggcccctcccctgagccgatcctcggaatgactaccccgattcccggaatgggcgttcgatgattggctctttcctgtaaagcctttttgcgtttcttataggctatatataatcttcatcactgttgtagacgttaaacaagcatccaacaggaggccggaccgaacacacgggggagtgactctagctctttcttctgggatattcatatcgtttctccattacatacagtcatttttttgcatttttaaattcgtgacttttagtactgcagctgttttttttctcacgtcaagaaattccataaagtctaactattaaacggataagagatacaatcatgttgagatttaccaattgtagttgcaagactttcgtaaaatcgtcatataagcttaatataagaagaatgaactcctcgttcagaactgaaaccgatgcatttggtgagatacacgtgcctgctgataagtactggggtgcccaaactcaaagatcctttcaaaacttcaagattggtggcgctcgtgaaagaatgccattgcctttggtgcatgcatttggtgttttgaagaaatctgccgcgattgtgaatgagtctctggggggattggatcccaagatctccaaggctattcaacaggccgctgacgaagtggcttctggtaagctagacgaccactttccattggttgttttccaaacgggttccggtacccagtctaacatgaatgctaatgaagttatttccaatcgtgccattgagatcctaggaggcaagattggatctaaacaagtccatccaaacaatcattgcaaccaatctcaatcatccaatgatactttccccactgtcatgcatatcgctgccagtttgcaaattcaaaacgagttgatacctgagttgaccaatttaaagaacgcccttgaagccaaatccaaggaatttgaccatattgtgaagatcggtagaacacacttgcaagatgccacgcctttgacactaggtcaagagttttccggttacgtgcaacaagttgagaacggtatccaaagagtggcacattctttgaaaacattgagtttcctggcacaaggtggtactgccgttggtacagggttgaacaccaagcccggattcgatgtcaagatagccgagcaaatttccaaagaaactggactaaagtttcaaaccgcccctaataagttcgaggctttggctgctcacgacgccattgtcgaatgtagcggtgctctaaacacccttgcttgttctcttttcaaaatagcgcaagatataagatacttagggtccgggccacgttgcggctaccatgaactaatgctgccagagaatgaaccaggttcctcaatcatgcctggtaaagttaacccaacccaaaacgaggcattgactcaagtgtgtgtgcaagtcatgggtaacaatgcagctatcacgtttgccggctctcaaggtcaattcgagttaaatgtcttcaagccagtcatgatcgccaatctattgaattcgatcaggttaattactgatgccgcatattcatttagagtgcactgtgttgaaggtatcaaagccaatgagcctcgtattcatgagttgttgactaaatctttaatgttagtcaccgctttgaaccctaagatcggttatgatgccgcttccaaggtcgccaagaatgctcataagaagggcattaccttgaaggaaagtgcattggaattgggtgtattgactgaaaaggaatttgatgaatgggttgttcctgaacacatgctaggtcctaaataaacgagctaaatacctaataatatacaagttttttatgtcttattatatgaaggaaaataaggaagtggagagaatttgtgattcagcaatggtccctccgctaaggtcccgcctctggccagttatgtcagaagaggagcataggcatacattccatttttgatggcttaatggggcccataaatttacatca

SEQ ID NO: 29115 - protein, 488 aa, Saccharomyces cerevisiae
MLRFTNCSCKTFVKSSYKLNIRRMNSSFRTETDAFGEIHVPADKYWGAQTQRSFQNFKIGGARERMPLPLVHAFGVLKKSAAIVNESLGGLDPKISKAIQQAADEVASGKLDDHFPLVVFQTGSGTQSNMNANEVISNRAIEILGGKIGSKQVHPNNHCNQSQSSNDTFPTVMHIAASLQIQNELIPELTNLKNALEAKSKEFDHIVKIGRTHLQDATPLTLGQEFSGYVQQVENGIQRVAHSLKTLSFLAQGGTAVGTGLNTKPGFDVKIAEQISKETGLKFQTAPNKFEALAAHDAIVECSGALNTLACSLFKIAQDIRYLGSGPRCGYHELMLPENEPGSSIMPGKVNPTQNEALTQVCVQVMGNNAAITFAGSQGQFELNVFKPVMIANLLNSIRLITDAAYSFRVHCVEGIKANEPRIHELLTKSLMLVTALNPKIGYDAASKVAKNAHKKGITLKESALELGVLTEKEFDEWVVPEHMLGPK

SEQ ID NO: 29116 - DNA, 1395 bp, Acinetobacter sp
  CDS (1)..(1395)
atgcaaactcgaattgaacacgacaccatgggtgaggttgaggtcccaaacgatgcactttggggagctcagacgcaacgcagtttgcaaaattttaagatcggtcaggaaagactcccacgagcgatgattcgtgcaatgggacttgtcaagaaggcagcagcgattaccaatgcagaactcgggcagttgccagaggatctgagccaatatatcgttggtgcggcagaagaagtaattgcaggtgactgggactcgcaatttcctttggtggtctggcaaacgggttcaggcacacaaagtaatatgaattgtaatgaagtgattgccaatattgcgaaccaaaaattaggaaatgctttaggttctcaatcacctgtgcatccgaacgatcatgtcaatcgtgctcagtcgacaaacgattctttcccaactgccatacatgttgctgcatcattacaaatcaacgaattgcttattcccgctgtaaaaagcctaaaagagaccttgaagaaaaaatcagatgaattttctgatattgtcaaaattggtcgcacgcatttacaggatgcaacaccgttaacattagggcaagagtttagtgggtatgtatcgcagctcgatcatgggttaaagcgattacagcaagcgcttgagggtttatacgagcttccgttaggtggaacggctgtgggtacaggtttaaatgcacatcctgattatgcagtgaatgcagctcaacaacttgctaaactgacaagtctgccattcgttacggcacctaataaatttgaagctttagctggacgtgatgctgcggtatttgcatctggtgcactgaaaactctcgctgtaagcttaaacaaaattgcaaatgatattcgttggctggcaagtggtccgcgttgcggatttggtgaaattcgtattccagaaaacgaaccaggctcaagcattatgccaggcaaagtaaatccaacgcaaagtgaagctatgacgatggtggttgcgcaggtgttaggcaatgatacaacgatcaatgttgcaggtgcttctggtaactttgaactgaatgtcttcatgcctgtaatcgcatttaatcttcttcagtcaattcagcttctaggtgatgcttgtaatagttttaacgaacattgtgcagtaggtatcgagccaaatagagaaaagattgattattttctgcataattcattaatgttggtgacggcattgaatcctgttattggttatgaaaacgctgcaaaagtagcaaaaacggcttacaaagaaaataaaacgttaaaacaggttgctgtagaactaaatttagtcacagaacagcagtttgatgaaatcgttcgtcctgaaaagatggtatctccaaataccaagtaa

SEQ ID NO: 29117 - protein, 464 aa, Acinetobacter sp
MQTRIEHDTMGEVEVPNDALWGAQTQRSLQNFKIGQERLPRAMIRAMGLVKKAAAITNAELGQLPEDLSQYIVGAAEEVIAGDWDSQFPLVVWQTGSGTQSNMNCNEVIANIANQKLGNALGSQSPVHPNDHVNRAQSTNDSFPTAIHVAASLQINELLIPAVKSLKETLKKKSDEFSDIVKIGRTHLQDATPLTLGQEFSGYVSQLDHGLKRLQQALEGLYELPLGGTAVGTGLNAHPDYAVNAAQQLAKLTSLPFVTAPNKFEALAGRDAAVFASGALKTLAVSLNKIANDIRWLASGPRCGFGEIRIPENEPGSSIMPGKVNPTQSEAMTMVVAQVLGNDTTINVAGASGNFELNVFMPVIAFNLLQSIQLLGDACNSFNEHCAVGIEPNREKIDYFLHNSLMLVTALNPVIGYENAAKVAKTAYKENKTLKQVAVELNLVTEQQFDEIVRPEKMVSPNTK

SEQ ID NO: 29118 - DNA, 1452 bp, Candida glabrata
  CDS (1)..(1452)
atgttgagggctagcagtagggcaaagacatcgctcatcgggtacagcgcgcggatgatgcattacagagtagagacggacactttcggcgagatcaaggtacccgcggacaagtactggggcgcgcagacgcagcggtcgttccagaacttcaagatcggcggcgcgcgcgagcgcatgccggagcccatcgtgagggcgttcggtgtgctgaagaagtcagccgccatagtcaacgagaagctcgggacgctagacagcgagatcgcggggcccatccagcaggccgctgacgaggtcgccaagggcaagctcaacgaccacttccccttggtggtgttccagaccgggtcaggcacgcagtctaacatgaacgccaacgaggtcatctccaacagggcgattgagctgatcggcggcgagctcggctccaagaagatccacccaaacaaccactgcaatcaggcgcagtcctccaacgacactttcccctcggtgatgcacatcgccgcggtcacggagatcaccaactccctcttgccggagatcacccagctgaaggacgccctccacaagaaggccgaggagttccaggacatcgtcaagatcggcagaacacacctgcaggacgccacaccgctgaccctcggacaggaattcagcggctacgtccagcagctcgtcaacggcatcgcaagaatcgagaacaccctgccacacctgaagtacctcgcacaaggtggtaccgctgtcggcacagggctgaacacgaaggagggcttcgacaagctgatcgccgagcagatctccaaggaaacgggcatcgacttcaaaaccgcccctaacaagttcgaagctctcgcagctcacgacgcgatcgtcgaggccagcggtgccctgaacaccgtggcttgctctctgttcaagatcgcacaggacatcaggtacctgggctccggccctcgttgcggctacggtgaactgcacttgccagagaacgagccaggttcctccatcatgcctggtaaggtcaacccaacacagaacgaggccatgacccaggtctgtgtccaggtcatgggtaacaacgcagctgtgaccttcgcgggcgccaacggtcagttcgaactgaacgtcttcaagccggtcatgatctcaaacttgttgagctccatcagattgctggcagacgcttgccactccttcagagtccactgtgtcgaaggcatcgaggcaaaccgcgagaagatcaaccacaacttgcacaactcattgatgctggtcaccgctctgaacccaaagatcggctacgacgccgcctccaagatcgcaaagaacgctttcaagaagaacatcaccttgaaagagtccgccttggagttgaaatacttgacctcagaagagttcgacgaatgggtcattcctgaaaacatggttggaccaaccaagtaa

SEQ ID NO: 29119 - protein, 483 aa, Candida glabrata
MLRASSRAKTSLIGYSARMMHYRVETDTFGEIKVPADKYWGAQTQRSFQNFKIGGARERMPEPIVRAFGVLKKSAAIVNEKLGTLDSEIAGPIQQAADEVAKGKLNDHFPLVVFQTGSGTQSNMNANEVISNRAIELIGGELGSKKIHPNNHCNQAQSSNDTFPSVMHIAAVTEITNSLLPEITQLKDALHKKAEEFQDIVKIGRTHLQDATPLTLGQEFSGYVQQLVNGIARIENTLPHLKYLAQGGTAVGTGLNTKEGFDKLIAEQISKETGIDFKTAPNKFEALAAHDAIVEASGALNTVACSLFKIAQDIRYLGSGPRCGYGELHLPENEPGSSIMPGKVNPTQNEAMTQVCVQVMGNNAAVTFAGANGQFELNVFKPVMISNLLSSIRLLADACHSFRVHCVEGIEANREKINHNLHNSLMLVTALNPKIGYDAASKIAKNAFKKNITLKESALELKYLTSEEFDEWVIPENMVGPTK

SEQ ID NO: 29120 - DNA, 1389 bp, Bartonella quintana str
  CDS (1)..(1389)
atggttgaaacacgtcaggaaacagatagctttggaacgatttcagtacgtcaagatcgttattggggagcacaaactgaacgttctctgcataattttaatattggcacagaaaaacaacctctcaccatcatctatgccttaagccttatcaaaaaagctgcagctgttgtcaatatggaaaaaggcaagcttgcacaaaacatcggaaaagcaatcattactgccgccgatgaagtgctcgcaggagcatttgatacgcattttccactttctgtctggcaaactggttctggcacacaaagtaatatgaacgtcaatgaagtcatcgccaaccatgccagcatgcttttgggaggaaaacttggcagtaaagcacccgttcaccccaatgatcacgtaaatatgagccaatcgtcaaacgattcctttcccacagcacttcacattgccaccacactccaaacacgccaacacttatttcccatccttgacgctcttattactactttaagaaaaaaagaagaagaatttgccgatatcatcaaaatcggacgcacccatacccaggatgcaacacctctgacattaggacaggaattttcaggttatcgcgcagcactagaagccaaccgccaacgcattgaaagtgcgcttgccgatgtccaaatgcttgcccaaggagggacagctgttggaacaggactcaatgcaccgcaaggttttgacgttgcttttgcgcaaacaatcagcaccctcacaggaataacctttaagactgccagcaataaatttgaagcactcgcccatcatggagcccttgcacattttcatggaagcttgaatgcattagcagctgatctgtttaaaattgccaatgacattcggtttttgggatccggtccacgctcagggttgggtgaactaagccttccagaaaatgaaccaggatcttccattatgccaggcaagatcaatcccacgcagtgtgaagcaatgactatggttgcttgccaggttttcggcaatcataccagtataacatttgccgcaagccagggacattttgaactcaatgtttataaacctgttattggctataatgttttacagtcgattacgcttcttggtgattgcatgcgttcttttgacatgcattgcattcaaggattacgtgccaatcgagtccatattcactctctcatggaacgctctctcatgttaataacagctcttgcaccggaaattggctatgaaaaagctgccgaaattgctaaagcagcacataaaaatgacacgactttgcgtactgaagctatcaaagcgggagtttctggagatgattatgatcggctggttgatcccaaaaagatgatccacccgcaataa

SEQ ID NO: 29121 - protein, 462 aa, Bartonella quintana str
MVETRQETDSFGTISVRQDRYWGAQTERSLHNFNIGTEKQPLTIIYALSLIKKAAAVVNMEKGKLAQNIGKAIITAADEVLAGAFDTHFPLSVWQTGSGTQSNMNVNEVIANHASMLLGGKLGSKAPVHPNDHVNMSQSSNDSFPTALHIATTLQTRQHLFPILDALITTLRKKEEEFADIIKIGRTHTQDATPLTLGQEFSGYRAALEANRQRIESALADVQMLAQGGTAVGTGLNAPQGFDVAFAQTISTLTGITFKTASNKFEALAHHGALAHFHGSLNALAADLFKIANDIRFLGSGPRSGLGELSLPENEPGSSIMPGKINPTQCEAMTMVACQVFGNHTSITFAASQGHFELNVYKPVIGYNVLQSITLLGDCMRSFDMHCIQGLRANRVHIHSLMERSLMLITALAPEIGYEKAAEIAKAAHKNDTTLRTEAIKAGVSGDDYDRLVDPKKMIHPQ

SEQ ID NO: 29122 - DNA, 1389 bp, Bartonella henselae
  CDS (1)..(1389)
atggttgaaacacgtcaagaaacggatagctttgggacgatttcagtccgtcaagaccgttattggggcgcacaaactgaacgctcattgcataattttaatattggcatagaaaaacaacccctcaccatcatctatgccttaagccttatcaaaaaagcagcagctgttgtgaatatggaaaaaggcaaactcgcaaaaaacattggaaaagccatcattactgctgccgatgaagtgctttccggtgcatttgacacgcatttccccctttctgtttggcaaacaggttctggaacacaaagcaatatgaacgtcaatgaagtgatcgccaatcatgccaatatgcttttgggaggaaaattgggtagcaaaacacctgtgcatcccaatgatcacgtcaatatgagccaatcgtcaaacgattcctttcccacagcacttcacattgctactaccctacaaacgcgccaacacctctttcctatccttgacgcacttattaccactttaaagaaaaaagaagaagaatttgccgatatcatcaaaattggacgtactcatacccaggatgccacacccttaactttagcgcaagaattttcgggctatcgcactgcactcgaagccaaccgccaacgcattgaaaatgctctttgtgatgttcaaatgcttgcccaaggaggtacagctgttggaacagggctgaacgcaccgcaaggctttgacatagcttttgcgcaaacaatcagtacatttacaggaataccctttaaaaccgctagcaataaatttgaagccctcgctcatcatggagctcttgcgcatttccatggtagcttaaatgcattagcagctgatctgtttaaaattgccaatgacattcggtttttgggatccggtccacgctcaggcttgggggaactaagcttaccagaaaatgaaccaggatcttccatcatgccaggcaaggttaaccccacacagtgtgaagcaatgaccatggttgcttgccaagtctttggcaatcataccagtgtaacatttgccgcaagccaagggcattttgaactcaacgtttataaacctgtcattggctacaatgttttacaatcgattacgcttcttggggattgcatgcgctcttttgatcttcattgtattcaaggattacgcgccaatcgagttcacattcattctctcatggaacgttctctcatgttggtgacagcgcttgcaccagaaattggctatgaaaaagctgccgcaattgccaaagcagcgcataaaaatgacacaactttgcgtaccgaagcactcaaactaggagtttctggagaagattatgatcggttggttgatcccaaaaagatgatccatccacaataa

SEQ ID NO: 29123 - protein, 462 aa, Bartonella henselae
MVETRQETDSFGTISVRQDRYWGAQTERSLHNFNIGIEKQPLTIIYALSLIKKAAAVVNMEKGKLAKNIGKAIITAADEVLSGAFDTHFPLSVWQTGSGTQSNMNVNEVIANHANMLLGGKLGSKTPVHPNDHVNMSQSSNDSFPTALHIATTLQTRQHLFPILDALITTLKKKEEEFADIIKIGRTHTQDATPLTLAQEFSGYRTALEANRQRIENALCDVQMLAQGGTAVGTGLNAPQGFDIAFAQTISTFTGIPFKTASNKFEALAHHGALAHFHGSLNALAADLFKIANDIRFLGSGPRSGLGELSLPENEPGSSIMPGKVNPTQCEAMTMVACQVFGNHTSVTFAASQGHFELNVYKPVIGYNVLQSITLLGDCMRSFDLHCIQGLRANRVHIHSLMERSLMLVTALAPEIGYEKAAAIAKAAHKNDTTLRTEALKLGVSGEDYDRLVDPKKMIHPQ

SEQ ID NO: 29124 - DNA, 1389 bp, Bacillus thuringiensis serovar konkukian str
  CDS (1)..(1389)
atggagtacagaattgaaagagatacattaggagaaataaaagttccagctgataaattatgggcagcacaaacacaacgtagtaaagaaaacttcccgattggaacagagcaaatgccgcttgaaattgtaaaagcatttgcaattttaaagaagagtgcagcacttagcaatcaaaaattaggaaagttatcagaagaaaaagcagaagcaattgtggcagcagctgacgaagtgattgcagggaaatggaatgaacattttccgcttgtcgtgtggcaaacaggtagtggtacacaatcaaacatgaatgtgaatgaagtaattgcaaatcgtgggaatcaaattttgaaagaaaagggatctgacgtacatattcatccgaatgatgatgtgaacatgtcccaaagttcaaatgatacatttccaacagcgcttcatgtagcatgtgtaatagcagtagaaaatcacgtattaccagctattacgaaattaaaagaaacgttagcagaaaaagtaactgcatttgaacatattataaaaattggtcgtacacatttacaagatgcgacaccgttaacattaggacaagaaattagtggatggcaccgtatgcttgaaaaaacagagcgtatgattgcagagagcaatacatatatgaaagagcttgcgattggtggtacagcagttggaacaggtattaacgctcatcctaaatttggtgagatggtatcagaggaaattagccaatttacaggtaaacaatttatttctgcaccaaataagttccacgcattaacgagccatgatgaagttgtgtatacgcatggtgcattaaaagcattagcagcggatttaatgaagatcgctaacgatgtacgttggcttgcaagtggtccacgtagtggtcttggagaaattattattccagcaaatgaaccgggaagctctattatgccaggtaaagtaaatccaacgcaaagtgaagcattaacgatggttgtagcgcaagtgatgggaaatgacgcaacaatcggatttgctgcgagtcaaggtaattttgagttgaacgtatttaaacctgttattgcatataacttcttacaatccgctcacttattagcagatgcaattgtttcatttaatgataattgtgcagttggtattgaagctgatgaagaagtcattaaagagaatgtgaatcgttcattaatgcttgttacagcattaaacccgcatatcggatatgaaaatgcagcgaaaattgcgaagcatgctcataaagaagggttaactttaaaagaagcagcattgcaatctggactactaacagaagagcaatttgatgaaattgtcgatccgaaaaaaatgattgctccgaaagagtaa

SEQ ID NO: 29125 - protein, 462 aa, Bacillus thuringiensis serovar konkukian str
MEYRIERDTLGEIKVPADKLWAAQTQRSKENFPIGTEQMPLEIVKAFAILKKSAALSNQKLGKLSEEKAEAIVAAADEVIAGKWNEHFPLVVWQTGSGTQSNMNVNEVIANRGNQILKEKGSDVHIHPNDDVNMSQSSNDTFPTALHVACVIAVENHVLPAITKLKETLAEKVTAFEHIIKIGRTHLQDATPLTLGQEISGWHRMLEKTERMIAESNTYMKELAIGGTAVGTGINAHPKFGEMVSEEISQFTGKQFISAPNKFHALTSHDEVVYTHGALKALAADLMKIANDVRWLASGPRSGLGEIIIPANEPGSSIMPGKVNPTQSEALTMVVAQVMGNDATIGFAASQGNFELNVFKPVIAYNFLQSAHLLADAIVSFNDNCAVGIEADEEVIKENVNRSLMLVTALNPHIGYENAAKIAKHAHKEGLTLKEAALQSGLLTEEQFDEIVDPKKMIAPKE

SEQ ID NO: 29126 - DNA, 1368 bp, Picrophilus torridus DSM 9790
  CDS (1)..(1368)
atgagaacagagcacgatgttataggcagtgttgagcttgatgattctgtttactatggcataaatacatacagggccatgaacaattttaaaatatcaggaataaaggaggatgatgaccatataaaggcaatagcaatggtcaagaaggcagctgcctatggaaaccatagagccgggaagcttaacgatgagctttacagtgcaatagaccaggcgtgtgacctggttatatcaggaaaatacaatgaccagtttgttatagatgtttaccaggcaggtgcaggaacctcatttaacatgaacgcaaacgaggttattgccaatatagcactggaaaaacttggccataaaaagggcgattataagataatacatccaaatgacactgtaaatatgagccagtcaacaaatgatatatacccaacaatgatgcgtgttgcaataatgataaaggctcctgaccttctggaatcaatgaaccagctgataatgtctctgaacaggaagggcgaggaattctcaaagatatacaaaacaggaagaacacacctgcaggacgccgttcgtgttacacttggcgatgagttccgtgcctgggcctatgcccttgcaaaggatatgaaggaaataaaaaatgccctggattacatattagaattaaacataggcggaacggctgttggaaacggcgccaatacacctgatggatacagggattacgccgttgaggcactttcaaatatgttaaaggtgaactttagaacctctggaaacatgatgggtgttatgcagtttatgactgatttttccaggttcatgaactctcttgcgaacactgcaatagaccttggcaagatctctgatgatttaaggcttctatactcgggacctggagccggaatccgtgagatactgttgccggcagtgcagcaggggtcatcaataatgcctggaaagataaatccatcaataccggaggcaatgaacatgatatgcaattccgtacttggtgcccagcaggcggtaaacatgtcggcaaaggcagggcagcttgaattaaacgtctttatgccaaatatagattatgagataacaagatcaataacaatacttaaaaatggcatggacatgctcagggaaagggccatagatggtataaaaccggatttaaagcactgcaggatgcatctgcagaacagctttggatctgccgcattgcttaatccataccttggctatgataccgttgctgcaatagttgaaagggcccttgaaaccggcgagaatatcagggatcttgtcctgcaaacaggaaaaataactgaggagcagtacgataaaatattctcgttcatgaatgaatga

SEQ ID NO: 29127 - protein, 455 aa, Picrophilus torridus DSM 9790
MRTEHDVIGSVELDDSVYYGINTYRAMNNFKISGIKEDDDHIKAIAMVKKAAAYGNHRAGKLNDELYSAIDQACDLVISGKYNDQFVIDVYQAGAGTSFNMNANEVIANIALEKLGHKKGDYKIIHPNDTVNMSQSTNDIYPTMMRVAIMIKAPDLLESMNQLIMSLNRKGEEFSKIYKTGRTHLQDAVRVTLGDEFRAWAYALAKDMKEIKNALDYILELNIGGTAVGNGANTPDGYRDYAVEALSNMLKVNFRTSGNMMGVMQFMTDFSRFMNSLANTAIDLGKISDDLRLLYSGPGAGIREILLPAVQQGSSIMPGKINPSIPEAMNMICNSVLGAQQAVNMSAKAGQLELNVFMPNIDYEITRSITILKNGMDMLRERAIDGIKPDLKHCRMHLQNSFGSAALLNPYLGYDTVAAIVERALETGENIRDLVLQTGKITEEQYDKIFSFMNE

SEQ ID NO: 29128 - DNA, 1392 bp, Parachlamydia sp
  CDS (1)..(1392)
atggactatcgaacagaaaaagacaccttaggagaagttagagtttctgcagactgttattatggagctcaaacgaagcgttcctacgataatttttcgattggaatagaaaaaatgcctaaggaagtaattcatgcgcttgctctaatcaagaaagcggccgccttaactaacgaacagcttggtttattaccaaaaaataaacaactcgtgatttgtgaagtttgcgacgaaattttatctggctgcttagatgatcaatttccgttatctgtttggcagacagggtctggaacgcaaacaaacatgaacctcaatgaagtgattagtaatagggccattgaaaagctgggtggggtgcttggttctaaatatccgatccatcccaatgatgatgtcaacttatctcaatcgtctaatgatgtgtttccttcagccatgcatattgcggtgatgtttgatatatctaagaagttgttaccaagtttaagagaactaaaagaaactttagaagcgaaagttgaagcttttaaagatattgtaaaaattgggcgtacgcatttaatggatgcgacccctttaacacttggacaagaattttcggggtatgtcagccaaatagagcatggaatacaagctctaaaaaatacgtttgcgcatctttctgaattggccttgggagcaactgctgtgggaacgggaatgaatacgcatcccaactacgcaaaattagtggctgaaaaaattagtgagttgtccggatttaattttgtttctgccaggaataaatttgagtcgctcgcgactaatgacgctcttgtagaagttagcggggctttaaaaagggtggccgtttcagtgtttaaaattgccaatgatattcggtggctttcttcaggccctagatgtgccataggagaaatcgttattcctgctaatgaaccaggctcatcgattatgccaggaaaagttaatcctacacaaagtgaagccttaatgatgattgccattcaagtaatggggaatgatgggatcattggttttgcaggttcgcaaggcaatctagaattgaatgtttttcgccctcttattatttataacttaattcaatctattcgattattgagcgatgctatttctaattttaaccaaaaatgtgttgtcggaatagaggctaaccaaacaagaattgcagaacatctgaatcgttccttaatgttagcaactgctcttaatcatgcaattggttatgatcgtgcaagtcaaattgtaaaaaaagcatacttagaaaatataacattaaaagaagctgcactagctttagcctttttaaccgaagatgaatttgatcagattatggatcctaaaaaaatgattgggccaatgacttaa

SEQ ID NO: 29129 - protein, 463 aa, Parachlamydia sp
MDYRTEKDTLGEVRVSADCYYGAQTKRSYDNFSIGIEKMPKEVIHALALIKKAAALTNEQLGLLPKNKQLVICEVCDEILSGCLDDQFPLSVWQTGSGTQTNMNLNEVISNRAIEKLGGVLGSKYPIHPNDDVNLSQSSNDVFPSAMHIAVMFDISKKLLPSLRELKETLEAKVEAFKDIVKIGRTHLMDATPLTLGQEFSGYVSQIEHGIQALKNTFAHLSELALGATAVGTGMNTHPNYAKLVAEKISELSGFNFVSARNKFESLATNDALVEVSGALKRVAVSVFKIANDIRWLSSGPRCAIGEIVIPANEPGSSIMPGKVNPTQSEALMMIAIQVMGNDGIIGFAGSQGNLELNVFRPLIIYNLIQSIRLLSDAISNFNQKCVVGIEANQTRIAEHLNRSLMLATALNHAIGYDRASQIVKKAYLENITLKEAALALAFLTEDEFDQIMDPKKMIGPMT

SEQ ID NO: 29130 - DNA, 1401 bp, Bdellovibrio bacteriovorus
  CDS (1)..(1401)
atgatggcagagggcggattcagaatcgaaaaagacaccatgggtgaagtgaaagttcccgcagacaagttctggggagcacagacccaaaggtccacagaaaacttccgcatcgggggcgatcgtttcccgcgcgagatgatccgggccttgggtgtcttgaagaagtccgccgctatcaccaacgaaaaactgggtctgcttgatccgaaaaaagcctcggtcatcgtgaaagccgccgatgaagtgatcgtcggcaaactcgacgcccatttcccgctggtggtgtggcagacgggttcaggcacacagaccaacatgaatgccaacgaagttatcgccaatcgtgcgatggacatgatgggcatcaaacttcccagcaaggaagttcatcccaatgatgatgtgaacaagggccagtcttcgaatgacactttccccaccgccatgcacattgctgtgggcgagcagattcatcatcgcctgattccgatgctggaaaagctgcacaaagctctggaaaacaaacagaaagaatttaaagacatcgtgaaaatcggtcgcacccatttgatggatgcaacccccctgaccctggggcaggagttttccggttacagcacccaggtgaaacactccatccagcgcgtgaaaaacaccttgccgcatctgtacgagctggcattgggcgggacggcggtgggaacgggtttgaacacgcatccgaaatttgcggttgaagccgctgcggaaatcgctcgcgagacggggattgcctttgtttcggctgaaaacaagtttgaagccctggcggcccatgacgctttggtggaagtcagcggggcgctgaactcggtcgcggtgtccctgatgaaaattgcgaacgacatccgcctgctgggttccggcccgcgctgcgggatcggggagcttcatttgcccgaaaatgaaccgggaagctccatcatgccgggcaaagtgaatcccacccagagcgaggctatgaccatggtctgtgcccaggtgatgggaaatcacgtggccgccacaattggcggggcgacggggcattttgagctgaacgtgtttaagcccgtgattgtgttcaatgttctgaattccgtgcgcctgttggcggacgcggcagaatccttcaccgatcactgtgtggtgggcattgaagccaaccgtaaacagattcagaagcatctggagcagtctttgatgctggtgacggcactgaatcctcacattggctatgacaacgcagccaaaattgccaaaactgcccataaaaacggcacaacactgcgcgaagaagccatcaatcttggactgctctctggcgaagaatttgataagatagtaaaaccggaaaacatggtcggccccagccgatag

SEQ ID NO: 29131 - protein, 466 aa, Bdellovibrio bacteriovorus
MMAEGGFRIEKDTMGEVKVPADKFWGAQTQRSTENFRIGGDRFPREMIRALGVLKKSAAITNEKLGLLDPKKASVIVKAADEVIVGKLDAHFPLVVWQTGSGTQTNMNANEVIANRAMDMMGIKLPSKEVHPNDDVNKGQSSNDTFPTAMHIAVGEQIHHRLIPMLEKLHKALENKQKEFKDIVKIGRTHLMDATPLTLGQEFSGYSTQVKHSIQRVKNTLPHLYELALGGTAVGTGLNTHPKFAVEAAAEIARETGIAFVSAENKFEALAAHDALVEVSGALNSVAVSLMKIANDIRLLGSGPRCGIGELHLPENEPGSSIMPGKVNPTQSEAMTMVCAQVMGNHVAATIGGATGHFELNVFKPVIVFNVLNSVRLLADAAESFTDHCVVGIEANRKQIQKHLEQSLMLVTALNPHIGYDNAAKIAKTAHKNGTTLREEAINLGLLSGEEFDKIVKPENMVGPSR

SEQ ID NO: 29132 - DNA, 1434 bp, Rhodopseudomonas palustris
  CDS (1)..(1434)
atgatcatggcccgcacgccccgctctccccgccccgcgcgttctgccgccacgcgaagcgagaccgatagtttcggtccgatcgatgtcgccgccgaccgttactggggcgcgcagaccgagcgttcgcggcaaaacttccgcatcggcaccgagcggatgccgatcggcatcatccgggcgctggcaatcgtgaaactggccgcggccgagaccaacaaggagctcggcctgctcgacaaccgccgcgccggcgccatcgtccgcgccgcccgcgaagtgatcgacggcacccatgacgatcacttcccgttggtggtgtggcagaccggctccggcacccagaccaacatgaacctcaacgaggtaattgctaatcgcgccaacgaactgctcggcggcgagcggggatcgaagaagccggtacatcccaacgatcacgtcaacatgagccagtcgtcgaacgactcgttcccgaccgcgatgcatatcgccgccgcgcaagcgattacggccgacctgatcccagcgctgacgctgctgcacgatgcgttacgcaagaaggagaaggcgttcgccaagatcgtcaagatcggccggactcacacccaggacgccaccccgctgacgctcggccaggaattttccggctacgcggcacagctcgccagcggcatcgcgcggatcaaatcggcgctgaaggagctgtatccgctggcgcagggcggcaccgcggtcggcaccggactgaacacgcatccgaaattcgccaaggcgttcgccaagcgcgccgcggcgattaccaagctgccgttcgtcaccgcgccgaacaaattcgaagcgctcgccgccaacgacgcctacgtgttcgtgcacggcgcactgaacgccgccgccaccgcgctgtttaagatcgccaacgacatccgcctgctcggctccggcccgcgctccgggcttggcgaactgatcctgccggagaacgagcccggctcatcgatcatgcccggcaaggtcaacccgacccagtgcgaggcgatgaccatggtgtgctgccaggtgttcggcaatcagaccaccctcaccgtcgccggcagccagggtcacttcgaactcaacgtctacaagccggtgatggcgcaggcgatgctgcagtcgatcgggctgctcgccgatgccgcacgctcgttcacgaccaactgcgtcgatggcatccgcgccgacgagcagcggatcggcgaactgatgcagcgctcgctgatgctggtgaccgcgctggcgccgagcatcggctacgacaatgccgccaagatcgccaaggcggcgcatcagcgtggtacgaccttgaaggacgaagcggtgcgttcggaactgatcagcgccgccgaattcgaccggctggtgcggccggacaaaatgacgcatccgggctga

SEQ ID NO: 29133 - protein, 477 aa, Rhodopseudomonas palustris
MIMARTPRSPRPARSAATRSETDSFGPIDVAADRYWGAQTERSRQNFRIGTERMPIGIIRALAIVKLAAAETNKELGLLDNRRAGAIVRAAREVIDGTHDDHFPLVVWQTGSGTQTNMNLNEVIANRANELLGGERGSKKPVHPNDHVNMSQSSNDSFPTAMHIAAAQAITADLIPALTLLHDALRKKEKAFAKIVKIGRTHTQDATPLTLGQEFSGYAAQLASGIARIKSALKELYPLAQGGTAVGTGLNTHPKFAKAFAKRAAAITKLPFVTAPNKFEALAANDAYVFVHGALNAAATALFKIANDIRLLGSGPRSGLGELILPENEPGSSIMPGKVNPTQCEAMTMVCCQVFGNQTTLTVAGSQGHFELNVYKPVMAQAMLQSIGLLADAARSFTTNCVDGIRADEQRIGELMQRSLMLVTALAPSIGYDNAAKIAKAAHQRGTTLKDEAVRSELISAAEFDRLVRPDKMTHPG

SEQ ID NO: 29134 - DNA, 1458 bp, Rhodopseudomonas palustris
  CDS (1)..(1458)
atggcgagcgagactgtgacaccgaccctgcgtgacgtgccgatcggcctcacggcgacaggccagcgccgcgaattcgacagcatgggcagcgtcgacgttccggcggatcgttattggggcgcgcagacgcagcgctcgttgcagcatttctcgatcggcggcgaccgcatgccgaaagcggtgtaccacgcctatggctacgtcaagaaagcctgcgcgctggtcaaccacgccgcgggccggctgccggcctggaagaccgaggccatcgtccgcgcagccgacgagacgatctcgggcgcgctggacgatcactacccgctgttcgtttggcagaccggctccggcacccagagcaacatgaacgtcaacgaagtcgtctccaaccgggcgatccagctgctcgggggtacgctcggcacgcagcagccggtcggccccaatgacgacgtcaatatgggtcagtcgtcgaacgacaccttcccgaccgccatgcacatcgcggcggtgacagcgatcgacgatcaggtcgtgccgcggctttccaagctgatcgagattatcgaacagaaagccgacggctggatggacgtggtcaagatcggccgcacccatctggaagacgccgtgccgctgacggtcggccaggaatggcacggctgggccggtcaattgcgcgacgcccgcgatgcgatcgaagccagccgcgccggcctgtatcagctcgcggtcggcggcaccgcggtcggcaccggcctcaacgcccccaagggcttcgctgccgacgttgctgccaggatcgccgagctgaccggcaagccgttcgtcaccgcaccgaacaagtttgccgcgcagggctcgctcgacgcgatggtccgcgcccacggcgcgctgcgcgatctcgcggtggcgctgatgaagatcgccaacgacatgcgctggctcgcttctggtccgcgctgcggcttcggcgaattgctgctgccgagcaacgagcccggctcctcgatcatgcccggcaaggtcaacccgacgcaatgcgaggcgatggtgatgatctgcatccaggtgatgggcaacgacagcgccgtcgccttcgccggcagccagggcaatttcgaactcaacgcgatgcggccggtgatcatcaacaacttcctgcattcggcgcgcatcctcgccgacggctgtgagaagttccggacctattcggtcgagggcaccgagctcaaccgcgatcgtgtcgcgcagtacgtcgaaggcagcgtgatgctggtcaccgcgctgtcaccggtgatcggctatcagaacgccgcgcatatcgccgaagatgcgatcgccaagaatctcacgctgaagcaggcggcactcgcctccggcaaggtcgacgaggcgacgttcgaccgcatcgtccggccgatcgacatggtcggcagcggtcttgcgggcgcctga

SEQ ID NO: 29135 - protein, 485 aa, Rhodopseudomonas palustris
MASETVTPTLRDVPIGLTATGQRREFDSMGSVDVPADRYWGAQTQRSLQHFSIGGDRMPKAVYHAYGYVKKACALVNHAAGRLPAWKTEAIVRAADETISGALDDHYPLFVWQTGSGTQSNMNVNEVVSNRAIQLLGGTLGTQQPVGPNDDVNMGQSSNDTFPTAMHIAAVTAIDDQVVPRLSKLIEIIEQKADGWMDVVKIGRTHLEDAVPLTVGQEWHGWAGQLRDARDAIEASRAGLYQLAVGGTAVGTGLNAPKGFAADVAARIAELTGKPFVTAPNKFAAQGSLDAMVRAHGALRDLAVALMKIANDMRWLASGPRCGFGELLLPSNEPGSSIMPGKVNPTQCEAMVMICIQVMGNDSAVAFAGSQGNFELNAMRPVIINNFLHSARILADGCEKFRTYSVEGTELNRDRVAQYVEGSVMLVTALSPVIGYQNAAHIAEDAIAKNLTLKQAALASGKVDEATFDRIVRPIDMVGSGLAGA

SEQ ID NO: 29136 - DNA, 1404 bp, Corynebacterium diphtheriae
  CDS (1)..(1404)
atgactgagcagcagtaccgcatcgagcacgacaccatgggtgaagttaaggtgcctatcgacgccctctggcgcgcacagacccagcgcgctgttgagaacttcccaatttctggccgtggcctcgaagccgcacagatccgcgctatggggctgctcaaggccgcttgtgctcaggttaataaggaccgcggacttctggctccagagcaggctgatgcaatcatcgccgcagctaccgaggtagccgagggcaagcacgacgaccagttccctatcgacgtcttccagaccggttccggcacctcgtcgaacatgaactccaacgaggttatcgcctcgatcgctaaggctaacggcgttgaggttcaccctaacgaccacgtcaacatgggccagtcctccaacgacaccttcccaactgctactcacatcgccgcaactgaggccgccgtcaaggacctcattccaggtctgaaggttctccatgcctccctagccaagaaagctgccgagtgggagaacgttgtaaagtccggccgtacccacctaatggatgccgttccagttaccttgggccaggagttctccggctacgctcgccagattgaggctggcatcgagcgcgtcgaggcatgcttgccacgtcttggcgagctctccatcggcggcaccgctgtaggcaccggcctgaacaccccagcagacttcggccagaaggtcactgccgagctcgttaagctgaccggggtttctgaacttcgcgagtgcgtgaaccactttgaggctcaggcaagccgcgacggcctcgtcgagttctccggcgcaatgcgcaccatcgctgtgtctttgaccaagattgctaacgacatccgctggatgggatccggcccgctgactggcctcggcgagatccacttgccagacctgcagccaggttcttccatcatgccaggcaaggtcaacccagttctgtgcgaaaccgcaactcaggtggcagctcaggttattggtaacgacgcagccatcgctttcggcggcgcacagggcgcattcgagctcaacgtcttcattccaatgatggcccgcaacgtcctcgagtcctctcgcctgttggctaacaccgcccgcgtattcgcagagcgtcttgtcgacggcatccatccaaatgaggagcgcatgcgcaccttggccgagtcttccccatcgatcgttaccccactgaactccgctatcggctatgaagctgcagcgaaggtggcaaagaccgcgctaaaggaaggcaagaccatccgccagactgtcatcgacttgggctttgttgatggcgaaaagctcaccgaggaagagctggacaagcgcctcaacgttctcgcaatggccaacaccgatcgcgacaagtaa

SEQ ID NO: 29137 - protein, 467 aa, Corynebacterium diphtheriae
MTEQQYRIEHDTMGEVKVPIDALWRAQTQRAVENFPISGRGLEAAQIRAMGLLKAACAQVNKDRGLLAPEQADAIIAAATEVAEGKHDDQFPIDVFQTGSGTSSNMNSNEVIASIAKANGVEVHPNDHVNMGQSSNDTFPTATHIAATEAAVKDLIPGLKVLHASLAKKAAEWENVVKSGRTHLMDAVPVTLGQEFSGYARQIEAGIERVEACLPRLGELSIGGTAVGTGLNTPADFGQKVTAELVKLTGVSELRECVNHFEAQASRDGLVEFSGAMRTIAVSLTKIANDIRWMGSGPLTGLGEIHLPDLQPGSSIMPGKVNPVLCETATQVAAQVIGNDAAIAFGGAQGAFELNVFIPMMARNVLESSRLLANTARVFAERLVDGIHPNEERMRTLAESSPSIVTPLNSAIGYEAAAKVAKTALKEGKTIRQTVIDLGFVDGEKLTEEELDKRLNVLAMANTDRDK

SEQ ID NO: 29138 - DNA, 1338 bp, Thermoproteus tenax
  CDS (1)..(1338)
atggactttgaagagagggcgaggagggtctatctggacactggaactaagttccagaggcctattatctggagcatggggctcatcaagtacgcggccgcctacgccaacgccgagctgggcctcctgccccggaggctggccgccgccatcatgggggcctccctggaggtaatggagggggtccacgacgctgaggtttatgtggacgtctttcagaccggctctggcacaggtctcaatatgaacatcaacgacgtgattgcgcggagagcctcggagatcgcaggctccagagttcatcctaacgaccacgttaatatgggccagtcctccaacgacgtagtgccgagcgccgtcagaatcgccgcgatcaagacggcggaggacgagctgatgcctgcgttgagcgccttgataggccgcttgagcgagaaatcggccgagttctccaaagtagtcaagcccggcagaacccacttaagagacgccttgcccgtcacgctcggccaagagctgggcgcctatgcggacgctcttgctcacggctgtcgggagctacgagacgtactcgcctatgtcggagagataccgctggggggcactgccgtcggcacaggtttcgggacgcatccccgcttcagacgtctggctattgacgccataaacaagacctcgggcctgcggctctccgaggggaacacgttcagaggaatgaggctcttgaccgatgtattgtatctatccgcagcgctccggaacatcgcggtagagctcatgagactagcgcaagacgtaagactcatgttctccggtcctactgcgggcctcgccgagatcgacctcccctcgcaggctgaagtgccagggagctctatgatgcccggcaaaataaacccagtcacggccgaggccgttatgttggccgcggcccagatcgtcggactggaccacgcgaaccaagccgccgccggcctaggcgagtttgagctcgccatgggcatcccgttgatagggtacaacgtagtggcccagattaacctcctatctgaagcatcgggaaagctctcagagctcgtaatagccgatatgaagccgcggagagaccgcttgagggacctcgcagagaggtcgcccgcgttggccacagctctggcgccagcgttgggatacgagggggtctcccaggttgtaaggaagatttccgagggcaaatccatcagagtggccttagaggaggtgggccgcccggatctggcgcaggagatccccgacgtcgataatatggcgcaggctccggaggcggagaggcggatcgattgtgatagctacaaatag

SEQ ID NO: 29139 - protein, 445 aa, Thermoproteus tenax
MDFEERARRVYLDTGTKFQRPIIWSMGLIKYAAAYANAELGLLPRRLAAAIMGASLEVMEGVHDAEVYVDVFQTGSGTGLNMNINDVIARRASEIAGSRVHPNDHVNMGQSSNDVVPSAVRIAAIKTAEDELMPALSALIGRLSEKSAEFSKVVKPGRTHLRDALPVTLGQELGAYADALAHGCRELRDVLAYVGEIPLGGTAVGTGFGTHPRFRRLAIDAINKTSGLRLSEGNTFRGMRLLTDVLYLSAALRNIAVELMRLAQDVRLMFSGPTAGLAEIDLPSQAEVPGSSMMPGKINPVTAEAVMLAAAQIVGLDHANQAAAGLGEFELAMGIPLIGYNVVAQINLLSEASGKLSELVIADMKPRRDRLRDLAERSPALATALAPALGYEGVSQVVRKISEGKSIRVALEEVGRPDLAQEIPDVDNMAQAPEAERRIDCDSYK

SEQ ID NO: 29140 - DNA, 1368 bp, Listeria monocytogenes str
  CDS (1)..(1368)
atggaacgaatagagcgagatacgcttggagaaatttctgtagatgcgacgaaatattggggagcgcaaacagaacgaagtaaaaggaactttgctattggtgataatcctatgccgatagaaattatatatgcttttgctcaattaaagaaagccactgcaaaagtaaacgcagcagaaggaaaactatccgaagaaaaagcgatagcgattggccaggtttgtgatcaaatcattcaaggagaactagatgagcattttcctttagtcgtttggcaaaccggaagcggaacgcagagcaacatgaatgtcaatgaagttatcgcacatgttgccaacttaactttaggcgaaggacaaattcatccgaatgatgatgtcaacatgtcgcaaagctcgaacgacacatttccaacagcgatgcatatcgctgcatacggggctttagtaacaaaacttttacctgaaataactaaaatggaagctgttttggcagagaagaaaagtaaatacatgcatctcgttaaaattggcagaacacatttgcaagacgcaaccccattaacacttggccaagaaattagtggctgggaagcatgtcttacaaataataaaaactatcttgaaacaagtatgaaagcaattttgccacttgcgattggtgggacggcagttggaactggcttaaatgcctcacgtgattttggtgataaggttgccgaagaattgatgaaacaaacgggatatccttttacttctgattccaataagtattttgctctaactagtcatagtccgattaattttgttcatggatccattcgtagccttgcttcggatctaatgaaaattgctaatgatatccgtttattagcaagtggaccacgtagcggcataggtgagttaacgatcccagttaatgaaccaggaagctccattatgccaggaaaagtaaatcctactcaatgtgaagcaatgacgatggtagcggctcaagtcatgggaaatgatgtgacaattaatgttgctgccagccaaggaaactttgaactcaatgtctacaagccagttatcatttttaatttcttagaatctgtcaaactgctttcagatagcatgcgttcgttccgattgcattgtttggaaggactcactgcgaatgaaaaagttattgaaacaaaagtaaatgactccctaatgcttgtgacagcattgaatccgcatatcggctatgaaaaagctgccaaaattgccaagctggcttttgatgaaaatacgacattaaaagaagcggcaatcaaaaccggttttgtgacagaaaagcaatttgatttatggattgatccgttaaaaatgactaatttgtaa

SEQ ID NO: 29141 - protein, 455 aa, Listeria monocytogenes str
MERIERDTLGEISVDATKYWGAQTERSKRNFAIGDNPMPIEIIYAFAQLKKATAKVNAAEGKLSEEKAIAIGQVCDQIIQGELDEHFPLVVWQTGSGTQSNMNVNEVIAHVANLTLGEGQIHPNDDVNMSQSSNDTFPTAMHIAAYGALVTKLLPEITKMEAVLAEKKSKYMHLVKIGRTHLQDATPLTLGQEISGWEACLTNNKNYLETSMKAILPLAIGGTAVGTGLNASRDFGDKVAEELMKQTGYPFTSDSNKYFALTSHSPINFVHGSIRSLASDLMKIANDIRLLASGPRSGIGELTIPVNEPGSSIMPGKVNPTQCEAMTMVAAQVMGNDVTINVAASQGNFELNVYKPVIIFNFLESVKLLSDSMRSFRLHCLEGLTANEKVIETKVNDSLMLVTALNPHIGYEKAAKIAKLAFDENTTLKEAAIKTGFVTEKQFDLWIDPLKMTNL

SEQ ID NO: 29142 - DNA, 1407 bp, Desulfovibrio vulgaris
  CDS (1)..(1407)
atgatgacaccggccgtacgcatcgaacatgacagcatgggggctgtggaggttcccgccgaccgctactggggggcccagacgcagcgcgcactggagcatttccgcatcggcacggaacggatgccgcaggagatggtgcaggcgctagggctcatcaagagggcggcggccgagaccaatgccgcgttggagctcctgccccggcagactgcggacgccgtggcgcgtgccgccaccgaggtggcgtccggtgcactgcccaaccattttcccctctgtgtgtggcagacaggtagcggcacccagaccaacatgaatgtcaacgaggtggtggccaaccgtgcatgtgaactgctgggcggtgtgcgtggcgaccggaaactcgtgcaccccaacgaccacgtcaacctctgccagtcgtccaacgatgtctttcctgcggccatgcacatcgcagcggcgctgggcctgcgcagcatgctgctgccctcgcttcaagcgctggaggccgaactggaggcacgggcacacgagttcgcgggtctggtgaaggtgggccgaacccacttgcaggacgcggttcccctcactctggggcaggaattctcggggtatgcggctcagcttgcgttgtgccgccgtcaactggagggcatgatgcccctcttgtgcgccctcgcgctggggggcactgccgtgggcaccgggctcaatgcccatcccgagttcgcgcggcgtgccgtggcgcgtctggcggggtacaccggcctgccgttcctgccagtggacaatcctttcgccgctcttgcggggcacgaggcccttgtggcctatagcggtgccctgcgtacgctggcagtggcccttttcaaggtgggcaacgacatccggttgctggcgtccggcccgcgctgcggtatcggtgaactggaactgcctgccaacgaacccggttcttccatcatgcccggcaaggtgaaccccacccagtgcgaggccctgaccatggtggcggtgcaggtcatgggtctggacaacgccgtgggcatcgccggttcgcaagggcatctcgaactcaacgtgttcaagccactcatcgcgagaaatgtgctcgaatcggcgcgtctgctggccgacagcatgcgttcattccgtatgcatgcggtgcgggggctgcgggcggtgcccgaacgcatcgcctcgcatgtcgaccggtcgctcatgctcgtcacggccctgtcgcggcatgtgggctatgaccgggcggcagaggtcgcccatcttgcccatgccgagggactgacgctacgggaggcgtgcctgcgccttggcctcatggacggcgaagccttcgacagggccgtcgaccctgtccggatggcgcacccgcacgacatgggctga

SEQ ID NO: 29143 - protein, 468 aa, Desulfovibrio vulgaris
MMTPAVRIEHDSMGAVEVPADRYWGAQTQRALEHFRIGTERMPQEMVQALGLIKRAAAETNAALELLPRQTADAVARAATEVASGALPNHFPLCVWQTGSGTQTNMNVNEVVANRACELLGGVRGDRKLVHPNDHVNLCQSSNDVFPAAMHIAAALGLRSMLLPSLQALEAELEARAHEFAGLVKVGRTHLQDAVPLTLGQEFSGYAAQLALCRRQLEGMMPLLCALALGGTAVGTGLNAHPEFARRAVARLAGYTGLPFLPVDNPFAALAGHEALVAYSGALRTLAVALFKVGNDIRLLASGPRCGIGELELPANEPGSSIMPGKVNPTQCEALTMVAVQVMGLDNAVGIAGSQGHLELNVFKPLIARNVLESARLLADSMRSFRMHAVRGLRAVPERIASHVDRSLMLVTALSRHVGYDRAAEVAHLAHAEGLTLREACLRLGLMDGEAFDRAVDPVRMAHPHDMG

SEQ ID NO: 29144 - DNA, 1389 bp, Bacillus cereus
  CDS (1)..(1389)
atggagtacagaattgaaagagacacattaggagaaattaaagttccagctgataaattatgggcagcacaaacacaacgtagtaaagaaaactttccgattggcacagagcaaatgccgcttgaaattgtaaaagcatttgccattttaaagaagagtgcagcacttactaataaaaaattaggaaagttatcagaagaaaaagcagaagcaattgtgacagcagctgacgaagtgattgcagggaaatggaatgaacattttccacttgtcgtatggcaaacaggtagtggtactcagtcaaatatgaatgtgaatgaagtaattgcaaaccgagggaatcaaattttgaaagagaagggatttgacgtacatattcatccgaatgatgatgtgaacatgtctcaaagttcaaatgatactttcccaactgcgcttcatgtagcatgtgtactcgcagtagaaaatcacgtgttaccagcaattacgaaattaaaagaaacgttagcagaaaaagtaaaagcatttgaaaatattataaaaattggtcgtacacatttacaagatgcgacaccgttaacattaggacaagaaattagtggatggcaccgtatgcttgaaaaaacagagcgtatgattgcagagagcaatacatatatgaaagagcttgcgattggtggtactgcagttggaacaggtataaacgcccatcctaaatttggtgagatggtatctgaggaaattagccaatttacaggtaagcaatttatttctgcaccaaataaattccatgcattaacgagtcatgatgaagttgtatatacacatggggcattaaaagcattagcagcggatttaatgaagatcgctaacgatgtgcgctggctggcaagtggtccacgtagtgggctaggagaaattattattccagcaaatgagccaggaagctctattatgccaggaaaagtaaatccaacgcaaagtgaagcgttaacgatggttgtagcacaagtgatgggaaatgacgcaacaattggatttgcagcgagccaaggcaattttgagttaaatgtatttaaacctgttattgcatataacttcttacaatctgctcacttattagcagatgcaattgtttcatttaatgataattgtgcagttggtattgaagcagatgaagaagtcattaaagagaatgtgaatcgttcattaatgcttgttacagcattaaacccgcatatcggatatgaaaatgcagcgaaaattgcgaagcatgctcataaagaagggctaactttaaaagaagcagcgttgcaatctggactactaacagaagtacaatttgatgaaattgtcgatccgaaaaaaatgattgctccgaaagagtaa

SEQ ID NO: 29145 - protein, 462 aa, Bacillus cereus
MEYRIERDTLGEIKVPADKLWAAQTQRSKENFPIGTEQMPLEIVKAFAILKKSAALTNKKLGKLSEEKAEAIVTAADEVIAGKWNEHFPLVVWQTGSGTQSNMNVNEVIANRGNQILKEKGFDVHIHPNDDVNMSQSSNDTFPTALHVACVLAVENHVLPAITKLKETLAEKVKAFENIIKIGRTHLQDATPLTLGQEISGWHRMLEKTERMIAESNTYMKELAIGGTAVGTGINAHPKFGEMVSEEISQFTGKQFISAPNKFHALTSHDEVVYTHGALKALAADLMKIANDVRWLASGPRSGLGEIIIPANEPGSSIMPGKVNPTQSEALTMVVAQVMGNDATIGFAASQGNFELNVFKPVIAYNFLQSAHLLADAIVSFNDNCAVGIEADEEVIKENVNRSLMLVTALNPHIGYENAAKIAKHAHKEGLTLKEAALQSGLLTEVQFDEIVDPKKMIAPKE

SEQ ID NO: 29146 - DNA, 1395 bp, Wolbachia pipientis wMel
  CDS (1)..(1395)
atggatagaaagacgagaatagaatcagacagcttaggggaagtaaaagtaccaagtgaacattactggggagcacagactcagcgttctttagaaaattttaagattggcacagaaaaaatgccagagcctctgattaaagcattagcaatagtaaaacttgcagcagcgcgtgttaatatgaaacatggtgttatagatgatagggtaggggacgcaatttgcacagccgcgagggaagtaatagatggcaaatttaataatgaatttccgcttgttgtttggcaaaccggatccggaacgcagactaatatgaatatgaatgaagtgatcagcaatcgtgcaatagagattttaggtggtaatttgggtagtaaatctccaatacatccaaatgatcatgtgaattatggtcagtcgtcaaatgacacctttccaacagcaatgcatatagcagcagcagagcaaataaactgcttgcttattccaaatcttgaaaaattgcataaggtgctggataataaggttcaggaatttaaagatataataaaagtaggacgtactcatctgcaagatgcaacgcccctaacactaggacaggagttttctggctatgcagcccagattaaaaaggggatagagagagtaaaatcaactttaagtggtatatacgagcttgcacaaggtggcactgcggttggcacgggactcaatactaaaaagggttttgctgaagattttgcaaagcaagttgcaggaattactaaccttccatttacttcagcaggcaataaatttgaagcgctagcagcaaatgatgctttagttgagctcagtggaacactcaatacagtagcagtcagtttaatgaaaattgcaaatgatataaggttgcttggttctggtccaagatgcggaattggggaaataatgttaccggaaaatgagcctggttcttcaattatgccaggtaaagtgaatccaactcagtgtgaagcggtgactatggtatgcactcaagttatgggaaatcatgttgctgtaaccattagtggttcaaacggtcattttgaattgaatgtgtttaagccagtgataatttacaatgttttgcagtctataagacttttagctgacgcaagtttaaattttacagaaaaatgtgtagttggtattaaagcaaatgaagagaggataaaagatttactgaatcagtcgttgatgttggtcactatattaaatacgcatatagggtacgacaatgcagcaaaaatagcgaagcttgcttataaagaaaatatcactctaaaggaagcagcagcaaaacttcaactgctcactgaggaagagtttgaaaggatagtgaaaccagaagaaatggtaaattatttgtaa

SEQ ID NO: 29147 - protein, 464 aa, Wolbachia pipientis wMel
MDRKTRIESDSLGEVKVPSEHYWGAQTQRSLENFKIGTEKMPEPLIKALAIVKLAAARVNMKHGVIDDRVGDAICTAAREVIDGKFNNEFPLVVWQTGSGTQTNMNMNEVISNRAIEILGGNLGSKSPIHPNDHVNYGQSSNDTFPTAMHIAAAEQINCLLIPNLEKLHKVLDNKVQEFKDIIKVGRTHLQDATPLTLGQEFSGYAAQIKKGIERVKSTLSGIYELAQGGTAVGTGLNTKKGFAEDFAKQVAGITNLPFTSAGNKFEALAANDALVELSGTLNTVAVSLMKIANDIRLLGSGPRCGIGEIMLPENEPGSSIMPGKVNPTQCEAVTMVCTQVMGNHVAVTISGSNGHFELNVFKPVIIYNVLQSIRLLADASLNFTEKCVVGIKANEERIKDLLNQSLMLVTILNTHIGYDNAAKIAKLAYKENITLKEAAAKLQLLTEEEFERIVKPEEMVNYL

SEQ ID NO: 29148 - DNA, 1413 bp, Mycobacterium paratuberculosis
  CDS (1)..(1413)
atggccactgacgacggcgacaccgactaccgcatcgagcgcgacaccatgggcgaggtccgggtacccgcaaaagcgttgtggcgcgcgcaaacccagcgcgcggtcgagaacttcccgatctcgggccggggcctggaacgcacccagatccgcgccctgggcctgctgaagggcgcctgcgcgcaggtcaacaaggatctggggctgctggcgccggagaaggccgacgcgatcatcgccgcggccgccgagatcgccgacggtcgccacgacgaccagtttcccatcgacgtcttccagaccggctcgggcaccagctcgaacatgaacaccaacgaggtgatcgcgtccatcgcggccgccaacggggtgaccgtgcatcctaacgacgacgtcaacatgtcgcagtcgtcgaacgacaccttccccaccgcaacccacatcgcggccacggaagccgcagtgcgccatctgattccggcgctgcaggtgctgcacgacgccctggcgagcaaggcccgcgagtggcacaccgtggtcaagtcgggccgcacccacctgatggacgccgtgccggtgacactcggccaggagttcagcggctacgcccgccagatcgaggccggcatcgaacgggtgcgggccacgctgccccggctgggtgagctggcgatcggcgggaccgcggtgggcaccggcctcaacgctcccgacggcttcggcgccaaggtggtcgagacgctgatcgcctccaccggattgagcgaattgcgcacggcgacaaactcgttcgaggcccaggcggcgcgcgacgggctggtcgaggcctccggcgcgctgcgcaccatcgcggtgtcgctgaccaagatcgccaacgacatccgctggatgggctcggggccgctgaccggcctggccgagatcgcccttcccgatctgcagccgggcagctcgatcatgccgggcaaggttaatccggttatccccgaagcggttacgcaggtcgccgcgcaggtgatcggcaacgacgcggcggtggccgtcggcggcttgtcgggcgccttcgagctcaacgtgtacatcccgatgatggcccgcaacatcctggagtcgttcaagctgctgaccaacgtgtcgaggctgttcgccgagcgctgcatcagcgggctgagcgccaacgtggagcacctgcgcgagctcgccgaatcctcaccgtccatcgtgacgccgctgaactcggcgatcggctacgaggaggcggcggcggtggccaagcaggcgctcaaggagcgcaagacgattcggcagaccgtcatcgaccgcgggctgatcggcgacaagctgtcgctcgaggagctcgaccgccggctcgacgtgctggccatggccaaggtcaagccgcaggactga

SEQ ID NO: 29149 - protein, 470 aa, Mycobacterium paratuberculosis
MATDDGDTDYRIERDTMGEVRVPAKALWRAQTQRAVENFPISGRGLERTQIRALGLLKGACAQVNKDLGLLAPEKADAIIAAAAEIADGRHDDQFPIDVFQTGSGTSSNMNTNEVIASIAAANGVTVHPNDDVNMSQSSNDTFPTATHIAATEAAVRHLIPALQVLHDALASKAREWHTVVKSGRTHLMDAVPVTLGQEFSGYARQIEAGIERVRATLPRLGELAIGGTAVGTGLNAPDGFGAKVVETLIASTGLSELRTATNSFEAQAARDGLVEASGALRTIAVSLTKIANDIRWMGSGPLTGLAEIALPDLQPGSSIMPGKVNPVIPEAVTQVAAQVIGNDAAVAVGGLSGAFELNVYIPMMARNILESFKLLTNVSRLFAERCISGLSANVEHLRELAESSPSIVTPLNSAIGYEEAAAVAKQALKERKTIRQTVIDRGLIGDKLSLEELDRRLDVLAMAKVKPQD

SEQ ID NO: 29150 - DNA, 1407 bp, Lactobacillus johnsonii
  CDS (1)..(1407)
atggtgaaaaaaggttatcgtgttgaaagtgatacattaggcccagtagaaattcctaaaaaggcattgtggggtccacaaacacaaagaagtaaggataatttccatactggagcgttaatgccaattggtattattcgtgcgcttcttcaaataaagctagctgctgctcaagctaatattgaagcaggaactgaaacagaagaaaaaggacgtgccattattgaagcaattcatcaactacttgatttaaacaatgaagaattgcaaccatattttccattgcatgtctatcaaactggatcaggtacccaaactaatatgaatgttaatgaagtggtggctaatcttgctaataaaaatcatcccggtttagatattttacctaatgatgatgtgaacatgggacaatcatcaaatgatacttttccaactgcaatgaatttagttgcaacacaagcgttagatgacttaaaaccttctattaaacacttgattaaagaactaaaagtgaaacaagatgagtattggacaacggttaaagtaggaagaacccacttgcaagatgcggttccattgacttttggtcaggaactatcaggctatatttctgctcttaatcatgatttatcctacattaacgagttagaagaaacactttatgaattaccaattggaggaactgcggttggcactggacttaatgcagctcctggtatggcagaagatatcgctgagcgtttatcaagaaagtatggacataattttaaagttgatacaaataaattctttggtttagcaaatcactcaggcttaaatgttgtgcatggcgctttaaaagctttggcagctgatatgttcaaaattgctcaagatattcgtttcttaggatctggcccaagagctggtttaggagaacttaatttacctgcaaacgaacctggttcatcaattatgccaggtaaagtaaatccgactcaagcagaagctgttaccatggcatgtttgagagtctttggaaatgatacaactattactatggctgcatctcaaggaaactttgaaatgaatgtctttaagccagtgatgattgcagcatttttagagtctgccaatgttttatctggaactatttctggctttgcagataagatgattcatggtatgactgttaataaagaaagaatggctaaggatgtagcaaattcattaatgacagttactgcactttcaccacatattggttaccatgaagctgctactattgcacagactgcagctaaaaataatacgactttgcgtacagcggctttaaagagcggcttagttactaaagaacaatatgataagtggatgaaaccaattaccatgactaatgcaatgaatactaagccaattgatgattag

SEQ ID NO: 29151 - protein, 468 aa, Lactobacillus johnsonii
MVKKGYRVESDTLGPVEIPKKALWGPQTQRSKDNFHTGALMPIGIIRALLQIKLAAAQANIEAGTETEEKGRAIIEAIHQLLDLNNEELQPYFPLHVYQTGSGTQTNMNVNEVVANLANKNHPGLDILPNDDVNMGQSSNDTFPTAMNLVATQALDDLKPSIKHLIKELKVKQDEYWTTVKVGRTHLQDAVPLTFGQELSGYISALNHDLSYINELEETLYELPIGGTAVGTGLNAAPGMAEDIAERLSRKYGHNFKVDTNKFFGLANHSGLNVVHGALKALAADMFKIAQDIRFLGSGPRAGLGELNLPANEPGSSIMPGKVNPTQAEAVTMACLRVFGNDTTITMAASQGNFEMNVFKPVMIAAFLESANVLSGTISGFADKMIHGMTVNKERMAKDVANSLMTVTALSPHIGYHEAATIAQTAAKNNTTLRTAALKSGLVTKEQYDKWMKPITMTNAMNTKPIDD
